United States Patent 7,834,146 (RECOMBINANT POLYPEPTIDES ASSOCIATED WITH PLANTS) - sequence listing, part 6

SEQ ID NO: 16405 - DNA, 428 bp, Sorghum bicolor
  unsure (1)..(428): unsure at all n locations
  Clone ID: LIB3481-002-Q6-K1-F12
gtcgaccccgcgtccgcccacgcgtccgcccacgcgtcctcaagatacagtgcaaacaactgaaagtggatatggccgcactgatccaacaaagcagcagcaagagcagctcccacatcagaagaacctcctcatccactcagctctagctcagccctcagcactgcatgccctgctgggtccttgcattgggcgcgggcgtgccaatctcatggcagatagatcaagatgtaccacaaccaaattacaattctagtactagaaaatatattatgtgtgtattctacactagtagtaccaattaaggatcgtaattcgtaagcaaacctttgacctncgacgatcctgctggtaagtactaatgcttgcgctctgcaactcctaatagtactatagctggctattcctaggtgcaatagaataggagg

SEQ ID NO: 16406 - DNA, 383 bp, Sorghum bicolor
  unsure (1)..(383): unsure at all n locations
  Clone ID: LIB3481-002-Q6-K1-F9
cgtccgggagaaagtcatgcacattttattgccaagtcccttttcgaggagtatcttatggtggaagaacttttcagtgatggaattcagtctgacgttattgaaaccttgcgtcatcagcacagtaaagacctgcagaaggttgtagacattgtgttgtctcaccagggtgtgagaaacaaagctaagcttgtaacagcactcatggaaaagctggtttatccaaatccggttgcttacagggatctgttggttcgcttttcttccctcaatcataaaagatattataagttggcccttaaagcaagggaacttcttgaacaaaccaaactaantgaactncgtgcaagccttgcaagaagcctttcanatctggggatgca

SEQ ID NO: 16407 - DNA, 172 bp, Sorghum bicolor
  Clone ID: LIB3481-002-Q6-K1-H8
tgcgtccgctgttttttgctgaccacagcgagggggggggtgatataaggaatcacgatgagaaccgccatgtgtaccttgttagtggagattaagggagagagatgcagaataggagtcatatttccatacagagacgctgtaagattgtgcgcatcatctcatatacaca

SEQ ID NO: 16408 - DNA, 353 bp, Sorghum bicolor
  unsure (1)..(353): unsure at all n locations
  Clone ID: LIB3481-003-Q6-K1-A10
gcgtccgcggactcgtgggcggacgcgtgnggtagtgggtgccccacacctaactcttaccacttgtgatggatagcaagatcaacaaaattgaggagatctatctccactccctgcccgtcaaggatccccagatcattttagacccttttcccggggcttaaggattattttataaagagggggggggggggtaaacccttatcccccctttctttacacccttttctatttctttttcttttctttcttttttatcttttatttttttttttctttttttttctttttttttttttttttttttttttttcttttttttttatctttctttttttttttttttttttttt

SEQ ID NO: 16409 - DNA, 477 bp, Sorghum bicolor
  Clone ID: LIB3481-003-Q6-K1-A9
cgtccgaggaagcttacttaagacgcatgtgagacatgtgtggcagcagatggaattgtgattaacatggtcgttggtggcgaggtggctacactcaaggctttagaagagaacagtggtctgctcattgccgagatgccaatacatgtttcagagatattatgagagtcccaatcgtacaaaatttgagaagttactgttctatttccacactaactactgatggttttacttctgctactttgattttggattgcttttcatgatacagattgttcctcaaattagatctctaaagaattagaataatgctcattgtttttttctctctctgaaatgatagaaataggagtggttcaacatccagtgacatgattcattactctgtgcatcgtatctatacttactgttagttcttacgagattggtgacagagtcacaaagaaatattcaattgccacagaaatattgctaaaa

SEQ ID NO: 16410 - DNA, 455 bp, Sorghum bicolor
  Clone ID: LIB3481-003-Q6-K1-B2
acgcgtccgccgactccgtcggggttgacctcgcggagccggccgagtcggagcaggaggaggaggaggcgttcgccacggaggaggatgagggggcggaggacgatgccgtagaggcctctgccgccgtcgaggacgaggaggtcggggagtatgtcgagccgcccgaggaggccaaggtctacgtcggcaacctaccctatgacgtcgacagcgagcgcctcgcgcagctcttcgagcaggccggcgtcgtcgaggtcgcagaggtcatttacaacagagaaacagacagaagtcgcggatttgggtttgtcactatgagcactgtcgaggaggctgacaaggctgtggagatgttgcatcgctatgatgtcaatggaaggcttctgactgtaaataaagcagctcctagaggctctcgtgtggacagacctcccagacatctgggccttctc

SEQ ID NO: 16411 - DNA, 235 bp, Sorghum bicolor
  Clone ID: LIB3481-003-Q6-K1-C6
cggagttagtgaatagaggtgttgcctaataagttgggccactttggtcaaaccacggaccagccgcatcggcaagttgctagcccttgggtcagaaaatcatgatggtgaaaaatgggcaaagcacaggagaatccttaatcctgcctctcactactacaaaacaaagtctgggccgccagcattatctaccctccgtattgcaactattattggattttagaattcagttcct

SEQ ID NO: 16412 - DNA, 381 bp, Sorghum bicolor
  unsure (1)..(381): unsure at all n locations
  Clone ID: LIB3481-003-Q6-K1-D2
cgtccggtaattcacatgtctttgtgctgtatatatctcaagttttgtccccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgggccgataaaaaaaaaaaaaggtaanaaacgggggaatggaagggaaaattttttaaaaaggggaaccaaaaataaatttgttggccaccttttaaaaacgggggaactggaaaaaccttggggtaaccaaaataaataccatggcgccaaatcccctttttcccaaatggggaaaaaccaaaaaggcccgccattatcccctttc

SEQ ID NO: 16413 - DNA, 421 bp, Sorghum bicolor
  Clone ID: LIB3481-003-Q6-K1-D7
cgtccggttattttttgatattttaccattggccatgtaaatacatggcatggaatatcacacgatggtgtgcagtaagtggttataaaaataagctcttgatctgggggacagttctagtgctgacacccgttcagggaaaaataaaatgctgatataacactgaagctccagttatttactccgcctatttttactatcttcttgtcatcttccttgcccttacattgtttcaaaatgttcatattatttaatccatgtttagggaaagaagtggactctgtcattctcattggtctggaataccctggtgtggctcatggttgtaaacttcattatccagatagttacttctacagcacagggttatctcaggacacaacaggagccagagatcagtaaaaagttggagaccgaactt

SEQ ID NO: 16414 - DNA, 201 bp, Sorghum bicolor
  Clone ID: LIB3481-003-Q6-K1-E1
ccggtcgaccacgcgtccggagatctccggaggggctagctgtacaaggatgggaaatatgaggaggcattggagaatgttacagtcagcctgggatcgaatacctggagtcatgaggcttcattgccagctcaatgttgcctgaactactcaaaactaggacatgaagaagctggtctatatgaactgaaggaaacccta

SEQ ID NO: 16415 - DNA, 429 bp, Sorghum bicolor
  Clone ID: LIB3481-003-Q6-K1-E8
cgtccgacgagtgatacggtgatacctttggacactagtggcgtttcagtgtttgtatgatactttcagagtacaataatacaattgttcacattaatgctaatgtttccctaaagaagcaatgctgttgccattatagtgcaataaacattatatccttgttgagagtttagctggtatgcaaatgcaagtgtaggattttaattattcaaattgatcagggatgggaattactttatatgatctcaaattagttcatgaattctggggaaatgtcaaatttgtccttatcggaattattctctattttaccatttaagaatgtctcaaccttctaggtttttttttccaatttactgcattaaattgcaatgtatatgtgctatggttaatccagtcttgggtctggaagttgtcttgatttgctat

SEQ ID NO: 16416 - DNA, 114 bp, Sorghum bicolor
  Clone ID: LIB3481-003-Q6-K1-F12
cgtccgcttattatccccacccattgtcgtgcataggaaattgctagcacatgatatgagatttgtgtatgcggcaatttactagaccatatgtgcgtgatgaagctcaaccta

SEQ ID NO: 16417 - DNA, 339 bp, Sorghum bicolor
  Clone ID: LIB3481-003-Q6-K1-F3
cgtccgcggagcctcgtggatcttggtgagaggaggtatggtgccctgccagtgctcgatcagcaaatcggacagctgaacttgaggctattgttgtacacaccaccacctgcactggatgaatcaattgcaatttctaaagctattcaattactgggaagcacaagaatacatcttgtttagccgtattgtattggacactgcctctacagtccttatactgaatgaaattacgattggcattatttcatgtcagtcttcactgacagcatctgtaactataagggacctctcacatttttactaaactattggtatttattagttatgcgagggaac

SEQ ID NO: 16418 - DNA, 118 bp, Sorghum bicolor
  Clone ID: LIB3481-003-Q6-K1-F7
cgtccgggcaagcacatcagagaaaggcgtctgggtcatgtctttgcaatacgatgagagcctgctttacacaagactgagtgaggtgaggctgcaccaccgtaccttccatatcaag

SEQ ID NO: 16419 - DNA, 420 bp, Sorghum bicolor
  unsure (1)..(420): unsure at all n locations
  Clone ID: LIB3481-004-Q6-K1-A10
cgtccgagcagattttgttgtttgggcctttggctnanctgcgccgagtcgtcattgatgatgctaaaatgctgaggacatactgtctgacacgaacatcctatttttttaacccgtcatccggcccctatcagctgatgaaatttccccccgatggtgaccctcgataatgcagtctggcgggtgctcggggccactgaatcgctttgttttattgtctagtcccgttctgtactagcataaatctataatccccatacgcaaacactcacgcatgtttgttgagtgtttcccccattatttagctcttagtttgatgagtccagaggaatcaggtaagctgtcgaaatcggaccgattcgatctcaggataatgatgcatttatgcctggaaaaaaaaaaaaaaaaccaaccacccca

SEQ ID NO: 16420 - DNA, 429 bp, Sorghum bicolor
  Clone ID: LIB3481-004-Q6-K1-A11
cgtccgattagatgaagattttataccctacacagatggggtatctcgatctcttttacatgcgcatatatgtaactgtgtctgaatgaaacacatctattattgattcttttccatgctcatatagtgcacctgcacaaagtatttatttgagctctgactgatggaaacagaccatgattcatacatgcggggggagggtatagaagactggagcacgagaaactcatacggagagcataccaactgattgcataaaaatagggactgttaatttacgatgatagataaacatactgtctatccgaaggaggaggaactgacagaagctgcctgtgttgatttctttgagctggaataaaaggatggaactaccctactgaatgtaaatacttgatcattttgcgatactttctgcataatagttgg

SEQ ID NO: 16421 - DNA, 429 bp, Sorghum bicolor
  unsure (1)..(429): unsure at all n locations
  Clone ID: LIB3481-004-Q6-K1-A12
cgtccgggccgagctcgaagaagttgcccacgaggccggagcagccgggaccgccctgcagccagaggaggagcggcgtggaagccggcggcgtgaccgggtccgtggcctcgtagaaggcgaagaagagggaggcgttcgcaggcgggatcgggaggtacccggacttggtcgggagcgctgggggtggggaacaccgttgctgctgtcgccgccgccgcgggtgcagccaagagtgggacggcggcagcgaggacgacgagaacgaggcgagcaagcggcggagccatgggactggtggaactgtcaacgtcggtgcgggtaggattgtaggaagggagtctttgactcttttgtatccaacaagaacaaggtgtgcagtgtaggtgtgctcatcgtggaaaataaacaactttccatgannaanaa

SEQ ID NO: 16422 - DNA, 395 bp, Sorghum bicolor
  Clone ID: LIB3481-004-Q6-K1-A2
gtccctccgctgccgcccggcttggtccttctcaccgcggcttgggcgccacccccctacctccaccaccacttttttcgggggtgcctggacctgtggagtgaagcccagggttggcctctaccaacctaaaagcaccccgaccgctcgccgcctggaccgcggaccaatggctggccacctcgagcctcggcgggaaccctaggtcccgctccaggggtggacggcgaggaccggcgtcggcgtcagcggggtggaggcggatgtaacgctcgaccagaccccgatgttgcaatccagaccaatcgccacgatccggccttctctacaatagccccagcagacccagttcttcaccctccgcattgcaaaccagatccgctcccacacatgtc

SEQ ID NO: 16423 - DNA, 387 bp, Sorghum bicolor
  unsure (1)..(387): unsure at all n locations
  Clone ID: LIB3481-004-Q6-K1-B2
cgtccggcgggaggcttgctaagttcgccatccatggctgtgatcttgtcacatcagttgggatcaggaggctagcaacggcgcttcggcccacaatcaaagaagtcagtatcttgcactgccggcttctggacacagcaacatgcctcactgctttaagtccgatccgtgatcgcattgagagtcttgaggtcagctgtgtctggaaggaagttgaacagcctgagagcgtggccaatggcacaaccggatgtgatcatgaagatgatgatctcggtgaagtgacatatgagtctgcatcgaagaaatgtaggtacatggaattggatgatctagtcagctgggagatgctacgttcactcttcctctgggtcccctgntgggagg

SEQ ID NO: 16424 - DNA, 339 bp, Sorghum bicolor
  unsure (1)..(339): unsure at all n locations
  Clone ID: LIB3481-004-Q6-K1-D9
gcctgcggttaccgtccgcactccgggtcgaccagcgtccgcaagaggtcccgagcgagtcgtagaggcgtgcgtgcgtgtgtgtgtgtgtgctagtgctacggcgtacggcgcacagcagcagcggcagccatgagcaccgggcgcgagagcaccaccagcagcaggtggcccgagctggcgaccctgcgggcgctggcgcgcgacgccgcggagcagctgcagctgccgcgcgtcggcatgtcggcgtcggcgggtgcggcgggcgggagggagccgncnaagcggcagccggcgggggggcgcggcgggcgagaccgggaggaccacgnccacggc

SEQ ID NO: 16425 - DNA, 169 bp, Sorghum bicolor
  Clone ID: LIB3481-004-Q6-K1-E4
gccgcgtaccgtccgcatcccggtcgccccgcgtccggcgggtcgctcgccgtcacgaaatccaccctctcccccgggcttcactccggccatgcttccgggcgaccagaaagattccaatgggaggagggggacatcgacacacgacgccacagcgcagaaacatact

SEQ ID NO: 16426 - DNA, 389 bp, Sorghum bicolor
  unsure (1)..(389): unsure at all n locations
  Clone ID: LIB3481-004-Q6-K1-H3
cgtccggtgcaagcggcacccggagcaccggatgtccaagggcgtctgcccgtactgcctccgggaccgcctcgcgcacctttccgcctcttcctcggcgaccaccactacgcgggcctcgtccacagcgaccacgtccctgtgctcctccggcggctcgtccccgccgccgcaccacgccgcgttctccgcggacgtcagctccgtccacgtcgtcggcgccggctcctccttcgccgacgtctccgccttctcgcagccgctgatgccgacctccgctaataagaagaagccgccgccgccgccgncgacgacgacgacgacggggaggcaagacgacgaggcggcggcgcaaccggcgagggggaagggcgaggngaanaggaaga

SEQ ID NO: 16427 - DNA, 508 bp, Sorghum bicolor
  Clone ID: LIB3481-005-Q6-K1-A1
cgtccggtaggtggtgtgcaccggcgtgcgaggacgatgtacgacacgtacatgattgatgagaaggagcacaagcgcaagcagcacctttgctgaggtcggcgtcatcgacgacggcgcctttgaactgtacgagaagcacgaggcgaagaatgaccaggtatgcacgcgcaccgtcacaagatcgaggtggagatcgcggtggaggcggtcgtgggatccggcggtttgaacttccacgagcaccacgagaagaagattgaccacagggaggccgaggaggtctgtggtgagaagaagcaccacttattggggtgatttttcccagtgacaacgtgcgtgcacgtacggccatatgtatgtgatatgtgcgtgtatatgtactgttgaacacggatatgtatctacgcgtgcttgtgatgagagtgagatcgatagatcgatatgtgggtctgtgcgcgagatctgcgtcatgtgtatgcgtgatgaataagtggctactatatat

SEQ ID NO: 16428 - DNA, 288 bp, Sorghum bicolor
  Clone ID: LIB3481-005-Q6-K1-C3
cgtccgaatggggtctcgtgccggaggaaaataatcaggtatgagctatgatggtaagaaaatggtggaagtttgagagtggatcttgatatgatataggatgtgttatttacggtttgagatgaacagtattcttaaagttgatggtgtttaataagcacacgggtgtgctattgacagaatttgtgtatggaaggaaggacaaaaggtggcgggcataataaaataataaggaagagctgttatgagggtgaggtcccgctaattaaaaaaagaaagaaaattttt

SEQ ID NO: 16429 - DNA, 370 bp, Sorghum bicolor
  Clone ID: LIB3481-005-Q6-K1-D5
cgtccggactgctatacacgacacaggagctatactacctgatgtgctgtgatctgatcgacatggccgcctgcaccatggctctaagctgccgcgcgctcgggatctagcctgtgaccaccatcacctgggacgtcttctgagatggccgcatcaccatgcgcatgattgctgccaagcgcaagccagcgtcgtccggaagccactgatgcggggccgaccgcgtgctgtacctgagtccgttcttcggagagcccccatgctacactgaccggagagctccgagagtactacggctgcgacactgacgggctgactgaggaccgcgagaccttctactataacctggagctggatgtgatccactgac

SEQ ID NO: 16430 - DNA, 249 bp, Sorghum bicolor
  unsure (1)..(249): unsure at all n locations
  Clone ID: LIB3481-005-Q6-K1-F1
cgcgtccgggagagcagcggtgcagcagcggcgggggagcctagtactacgtcgagctttgccagggcgtcaacgatgatgagttctcgcgcggcgtcggcgtcggcgtcggcggcggcggtggccgtaggcgaacatcgccgtcagcacgccacggtggggtacggtgggctgccgcggcccatcaggcctgttctgggcgcggcgggcccacggcctgggacgccgaggccggggggncctgctcct

SEQ ID NO: 16431 - DNA, 156 bp, Sorghum bicolor
  Clone ID: LIB3481-005-Q6-K1-F5
cgggtcgaccacgcgtccggtcgatccaggtgataaaatagaagcctgcaccttgactccaagcctaggattcaggatggcgatgaacaggaaaaatatcacctgactgagtatgagaggtcactaaaaccagagaaggtagatgatctatcagag

SEQ ID NO: 16432 - DNA, 480 bp, Sorghum bicolor
  Clone ID: LIB3481-005-Q6-K1-H1
tgctgtccgagtgactgatgttgtcgggggacctcgagcaccaccaccggggcggcggcggtctcgacgatggcgtccttcaggcgccggaacggctactcgggctacctcaagtccatggcggcggcctcgtcgtcgtcgtcgtcgggcggatttgacgggctcatgaacaccgtcatcaagaagaagctcggcatcatcccaaaggatctcaattggggcgaccagtcagacgacgtgttcgtagctctggagggagacttcatgaagcccaggatagaggaggtcgaccggctcctcaagctcggcgtcaatgtcaccatctacaacggacagctggacctcatctgcgcgaccaaaggtacgatggactgggttcacaagcttaagtgggacggcctcaacagcttcctgagcgctcccagaacgcccatctactgcgacaatgaagggcagtctggcacccgcacccaagccttt

SEQ ID NO: 16433 - DNA, 386 bp, Sorghum bicolor
  Clone ID: LIB3481-005-Q6-K1-H2
cgtccggcacacacgcctgttctggcgtagcaacacgagcctataagtgccagatgtgtcgatggcaggactcacaaggccaatgagagcggactgcacactggaaacatctataaggacagccacgaggtggcacacatgaccgtcaactacaacaggtcatgatgtcgccaaagtacatcttccattagcctggctgaggtgttcctcacacatgacccctttgagagctctctccagatagaaaacgggccaactgcctaagcttgctacacagaacgccccctaaactaggtctaacttgaaggtggacatttgttgagaacatggtggagagactttatcagttgctttcttcaacaaggttgagctggattacgtttctt

SEQ ID NO: 16434 - DNA, 157 bp, Sorghum bicolor
  Clone ID: LIB3481-005-Q6-K1-H5
ctgcggtccgtccgcatcctgtcgccacgcgtccgcctcctggttcgtcccctcccatcccatgcatccgcccatcacacacttctcgcggagcgccagcacccacctggtagccctccacccgccgcgtctccccacccttggcgccttcacattc

SEQ ID NO: 16435 - DNA, 364 bp, Sorghum bicolor
  Clone ID: LIB3481-006-Q6-K1-A1
cgtccgccccgcgtccgcccacgcgtccgttggattcggcggcgtctttctgctgcaccacaggtctggctgatatgatttagcaagaacagggtgttacttgatcattaaaacgtgattggtcttgctggatgctactatggataatagcgtaaactagtgatgctgttagttactggactttaggcatctagggtgcgtaactcaatccgtttacctagcaccacaaggcttgtattgctcttccacaaacttgttttgatggtttaggctggtctcatttcgctcgccgatactacgggaatgggttttggtttctttttgtctggatactaagatgttttacttggccaggttttctctt

SEQ ID NO: 16436 - DNA, 259 bp, Sorghum bicolor
  unsure (1)..(259): unsure at all n locations
  Clone ID: LIB3481-006-Q6-K1-A2
cgtccgcttggcagtactactttgatagtcttctaccaagattcctctcccagtaactcgtcagatacagccaatcttgtgaagatgatattgcccacttaactatcatgactacctgaacactcaagtcaatgattgacaagcaattggggattggaatatggaagttttaaaggcatgtgagggtcttggccctctaagtgccnagcctgaggtaatgacaacagatctgattgaaaaggacaaattnctgatcatg

SEQ ID NO: 16437 - DNA, 330 bp, Sorghum bicolor
  Clone ID: LIB3481-006-Q6-K1-A3
cgtccgcaccgccgtcgcggcgctcctcaggaatgggcagcagcgcgcgtcgtcgacgtccttcctcggcggcaagacgctgctgaggcaggccaccgaggcggaccgatcgactgtcgggcggcttttttagaggtatacatgtttacctctggttgctttcaacttttttttttttttttggtgtgacttaatttaatttgactgggggttagtttataaacgttttggatggtaaaaccctgcttttcccaattttattgtacttttatataattccctttttgccagttggtttaataggaaaaatatcttctcttttcttttttt

SEQ ID NO: 16438 - DNA, 275 bp, Sorghum bicolor
  Clone ID: LIB3481-006-Q6-K1-A4
ggtcgacacacgcgtccgtgaggctatggcgatactatcattgcatttctagtcatccatcagggaaagatgatttgctgtttatctatggtagaaagatgcgcattcttgcagacgacctcgagattccatcatgatggttgtatagtgcgcggctggctcggcagttctcgatgaatactatgacagcttgcatgccgtcggagggtagccgcactgtgctagacccagtcgctttctaaaatctgggaagtgctttggatcaggaatcctat

SEQ ID NO: 16439 - DNA, 136 bp, Sorghum bicolor
  Clone ID: LIB3481-006-Q6-K1-B6
gtcgaccacgcgtccgctagccactcgagtgctcaacaagagagagagctagctagctagcccagcatcatcaatggcggcctcctcgaccctcttggtgctcctcgcagcagccttggtggccggcgccagcgcc

SEQ ID NO: 16440 - DNA, 264 bp, Sorghum bicolor
  Clone ID: LIB3481-006-Q6-K1-E1
ctgctctcgctcacaaagcatacaacaaaaaaaacaaaaaaaaagaaaaaaaaaaaaaaaaaataatgggccatcatttaacacttccacggcttgcaaatgcccaacccttacccttcttaatcgccttcgatggcacccaaattcccccagctggcctggttaaacaaacggcctgaccggataaacccacagacctgctccacttagcgggacttgcaatcgttaagcgcctgtgggagggggcataaagccccgaaaggc

SEQ ID NO: 16441 - DNA, 273 bp, Sorghum bicolor
  Clone ID: LIB3481-006-Q6-K1-E6
cccgggcgaacccacccgtccgaggtcttttcctaaggtttatacctggcggggagttccttattgtgtgtataccaagacacctttattactgggtgtcacagtgttatacacacaccacgcggagaaagagatctgggggccgatataagaggggtcttatatctctgttgatagtgatgatgtggagtaatcctttcgtgaggaagaggggaggaagcaagaaagcatgctcgtctgttctttttgctagcaaggacgggcgtttcttga

SEQ ID NO: 16442 - DNA, 175 bp, Sorghum bicolor
  unsure (1)..(175): unsure at all n locations
  Clone ID: LIB3481-006-Q6-K1-E7
cgtccgtctagttgtactacacgcttatacgagcaacgaagggaggactaccaccagcaccagaccggcgaggctgagctcgtcgccgtgctcctgtgccacacctagcaggtgtgcatgctcgtatcgcgggctccgagtacgaaggaggtgttacagttgtacatnnttattt

SEQ ID NO: 16443 - DNA, 309 bp, Sorghum bicolor
  Clone ID: LIB3481-006-Q6-K1-E8
cctccgtccttttccaaaattccttgcgggggcggctggtccaagtatttcatgggggcctccggaagaaggagagtttttatcctcctagcacgagccgaaaaacatatcagggctgggggaccatcgcaggtggggtaatttgtgctcaagaagctggagggcacacatgtcactggagaggggaaccttgggatttcgctgctgaccaaacagggcgcataatcatctatccttggggtggtgttctggctaccaactgtgctcttgatgaccagcttgtataaatgatcacagcttcttataatt

SEQ ID NO: 16444 - DNA, 184 bp, Sorghum bicolor
  Clone ID: LIB3481-006-Q6-K1-F5
cgtccgatccggtcgacagcgtcgaatcaatgttatgctacggacttgtggagccatagattcctagccctttagtgtcacttatgcataggcataggtcttggacagtaatgtgaaagcatggtagaagagataagtgtgaacttgcagtgtagttctgagattggtgggggggtgagtttct

SEQ ID NO: 16445 - DNA, 202 bp, Sorghum bicolor
  unsure (1)..(202): unsure at all n locations
  Clone ID: LIB3481-006-Q6-K1-G4
cgtccgaatcccggtcgccccgcgtccggctggacgagctcatggcagaccatcggctgtgagtgcaacggcggacagcaaagctgagatgccggggagagggcgagacgaggagagaggaaatcctctcgcaccggagacgacgctgctggacatgatgccgancanatgaggccanaggagatgacganctggaatcctg

SEQ ID NO: 16446 - DNA, 238 bp, Sorghum bicolor
  unsure (1)..(238): unsure at all n locations
  Clone ID: LIB3481-006-Q6-K1-G6
gcgtccgcagtagtgtgtgtgtgtgtgtgtattctacacgcctacaccttcaatgcacatgtgtgcctgatggctggaagatattatatataacttcggatgcttagcagccggccaggcaagcaaagacacatgtctgcttttcagtagtcaggctgtggttgcaggtgataggtggagacaggtgagaggtggagacaaggtacatgcggngactagtgaataacgaggataggat

SEQ ID NO: 16447 - DNA, 416 bp, Sorghum bicolor
  unsure (1)..(416): unsure at all n locations
  Clone ID: LIB3481-006-Q6-K1-H1
ccgtccgccagactacgtgacctcactaaggaggtggcagcagcagttgtgagggaggcagtagcagaggatctagctgagggataccgtgacatggatgcacatgagcttgcacgactcagtgaggaagagactattgaatatgtcaagacgaacatgtggagtcctgtctatccaacaataatatacaagaaggactagatagctctatttgctattttgcatattttcagtgatcatgtatgatatactttaggttgcgttctggaaggtactccagaagtgtaggtacgttagttataagcaagcagctttcattgttcgttgacctcacttttaattgaatntaggacacgaggcccttttgggccaataatataggccacagttcctgacgtactccatcgtgctgaaca

SEQ ID NO: 16448 - DNA, 461 bp, Sorghum bicolor
  unsure (1)..(461): unsure at all n locations
  Clone ID: LIB3481-006-Q6-K1-H2
cctgcgttaccgtccgcattcccggtcgcccagcgtnccttgctgcaattgataagtttgatgccatgttgtcgagaagcaacacttatgctccagaagctctctacagatggggcactgcactgcagcagcggtcctatctgcggcctcggaacagcagggataaggtgaggcttctggagcaggcgaagagcttgttcgaagatgtgctatatgtggaagcagacaacaagatggtgagggaggcgctgtcatcgtgcatatcagagcttaactaccatggccgatggttatagacagtttgttttggcggagcagctgcgggcctatatgagctacctatcaggaatcatgattgccggatgaatcaatataagcagctaggatgtgatttacaggacagtagtttnctctgcctcttctgcttggagcaactcaagcgaggagagaaacataagctc

SEQ ID NO: 16449 - DNA, 397 bp, Sorghum bicolor
  unsure (1)..(397): unsure at all n locations
  Clone ID: LIB3481-006-Q6-K1-H5
ccgggtcgaccacgcgtccgggaggtgccccctcaggatttctctaagcgtgttttggaagggttccaagtcaccccaatctggcaccagggtttcatacgtgatgatggaaggtcaaagtacgtgccaaatgtccaaacagctcgctgggagtacagcactcgtccagtttatgggtggggtgatgtcaaatctaagcagttgtccacagctggttggcttgcagcttttcctttctttgaacctcattggcaaatatgcatggctggtggcttgtccacaggatggatagaatgggatggagaaaggtttgagtttgaaaatgctccatcttactcataaaagaactggggtggaggttttccaagaaaggggtattgngtgcttctgttgaagt

SEQ ID NO: 16450 - DNA, 416 bp, Sorghum bicolor
  unsure (1)..(416): unsure at all n locations
  Clone ID: LIB3481-006-Q6-K1-H6
cgccgcgtaccgtccgaatcccggtcgccccgcgtccgacgtcatacacntatggcactagtgtccgctctgtcctcacatgtagttgtgggtcccagtaatggcttatgcgggcgctagtgtttccccggccggaccgacgtcgctcgctgtgcacggcgcttgctgtgcgtcgcgttgttctgcgggggagggaggaggggacctaccttcctggtctcggagatggcgggccgcggcgagggcccggccgatacactactataagctctcctatcggcaagcgggttggaaaagtgctccttttacggtctaaatngtctttacatagcttatacacattggattgattaaaataaacagtgacttgtggtagcctaagtacaattggatctgctggcaaaactttcaactat

SEQ ID NO: 16451 - DNA, 196 bp, Sorghum bicolor
  Clone ID: LIB3481-007-Q6-K1-A4
acatcgacgccggaggctatggtgactatgccatgctagtagaacgttcattactccagacaaactcacagattgaagatagccttgaagattaagtggagtgccaagcttatgacaatggctttagcccagcttgaaacacgctgggggatgggcgcgcgatactgtcgccatgcgtgttttttgtctggtgtgt

SEQ ID NO: 16452 - DNA, 531 bp, Sorghum bicolor
  Clone ID: LIB3481-007-Q6-K1-A7
ggccgcccttctttttttttttgttcactttattcagcacacgcggagcgctgatgcagctccattatttgggacccatattacaaagagatgggatcaagtgatgccatgacctgtgacacaaaggcgggatccaaaggggagatggacagaggtgactgctaaagatgaggacttgagatacggcactgcattattgcatgtaagctatggatccaggctctatacacaacactgatacacactgatgacataaactgatggagtacacggagggggaccaccagggagcgcccttatgcatggaccttgtgcgcccatcttgggctcccatgctgctatgatgggttactctggtggattaatttacggataaaattaacgtttgagaagagccttactgtaggcatggactctgggatcgttcagtgggagctatgctctattgaaatgcgctagtgcaagatgtatggggcagggcttagatgtaggggttagatctatccgcccgtgcgatctggccgatggata

SEQ ID NO: 16453 - DNA, 188 bp, Sorghum bicolor
  unsure (1)..(188): unsure at all n locations
  Clone ID: LIB3481-007-Q6-K1-A9
cgtccgatgatgatgtgcgtggaggcgcgcggggggcgtgggcacgacaaaatccacaccaatgtcagtaacatttgctgctatatgaactgcgcaatggaagaatatgttctcgataagatggcanagaaggccacagaaatttgggacataatatgacatggtggttttttttttgaggggggggg

SEQ ID NO: 16454 - DNA, 180 bp, Sorghum bicolor
  Clone ID: LIB3481-007-Q6-K1-B3
cgtccgtttttttttttttttttttttttttttttttttttttattttttttaaatagctaggggtcgtttgagggggaccaagatgactcacgcgtacatgccacggcatacgaggtgaggcgtgcgaggaaaatgcagaaaaaggggcgcgggtgcacaacgtgtagcaggaggaagc

SEQ ID NO: 16455 - DNA, 384 bp, Sorghum bicolor
  Clone ID: LIB3481-007-Q6-K1-C5
cgtccgcgccatggtgggcttcatgtacgcgctcagcctgtcgaggcgtaacggcgatgggggtctcctatagcaggccgtgaacggatccggtctgacctgcttcgcggccacgggacgacgagctctccgttgcgactatcgtgccgttgctaaagggggacagcgccgaggacaggagcgacgccagcatgagcgccgacaccaagctctggaacggacgcttcgtcatgctcggactcgtcatgctcatcttcactgaatacctcactgatgccctgaacatcaacacctagatctagatgcataccaatgcatgtataatgcggagcaacttctgaagaatatttagaactatactagcacaactgcttatagtgcacg

SEQ ID NO: 16456 - DNA, 400 bp, Sorghum bicolor
  Clone ID: LIB3481-007-Q6-K1-C7
ttgttcactctatgcagaacacgcacgagcccttatgcggttcccttattacgggacccacatgaccaagacatgcgatggagagatgccatggcctgtgaccaaaggcgggatgcacaggggcgacgcccaaaggtgactgctaaagatgcggacctgagacacggcaccgcattattgcatccaagttatgcatgcaagctctatacgcaacactgataccgactgatgacatcgacggatggaatacacggggggggtccaccacggagggcccttgtgcatggcccttgtgcgctcaccttgggcgcacatgctgcaatgacgggctactcgggtggattaattcacggataagaataaccgttgagaagagccttgcggtaggcagggactttgg

SEQ ID NO: 16457 - DNA, 516 bp, Sorghum bicolor
  Clone ID: LIB3481-007-Q6-K1-D3
cgtccgcccatgcgtccgcagcgctccctcaaagagaagaagcgtgattgcgcagctgcagctttgcaaaggcggcagcagatgttgctgactcgtctacctagctcgtcaacagcgcagcagaggcatgcgtgcgccggcaagtcccacctccgcggcgccgccgccgcatgctggaggaagcgtgagaagctccccggcttgagggccgtcaagccgccgcgcgccgctccagggaaaggcggcattgtcccggccagcgacgatgacgacggggtcagcctcggcaccgtgaagctgccgggcaacatcgacatcgctcgcttcgagtccttgctcttccagtgggggaacagcctctgccaaggcgccaacctgccacttccggtgcctctcaaggtggacaaggttgagggcggcatcaggctagggttcatcgcggtggacaacggcgcgacgcagacgctggtctacatcgactgcctggtttctccggcgccggacggctccgggctg

SEQ ID NO: 16458 - DNA, 417 bp, Sorghum bicolor
  unsure (1)..(417): unsure at all n locations
  Clone ID: LIB3481-007-Q6-K1-E5
cgtccgaggcacccgtcgattccgatcgagtgaggcatggacgtcacaaccgccagaccaacatcccaaggtgcgcacgcggcaggaacacgccaccgatcctcacaaccttgcgtacagtctaatgaaagatataattgcaacaagagcatagatgccatctcacgaattggttcgcaacacaaacccgacttatagggcacctttgctagatgcgtatcctagcttacagtaaacttatctgtagaggtacaagtgagangttcatgagtttagaggcaaactctggtacctgctggtgcatggtgcacagcctgggtgataatattccattctcagctaatgctagaagctgctacagtgcgagcacataacacatatgggaaaagtggtcaactgctggtacatagaaacacg

SEQ ID NO: 16459 - DNA, 342 bp, Sorghum bicolor
  Clone ID: LIB3481-007-Q6-K1-E7
cgtccgcccacgcgtccgggcttcaggaaacaagatttcagggtgcaagtcgacggcgccggccgcctcaccgtccgcggccagcgctccgacgccgccaccaaccccaggcactcccgcttcagcaaggtcttccagctgccctccacctccaacctcgacgacatcgccggccgcttcgacgccggagtcctcacgctcaccgtacccaagcgcctgcctgcgtcgcagcagcaggtccgccaggatcaggatcaggcggcggccaagcagcaggaaaaggcaaaggcgccgcccaaggacgacaccgttgccaaggacgaggcggatgcccaccgacag

SEQ ID NO: 16460 - DNA, 507 bp, Sorghum bicolor
  Clone ID: LIB3481-007-Q6-K1-G9
cgtccgcccatgcatgcacatatgcattgacagctatgatgactgctcttatgacaagtgatattagaagtgagatgttgagctgggaggagattttatgagaaagaatgtcttactgctttgcctattgcgaatattgatcagactcttgtgcagacggtggtggaaagggtgcgttctaccatgccacatagcgatcctcgtccatagcatgcctcctctgatgcattgtctgttgcactgatgatggctctaatggaggctctaatagagaaggtccactcttactgccagatcatctatgagagcctgatcgagagtgtggactagtctaaccactctatgcatgctcgtgtgcgtgccttcatggtggacaactggtccactaccggttgctcgggagcaaggtagtgatcaccgcactgggatcacatcttgacccacctagcgaccgagaccgcggacgagaccgctccaatcaaccaacacctcatccacgacttcatg

SEQ ID NO: 16461 - DNA, 388 bp, Sorghum bicolor
  unsure (1)..(388): unsure at all n locations
  Clone ID: LIB3481-007-Q6-K1-H1
tcctgacaatcaggcagggtcttggtgttggtgggtggaaccgcctactggctttgacgtaaggcattctgagatgatggaatgttttataatggttggatccttggggttgagggaatgaaagtgggaggncagaagttgataatcgttcctcctgaactggcatatggaaagaagggggtccaggaaattcctccaaatgcaactattgagctggatgtcgagctactatcaatcaaacaaagtccattcgggactcctgtgaagatcattgaaggatagttgtgcatagagttctgaaggaaatggtacatatttgcatggacagtggagtgttgctattgaaaaaggctagtttaccaaatatgcttgtgctattgcattgata

SEQ ID NO: 16462 - DNA, 492 bp, Sorghum bicolor
  unsure (1)..(492): unsure at all n locations
  Clone ID: LIB3481-007-Q6-K1-H2
tgcgtccgcccacgcgtccgtgaagatagctgattcgtttgtgctatgttgcaaggggctccaacaagaaaacgcagtgcagagtttgatgactctgccatgatcaatgtacatatgcatagcaaggagcctatttctggtaaaccatggcacccgctacagtcgatgttgcctcatctgtcctggaagataaatctgtaaattcggtctgaagctcagcatcaggtggttattgtatcaacaagccctggcacaaaggcttcgtttgtaataataagcattgcatggagctgtctgctgaatgtgtgctagggtactttcaatactgggctcagcatcagtccagaagctgtactctgaacaaagattctggatggcttcttgtgccaactaggaacaatgtaaaactgatgtaagcatctccggccactcctgatccatgtanaactaagttaaaagttntaattggtatagattgggtgccgatggaca

SEQ ID NO: 16463 - DNA, 437 bp, Sorghum bicolor
  Clone ID: LIB3481-008-Q6-K1-A1
cgtccgatccgagagcgcggagcgcttccccgggcagcggcggacactaggagcagccgtcagcagccactgaggagcgacctgttgccgccgcccacctgtcgactgccgagctcgctcttggtcttcttcctagtctaatgtgaactttgggagaggggatgatgcggatgagaagctcgaggatttgctcaaacagcacggctaggtggagttcagcttatgtggacctgcgtttaccaccgatgaggccgacgacgacgccgtttgcttgagctttgctgtctggatggctaaagccacacgcgatataaaggctactgatatcgcggtactttgggtgaatcggctcagctagtggactacgtttttcatcattctaactgcccttctttatgctcaaattgatgctttattgccaaaatgagagatattgc

SEQ ID NO: 16464 - DNA, 349 bp, Sorghum bicolor
  unsure (1)..(349): unsure at all n locations
  Clone ID: LIB3481-008-Q6-K1-B3
ccgtccgaaaaattttaaaaaaaaaaaaaagggcagagacgatctaaaaagataccaaactaacaaacacagtagcatgcgacataatagggtcttgtctattttaagcttccttgctttcgctggccggcgttcttacggcgaggttcttgtttgggcccccctgtttcccatccactgccccttgtttaacacccccctttttggaactcccgtggggttccccaagttaaccgctttggggcttgtcttcttttaaccagttggggtgaaaaccgagaggccccccccattggccctttaaaaaaaagggggcgttttgaatggggggtggaacccccnttgggtc

SEQ ID NO: 16465 - DNA, 325 bp, Sorghum bicolor
  Clone ID: LIB3481-008-Q6-K1-C7
cctgcgtaccgtccgattcccggtcgcccacgcgtccgatgttccttcttcacacaactggacttccgatgtgaaccgtactgagtatcagctgattgacatatcagaggatggatttgtgagccttcttacttagatggcaacctaaggatgatcttagctcccaactgatgagactcttgtggcccagattaaggaaggttttggggtgggaaggatcttgtgtgactgccagtctgtatgggggaggagcgatctgcgccctgaaggatttggccccagtaacttccctgccttggaagacggaactacctgatctcaaaac

SEQ ID NO: 16466 - DNA, 290 bp, Sorghum bicolor
  Clone ID: LIB3481-008-Q6-K1-C8
cgtccggtcccaggttagtccttaattaatcagccttttgatcgaaattgacctattgtatgaaatgaatgatattagtaccacactaccactgctactaggtatagtagagaatgcttggatgagcttgtgaaagacagcaatctgtatgatttttttttctatttatttaatggcttagttgtggtgcatgctgtaactaaggagaaaaaatctgcaggttgagctttgggacattgcaagtggtagaaagatcgtaactttgccccaaacatgtagcactgatacgg

SEQ ID NO: 16467 - DNA, 252 bp, Sorghum bicolor
  unsure (1)..(252): unsure at all n locations
  Clone ID: LIB3481-008-Q6-K1-D5
gccgcggtaccgtccgcatcccggtcgccccgcgtccgcccgcgtccgtcgagcaggaaatgcagaccgtgctcttcctcgcttggagaagtcctacgagcttccgacgacaagcatcaccatcggaacgagagatcagaggacccgaggccctttccaccctcattttgggtatggaggctgtggtgtccacgagaccacctaggctnctnatgaaggcgatgtcgacanagaaaggacctgacggaaacg

SEQ ID NO: 16468 - DNA, 444 bp, Sorghum bicolor
  unsure (1)..(444): unsure at all n locations
  Clone ID: LIB3481-008-Q6-K1-D7
cgtccgcctagatgcagatgaatggtaaattcaagttcatggggctaggcagagtaactgaacagttaaaaaaatgtaatgctcatatgctttttcttccatatctcacttgtaactaaagtcataattatgctctgcttgtgccgtactaaatgaacctctagtccgtttgacatcagaatctagccagttgccattaactcatgggatcatgatagtgtctcttgaaacttatctgtgtatcttttgtttgtgtttacaatagtatttcttttcaacacaattgtgcttacatgtttattcgttaataaacttttgaagaccgtnctggcatattctaccagaaggacagggccaaatgggatgcatggaaggctggtgaaggttcatatacttatctgattggtgnattttgggccgcttatataattttggtatttacca

SEQ ID NO: 16469 - DNA, 277 bp, Sorghum bicolor
  unsure (1)..(277): unsure at all n locations
  Clone ID: LIB3481-008-Q6-K1-E6
cccggtcgccccgcgtccggcagcaggcaccacacacacagaatgccttgtcagctgccgcggcaataacatgaaagcgcttatccttattggggatttatgcatcttgcacggacccatctgaggggatgccacacaccctgtcgggacattgacttggacantgcgatgcctgggaccctcaggaccgagcctgctgtgaaaataaacagccaaacgacctgctgggggggatcctgatggcaattgccgctcactgggggagcataatggcgcc

SEQ ID NO: 16470 - DNA, 179 bp, Sorghum bicolor
  unsure (1)..(179): unsure at all n locations
  Clone ID: LIB3481-008-Q6-K1-F6
gtccgccccgcgtccgcccacgcgtccgcccgacgcgtgcgcagccaagttctaccaatgatccatttggacttcgaagggtctcttatggactggtccaaatattggttgagaacaagaagagctttgacctnaggcgagctcttaccttattggctggggngcaacccatataaata

SEQ ID NO: 16471 - DNA, 341 bp, Sorghum bicolor
  Clone ID: LIB3481-008-Q6-K1-F8
cgtccggtgaagcacggggcccgggtggtgatcgcggacatcgacgacgccgccggggaggcgctggcgtcggcgctgggcccgcaggtcagcttcgtgcgctgcgacgtgtcggtggaggaggacgtcgcgcgcgccgtggagtgggcgctgtcgcggcacggcgggcgtctggacgtctactgcaacaacgccggggtgctgggccgccagacgcgcgccgccaagagcatcctgtccttcgacgcgggcgagttcgaccgcgtgctccgtgtcaacgcgctgggcgccgcgctcgggatgaagcacgcggcgctcgccatggcgccgcgccgcgccgg

SEQ ID NO: 16472 - DNA, 176 bp, Sorghum bicolor
  Clone ID: LIB3481-008-Q6-K1-G7
cgtccgaatgaaggccaagggccgacgtgtgctaagaaaattcaataaatatgactaaaagaaattaaaataaaaaaaaataataaaaaaaaaaaaaaaaaaaaaacgtagacgaaaatgtgccgtaaaatatccaattgcgaatgcaatgactgaactagtacatgcttttttta

SEQ ID NO: 16473 - DNA, 154 bp, Sorghum bicolor
  Clone ID: LIB3481-009-Q6-K1-A11
cgtccgctcggcttgcaagatatggccacgctcatgtgtggaggcgtaactaagacgagaacctacttccatagctgaaatagaggtagccgatactgccctgatgagggctgcgaaaggaaggtcatgggcaagggacgggcccaggtgtgca

SEQ ID NO: 16474 - DNA, 226 bp, Sorghum bicolor
  Clone ID: LIB3481-009-Q6-K1-A7
cgtccgcacaaagttgggttttgtagggtaagagtgccgttttcatctttccggccagtaaacccacaggatcctccactggacccgtttcttgtccacacactaaccattaggtttgaaccaaagaagcagagacctggtgattcatctgaaggagctagtgaccaaagaaactttgagctcaaaatggagttcataaaagccttgccgagtggtcaagaaacag

SEQ ID NO: 16475 - DNA, 489 bp, Sorghum bicolor
  unsure (1)..(489): unsure at all n locations
  Clone ID: LIB3481-009-Q6-K1-B11
cccgggtcgaggacgcgtccgtgatgctgcagtgctagactgccagtgctgcctagtgcgaggtactacggatcgcaatttgcgagtgcccaactcgagttgcagtaggaattgattccagtaggcgatagccgataggtaaacttcccaaagtttgtaacaaagagatgaggcagaatatgtcctctgtcacccttttcctccctatggtcataccaatggatggcgagcggacgagaatgtccgaggccctcgcacacaaggcgactaggcgagtaataattccacacgaaagctcactcccaacggcttaattttcgatcaatcgtgcctgttacatgaaaattgacaaccgcgccgcgcgcgccaactgatcagtcaaatcagnagcggctccagcacaatccggnccaatattatggggttnggtatgccaatcattcccgaatttctaanggaccgcatgccacgcacatttacaactggacc

SEQ ID NO: 16476 - DNA, 248 bp, Sorghum bicolor
  unsure (1)..(248): unsure at all n locations
  Clone ID: LIB3481-009-Q6-K1-B6
ccgtcgcccgcgtccgtgctccccggcctccctcccccgctcctcgacggcagcctgcgggtgacatggcttcgacccgttgggcctggcggaggaccccgagaacctgggggttggcagggactggtgaacgggcggggcgatgtgggtggcggatgtgatccgagtgtgacaagcggctcataacgcccgatggtacacccgcagtggatcttgcgtcgcncacctgtctgatcatnatctgtcat

SEQ ID NO: 16477 - DNA, 574 bp, Sorghum bicolor
  Clone ID: LIB3481-009-Q6-K1-C12
cgtccgggggaagccggtgcccgtgacggtcgtcgggttccgggagaggcggcaacgtggtgacgcaggtgaagacggccgtcacggacgggtaccacgccgtccaggtcgggtaccacggcgtgcgcgaggactagctcacccgcccggagctgggacacctgggcgaggccggcgccccgccgctgaagcagctgcaggagttcaggctcaccgccgtcgacgccttcgagcccgggcagccgctcgacttcgccgacctcttgaaggagggcgacatcatcgacgtctccggcgacaccatcggcaaggggttccaaggtggcatctagaggcacaacttcaagcgagggctgatgacacacggttccaagagccacaggcagctgggttccatcggagcggggacgacgccggggcgtgtatacaaggggaagaagatgcccgggaggatgggaggaaagaagaccaagatcaggaagctcaagatcgtcaagatcgacaatgatctccgggtgctcatgatcaagggtgccgtgccaggaaagcccgggaacctcctccgcattacgcc

SEQ ID NO: 16478 - DNA, 562 bp, Sorghum bicolor
  Clone ID: LIB3481-009-Q6-K1-C8
gtatcttttgctgtttggagattcttcaacaggcttcttactaaacttaaagatggaactgtcagtcaagcacatatttctgtgtcctccaaagttgatgagctatttatgatgatacaatatggttcaaggctccttcactggtggtctattgatgaagatagcaaagaggaacaggctcacttatgctatgcaaataatattggctatagtaccttttgcagttatccaccagaggtggtaaaagagatgccaaaggaagttcttgtcaaagaggtacagagacttcaactagccttggaagagcaaactgaaatggcaaatcatagccaacagcagtgtgatagtctaagaaatgaaaggatcttgtgtcgaatttgctttgaaagagacatatgcattgttatgcttccctgccgccatcatgttctctgcgagccctgctctaacaagtgtcagtcatgcccaatttgccgattgaccgttgagagcaggttatctgtttatgatacagtgatatcagccaatccattatgggatgcagtttaaaagttcacatgtc

SEQ ID NO: 16479 - DNA, 404 bp, Sorghum bicolor
  Clone ID: LIB3481-009-Q6-K1-D4
ccgtccggcttttctttaggaagttcagcaaagccggcaaattcccaagtgttcaacctatgatgaatccatgaattcaccacaaccagtggcaccaccttttccagtggagttctccacctgtaaacggcttataaaggcatctgtacagatgcgacaataatgtctctatcaattttatctccaagaactatcactttgcagtacgagaattggctctcaagtcaacatttgtggcttgtgcttttgtcacattgctatgatttcgcatatcttgcggtctgcaatcctctggtactcgattggagatctctgcctagcgtggaaggcatccaagattgtgtgctggtgccagtatttgccaagaacctgctaggtgcatgctccacattattcgcaaggac

SEQ ID NO: 16480 - DNA, 164 bp, Sorghum bicolor
  Clone ID: LIB3481-009-Q6-K1-D6
cgtccgcccagtgtccggcgactccagaaccttctcttcttccttgttcgttcatcccctaaccctttctttgttcatcttgttcttcctcttgtcgactcgtcgagatggccgggattggtccgatcaggcaggactgggagccggtggtggagctcaagaag

SEQ ID NO: 16481 - DNA, 493 bp, Sorghum bicolor
  unsure (1)..(493): unsure at all n locations
  Clone ID: LIB3481-009-Q6-K1-D9
tctacgtgtccggcctgcggcagtggcgtcttcgtcgtcaacgtcggagacgtcctcgagatcttcaccaacggcaggtacaggagcgtcgagcaccgggccgtcgtcaacgcccacacggagcgtctgtccgtcgcggcgttccactctcccagcatacatgccaccattggcccgctgccggagctcctcggcgaccaggaggcgcccaagtataagacgctggaccaccaaagcttcatcacgctcttcttctccgccaagctccagggcaagagcttcttggaacggatgaagaagaagaagctctctgattaattaattaattactcgtccgttcctttcaggcaattaatctcacaatcactacacgcattttagcttttggaggcacttgcttttgttgttcggccttgttcagttctcaattttttttaattatgtattgtagccctttngtttttatttggcaaatattatttaattatgaact

SEQ ID NO: 16482 - DNA, 191 bp, Sorghum bicolor
  unsure (1)..(191): unsure at all n locations
  Clone ID: LIB3481-009-Q6-K1-E1
ccgggtcgttacttttttttatgtgttgagttagtgaattgttaccctcacaattaatgtgttatatgatggaggtgatttaagaattctttgggcattattaattgtcatcaatctgcagggatgggttanagaaaaaaacgaaaaatgaccctagtgaaactttgggggggactaaagatatccaaagg

SEQ ID NO: 16483 - DNA, 454 bp, Sorghum bicolor
  Clone ID: LIB3481-009-Q6-K1-E12
cgtccggcacaagaggtgcctggtgatatttgaggacgtggacatgcacaggaagcggatgcttgaagagttcttgcaaagatcaagatgtggcaaggtggggacaatcaagatgatcatcaccacaaacaatcggcgtgtcgcaaacatcgtcgggacggtggagccgatcaagctgatgccgttgccatgccctgagtactggttcttcttcaaggcgcacgcattcgccgggagagacatcgaggagaatccacggctgatgtctacagggaaagccatagcgaagaagctgaacgggtcattctttggtgccaagatcattggaggggtgctcagggatcacccggatcccaggctctggtgcaaggtcatgagcagcagcatcggagggatgtctccccttggtgatggcatcagctacatttcggacttggctgatagcttgctgccc

SEQ ID NO: 16484 - DNA, 280 bp, Sorghum bicolor
  Clone ID: LIB3481-009-Q6-K1-F4
agctttcactctactctatattaccacagtctacttaatctgatcccttctacaacccattaaccaaggtttttgggaaaaaaaaccattaaccacaataccacatcaagttaggaattagtcacaggatgctagtaaatttcacacaatcaaaggcaataaaatcaccatacgagtaataattatccaattaatggataattgaaagtagtaagaatatatacatgccaccttttataatgtagatgaggagttcactcgtggcttttttttttttttt

SEQ ID NO: 16485 - DNA, 165 bp, Sorghum bicolor
  unsure (1)..(165): unsure at all n locations
  Clone ID: LIB3481-009-Q6-K1-G12
gtccggagaccgccgctgaccgcgcgctacggctcaaggcgaaactcgcggcgcgcgggctccgcaccagcgtccatggcgtcctcctggtggagctgttcgatcacccgcacctgctgctgctgcaggtccggaactcctnctttctgctccccggnggccttt

SEQ ID NO: 16486 - DNA, 205 bp, Sorghum bicolor
  unsure (1)..(205): unsure at all n locations
  Clone ID: LIB3481-009-Q6-K1-G5
cgtccgacagcatgatcatgatctttgtgcgcacatgtgaatctactaggctccttgctcttatgctgaggaatcttggtttgaaagctatgtctatcagtggccaaatgagtcaggacaagagactaggtgctttgaacaggttcaaagcgaaagattgcaatatccttatttgcactgatgtagcaaggcgnggncttgacat

SEQ ID NO: 16487 - DNA, 206 bp, Sorghum bicolor
  unsure (1)..(206): unsure at all n locations
  Clone ID: LIB3481-009-Q6-K1-H4
cgtccgatgagttcaaacagtttttgtgctcaggatttcaagaaacaaatatgctttacatagtgtgatgcttcatgcatgtgaacaggcttcagaagataagctaaaccatgtgtactctgacacttcccttcactaaaatatgcaaatatacagtttcgacttcctttttngtctttattttgccacagaaactacaatttatt

SEQ ID NO: 16488 - DNA, 311 bp, Sorghum bicolor
  Clone ID: LIB3481-009-Q6-K1-H5
cgtccgcccacgcgtccgacctagctgagaagactgacatgggaagacttgcttctccttcattactgaaactagtatatgattctgcaaggccaaatggcaaaactagtgaggggagacttagtacagagatatggaatgaaatcgaacaactacttgagaaagtctcagtatggtttgccgatccttcaaaacttgcatgcttccttatcatggatcctaggagatcaatctctgtatcctctgcattacgatactggggttgtaccactcaagctggcggtcaaatatgtgggggatttggatatact

SEQ ID NO: 16489 - DNA, 110 bp, Sorghum bicolor
  unsure (1)..(110): unsure at all n locations
  Clone ID: LIB3481-010-Q6-K1-A11
cgtccgggcttgctgtggatacctangcacccggagaggaggaagggcgtancaagcgacnaaatgcttcngggagttnaaaataancatanatccggagattnccaaat

SEQ ID NO: 16490 - DNA, 256 bp, Sorghum bicolor
  unsure (1)..(256): unsure at all n locations
  Clone ID: LIB3481-010-Q6-K1-A2
cgtccgtaatcttttagcagttgttaacacaaaacttttgcgagattatgcacaaatagatagaaggttaaggcagttggcattcattgtgaagcattgggctaaaattcgacgtgtaaatgaaacttaccaaggaacactttctagctatgcctatgtgataatgtgcattttcctnctacaggtgggaagaatactcccntgtgtacaggaaatggaggccacttattatgtggggggggatgaaaataactgt

SEQ ID NO: 16491 - DNA, 382 bp, Sorghum bicolor
  unsure (1)..(382): unsure at all n locations
  Clone ID: LIB3481-010-Q6-K1-B12
cgtccgcctggcgaacgtgtggaaatatcgctcaatgagatgctctccaattctgaggaacacaggtattgcgaaagcccatatggaacatatatgatcgtttgtgctgcataccttctccaaagctgtctcatacccgggcagtatttttaatacttcatattcatacttcctcgttcaaaagggcgagacgttatggcttttctaggtcataggttttgcttcacacctagatatacattatgcctggatacatagaaaagctatgtatctaaaaagctagaacgacttaccatnntggaaaagggggaatcaagaaaccttttcaacatttttggtggtctttctcttacatatgtaggctggggnntaagggttgggt

SEQ ID NO: 16492 - DNA, 447 bp, Sorghum bicolor
  Clone ID: LIB3481-010-Q6-K1-C11
cgtccgcccacgcgtacgatcaaaagattcaccggtgcaggacaaggagatgttatcgcgttgcctgctggtgtagctcattggtgctacaatgatggtgaagtgccggttgttgccatatatgtcactgatatcaacaacggtgctaatcaacttgaccctcgacagagggatttcttgttagctggaaataagagaaaccctcaagcatacaggcgtgaagttgaggagtggtcacaaaacatatttagtggctttagcactgaactgcttagcgaggcttttggcataagcaaccaagttgcaaggcagctccagcgtcaaaatgaccaaagaggagaaattgtccgagtagaacgcggactcagtttgctgcacccatatgcatcatggcaagagcaggaacccggactcgtgccatccggagagcatcatcaatacggagga

SEQ ID NO: 16493 - DNA, 200 bp, Sorghum bicolor
  Clone ID: LIB3481-010-Q6-K1-D4
ccggaaaaaacctttctttctccggtctgatgcgagtacataacttctgcccctgttgtttgcatggcttgagaggggaatggtgttgttgcatcatctcgcaagttaataggagctgctaatccccttcaagctgatccaccgaccatacgcggcgatcttccagttcatacaggatggaatgttgtccatcgaagtga

SEQ ID NO: 16494 - DNA, 275 bp, Sorghum bicolor
  Clone ID: LIB3481-010-Q6-K1-D7
cgtgcggcagagctagacgcaccggaacctcgatctcacccagcacaacgagcagggcgacaggtactcgggactcggcacacagggttgatgaagccctaggctttatgtttggctgatgggcgtaaccagtggaccaccccttgatgacatgtactgatctctggaccttacatgattgccttcttgtacgctatgaacaatgtctgacctgtcaggactccactaatggtcatttctacgactgctgtgcccacatgctatgggtggtccaa

SEQ ID NO: 16495 - DNA, 521 bp, Sorghum bicolor
  unsure (1)..(521): unsure at all n locations
  Clone ID: LIB3481-010-Q6-K1-D8
cgtccgcccatgtgtccgcccacgcgtccggtggaagtgcacatctataccaggcaggggggaggaaaccttggcacagtatcaactttgtgtgtgcgcatgatggatttacgctggctgatttggtgacatataacaagaagtacaactcttcaaatggtgaggataatagagatggagaaaatcataacctcagctggaactgtggggaggaaggagaatttgcaggtttgtcggtcaaaagattgaggaagaggcaaatgcgcaatttctttgtttctctcatggtttctcaaggtgttccgatgttctacatgggcgatgaatatggccatacaaaaggaggcaacatcaacacatactgccatgaccattatgtcaattatttacgctgggacaagaaagaagaatcctctgacttgcaacggttcttctctcttatgaccaaattccgcanacaatgcgagtcccttggcctcacatacttcgcaacagcttaacggttgcattggcatggccat

SEQ ID NO: 16496 - DNA, 435 bp, Sorghum bicolor
  Clone ID: LIB3481-010-Q6-K1-E8
cccgcgtccgcgccgcgctgttctgacatgccgttcgacgccattttcctcatctacaactctctatctattttagcgcccttactaactatgccatggctctatggcccagctatttggtccgaacgtaaatccatggcacaaccctcggcaaggaggttttagggagtgtagatttgatagactacaagcatttgaaccacttcggagagtgaggtcagaagccggggttacagagtactttgatgagaagaatgaacaattccagtgcacaggtacatttgtcatccgacgtgtcattgagcctcaaggccttctggtacctcgatacagcaatactcctggcatggtctacatcatccaagggagagggtttatgggattaactttccccggcttgccagcaacctaacaaaaaaatgcggacattgtttg

SEQ ID NO: 16497 - DNA, 437 bp, Sorghum bicolor
  unsure (1)..(437): unsure at all n locations
  Clone ID: LIB3481-010-Q6-K1-F8
acgcgtccgcccacgcgtccgcccacgcgtccgcccacgcgtnncgaccacncgtnnngaataaaaagaagggaaaaagaacatgaaatnctgcaacatgaaaaacattgaatcacaagacgattttgacaagcagctcctgttggccagcgataagctcaccgtggtgcacttcttttcccctagttgtggagctggcanggccctncnccctatggtatgtcaattggctggcatgcatccggaactggcatttcttatggtcaactccaatgaacaaaaggagatgtgccgcangctcaatgttcatgtattgccaatgttccgcttttacagaggtgcagaaggccgtatctgtagcttcagctgtacaatttcaactatttataaaatcaaagatgcattgaaaagggatggggttcaactagagaatcttt

SEQ ID NO: 16498 - DNA, 366 bp, Sorghum bicolor
  unsure (1)..(366): unsure at all n locations
  Clone ID: LIB3481-010-Q6-K1-F9
gcgtccgcggcatactaacgaggcacgatttcatgcctgaacatatattgggccttcatcctttcctctttaagagcagatggaagaaggtgcgacttggcaaggtgaaagtcgccgacatattttgaagcttgctggtgactaatgatttggggaggtcacagaaggatcatctaatcaccgttgtatactttggcgtctcactccaaaaaatctcattgagcggaatcgtatattttgcagagaataactcaacttcaatactagtggactttagtcaaggaaaataatttcgttgtaaatgctaacangaggatggaacatactcagtagctgctaagngctaacaaggtnttttnccacgaa

SEQ ID NO: 16499 - DNA, 386 bp, Sorghum bicolor
  Clone ID: LIB3481-010-Q6-K1-G10
cccggtcgaccagcgtccgccatttttcgcctaccaagcgcgtagcgaggagaaaacaagagaaaaaagcagcagcggccatggagggatacgaccgcgagttctaccagttcagcgaccagctgcggctgcagacggcgagcttctccggcctctccctcggcgactccatctggtcctccccctccgaggtgtggggcgagccggccttcgacggcgagtaccaccacttctcctccccctgcccctggaagaacgccatcgccaacatcaacggcgtcgccggaaacctggatggcccggacctcatcggctccggcaagctcgaatcctccgcgctcgtcagcctggccgacggcgacacctacccgggggatctggcccta

SEQ ID NO: 16500 - DNA, 400 bp, Sorghum bicolor
  unsure (1)..(400): unsure at all n locations
  Clone ID: LIB3481-010-Q6-K1-G6
ccggtcgaccccgcgtccgcccacgcgtccgcccacgcgtncggaatctccgaacgacaagtttgaagtattntatattgactaaggaaaccaanaggcggnngnaaaaaagagatcgctntntggntccctgaangtttaactgantggaggagcaaccttnacccttggatctatgagtcttaaaacttnncgccaaggggggatcccctttggggggctanttttnnttaaatatttgaattttgtttcaaaattnacatttgtctgtcctcagaaacaacattataattcttctgatactacatcacaattatatttctccctgaactaatatgcttaataaatttntggaatggaaataaaagaaaaaataaaccaacaattatttttttattat

SEQ ID NO: 16501 - DNA, 300 bp, Sorghum bicolor
  unsure (1)..(300): unsure at all n locations
  Clone ID: LIB3481-010-Q6-K1-G9
tcccggtcgacccgcgtccgcgactcaagtgtcccccgctcttgccccatctcctcagatcggcttcctgtacaggcggagaggtcgagcacggtgtcaggcgcttgtggtgagaggttccttctcatctgtatcgcaagggccgctcacatcttcggtaagctcggcaggctcgccaagccatgcatcctctgtcttacggncttaatatgcgagtatgctgtctgtggggagatggncatccntccatgctnagatatgcacacgtnngatcatgcaaattatgaatggacctacata

SEQ ID NO: 16502 - DNA, 105 bp, Sorghum bicolor
  Clone ID: LIB3481-011-Q6-K1-A2
tgcgtccgcttgaccctatgcaaagggattactggttaactggaaataagagaaaccctgaagcatacaggcggtgagtgctgaggagcgggtcacaggaacata

SEQ ID NO: 16503 - DNA, 571 bp, Sorghum bicolor
  Clone ID: LIB3481-011-Q6-K1-C12
gcgtccgcggacgcgtgggtgagtgtcttagttcaaacattcaatctgaaacaaaacaaaatgatacactcccatctgcctgcaggtttaaatttgaagatattacagcttcatctttggtgttggttctgaaggaagctgtttcctcacagtatcatactatcaaaggctataaactctggtactggaatagcagagaagcaccttacacaggggagcctgctgttttccccaaagaccaaagaaggattcttatatccaatctgcagccctgcacagagtactccttccgcattatttcatttactgaggatggtgaactgggccattctgaatcgaagatctttaccaagagtgtggaaattattcataagaacacagagcatggagcagaaggttgctcatcttctgccaaaagagttggtaagagacaaaatgttaggtcattaggcttccaggtgcgtcagctgggtaatgtattccgaaaagcacaaactgaggaaaatggttaccccaatgcactgtgtaaagatgagattgaagattcatgtgatcagagtgattctttgat

SEQ ID NO: 16504 - DNA, 265 bp, Sorghum bicolor
  Clone ID: LIB3481-011-Q6-K1-C5
cgtccgcaactggtaataattggagcttgtggagatgacacgccagggcgttttgtttgtcagcaacatgagctttagtggagtagacctcacaagattaaggacaaaaaaggggcacactgctcagtgtgcatgcttggtcgatgcaagtggcaatcgcaccatgcgcccttgcctatctagtgcaggggagctccaggccaacgagttcaaaaaggaggacttcaaaggctccaagtgctctgctgtacgatatgcaagacag

SEQ ID NO: 16505 - DNA, 288 bp, Sorghum bicolor
  unsure (1)..(288): unsure at all n locations
  Clone ID: LIB3481-011-Q6-K1-D1
gtccgtattatctntggattgtcctaatgcgcctttgcatcgttgagtaatttttacaggattcacatcacaaggaaagtggacaggagcaagatggagatgttcgaagttcccagaatggtgcatcacgttcaccatctgagggaaaattgaaccaagctatgacaatcgtgcccatgccatcaagtggcccagtaactggtccaactacaaacctaaatattggaatggactattgggccaacacagcaagctctgctcctgcaattcatggcaaagtgaccccaa

SEQ ID NO: 16506 - DNA, 567 bp, Sorghum bicolor
  Clone ID: LIB3481-011-Q6-K1-D12
gtccgccatgtagggctacacacctgcacatggtgcctgacatgtacaacaatggcggcctcgccacggacgcctaccagtaccagacgtgccatggcggcacaatgcagcacggctacgtcttcccgtgcgcacgcgccagttttagttacttcattatgccttatgttttttcatattttggggggggggggtctttttctttttctattttcttttctctttgatcttatttgcttttattccgtctttctccttttctcttttttttcctgcccgttatatttttcttcctttttctttctctttatttttttctttcttcctttttttttactttatcctttttttttttcttttttgttttatcttttcttattcttcttttttctctttgctttttcatacttctttcttttttccttgattttcttgttattttcttacccttttctcttttttttttttctcttctttttttccttctcttctttttttttccctctctctttctctccctttccttttttctttcttttttttttatttcttttttttccctttttt

SEQ ID NO: 16507 - DNA, 500 bp, Sorghum bicolor
  Clone ID: LIB3481-011-Q6-K1-D3
acgcgtccggcctgaagccgaagtaataccgaatgttttttttctcctgtgtctcaggttactgcgcatgaaatcatgctgtggtgcatcaaagatgcacaggacctcatcaggaagaccccgcctcccccactccctggatctgatctcacgaagctccttgcggagtatgagaccctttccaagtgcgcagagaccgagtctatcgagatctttgctggaactggcaacttccttaagcttcaggtgaagacctggcaaaattatggtgaaactgtcaagggaggtgggatcgaagctgcacaggatgtcacctgcaccgttcgttcagcatgtgtggatcatgtgatccgccatcgcctactctccaggtttggattgaagatggacaatatgccagaggaccccattgagcatgacatggctgcagctatgatgtatagcgcagacttcaccaaggaccgtcgcgggagatacagaagggagctgaaatggattga

SEQ ID NO: 16508 - DNA, 456 bp, Sorghum bicolor
  unsure (1)..(456): unsure at all n locations
  Clone ID: LIB3481-011-Q6-K1-D5
cgtccggctcccagctcgtccacagccgcgtcgaccgcgcccgcgccgggcaagctgccggctcggcgggcatcggcatcacggtgaccgcgctcccgttcccttgcgccgaagccggcctgccggcgggctgcgagaggctggaccacgtcccctcggtcgacctcgtgcccaacttcttcgacgccgacgcgccggccgagctgcatcgtcgccgggatgtgcaacacgtgggcgcacggcgtggcgcgtgagctcggcgtgccctgcttcatcttccatggcttcggcgcgttcgctctgctgtgctgcgagtatctcancacgcacaagccgcacgagggcaagtcgctggacgaggccatcgacgtncccgtcctgccgncggctttngagctcaagttcgccaggaggcagctgccgctacagtttcctgcctttgtgcctcaattccgg

SEQ ID NO: 16509 - DNA, 396 bp, Sorghum bicolor
  Clone ID: LIB3481-011-Q6-K1-D9
cgcgtccggctactgcgggcctgaggtcgactggctgaggaccggagacctgctcctggacggctacaccatgagctacttcagcggcaggatcccgatacaacgctggtggtggacgtgatcgcggagatcgcactgatgagcagcgcctgagtactaccggatcattaagggactggaccttgaggacgggctgcaccccgggggggccttgtacccgctgcgcctgatcagcaaacatgcacgcccgtgccatctttgaggctgcgatagcaatgtccaaccagggtgcagaagctttacgatagatcatggcatctattgctgcaacaccagaggaagtgcgacataaagcgaatgttatcaaacaaactgccgataaagtaataacctatg

SEQ ID NO: 16510 - DNA, 440 bp, Sorghum bicolor
  Clone ID: LIB3481-011-Q6-K1-E6
cgtccgcccacgcgtctcgccacgcgtccgcccacgcgtccgcccacgcgtccgggagctgctaaagccatgtatccagcagcaggttatgcagttccgcaagtccaaccagttctaccagatagtgatccgacaaacaccactatatttataggtaacttggatcagaatgtgacagaagatgaactcaggcagatctgtgtccaatttggggagcttatatatgtaaaaattccagccaataaagcttgtggatttgtacaatatgcatctcgggcatcagctgaagaggcagtacaacgtcttcatggcacaacgatcggccaacaagtagtcaggctttcatggggcaggagtcctgcgagcaagctagatcaatcagctgtctggagtcaacatgctgattctaatcattgggcaggggcttattatggctatgg

SEQ ID NO: 16511 - DNA, 181 bp, Sorghum bicolor
  Clone ID: LIB3481-011-Q6-K1-F12
ccgattcttccaggtatgtaccagaagaagattcttgatggtgccactttcactgtaccttcaggaaagagtgtggcaattgttggatctagtggagcgggaaatcaactattcttagacttctgttcagattctttgattcgacttcaggatctgtaagaatatagaagtattggggggg

SEQ ID NO: 16512 - DNA, 438 bp, Sorghum bicolor
  Clone ID: LIB3481-011-Q6-K1-F5
cgtccggcagacagaagtagttgaatccttactttttgagatgcaagatttaggtataagaccgagtgctggatcgtacaattgtctcataagtgcctatggtcgccagaagaaaatgagtggaaaggctgaagatgctttcttgaggatgaaaagggaaggtattaagccattatcttcttcatataatgcactactctttgcatatgcagttaatggattgcatgaaaaagctcataccatatatgtggatatgaaaagagaaggacttaaacctaccttagaaacgtatacagctttactcaacactcttaggagagcaggtgacacagagaagctaatggagacatggaaaactatgattgatgaaaaggttggtggaacacgagtcatattccatgtggtgctcgattgtttagcaaaacatgggctgtatct

SEQ ID NO: 16513 - DNA, 499 bp, Sorghum bicolor
  unsure (1)..(499): unsure at all n locations
  Clone ID: LIB3481-011-Q6-K1-F7
cgtccggatgcggtctgcttcccccttacactcttctcaagtttatttgaacctggatggtcttctgggagttcagcagtctccattaagggccttttatcattgctggtggaaggaggcgctgacaatgtaaatcagtgtttccttgaagcagcacgctttggaagtactgaacttgtacgcattctgctggaggttgcatatcagaatagcttggctgtggacaccgagctggctctagtatatgcctctcattactgcaagttcaacacaatggaatgcctagttgatgaagggaacgtgaattctttcctcagccctctgataaaagctgcagagcgtgggtgcttgcaggttgtccactggtttgtcagtcgaggcatctctgaaattgagatgtgccttgccctgacaactgctgcctccagtggccatttcatggtggcctcgtatttgcttgcacatatcccccagcanattcttgaagctctcagcactc

SEQ ID NO: 16514 - DNA, 444 bp, Sorghum bicolor
  Clone ID: LIB3481-011-Q6-K1-F8
cgtccgttgggttctctgccgccttcattacggtccgaaaattacagtccccaggagcctcaggtgggcgtcatgcggagcgatctcaatgagcttaacatcagccctgcttgtgcggtctttcagcccagagtgcgaacctcagaatattatagctgcttacgacaaacctcaacgcaagactgaataacatcaacagggtgtcaggccactgctactctccctatcaaattattttggttgtttgattcagttcagtcgaggatatacttgtatgtccctttgtatgatactacgtatttatgcatcataatatctccctgttgagtgaagaactatttgcctttatgtttggcactatatgcaaaccaccatggatttgggtctgagatgtactgtctataatcaatattgatactatgttacagttacactacttgaaaa

SEQ ID NO: 16515 - DNA, 432 bp, Sorghum bicolor
  Clone ID: LIB3481-011-Q6-K1-G10
cgtccgcccttcccgtgtccgctgatgggagggagacaccgcagtccaataaagtgcggagcgtcgtcgggaggctcgccgtccaagcggcccaaaggggtttgagggtatacctgcaggatgaatatggaacgtccacggacgccctagagtacatgatctccaggggtgtcaagaagtctgcccgtgatacccaatctgatgcatatgctgctgtgatgattttgaagagatatttcacgtcatcaggtcaaggggctaagattgttctccccaggcaaccagaattacaggacaagttaatagttcagtctaggcaagatgctgaaatttagaaaggcatgtcttctagtttctccatcagtagagaacatgtccagttgagagcacctcattttctataccatctcatccgctgtgatgtagatgatt

SEQ ID NO: 16516 - DNA, 438 bp, Sorghum bicolor
  Clone ID: LIB3481-011-Q6-K1-H12
cgtccgatcctatgtaagatattagtgtttcgtgcatatgcacccgcagcccatcataatagatcacgcacatgtagcggtatgccacacgacctgatgatagattcgatggctactacattagtctcttgcctctctgttgttgctgttggactggcttctccctgaggctgtgaaccaggagtagtctgctgcaggggcagagtcgaactcacaaccaacaaaccctcagacgggggcctggggacgaggaaacatttgattgaacgacccgttatttctggtgaggaagagctgggccgagggctcgcttacattgtttgttgggaccggaacttgatggcagcaatttgcggctactttccacaggatgcctaggagctcgcagggtctgtctatgggcctgttgagtgcaattgggatggatacttattttta

SEQ ID NO: 16517 - DNA, 413 bp, Sorghum bicolor
  unsure (1)..(413): unsure at all n locations
  Clone ID: LIB3481-011-Q6-K1-H5
cgtccggagcaaactcaccgagatggccgagtttttccacgccggcaggaccaacaccgacgactgctacgacgccggcaagcacgtgcacggcagcaggagggtgtacggacacgacgacgcgagccgcagtaggccagcgtacgccgacgactgctacaacggcggcgagctgggcgccctcgccgccggcgccgcctccgcctccgcctccgcactgaaggagcagaaggaggccaagcagcgcagcagggcgcacgacagccacttctgtcaccactagagatcgtcgatccgatgaactattcatggcctgcatgcatcgtcttcctgctggctgctgaggctgtgagcttgnancgtgtgccatgcaatatgcatggnancncncatatatattgtgccatntacct

SEQ ID NO: 16518 - DNA, 260 bp, Sorghum bicolor
  Clone ID: LIB3481-011-Q6-K1-H6
ggcgacacccacccgccggcccactcatagctagaacagaatctatgaaggagcgcgaggcctacacccagaggattccagtcttcatctctcttgttggctcgccataccaaggatcaagaacacgccaatgctggggagccaaccaggtacgcatgcgcgcaatatcgcggctatgcgccatgtgcttgcactctctatagcctcatcaactgatgttgcatacagcagagatttgtatatcttgtctaaatgccgct

SEQ ID NO: 16519 - DNA, 361 bp, Sorghum bicolor
  Clone ID: LIB3481-012-Q6-K1-A8
tcgccccgcgtccgggaattggcctatcttatcacgtgttgaacagaaagatggaatgccaagcatgcacaattagtgacagcgccactgctgacactggtgattctcatacatgtggcattggtgcggagactcacctatatggaacagctagagcaggggtcgcctcttatgaggaacatactgaaaaggggggtcgtgagtcaactggttacaggatatcttacgagggttattcttcattagatctcgggacatgtgccgtccataatgaacctattttggactatgcacggatttgtttactgatagggggattgagcgaagcgtgtgcaaaaagatgctgtggtctacaatatgg

SEQ ID NO: 16520 - DNA, 364 bp, Sorghum bicolor
  unsure (1)..(364): unsure at all n locations
  Clone ID: LIB3481-012-Q6-K1-B11
cgtccgctggtatctactgctagtagcctagtgagctcgtctccaggtggatgccatgcacggttattttgaaggtgggcagaggcaactggacagttaggggtcatcactaagcagtgaaagcattgtacactactccgtataggtcggatagcttgaccttacacactccctgttaggatctggcgatttttcatgcctgatgtagttgttcttcctggatagtaatgaggactaatgtaattgatcgtgtggtgttagcatgccgtgttnataagatttgtttancatgctgatgtgtagtgttagttgaactacactggcgnangtaccggaacaatgtaattggaacgggagctttgtg

SEQ ID NO: 16521 - DNA, 382 bp, Sorghum bicolor
  Clone ID: LIB3481-012-Q6-K1-B4
gcgtccgcggacgctgtgggaaaaaaaaaaaaaaaaaaaaaaaaaaaaaaaaaaaaaaaaaaaaaaaaaaaaaaaaaaaaaaaaaaaaaaaaagggcggacagttttaaaggatccaaactttacatgggcgggccttctttaaaggtgcctgttttatttgggcgtccaagccatttctattgttttttttgggggcccctattttcttttaaatccccggcttttcccaacttgggggctgggaaacccttgggttttcggaaattattgggtttgcccaaaatgccctttttgttggctgttgtaattttaaaagggccctgactgttcaactttccccccctttttgcgctttattatagtatgggggcccccttttt

SEQ ID NO: 16522 - DNA, 283 bp, Sorghum bicolor
  unsure (1)..(283): unsure at all n locations
  Clone ID: LIB3481-012-Q6-K1-B9
cgtccgctcctcccatggttttctccgtgatccaaccgggccgcttctccaacagcttggttcagtctgatttcatcgcaaagattcttgggcgctccgaagctcctctgacctacaggcgcacgaaggccggctacccggacaagttcggcgtcaacttcgccgtgggcggcgccggcgtcttcgaggtgccgcgcgaggcgccgacgctcgccagacagatcgacgactnngagaagatgcncgacgacnacaggaccatngggaaatggcagctcaggca

SEQ ID NO: 16523 - DNA, 165 bp, Sorghum bicolor
  unsure (1)..(165): unsure at all n locations
  Clone ID: LIB3481-012-Q6-K1-C2
cgtccgacaaaggtgggccgtcacaagaaaacacacacacacacacacaaggcaacagtctccattctccacaccacacgaccaccanctcaactcanctctcactaaaccccattcacttttttataataaaactccctccattcatcttncttaactataatt

SEQ ID NO: 16524 - DNA, 506 bp, Sorghum bicolor
  Clone ID: LIB3481-012-Q6-K1-C5
ccgtccgcccacgcgtccgtatgctcacgagaatcacaaggcttatgttaccatctctctactgaggacatggtctaactcttaacaatggtgctttcgctgtccctggatgaaactaggttgaatgctgaagcactgattgtcacttaagaagatgcatgttaatttgtcacacctaacttggatcttttgtcccagttgttacttatccattttgatgttcaattatcagtaggacttcaattaaacagatgaatgtgttcattaaaacttttttcttcactttccaaaaacaggtggtcattcctcttcaccagctaagagcagctaatccttcagtaagcaaagtaaattctgctgagaagtacattcaggtcgtttctgttgaaggccatgagttctggttcatgggttttctaatgtacgacaaggctgcagccagtcttcaagaagccttggctactgctcgtgagttgcaaccgtaaaggcaccaagtggtgtttttt

SEQ ID NO: 16525 - DNA, 500 bp, Sorghum bicolor
  Clone ID: LIB3481-012-Q6-K1-C6
gtccgacggacgcgtgggaaaaaaaaaaaaaaaaaaaaaaaaaaaaaaaaaaaaaaaaaaaaaaaggagcggaagataaaaatctaaaaactgatttaaccaatagcggataaaactatagaatggggggccggtcctattattaaatttttttcgccaattctggtgaatcttttggttccaaaatgggctctttttttgaatttcccagggaactttttggggctgatcaatttgggatacaggctggattttttttttttggaacaacccacctcccccggttaatttttgcttccaccggggatttttggggaaatttttttcccatttccctgcctacgggtttcctccaacataacccctttggggttttctacccaaaaggagggggccaactttttaatttttcttccaaaaggggccccccaacttggcttattttgaaggggggcttttgtggaaaactgtggggaaacccttatttatttctttttttt

SEQ ID NO: 16526 - DNA, 198 bp, Sorghum bicolor
  Clone ID: LIB3481-012-Q6-K1-D6
cctgcagtccgtccgatccggtcgacacgcgcgaaagagatggaggcctgggccgatggccggctgaccacgcgccagccgccaggggcttcgcatggcggccaagcgctgccagggcgaccagactcggcggcatgtctggagctcccggacgcgagcagggtcgtgcggcaactcggggggtgggggcggctgggg

SEQ ID NO: 16527 - DNA, 290 bp, Sorghum bicolor
  unsure (1)..(290): unsure at all n locations
  Clone ID: LIB3481-012-Q6-K1-E10
cgtccgcccacgcgtccgcccacgcgtccggattaattggttacacacgagttgaaaatcgtaactggtgaaaccaaacaagcatggtgaagaaagttaaatcggacgcagagtaactgacaattcaacgaacaggcgcggcagtcaaatgggcttctgctctcacctgcttgaagatagcgtcggagctgagggggctctccttggctttccggtggacaggcgccgcggcgcggaacgtgaaagcggaaaagtcccctgccccgccccggccgccgncggcggnggac

SEQ ID NO: 16528 - DNA, 467 bp, Sorghum bicolor
  Clone ID: LIB3481-012-Q6-K1-E6
cgtccgctacacaatttcacaggactggtcccccggcagtcaaggagattcactactccgcgtggactgcgacgtatacaggttctcaccttcgaacgagactggggatacaccgacttgagcaacgccatagagctcgtgtgtgcgcctgaggagctaggaggcgacaacggcaccttcagcacgtacggaggtgccgatcagatacaagggctggcgtctcaggtgatggagacgctggacacgatcaacgttgccgggcgcaaggtcacgccataaaatggcacactggggcggacatgggataacgacgagaaacttctcgtggacgccgattggggcaactacaaggggtggccatttaacggggggagagttatcaaaatggtagaaagggcatgaccaaagatgcggctgcccacaatggctaacacaccgcaagataagggaaggcaggggaaaatgtg

SEQ ID NO: 16529 - DNA, 354 bp, Sorghum bicolor
  Clone ID: LIB3481-012-Q6-K1-F2
gcgtccgcggagaggaagtgcgcggtgccgggcggcggctgcgaacgcggaggcggcagcttccaccaatcagtgcagcctcatcctcaaaggctgttccagcagcatggaaaaagtctacgccgtcaacagtcctcataagaaaagaaaatcacagtatgagctgagtgatccaaagttggtaccacttaaatgcaagtttcgcaaacggttatcttgccacgatgatgagtctgcaaccacagaaagtttaggatatgattgcattttcatgaacaagacctctgggacggacatggtcagcatacctgaagaattggactcttgggagaacactatgagcctatttggtgg

SEQ ID NO: 16530 - DNA, 378 bp, Sorghum bicolor
  unsure (1)..(378): unsure at all n locations
  Clone ID: LIB3481-012-Q6-K1-F7
cgtccggagggcttgctagcttttaattgtatccatctctgttccacagtantgctggaagacaacagcataactgggacaatccctgcagagattggcaagcttagcgggctcaagaaactcgatctctccagcaaccacttgtatggtgaaatcccttcctctctgttctaccttgaaagcctccggtacatgtgagtgagcgctgatgcatatacgccaattctatcttgttgcgttctttaggtagctgcaacattttggtttaatttgtactcggtgtgcttgcgcttgtgtcttccagaaacctgtcctataataacttgagcggaccgatacccaaatcgtttgcagggacactctagtaaggatataatt

SEQ ID NO: 16531 - DNA, 461 bp, Sorghum bicolor
  Clone ID: LIB3481-012-Q6-K1-H9
gcttgctatccacccggttgcattcaggcgggcgtggcgtagaacttgctgtcgattgccaacgacgcgccgccagagcgcgcaaccgcctaaccgccgtgggtgcaccctgatgagtagccatacacgcgagatccatattcaacgcttcgacctggagggcgcctgcagctggatgtccggcatctgcgggccgcaccgcctggcgacaagcacgcccgagcgcctgcgttttcaccacagcgccaatgtgttcaagtcccgcgccaccaccttgggcgtgatcgagtacggcaccgatgtgaccattgatatcgaagacgccgagcacttcagcagctacagcctgagcctgccgttggtgggcgagcaggaattgagcaagaacggggagcgcctgagtttccaccgtgaccaaggcgtgattttgtcgcctaacagcatcaggtgctggcgatttc

SEQ ID NO: 16532 - DNA, 103 bp, Sorghum bicolor
  Clone ID: LIB3481-013-P1-K1-A1
cgcgtccgtgattacaccgggctgatcttgctgctccatactggcagcgtccggtggtgcctactactggagcatgtcccggagtgcagacaaaatcgactat

SEQ ID NO: 16533 - DNA, 435 bp, Sorghum bicolor
  Clone ID: LIB3481-013-P1-K1-A4
cgtccggttagagcctgcgttgttccaagctttgcgacctcgacggaccgacttatagcccttctctgaaagctgctagcccatcatacgcaaagtcatggttgctcaagaacacagtttctgtgaaatggtcgcggactctttcatccttaaaaacatgagcgactagtgtggtctttcctactgcggagggaccgacaattggaaggacctacactggttctttgacaccaccaggaggctgtgtgtgcagaaggaagtcgatgacatattgtgcttccatctggcgaccaaacatgcagtttcccagcaggagatgcatgctgtaaggctgcctgtacatgcggtggtagttcgccaagaacaggactagttcatgtgcatcaacaatcatggtgctcaaagtgtaagcaccttctgcatttctttgagata

SEQ ID NO: 16534 - DNA, 212 bp, Sorghum bicolor
  Clone ID: LIB3481-013-P1-K1-A7
cacgcgaccggtacgcgtgggcgaggacgctagctgctacttcccgttgcggcggtccttctggtcactgtttgggcatcgccatcgcgatggggtacgcggtcacgtgggtgagctatgcgcggctgagccaacacgcacggcaggtccatggagggcgacagtcatatgccggcgtgacgaacaaatctcaacttgatcaatccgaagtc

SEQ ID NO: 16535 - DNA, 464 bp, Sorghum bicolor
  Clone ID: LIB3481-013-P1-K1-A8
cgtccggtaaccaatgtgatggatttgatatttggcatttgatatgacaatgaggaccaatgcatctgggaccttctctgtttcttctgtttacttgttcgagaatgccagcattccaaagattcagcagcaaattttgctgaagtttgagagcttatagagtgaactttctttcggtgatgtaacattaaaattatgcaatttttcatgtttattgtacttatatgttgtctcatggtatgtccatatgagggccattgtatgttaatggacatgctataggtcttgtagtggggcgatttttcatattttcaacttgttcgtgtattttttttcttcttctgtcgtttaagtgttaccttgcttctgcctctccctctgaagaggtgctggtgtaattttcgagaaatcatgtgttgctctcaggccaatacaaatgaaaggtttcaattcatctttaaaaa

SEQ ID NO: 16536 - DNA, 347 bp, Sorghum bicolor
  Clone ID: LIB3481-013-P1-K1-B1
aacataaactctcatattgggtgcgactatggcagatggtgatgccgggacagaactcgctgaaacatacgttctgttacatatgtacacgccagctgcctttagtgatgaggagctaatcttagtccaaccaactattccactctatcatatagcctatgctgtggtactgtacactatggttggcttggatattcttcgtacagctcagaagtactgtgcataaacaatccagttgactggaggcatgaatacacgtgccttttgtggagatagttgcgcacgtctgcaatcattcggtttaccgacgtaaggaatttagcggaagaggactcacatcttgcaat

SEQ ID NO: 16537 - DNA, 379 bp, Sorghum bicolor
  unsure (1)..(379): unsure at all n locations
  Clone ID: LIB3481-013-P1-K1-B2
cgtccgacttcagcaggatacttatctagcattggcgacagcatttgttattttgagattgctgtatcatctttatccaaagataaattcctttgctagatgggcatggaggaggcataatctgttttcaaacttgatgggggcacatgaatatttcctcacctaccttgagcaagcaagacagaagtttcataggctgtacccttcaagttcaaagcgaggaaatttgcaggagggggcaatgaacgcgactgcttgggcttccaaatcattagcatctgtttcgattggagaaccaagtgctattggaaggacaaactctacaagtgaagctaggatgaagtgtataaccctnttttgtccacaggggatatatgta

SEQ ID NO: 16538 - DNA, 283 bp, Sorghum bicolor
  Clone ID: LIB3481-013-P1-K1-B9
cgtccgaccagagatgcaagctgaggtagagaggcgagactgtgagtggagatacaggagggccgggcggtcgccgggaacatacttatgagcgtagctcatgaagcttatgacattccaagggggctctctctatgcctgccgtgcttgactcgagaccgacgcacttgacgctaaccacaccgcctgtgaatgagactcagtcgtcgcccggagaatgcaccggacgatgattgatgccgccaacatgttctacaatgactgctgctgaagctctcagtga

SEQ ID NO: 16539 - DNA, 432 bp, Sorghum bicolor
  Clone ID: LIB3481-013-P1-K1-C5
cgtccgcagctcccgaagtcagccaacaaagcgcctccagccacaagagaactgaagtttggtaccgccttaacttacgaagctggacctggacgcggctgctatattcacccgctggaaggagcgtagaggatgtgaagagacggacacgaggttcccaggactgcacacacgactgagtgctcaacaagtactaccacgtccgtggccagactaaagagcacattgatgtgatgtgcagatggacagtcatctctgatactgcacatattgcctatgccgcgtcctgctgtgtgacacagacgatgatacagaacatcctgcgtgactgttgagatcaggcatatcacctctactgactcagtgtttctaaaacaaaggagcctacgaagtattgcgactgcgaccccggcaagaagcggaaggaaaagg

SEQ ID NO: 16540 - DNA, 317 bp, Sorghum bicolor
  Clone ID: LIB3481-013-P1-K1-C7
cgtccggaccagggcaggcagctacacgcaagaagctcgacttcgatgtgcaaggtgtacacaagctgtgaccaacaaaagtgcagcgctcaagattatccaccgtgcgcaccacgcattgatgtcatgactgccgctgtgtgaccaggtcagggcgtatatcgattgctggccactattgactgtcacgatgcacgtgacatgcaccataatggactgcaaatataactgcaaatgcctaatgcatgtagtgctctcagctgatagcagcaagtgtatgtgctagcgtgtctctacaccgtagaggtcacatatgt

SEQ ID NO: 16541 - DNA, 412 bp, Sorghum bicolor
  Clone ID: LIB3481-013-P1-K1-C9
acgcgtccgcggacacgtgggccaactcactctacttctacgatactactactagaactacatacagcagacatgctcccaccagatggccccatcaatacaacagtcttgctgacaaatactactcataccacacactactgatactaatacttaaaaacaagaaccatagatctataaaactaaatgatcatatataatatgatcaaagaggaaaacatgtacaaggatgatttgaataaattgaacattccaaatgttagatcatatacttacacagattcccaagataacatgtacaaactcattttctaaatactatagtagtcatagattcagatcctagtgtgcaaactattggtctagtttcatgtgatatgaacttcgcataggagtcaatatcaacagaatt

SEQ ID NO: 16542 - DNA, 396 bp, Sorghum bicolor
  Clone ID: LIB3481-013-P1-K1-D8
cgtccgtgaaggtggatttgggtctgttcatcgaggtgtccttcctgacgggcaggctattgctgttaagcaacacaagcttgctagttcccagggtgatgttgagttctgctcagaggtggaagttcttagttgtgcacaacaccgaaatgttgtcatgctgattggtttttgtgttgaggacagaaggcgtttattggtttacgagtacatctgcaatagatctctggattcacatctctatggtcgaaatagagaaacattggagtggactgcacggcaaaagattgcagttggtgctgctcgtgggctgcggtacctccacgaggaatgcagggttggctgcataatccatcgtgacatgagaccaaacaacatccttgtcacacatgattt

SEQ ID NO: 16543 - DNA, 455 bp, Sorghum bicolor
  Clone ID: LIB3481-013-P1-K1-E11
cgtccgcccacgcgtccgggcagcagaaaccctaggaagcaaggaggacggcggccgggagcagaaaccctagagtctctcgcacggcctgcgcatcctaaagttgacaatggctgctgttgtggaggtcacgtttgatgcacaaaaacatgtcaatgtctccaaggggtctattgttggtgaggatggtggtattggataccttgtgtaccccatgcccccagctggcacttttgacctgtccactgacaaggaattactcaagaacatcaatcaagagctcatcggttgtaaaggaggtgataacgcccgtgcaggcagcccaaagacactgcgtaaggcttgcgagaaagctgttcgcagggcctttctggcctatctagggcagtaaatgcatttgaacattgtctcaaacaattcttgagtatatggtgaataacacgtattgatatgtg

SEQ ID NO: 16544 - DNA, 348 bp, Sorghum bicolor
  Clone ID: LIB3481-013-P1-K1-E2
cgtccgatctggataaggtcgagaatgtgtcgcagtgcccagaactgaagcatctacattcggactgtagtatgagcacggaagggcagcatggcacgtttcgcaggaccgccacaagagtctcgctgacgtgtcggttggtgctgaaagtccacaaaaagctatttaaaatctagaaattctgattatagccttaagcaagtatccgcaaaacaaaacccgaaaggaaagaaagcgttttctggtcaagaatcccaaagagcggtcgatcccagtttctagaaatcgacaacgagaaggaacaagaaatcgctgggtatgatgtacgcgtccgagatgatgctgttt

SEQ ID NO: 16545 - DNA, 347 bp, Sorghum bicolor
  Clone ID: LIB3481-013-P1-K1-E3
cgtccgcagcacgcatgagcatcacgagcctgaataagtctatgggcgtgatttacacgaccgccgcgggacttataatgagggctttgtccgcgatgaaggatgccaccgatcttgaagccgagatgaccgtcgtacacgacgagagtcataccatggatgccgacagccagtttttggcgtccatgtggcccgactacgacaaggtagtcaagttcatatctgtttcggcttacggtgctcccatgccggccactgatatgtactcaccacaggtagcagttgtgtccgttcccttctgcgaagagtctgctatcacccccgcagacgaaaccttcgatggaaaa

SEQ ID NO: 16546 - DNA, 150 bp, Sorghum bicolor
  Clone ID: LIB3481-013-P1-K1-E4
cgtccggcttcctgcaactatctttattgagggttatggtggccgccttaccattcaacttgccaaggagggtttcactattggttgggtggctttggtcaaatcttggttgggctattttggccaatttacccaattcttgggggccaa

SEQ ID NO: 16547 - DNA, 539 bp, Sorghum bicolor
  Clone ID: LIB3481-013-P1-K1-E5
cgtccggcttgctgcagctatctatatggaggataatgttgtcggcattacaattcagcttgcacagaaggattacactattggctgtgtgcgagaggacaattcttgcctggcatatagtgtcaattagaccaattcatcggtgacgtagcatactagctgcactgactctacaggatctgcgaattgcaaagggcgctgagacagtagttgagtcgatcatgatattcaggaatcctgcgtccataacaggaatgctcgtgtacactctcacggttataggcgttattctttacagagaatacaagacgcgcatcaacaagccatgaacaccctagaagacagtaaatatggcaatcattgctttgtactgtcagtgcctacagctaatatttgatgagaaatactacggagtcgatcacatacaaatcctaagccatactgactcagcaagtggacatcgcggatagaagtccaatactacctgtagtatatactagacatgacgcaggcatttagttcaatggcgatgatggata

SEQ ID NO: 16548 - DNA, 285 bp, Sorghum bicolor
  Clone ID: LIB3481-013-P1-K1-E6
aaaaaaaaataataataaaaaaaaaaaaagtgggtggccttgacgggccggcccgccagcagaaaccctttttggcttgtttgggttggcccaattttgggagggctcggggggtcattcccacggtttattacataaaaaccctcctaaaacacttccaccggtggttatggccctagctgaggcattcaaattggttgataacgcctttttgcctttcaggatttgtgcacttttagctcacttgtaccctgccgaaaacatggatttagttgtactccttta

SEQ ID NO: 16549 - DNA, 361 bp, Sorghum bicolor
  Clone ID: LIB3481-013-P1-K1-E8
cgtccgcgttcgcggaccggcccatcaaggagtccgcgtacgggctcctgttccaccgcgcttcgacctgcagagcaccaggtccaggtgcgaccgcctcgtcccgctcgtgaaccgcttcgtcggcggcatcatcgacgagcaccgcgcccggaacgacctccggtccgctccaccacacgccgtcatggacttcaccgacgtgctcctctcgctgccggccgacgacaggctcaccgactctgacatgatcgccgtcctctgggaaatggtgttccggggaactgacaccgttgccgggctgatcgagtgggtgctggcgaggctcgtgctgcacccctgacgtgcaagcccgtgtcca

SEQ ID NO: 16550 - DNA, 325 bp, Sorghum bicolor
  unsure (1)..(325): unsure at all n locations
  Clone ID: LIB3481-013-P1-K1-F4
cgtccgccgccgtgccgatccacatccacgccatgggtctctcgtcgatctgttgttttccgcttgtttttcacgaatgtgtttgtttgtagtatgtgtttggtactggtactagtaggccgcagctagctgcaaacctgcttgtagcatagacaagagttttttttttttttttgttaatagatggcttggtagctagtagctagtagcatagagcatagggactgtgtagacgagctctagacatctggcgctgtgttgtgttttgtactattcaaatcaggaaatccatgtgaattgcacgagctgtggtnnaaaaaataaa

SEQ ID NO: 16551 - DNA, 322 bp, Sorghum bicolor
  unsure (1)..(322): unsure at all n locations
  Clone ID: LIB3481-013-P1-K1-G10
gcgtccgagacaacacataaaatacaataaccaaggtaggcgtaagagtacagcgccgagaggttcttagagccacataacttgataacgggcggggcgcgtttaaagtgctaggctggccgcttggnctcttcctcacgtcggcctgtacgagagcagcgtggaggtgcttcacgtgccgtacattgtcccagtggatgtgcggcgggctgtccgtcgttaggtgggtggaactcctcgacggccccggtttattcctctacgcgtatatgcacggaagctcccttgccataatggcgagcgctagctactacgtcgcctt

SEQ ID NO: 16552 - DNA, 210 bp, Sorghum bicolor
  Clone ID: LIB3481-013-P1-K1-G11
cgtccgagccggcggagccatggcgaccactctttcgttatcctctcccctcttcctcggagctccggccagagctagagatgcaatttcgtatggagtggcttcggctagtatatcaccaaccactgtaaatgttctaagcaagggctacacgagcagggttcctgttcgggagcaacaacgacgaatggcgatagtatctgtgcttgg

SEQ ID NO: 16553 - DNA, 208 bp, Sorghum bicolor
  Clone ID: LIB3481-013-P1-K1-G7
cgtacggaagaaggaggagtgtcaagcggaggtacgccgactccgccgcaagctgtaagcaacattcctagctggatctttgtgtgcaggtatccagtgccgagctcatccgcatcacgctcactctcaacttctgctggtgggccaccgccgccatgctcttcggctacgtctgctggagagagtgccccgactcttaggacgggtt

SEQ ID NO: 16554 - DNA, 372 bp, Sorghum bicolor
  unsure (1)..(372): unsure at all n locations
  Clone ID: LIB3481-013-P1-K1-H3
cgtccgaagagaataaaatttataaaaaaacacncttttacaatataagtaaacctgaaagactacaataataaaagataaaaacataaatataaacgggtggttagataaccatgcgatgttgagttctttcacatatttttaaataattttttatataacaaacaatagctttaagctggaaactctaaaaacggggggggcctttttggaggtgcccttttttcttccccgttgcgggcctagaaaggatcttatttgtggggcacaatattgtatttagggtgcagggttataaacccttaggggggagcaaactccaggtcacagcccacttattttgagattcgagnnanncccttttgcccgggg

SEQ ID NO: 16555 - DNA, 343 bp, Sorghum bicolor
  Clone ID: LIB3481-014-P1-K1-A7
acgcgtccgagataagatcgggccgaccatggccgtgctgaggctcgacgtccaacggaacatcgagaggctgcatgagctgtacctgttggacccagtcaagtactctaccctaacggaggtagtggagaaggaagtcaaggagggcactgcaaggaaggtcgatagctgtgcaagggctgacctgtggcttgctagatccatggactacacaattgcgctggtagtgagcatagaagaggactctgatgagcatcagcagcagagcctcgcgcagcttgacgaagacccgtacgaggcctgtctgaagccatggcatggctggatctcttcggcggactgc

SEQ ID NO: 16556 - DNA, 455 bp, Sorghum bicolor
  Clone ID: LIB3481-014-P1-K1-B11
cgtccggaggtgatgctgaggaaaatggtgaggaagatgaggaagatcccgaagaccaggagggtggtggcggcgatgacgatgacgacgatgacgatgacaatggggatgatgaggacgacgacaatggggatgacgaggaggaggatggtgtagatgaggaggaagacgacgaccaggatgaggacgaggaggaagatgatgatgaagactcactccagcccccaaagaagaggaagaagtgaagatcttcgctccggctttagttaccatgtgctgagttctggctcgcttttcgtcatatcctcgcatttgaactttcccttagagagttaagaagggcttgtaagagctttatgatttgatgaggcaattagggagaactctatgtcattgttgcttgcttctgtggagttgaacagatgtttcgctaacataattcaacctgagtgatg

SEQ ID NO: 16557 - DNA, 491 bp, Sorghum bicolor
  Clone ID: LIB3481-014-P1-K1-D2
cgtccggaacaggaaacgatttcgaggaaaacctcacctgcgtggccgcggcgacaaatttccagcgatgtcagcggcgccggctgctagcccatggttacggccgtctccaactgtgcggctccgcgaaacggcctccttggcttgtagcatcagctccacccctacgcggctctgcatcggacgacgctgctcggatagaacttttgtagggattcaaaccgcaggttccgacttgagaagatccacgattgcccatgttaaaagtggggaggctgatggatatccaaaaactgaggatctggtggatgaagatactctgctatcaaatttagacagagcaatcaaggaagaagattatgcccgtgcagcgaagatccgggatgatctgcgtatcctccatgaggatgctaaagcttcgctcctagcaagcaaatgcacggttctacaatgccttcaagaatggagatatcgctgcaatgtattctatc

SEQ ID NO: 16558 - DNA, 338 bp, Sorghum bicolor
  Clone ID: LIB3481-014-P1-K1-E1
cgtccgcctgaagtctctgacagtgcaagcttactaaaggcagaatggctagaagctttcgaggctggatcaagctgcatccacgctggcgcacacagtgtagctgacaaggtctatgtgactctgcaaccaatcacacaacttccagatggaggcgtcacaaatcttccagatggaggtgtcataaatgttccagatggtggtgacgattgttttgatataggtgagatgctcagtatgatggaagctcatccacataatgaacgtggagctcacgttcgcattgggcagccctggagactagatgggctcgattcgagtgtcctggagagcatgct

SEQ ID NO: 16559 - DNA, 270 bp, Sorghum bicolor
  unsure (1)..(270): unsure at all n locations
  Clone ID: LIB3481-014-P1-K1-E10
cgtccgcaggcagcagatcgcctcgccggccatggagagctgggcgacctgggtggggaccagcgtcacctccgccttcttcgcctccctcgagcgctgctcctgcatcaacctctccaccgacgactacgactacgactaccgcgaccacgacgaggccaaggaccgccccctcattcttgccgncgncccccggcacgacgacgttgccaagcccgatccagacttcttccttcccggccccggtcgcaaggaccagaagcaagagca

SEQ ID NO: 16560 - DNA, 350 bp, Sorghum bicolor
  Clone ID: LIB3481-014-P1-K1-E6
gcgtccggttgcattgcaaaaaaaaaaaacttacacaaacaaaaaaagcaagcacaaattgctgaatacaaaaataaaaaacaacagcataagaggagccggcggaaaaaaacaaggggctgtggttcataaaccaacgtgcaaacgggctcggcctttttatgaaacccacgtttgattactcattcttgacactcttatactttttttaatgtgaccccaaagtccatttcaatgcccccggtatgaaacccttgggccttgaaaactcctgctttatccacattaaatcccttaacaaaaaatcctcctttccaatctatctttaaaatcaaagagctcccaactaa

SEQ ID NO: 16561 - DNA, 284 bp, Sorghum bicolor
  Clone ID: LIB3481-014-P1-K1-E9
cgtccggacacaatagaaccggcggatcgaccggttctaaacagtaggaccaatggaccattgaaccgacggactggccggatcgattttcggagcgggactaataactgtgcacatggtcctagtcgcatggagggatagtgagtaacgagtacgatgcggtacgcactagtacacaagggccgatcggacgagccaaacagcatatacagctccgcgggggaggctcatgcatatacaaagtcgaacgcctacaagaagatgtgcgaatacacgtgacatac

SEQ ID NO: 16562 - DNA, 298 bp, Sorghum bicolor
  Clone ID: LIB3481-014-P1-K1-F1
aaaatgtcagaggccgacttgcgtgtgattgggctatggccgagcctcgtcgtgatccgtgttctgctgcccctgaggcggtgggttcttgggtttgagttggtgcaggaggtggtggtcaagaagagctggctgctgctgaggtcgtactcggagcacatgaagattcctgttctgcttcaccacggtaagtctatttccttgtttctcatcatcgtccagaacatcaacgaggtttggtcctctgacacgctagcttttcttctgtctgtcgactcttacacccgtgccgttcttt

SEQ ID NO: 16563 - DNA, 320 bp, Sorghum bicolor
  Clone ID: LIB3481-014-P1-K1-F7
cgtccggaagccatacgcagtccgcccctgggacgcgagcgccgtcagggagcctaaagtacgcatcagtttcgtcggttcagggggggagatgtgcttggtctagtgtagcgcctctcaccatgccgccagctcccaagttcggcgacgccctcttagccagcgtggatcgcgtcaatgccgagctgattaccctcacgtacggtgccatcgtgcggaatctgctcaccgatctggaggaggtcgaggaggtcaacaagctagactatcagatgggtgacaacatgtgaacgcgatgtgcttatgagttcttagcatag

SEQ ID NO: 16564 - DNA, 373 bp, Sorghum bicolor
  Clone ID: LIB3481-014-P1-K1-G11
cgtccgcgaggattgggatccccgtccggttccggatcggaggcaacactccagaagtagctgtacctgactcgatcagcgtgtttgtttgggcgttgagtatcagggatacaagaacgtacaatctaggtcaggtatcgatgctaagcctagccagaggagtggcaccactgcagacaccttcattgctgacctgtaagttgacctggctaccgttcaaatcaagacaggagctccctgccagtcttagcgcctgtccaaatacaaccagctcctgacgatcgaggaagagctcgatgatgccttagtctaccacagatcaaagctcacggcaccagtggagccctactaaaccacgagagcccagagtctt

SEQ ID NO: 16565 - DNA, 426 bp, Sorghum bicolor
  Clone ID: LIB3481-014-P1-K1-G2
tcgacccacgcgtccggaaaagttatcctcagggaaaactaaacctagaaattttcaatatgaaactgctcaatccatttacatttacacattagggtggttgttgtctgagccttttctgcatatacagcacctttacaaaatttatttcatgccaacagcaagaaagtttgcacgtacaaaaagaaagagaaccatttcctttccaaatgaacatataccaccttgtttagttaaatttattttattcagtaggctctgcccctcctattccctcaaaaaaaaaatgcatgattgttggaaacttaaaagggttaaaggatattgctcctgtgttaagttttcacaatcatgagttgcaaattacattgttttggaaccagtaaaacattactggacataaactggatgctctctaggagatgc

SEQ ID NO: 16566 - DNA, 441 bp, Sorghum bicolor
  unsure (1)..(441): unsure at all n locations
  Clone ID: LIB3481-014-P1-K1-G3
cgtccggagcaagccttgtcttcgaatgcagcttccgtagctggcaaggtacatttttagaggtaaaagggctatgttcagcaatattacttttatggttaattctgcactgaacttttacagccattttttgttacgaatgatgaacctatggaaacatgggagtttatgaattgcattatggaagccatgggttgtcagaggcccaggattaatcttcctgccaagatgttaacgtctgcagccttggtttccaaaatgattcatcacaggcttggttttcaaatgctttccacccctcttctccattcagatacaatatacttcttgtcatgcactagaacctttaacacttcaagagccagaagattacttggataccacccgattgtaacattggaggatggaattatgaagactgntgggtcatttacagaacta

SEQ ID NO: 16567 - DNA, 470 bp, Sorghum bicolor
  unsure (1)..(470): unsure at all n locations
  Clone ID: LIB3481-014-P1-K1-G8
cgtccgcggacgcgtgggatttcctgggcatcaaacgaagtgccaagcctggaagcttacctcctccagtcccaaagaaaccgaagaactgaacctgctctgccattcactctgagtaggaatcagccgacctgcttcagcaggctacaacgcattcactgtgaagcaatcagcccacttaacacattcgctgtgagttgcaatcagcccacctgcttccgcaggctacaacaggtccagatgcctacacggcatgctgaagccccagtgcactgaaaatgcaatagcctgtacatttcttctaagctggtcacactaacgttctgacatgttcgatgcgattttgtaagtgatactagtgcatccttgttctggcaaacacagatgttgaacatttaagtgatggaactaaatattggtctcgcaacacaccaatnttggtttggaataaacctgtaagttatgatgtc

SEQ ID NO: 16568 - DNA, 488 bp, Sorghum bicolor
  unsure (1)..(488): unsure at all n locations
  Clone ID: LIB3481-014-P1-K1-H10
cgtccggtgaatctgctgtggactttgttgcaaggaggtgccggctcgctttccttgacacagatgctgctggtagagcattgccccgaatcgttgaaattttagcttcagagcacaagtgggacaaggcaaggaggaaggtggagctgcagaagggtagagagttcttggaaacattcaagtcatctaagaatgcccaattccgtgatgggaaacataatggaccatgaccgaatacactgttttttggtgaataagcgtggatcttatacacaagttctcttgaacaagcaggctccgatacaagagtgagcccgtgaatgttgaaagngtcggtttccacatttccacgcatggctgtgaaatcgatgtcctgacttccagcagaataacatgtggtcacggcactatataattgtaaatgccccaggatattagtccaacttaaaaataaactggaatcagagaccaaagatttcttgctcctc

SEQ ID NO: 16569 - DNA, 286 bp, Sorghum bicolor
  Clone ID: LIB3481-015-P1-K1-A3
cgtccgcggacgcgtgggtgcttggtcaatttctgctgttgaattcatagctgaacctgcatgtatgtgtagtagacacttccgttcaatttagtgatacttgttatccatccaccttcggatactctgtcggtcccaaaatgagttcaattctagatttgaatcatgttataaactttcttaaatttggccaagttatagaagatagtatcaatgtttatgtctctgagtaggcttactatgccatgattaacctgatgacctttaaattgtttttttactcttc

SEQ ID NO: 16570 - DNA, 363 bp, Sorghum bicolor
  Clone ID: LIB3481-015-P1-K1-A4
cgtccgtcttgattctctatgatcagtagcactcacttgtaccagcagttaggaatgacgtgtgcataaccattactgagcaaaaaatataagagaacattttgacacaaattatccttatgaagtgtacatctatgccccaattgaaaagcttgtcttgtctttaatcttgtatatgtaaatgttctcttatcactgatttaatagtcgcaagtatgaagataagtaaactctatgctgccccctttttttgtagatcatcatgcacatgatcacactcatgatcctggtgtttcttctgtgagcattgtttgcgaaagggagatggatcttgaaaaggctgacttttggttgggaacctac

SEQ ID NO: 16571 - DNA, 331 bp, Sorghum bicolor
  unsure (1)..(331): unsure at all n locations
  Clone ID: LIB3481-015-P1-K1-A5
cgtccggacgaagccataccaaacgggttagtcacgctaactaacggcatcacgctgaatgatctctatgctcgtcttgtgagacatgaggagggtcagcgcatcaacatccacaaaactgatctatggtggagatgcgacacaacaagtgatgagacacaggatctgctatctcctcttccatcatcaacgtcggtggagccagtatgcatatccggnggctcgaatacgggctcacgattccaacttgcaggaaaaccgacgaacgctgctcgctcggcttggggcgggacgggttcacttttgcccccacgggtctcgggtttggggc

SEQ ID NO: 16572 - DNA, 155 bp, Sorghum bicolor
  Clone ID: LIB3481-015-P1-K1-B4
cgtccgacctgcgagcatggcatcctagagccgaggggtgcctacagctctaccacgagctgctatacggcgacccgctcactgttgactaggtccatgctctggagccatttgtcaacgttctttgggcagccaccggcaggtcagtcactaaa

SEQ ID NO: 16573 - DNA, 219 bp, Sorghum bicolor
  unsure (1)..(219): unsure at all n locations
  Clone ID: LIB3481-015-P1-K1-C4
acgcgtccggttttcatcatggcgcctctcatactgccctttttgctcgtgtacttctgcctcggctacttggtatatcggaaccagattctgaacgtgtactacccaaagtccgaaatggggggcaagctgtggccgatcatgcacaacaccatagtgttctcgcttgtcctcacgcangtgatcgcgctcggcgtcttcaccatcaagcactcccct

SEQ ID NO: 16574 - DNA, 327 bp, Sorghum bicolor
  unsure (1)..(327): unsure at all n locations
  Clone ID: LIB3481-015-P1-K1-C7
aaaaaaaaaaaaaaggacaaaaactaaaaaaaataaaacgggcggtcggtaaaaaaaataaaaataatattaaacacaccggaggaggggagtatgatcacgaggacagccattgtttcattacgtggccaccctggtgggcgggcttcctgggcacctaacctgtccgtcccggcccccgttaacgggcggcatggtgtccggttccccttcttctagccggaaatggctgttggccccaacaatgttgtcaanatttctgttcccggccgcttaggtaccccggcgccgtggtgcccgacttcttttagggcacgctggttgggg

SEQ ID NO: 16575 - DNA, 265 bp, Sorghum bicolor
  Clone ID: LIB3481-015-P1-K1-C9
cgtccgcttttttttttttttttttaattctcttacatcacaagacagcacggattgcacatcgactcctatattttaaacgcactcgagctggaatctactatctgatcctgcactgccaatcatcataattgccccttataccggtctctcaccttaccgcatattctttcatcatagactagctcaaaaagaatttggagctcatcttcgtccatccctgttcttattcggttgcataaatagcatgatggactttatctat

SEQ ID NO: 16576 - DNA, 296 bp, Sorghum bicolor
  unsure (1)..(296): unsure at all n locations
  Clone ID: LIB3481-015-P1-K1-D10
cgtccggtggaangcggcagtgtctgtgcatccaagcggagtaccacgtacgcaacgagcaccggcgagcagaacagcatggccactatgagaccaagcattaggcgccaagagcacagacacagggtgccgcacggttactactggaactgaaactcatgcgaacgatcgatgcatatgcacatgcggatatgcagatcgacatcgacgaagctagcataattgtcctatggactgctacgacgactacatactgctgagtaatagacaacctgcgggagtgctactactaacta

SEQ ID NO: 16577 - DNA, 423 bp, Sorghum bicolor
  unsure (1)..(423): unsure at all n locations
  Clone ID: LIB3481-015-P1-K1-D5
cgtccggctttggaagtgtcttaggactcctgtttgcccctcccatcattcagaaccttggctgggagtctgtcttttacatatttggccttcttgggattgtttggtaagcagatatttctatgtaggtaccaaataatctattgtgagtgaactttattttctgttttgtctgcaggtgcttaggatttgaatctcttaaagtgcaacggttcggtgacaaagaaggcatattaaaccttggacaaagttctactggatctgatggtcttatctcatccgccatgtcttcggaatcatcacactcgtcattggaagatctgcaaaattcactaanaggatgtgccttggggagcatttttcaaaaagcaaaggcagtgtgggcaatgatatatgcacaacttttgggtgaagttgggggca

SEQ ID NO: 16578 - DNA, 370 bp, Sorghum bicolor
  Clone ID: LIB3481-015-P1-K1-E4
ggggcggcggagtacccgaccaacaaaggaggggcctcctcctactgtcagcagcagcatcataacaccaccagcagccgccgtggtgacgacctctatttctaaaaatgattctcccccctcttctgatgatgactactacacaagatgttcttcagacgacgacgacggcgttattaattcaccaccctgggagaagctggtagccttgctccattaacttgacgtccatgaggggaggtcattgtttttacttgttggttgccaccgggtgatgaataccatcatgtgcttgttttttggctcctcttcatcaattaactcaatatattatatactacgcgtcgctaatcaaaaaaaaaaataaagg

SEQ ID NO: 16579 - DNA, 525 bp, Sorghum bicolor
  unsure (1)..(525): unsure at all n locations
  Clone ID: LIB3481-015-P1-K1-F1
cgtccgcggacgcgtgggtttctcgtctcagcatgacaaggcatgcattgttccactggtgaaggaaaggaacattnggacaaacaatcatggtcctactacaaatcatgattggtgttattctaaggctgcaaatgcagcaaaccaaccatgtcatttacatgtgtggctgcatgtatgacaggaaaagaagcagatggtgaaggtttcgattgtccaatgcatgattctttgattccatatcatcaactcctcaccgacgcataaccatgctaagatttatcagagttatgatcaatttgtcataggttgtgatggctggttgctgccaaaatggaggtggctctgctcatttcacctctctatatcccatgaatgcaattgtaaaaagtgtagagctgataggaaaaggcaaacaacaaatatttaaaaagatgagtgaaatgatttgntgaagtgctgaaatctcattgaaatgaactgtgccgaggatctggagccgttgtcgatataatacataatatg

SEQ ID NO: 16580 - DNA, 279 bp, Sorghum bicolor
  Clone ID: LIB3481-015-P1-K1-F11
cgtccgagaggataaggttgctgcttctgctgagctgcctaagaggacccctacgctcaatgaaaggatcctctcttctttgtccaggatggctgtagcatctcatcaccggcctgatcttcgagatcggtgctggtgctcctgctgcattcaatgtagccggcgggaccacctacggtagccgagttcattattggctccacaagaaaacttggccgaataatggtgcacgagctcttttctgatgggcacaatgcccgcaccattacagggtcattc

SEQ ID NO: 16581 - DNA, 345 bp, Sorghum bicolor
  Clone ID: LIB3481-015-P1-K1-F2
tcgactcacgcgtccgaaaaaaaaaaaaaaaaaaaaaaaaaaaaaaaaaaaaggaaaaacaaaaaaaaaaaaaaaaatagactaaaaataaaaaaaaaaaataaaagagtagggggaaaaaaaaataaaaaatataattaaaattgggggcggccgttcgaaattaaaaactgggtttaacttggaaacgggtttcccattttaagaggggaaccccctcctccgggttttaatccttttaaccctctttggccccattggccttttggggaaccgagggcgttttttaaacaaggagttaaccggcttaaaaaaggccgttttcaaacccggaaagggttttcg

SEQ ID NO: 16582 - DNA, 273 bp, Sorghum bicolor
  Clone ID: LIB3481-015-P1-K1-F9
gcgcgtggcgcacccacaccatctctcctccccctccccacctacacctctcacccgcgaaggatcggctgcggcggcgagcgccttccctgcgcgaagtccacccggcggcagagcagagcctccttactgacgatgaggacatcgctatcatggaagatatgccgatgaggccgccgcatccggtcccaacgatgcagcaccgcagcccctcatctatagcgcgcctacctccctaaccaatctaccggatgaagacctgttctctgctgc

SEQ ID NO: 16583 - DNA, 162 bp, Sorghum bicolor
  Clone ID: LIB3481-015-P1-K1-G5
atagactctgggatttcgtggttgaaactctgaaccattgttcctactgcttaaaagaaactgggtggaccaaatctgtgtggattttgatcccatgctgctttgctcgactaggaatattggctttgatgggttatttctgtgggccacacaatttctttt

SEQ ID NO: 16584 - DNA, 377 bp, Sorghum bicolor
  Clone ID: LIB3481-015-P1-K1-G9
ttcccaattccccatccacccggcgtgcgagctcaacaccattctcctaatgtacttacacacacacgaccactcacgaccttgtcccatcacacacgcatctccccacccgggcctgccatctacctggccggcacctcgtacacctactattctctcactgtcagactgaagagcatcatgctgctacttctctcgctccgaagcatcgaccactccgctgtcggcaaatccgtcgatccacatgatgataacgatcatctaaacaaacgatttgagctgctaccaaaatagccatcttgataataaatattcataaccaataagacattcactatccttgaacacaaatctagtccatccatcactaacttcta

SEQ ID NO: 16585 - DNA, 343 bp, Sorghum bicolor
  Clone ID: LIB3481-015-P1-K1-H10
cgtccgagctcccatacctaaactgatgtcaatgccgatgcattcaatggctaccttccggccgtcaattctaggccggtcatatcagcaggagcacgatgtggtctgggatcaagcaaaagctaacacgcataaaacaggcaccatcaaggacctagatgggacaacagtttacgacacagtcaacagagaacacagtgcgtatccaacgagacagacgtcgcatgatgtggattaccctgtagcgtgtctgttattcataagggtgacgggcctggttagcgtgatactgaatgacaacaatgtctaggcacaaatgtcttgctgtccacaggtctgtgat

SEQ ID NO: 16586 - DNA, 519 bp, Sorghum bicolor
  unsure (1)..(519): unsure at all n locations
  Clone ID: LIB3481-016-P1-K1-B10
cgtccgcccacgcgtccggctcatcagcatcagttcaatttgcatgctgcattggatgttgctcaggaccttgcatggtctactaatgcaatgtttctgagatcagttgatagattcagtgacttcgtcgtgtctgtatatgtaactgctggtcataccagatttatgttgcttcatgactcacggagcgatgatggaataaagagtttctttcaggaggtccatgaactttacatgaagcttaatattcagatatagttcatggcttttcctggttatttactctgagatgactgcgatgcgatgttacaaaattttgcacctacatcattggatatcttttctctgtacaatccaatattcttcatcctttccttcttctgacattatgggcttttctttgtgaaacttttgctgtgcaaatattcctcaatccgctctacttgcctggttctcgcatcacatcttcctatnttgataccaaggttaggacgctngcaaggaaatacctttagcatg

SEQ ID NO: 16587 - DNA, 344 bp, Sorghum bicolor
  unsure (1)..(344): unsure at all n locations
  Clone ID: LIB3481-016-P1-K1-B12
cgtccgtactgatgctntcattcctgacgcggaaagctgaatctctgcttctccctgcatttcacgcactccaactcttcactgtacaccgatctgcaggactctgcttcatcatacgggtacacatcatcgntcaaaaaacatatataatgagcacctaacttagattgtggcaaattttggcaaagatcagacccttgactttccgtggtcttttgaaaccactgaaagcaggagatgctgcatcatggatcagactagagactttttctgcatcggtcaaccagcttagtggcagaacgaaaaatgcttttgaagactctacttcatcatcatgttacaca

SEQ ID NO: 16588 - DNA, 165 bp, Sorghum bicolor
  unsure (1)..(165): unsure at all n locations
  Clone ID: LIB3481-016-P1-K1-B3
gtcgacccacgcgtgcgaccgcttnctcctctcctccggctccaccccgtccncgcagcgtcacagggctaaaaacctgcatcgccgccgtgcgcgctcagcgccgcgcagcccgcgcagatggaacgcatgggggaggttaaggtcgtgaagctgcgggcggtg

SEQ ID NO: 16589 - DNA, 285 bp, Sorghum bicolor
  Clone ID: LIB3481-016-P1-K1-B5
cgtccgagctgctgcggtggcatcagggcgctcctctccctccaggacggtgcacctgacaacttccacttgttgaggactgcgtcaagattggctgcctgccaagatgaagggaagaagagaacgcttcgggccgtcgatgaccaagctcattctagagaggggcggaatggtctgggacctagaccatattctaggaggctgccaacggacccaagctgcgggcacatactctgaagggagcctacaggagttaagttggacacacggcactcactatatata

SEQ ID NO: 16590 - DNA, 570 bp, Sorghum bicolor
  unsure (1)..(570): unsure at all n locations
  Clone ID: LIB3481-016-P1-K1-B6
atccagcaagaagatacaatccttatttccttgacaagggattggtctctgtctgccattngtcccaatctagctcataatggtactgtgcatgtgtgctattgattgtgaagaaaagttgattgcatgcattcttgggtttcacctgttcatttttattttattttattttattttgattcatgaacacttaaaatagaggctgggctcctaccctactaaactagtgtatgttgctactgcattgaatttgctcgtatcatgtgctaccccctctttgcttttaggttcaatgaacaaagagattgggtcttgcaaaatggagcataggctaaatgatgtagatattctntaggaatatgcagcccttcaccttttaaactctatattggcaaatacaaggggagcattttcccacccttaaacatgaaacaaaaagaacaaatgagagatgtcttgttctcaattttgatttatataattgagcctgatgattggtcccatttcaaaattctacttcctgtgtctatcaaaagattttattttctttaataagttggcagtacacat

SEQ ID NO: 16591 - DNA, 144 bp, Sorghum bicolor
  unsure (1)..(144): unsure at all n locations
  Clone ID: LIB3481-016-P1-K1-B7
cgtgcggccatggaagcgtnctgcgtacccataccgccctctcctccaggcagctcgtcggtggagccaggcgcacgctggcagcggccacacgcgccgcaccaagctggcgcccgtcagcgcgccccacggcgactggtgccg

SEQ ID NO: 16592 - DNA, 207 bp, Sorghum bicolor
  Clone ID: LIB3481-016-P1-K1-C11
atgctactaccatgggcaataatccaagaagaactcgaaggaggctatattggctctggaggcatgtaaaggcaacaagtatacttccatcgatcgacaagctataccactaggacaggagcaggttctggacgaacatgcaacagaaattgccgatgagacggctcctaaaaggttatagcttgcacgaggcaagctccaaaagct

SEQ ID NO: 16593 - DNA, 237 bp, Sorghum bicolor
  unsure (1)..(237): unsure at all n locations
  Clone ID: LIB3481-016-P1-K1-C7
gatgtggtgctgcagtaggcttttgctgggaacgggagtccaagcaggaacactcgtgaggtatgatcgagactgaatgtacataatgcgggggcgtcatttgggccggaatattgtccgctacgaatatggtgcacagattctgtatttgctgtatctaacagagcagagaagccgccatgatcgaataattagagatctgatacangggtgtcttgaaatagttgatgacgaact

SEQ ID NO: 16594 - DNA, 465 bp, Sorghum bicolor
  unsure (1)..(465): unsure at all n locations
  Clone ID: LIB3481-016-P1-K1-D10
cgtccgcggactcctctatactgcattcacgcaccgttcttataacactatcgagcttcgttacgacatcgtgtctaatgtgaggagacatatacgttaacatatctcgcaaggaactgcactatctatacaagcatgtgatcgctgacatatttcaggatgaactggtcactgcgctgtaagtattgttagatcgaccattagttgtctcagacctgtgcaaacattttcttcaactttacgactcctaccatnggcttaaatctgtttttctgttgctgtagacttttgttgatgctgccatggtccatcttgacatagacgaacatgcttctaccttagatggctcaatgtatgagactgactaggtttgtacacccataaaggctgtcagctgtcatgggttgtgaggctactaattagttagacttgtagtttggattagccatctaatgagtactgttc

SEQ ID NO: 16595 - DNA, 152 bp, Sorghum bicolor
  Clone ID: LIB3481-016-P1-K1-D3
caactaacaatcacatcctgaagatctttatgctatagtagatataaattgcttcaatgggagccagatcagatcattacgagccgggaaaaaccatcacggaaccgattatacaatggtactcttcaataccacttttcgataaatgcaat

SEQ ID NO: 16596 - DNA, 399 bp, Sorghum bicolor
  Clone ID: LIB3481-016-P1-K1-D4
cgtgcgctctcgaactgatggacctcttgaggttatgaacgcattaactagggctaagccatttgtcagactctgggccgtggaactttatgcaactatgctatccaaggtaagacgttatggagtgagtgataactgcgtgcacgcgctggcgaacacggatcctgtgcgtaacaagttctgaagtgaaagttgttggctgatcgaaagcagagatctctatagccggagattgattcttgctataacaaggagtaatacatgctgcttgcattgaaacgtcgcaaggttggctaattcatggtagatgggcgctaaatgcaatatccggaggaaaagaatcacctattgtggactgtgaagaatggaatggtcacccgatggtaatgggtggtcata

SEQ ID NO: 16597 - DNA, 586 bp, Sorghum bicolor
  unsure (1)..(586): unsure at all n locations
  Clone ID: LIB3481-016-P1-K1-E1
gtcgacccacgcgtgcgggtgcatgccagatggattggggcgccacctatacctgtggagcaattacaattgcaatcactgattgatgcaatcaaatntatgattgatccaaaggtaaaggaacgagctgttcagctagcaaaggcaatcgaatcagaagatggtgttgatggngctgtaaaatcctttntaaaacatcttccacagaaaagggattccgaggcaacgccaactgcaccacagtcaacattcatgcaaccgctgcttctccctgtaaagaggtgttttggcatggcatcctaattcctaaccccgcatttccaagcacctgctttggctttgtggcaagtggcatcaccggtccggaacaagttgcgccacatgcttaggagaaggggaagtaccaacatgcgtagccagtcgtttcatcctacctataaagattaaagaatgtagaggcctgtttggttccccttactaaattttaatcagctgtgactagtggaactaaactattttagctccttttagtcagtgtgtttggaagtttagctactaaagtgactaaaatttagctggctaaaat

SEQ ID NO: 16598 - DNA, 540 bp, Sorghum bicolor
  unsure (1)..(540): unsure at all n locations
  Clone ID: LIB3481-016-P1-K1-E10
cgtgcgggagcatcgtgctgatcacctagggtttcacagagctntatgtgttcttatgggttggaattattccgtagcccctgttcacaaaaccgcttaccaagcattatcaactatcgacgctgaagccaatcaaggagaccttatcttatggccaccgacagttataattgagaacacatacaagtcaaagcacgatggacaaaaggatggcatgagtgataaagatatggagagcaagctgagagaaatgggctttgtcggtgtcgatgtgcagccactccctgggaaggacgggcagaggtccatgcaagctaagtttcctgccagccttgatggtctgaacaatgcgtcactgctcgttgagtttttcgagcgccaaggccacgggcgagcagcttgggctcgcatccggagcatcgtccctgccagtgatgggggcaataacaaccccatgctggtcaaggtggacggcaagggtgagcggacatgggtcctctacggttaccttgccacggcatgggacctggacattctaga

SEQ ID NO: 16599 - DNA, 190 bp, Sorghum bicolor
  Clone ID: LIB3481-016-P1-K1-E4
tgatcgtccttcataacatgtgcgcacactgaatggagagtgggacgcacactgtaccggcgcattatgcgctgccagtgcggtggttacgggcagacgcgactgatgcactggacagtgtcctagatgccgttgatactagtgtgtttcgtggctttctggccacgttggacgattgtactgggcatgc

SEQ ID NO: 16600 - DNA, 508 bp, Sorghum bicolor
  Clone ID: LIB3481-016-P1-K1-E5
cgtccgatgagctgtgagctctggatgcctgaagcatatcctaaggctgtcatacatgataatgtggtgttgacattctaacatcattacaggagagcgcacgccacactggagatataactgcactgatgcacaaacactcctctgaggagatcactatcaggtgtgcaagagctgagcacgcaagacactcggatgccactacaagggattcgatacggggaatgaaaacacatctctcgaatcaggcgggacacgatgaatgaaagcatggcagatgcagcttaccaggcctagatcttagaccgtggtagatgctctgaggatgtccagtacaaggcaacatatcactatactcgcatagcaccagagaagatgacttgggccatagaagttgcagatgctatacaaccaaagcttcaagcacacgtggagtagacttatgagctgaccgcaaggtgatagagtaggagaatgactacaccgcagaggagctgttggagaagag

SEQ ID NO: 16601 - DNA, 186 bp, Sorghum bicolor
  Clone ID: LIB3481-016-P1-K1-E6
aaccccccttgaaccggcctataaagcccggcgggtgtgggggtaacccccaggggaaccgttacatttgcaagcgcctaagcgcccgctcttttcgtttttttcctttcctttttcgccactttcgccggttttccccgtaaagttttaaattgggggctccttttagggttccaattaagtgtt

SEQ ID NO: 16602 - DNA, 509 bp, Sorghum bicolor
  unsure (1)..(509): unsure at all n locations
  Clone ID: LIB3481-016-P1-K1-E9
cgtgcggccagcaacaccggctgtacaccaagggcgccaacgaggtgctcctcgtcatctaggcctactagacgctccgtgaccgggcgccgctacccgccagctgtatgctggcacagctcaccggcagctactcctacgcgctctacgcaggtgcaccaactcgcctgtaggctatctgatcctgagggcatggtgccggtctactggcggatcactgctgatggcgtgcgaacactgctatgatgacattgacatgctcaaaggatcatgtggcaaagcagatcgcgcctttaccacaaggttgcttctactctaacggccttggaggctctgaactgctatgagaaccccatgcacatggtcactgctgtatctgcagacgaggaagaaaggtgtggtgcaactatgaaggcggaagggtctacagtgctgacagcgctgcatttntaggagattgccacgtggaagcatgggtggagcgcaatgcaatgcacaactggactaca

SEQ ID NO: 16603 - DNA, 242 bp, Sorghum bicolor
  Clone ID: LIB3481-016-P1-K1-G12
tcgaccacgcgtctcgcagctgcagggccggggcgttcctctacagcagcgcgttctcgtcgcggacgctgggcggagcggccggccgccacggggcggtctccgtcacgctggcagggttcagcggatcgacgggagcggactgcacatggggtgagctggcgcgggcgtgcgcgtcgggcacggacctggccagtcgggcgcggacgcggcggaaatacgacggagacacggcaaaccaa

SEQ ID NO: 16604 - DNA, 510 bp, Sorghum bicolor
  unsure (1)..(510): unsure at all n locations
  Clone ID: LIB3481-016-P1-K1-H3
tcgattccgtcgccacgcgtcggaaggcagagcactttggaaactctgaacagaataatctactcctcaatcagggtggtcggtctatgcagacatggaagactttactatgtacccttcttggaatgtgaatcaaggtataagtggagatggtgcaatgatgataccgcaattgacagcggatctagaaaantgacagtgtacacagctatttgtgaagggtgtcagtcagcctgggctgccaagtgtcgtgcacagtgatacctgatacggaattatggaggccgaagcaacagggctgtttgtatttgtctatgttggttgttgtctgccaaccggctgttatacgcgtgcgtgcgctgaggccagaatcaactattgccctattgcctactatatagttgcaattctggagatttctatagcctacagcgggaggatcaacgggaagaattccagaaggcagtggtttagttgggcctgtngtaaacaaacatatcaatgccaccg

SEQ ID NO: 16605 - DNA, 251 bp, Sorghum bicolor
  unsure (1)..(251): unsure at all n locations
  Clone ID: LIB3481-016-P1-K1-H4
atacataccagatgtaatngagctctngtcaagatggaaaccaagactngcttatgagatgtacatgaaggcttgcagccaaggtcttcagcttcctgcaaagtcatatgacactgtactggaggcgtgtaaggcttatggctccatagtagatctaactactttgggtcctcgcccttcaaaaggggtggaacccatcaggatagagaataacttttccagtttctctcaattcaaggatctgcctagca

SEQ ID NO: 16606 - DNA, 472 bp, Sorghum bicolor
  unsure (1)..(472): unsure at all n locations
  Clone ID: LIB3481-016-P1-K1-H5
cagaccggcggcttctggggaagtacgctggctngttcatctctaccggcacccagggtggtggacaggagagcactgctctcgctgccatgagcaccctcgcccaccacggcatcatctacgttcctcttggctacaagaccacattccacctcctcggtgacaacagcgaagtccgcggtggtagcgcttggggcgccggtaccttctccaacggcgacggctctcgccagccctcccagaaggagttggagctcgctaccgtccagggcaaggcattctacgaggctgttgccaaggtgaacttccagtgactgcaaggtcgggaagacaagcaagaccccaacacggctgagcctaccactgctactgcgggcaatggaagcgcaaaggagactcctacatntgcgcctaccaccaacgcaaccactcagcagcagacgtncactcaaccacagcccagagatgagaa

SEQ ID NO: 16607 - DNA, 423 bp, Sorghum bicolor
  Clone ID: LIB3481-017-P1-K1-A2
ccgggcccgacccacgcgtccgcccacgcgtccgcccatttggaggatgagcacccttttgagtctaaaattgtgtcttgccctgtttgcttggctaggatttcgaagaacttgttggatcatataacccttcagggtggctacctatttacactgcagagacatcacagagtacgtagagttactggtaatggcaaccacaatctctcctatgcagggagagatcttcagcttcaagagacctacttaaaggtgcttcttggaaatagcagtcgaagcagcagtaccaatgcatcaagtacagtcactgattcactgctatcctcgctagttttaaatctatcttcattagaagtggaggacacgtcaaagtcttcagcttcttctgtggtggaaaataaatggtttaaacgatcactacct

SEQ ID NO: 16608 - DNA, 508 bp, Sorghum bicolor
  unsure (1)..(508): unsure at all n locations
  Clone ID: LIB3481-017-P1-K1-A3
tcgacccacgcgtccgtttctcgttgaagcattaattgagatgttcccagctgttgagcttgttgagttactggaagcctttgagaaaagaccgcctgagtgcttgcggacagagacactaaaggtatactgcctgtggtcaatctgaaagtgtatgagtggtatcagtaccacacagtcatttcgtttactgtttgttgtcaatttggttcatatctgcatagactctgctcttctcaataactttatctaccttatttatttagttacttggcagcttaccataacttgcttggatcaaaaggctntgttgttattgcatttaagttattggtgaattttgcactttgcagacccggaggagggatcttgctgctgctcttataccaagaggatttaatttggacccaataagcaaatggtcaaaggtgggattagttgtctattactcaaccattttaactggtgctactactgaatatatggctggacattacatgaaacaagg

SEQ ID NO: 16609 - DNA, 498 bp, Sorghum bicolor
  Clone ID: LIB3481-017-P1-K1-A4
cgtccggtttcaacagacacacaagttgccatatggcgtgattcttctcgaagaaggttggttgttgcctttcgaggaactgaacaatcaaggtggaaggatttgcgaactgacttaatgcttgtacctgctggactaaacccttagaggctgggtggtgacttcaaacaagaagttcaagttcacagtggattcttaggtgcatatgactctgttaggaacaggatcatgacactcatcaaatatgccgttggattcctggatgaagaagatgcaggaaccatacctagttggcatgtttatgtgactggacacagtttaggtggagcactagcaacccttcttgctcttgaactctcatcaagtcaaatggccaagaatggtgtcatatttgtgacaatgtacaattttggctctcctagagtgggaaatagaagattcgctgaagtatacaatgcgaaagtaaaggacagcttgagaattgcaaccatcgagata

SEQ ID NO: 16610 - DNA, 389 bp, Sorghum bicolor
  Clone ID: LIB3481-017-P1-K1-B5
tcgtccgtgtagctgcgctgcaagagttaaagaaatctgcacctgcctttctggagactttagtgcatagttgggtctcagctttattttcaggcgacccagggtgtgtttctatcaatgccccatcatgttcaatgcatgacatgatgccctatgtcagctcgcggaagctacacttactgaacataatttgcagaaaagtaatgctcagcaatcatgcacagcatggtcctggtgctgaaaacagtaacgaggaaacaactgatctctggaacactcttttggtaaggagtgaaacagaactgagagagaggctggtgggtttcacctttgctgcagtcctgaaacggacagcaagcttgttcaatggtacctctactgaaacttgc

SEQ ID NO: 16611 - DNA, 167 bp, Sorghum bicolor
  Clone ID: LIB3481-017-P1-K1-B8
aacgctcacttcctgatgctccttatcgaggatacatggtccgcgttcgtcttcatcggcttggccgaagccgacggggggtcagggttggacgtttcgctaatgcgagctactagcttcgtcgcggacatggagagcctgccatgtgagtacacgacgggttgtga

SEQ ID NO: 16612 - DNA, 335 bp, Sorghum bicolor
  Clone ID: LIB3481-017-P1-K1-B9
cgtccgcgcggacatccaagctgagatccgagcggtgtaacgaagggagcgcctgttggagcgcacgatattgcacccaaggtaagagctagagggagatgttcaaaactaccgtgcagactacaaaccatatatcaatcatttgatagaggctatggagtttgctaatgagggtgctcttactgagacattaacaatgacatgatgcgtggtgactcgagatcaggctattaataccatggttaacgcgctggctgatgtgctggacgttataacatacggtctgaccatgaggccatacatgcggcacatgcatcgttatgagcatgttactg

SEQ ID NO: 16613 - DNA, 470 bp, Sorghum bicolor
  unsure (1)..(470): unsure at all n locations
  Clone ID: LIB3481-017-P1-K1-C4
tcgacccactcgtccgggacctccagctacggcggcaagcacggcggcggcgggggcggcggcggaggctgcagcttcgactgcaccaaacgctgcgccgccacctgctgaatctctgagcgcatatgggtcctgatggtttgcaaaggatggcgtggccgccctagttaaattagctagctagctagctgaacgcgaagctcatatactactttactcctcgatctactactggcatgcagtgtgcggtgctcggctaataccaccatatggattattattattactaatagtagtatcgacatagttgttggtttctttgctcttgtgatcgattgtgatgagaccatatatgcatgtgtgtctgtaaatttgatgtctgtctgtcggacttttttgatcaataataagaggagatgaataaagggtttagttcgcnntanaaaaaaatttatattaaaaaaataata

SEQ ID NO: 16614 - DNA, 438 bp, Sorghum bicolor
  unsure (1)..(438): unsure at all n locations
  Clone ID: LIB3481-017-P1-K1-C7
cgtccgaaaaaaaaaaaaaaaaaaaaaaaattaataaaaaaaaaaaataatttataaatatatattaataatatataataataagaggggaaaatggttaaaataataaatatgagtttataaataaaatatataaaaaaaatttataatnggggggggccctttctggttttaaatttggattccttaaaaccaattggtttttttgatttcttcaatccaaaaaagttttttttttttttccccttatcggttaaaaattttttgatttccgtttttacaagggaattttttattttttcaaaagggattgggcatttattttttttccgcattggctaatttttttttttaaaacaaaaaaatcttttcaccctgtttttttaatttaggttttatttatttaccttgggctcaaataaatttttttttttttct

SEQ ID NO: 16615 - DNA, 473 bp, Sorghum bicolor
  Clone ID: LIB3481-017-P1-K1-D3
cgtccgaacaaacaaaagaaataaaaactgccactaacaccgtactcgtccgaacaagaacttagtagctagtaatactaacatagcaagcgcctccggtgcgacggcgtcaacaacaacaagctacatgaagggggcggcctttctagaggaacaaatattacttacccctccaggccaccgtaaagatttttttaaagtaacccaaattaaaatttgcgggccgaccttttacaaccatgaagcgggaaaaacccgggacttcccaaactaaatgctgtgggaccaaatccccctttccccagttggggtaattacaaaaaaggcctcaccgttcgccctttctaacaatttttcacccgagaaggcaaagggggccccccctatatcgagacattaacctcgccgggttgggaggattcccgccactggaccattaaatttctcacccccctaagccccccctatttccc

SEQ ID NO: 16616 - DNA, 285 bp, Sorghum bicolor
  Clone ID: LIB3481-017-P1-K1-E1
cgtccgggctcgtacccaatgacctcacgctgatacatgggctcatgggtgactcgacgtttttgttggtgtatcagtacatgacgcttaccaggtacagtatgaacgccttgtgcactgaccttttctgcttactgccgtggaacagaccttagaacaagtttatttgctcttgccatggattccagtacaacaaccagggcaaggtggtctatggaccggctcctctatcgttggcgcttatttatgcctactttgactacggcaaagttcttttttttccgt

SEQ ID NO: 16617 - DNA, 316 bp, Sorghum bicolor
  Clone ID: LIB3481-017-P1-K1-E8
cgtccgtccacacgtacggtgagtgtctgttaccttatagcccctgcacaagtcaatcaaagaggtcagaacggcagctctgatcgtggattctgaattgaaggctttacaaacatggaaatgttgggctccatgcaaaaacagtcctttgacagtcttagacattaatgaccggctgatgatgaccgaacgtgcatgttactgactctgatggactatctggacagtcatggtacaagcacactgatatacgcacgttaactgcacaacgactacggggctgaagggcattcaggtgtcgatcactccattcaga

SEQ ID NO: 16618 - DNA, 285 bp, Sorghum bicolor
  Clone ID: LIB3481-017-P1-K1-E9
ccgcaataccggtgccgacccacgcggtcgacccacgcgtccgcgtcgatctatcagcaaagcacccacaccagcgaaaaagcatgcagtgatggcggcctccatgatctcgccgtcagcgggtggtggcgcgcgtcgtccagggcgcagggactgccgtccctctgtcgtcgtgccttctccttttccgtctgctgcggcaccggctagactatcaagaccgacaagcctttccggattgctggagtcctgaccgtccataaagattcctacgggaggaacgtc

SEQ ID NO: 16619 - DNA, 309 bp, Sorghum bicolor
  Clone ID: LIB3481-017-P1-K1-F1
cgtccgatacaccacaagtcacaaacacatacactacatatggggctcatctgacagcatgtggtaacattgaggaacccacctgtgtgcatggtgcgtgcgaccaatactactcatcaaggccctgatggcaccccgagcattatgaagctgtttgtatttatgcacagaggaccacatcgtgtgctccatatgcggagcagaattaacagcttcatgtcactgagcaatggctcattaccacctcatgcaagcaaattcaatccatgcgtgcgtacatcatacacggtacacgggaatgcacacgcc

SEQ ID NO: 16620 - DNA, 345 bp, Sorghum bicolor
  Clone ID: LIB3481-017-P1-K1-F7
cgtccgccgtcgcctctccagtgttctgccgcattaccccctagccaacgaactgtcctcatgccttcctccaccagatccgagcccaaggatcagccagtacatctccaccaggaagaaaggtgccataaaatggtgtaattcgttgcttcaaatagtagatgctgcactttgcaagttcgccagcaaaactgggctacactatgagcttcataccatatatggtgatagcttactgactgatgaggacttctatgactattatcatatcaatttcatggggctaccaaaagacgatcgcagctctagttctggtgcaaaacctgtacgtgccctggttttctt

SEQ ID NO: 16621 - DNA, 248 bp, Sorghum bicolor
  Clone ID: LIB3481-017-P1-K1-F8
cgtccgattatctgttttgtcattacaaaaggtgcatagttaccaatgacaattataaggaggactgcgtatcattgtattaatagaaggaaaaagtagccgtacaagactcaacacacaacaaagaacacacacagaagcacccacaagggcacctagaccgcctcacacctcacttacaagctagcagaaaagagacactcaagactgaaaaacacccaaagcccactaaccaacatctagcccct

SEQ ID NO: 16622 - DNA, 258 bp, Sorghum bicolor
  Clone ID: LIB3481-017-P1-K1-G10
cgtccgattgtcttatgtgctcacggtgagatgtaaggaagaacgatgttgtatatgtattagccaattttatagcaataccttctcagtataaagcaactcagggcctctgacctgcaagcaagtatacacagaggattggctgttctagagattatttcttgttcaaagaaatgtacgtagaaaatgctaatgatgcgcgcttgacatctctcccaaacggtgagcttgaagtctactggggttggcaaaagcact

SEQ ID NO: 16623 - DNA, 377 bp, Sorghum bicolor
  Clone ID: LIB3481-017-P1-K1-G9
cgtccgcctcatctcctcttctccccgatgctaacgctactgctcgtcaatctcccctcccacacggagtagtagaaaaagagagaatcccatccatcccggttccttgattcggcacaggcccctcggagaccgaatcaaaccccatcggaggagttggattgcttcccggaggtcgcttccgtctgttaatcaagaaatcccaaacttctcctcgcccgaatccgtgcgggcttggtgaagcagggtaaattgggccaggagacgtcggtcccgaccacgaagtccccgtccctcgccggaattccaagaaagccgccgccttccggccgttcttgttggtcgggggagataaagggattggtgccattgatccg

SEQ ID NO: 16624 - DNA, 474 bp, Sorghum bicolor
  Clone ID: LIB3481-017-P1-K1-H1
cgtccgtacaaacatgaaacatacggggaacagttgtaaagaaacaatttcacaaattcaaagtaaccacagctctggcattagaagcttgtgcatggacacacatcctgaacccatcgtcgaaactactgactttgggttggtcaagagtcaaaaccatggactcaacgcagatggactcaggttttaccctcttttctcattatctgttcctgcccagcatggcatatgctgtagaaaaccaggcttcgtcgaaactacgtcgtactacaattcgttgccctttttctttaatttttctctctcgatcaggccatatatgtatagcctgctacaattatttcgttgccgccagcacaatcatcagcttggtcaaatacatgcacataatgctacaaatttcagatcttgggtggagtcgttgacctgcctgcgttcttggtttttttgtttccatgcatgcatgtgcacaca

SEQ ID NO: 16625 - DNA, 275 bp, Sorghum bicolor
  unsure (1)..(275): unsure at all n locations
  Clone ID: LIB3481-017-P1-K1-H6
cgtgcggagaggaggagggggggtctcttcgacagttctccttggcttgcgcttcgcgcatgagctggtgctattgacgcacaggcgaccgtggaccgtcgcaggaatcgagaaccggtacttcgacctgctcctcgtccccattgcgctctgcctcggcgccacgctgctcgccgcgcaccgcccaggggagcccacgccgcggctcgcccgcgcggcgggcctggcgctgcanggcacgtggatgctgcagatgggcttctccttcttcacca

SEQ ID NO: 16626 - DNA, 353 bp, Sorghum bicolor
  Clone ID: LIB3481-017-P1-K1-H8
gacccacgcgtccgatgcaagtctaactataagcatacacccactgctataagcagtacagtagcgctttataccatgcactatttccaggagggattttggagttactgtatataacgtgacttttggctaacttgtactacgcattgcaccatttcttcttcaagcacgactgctagttctactatcactcttctgctaagtatgccattgcctaagtttatccagtggtgatggcctactatctctatacgatctatggtctttttcattttatataacgtatatctcatttttcgttccttaattatgctgaatttcttcattcacacttctcatgtattttttatttt

SEQ ID NO: 16627 - DNA, 351 bp, Sorghum bicolor
  Clone ID: LIB3481-018-P1-K1-A1
cgtccgctgacgcgtgggtttcacaatacgcgacgcgatgtgcatcattcatggtgatgagtgaggaggagctaccactatgctgtgcaacagtacgccggccgggctgcatgctactgtaaaagcaagctcacagaccagagctgctcggctcggcattagctgttgggaccactggcacgagtcctgcaataggtgggtccgcggcggtgtctactccacattttatgaagcatgtacatcaatgatgacgtgatagagacatgcgtgaacgactggtcggtctgggctgacacgcgagaaacctgagggcgtaattgcacgctgagcgggggaactgacagcgggcta

SEQ ID NO: 16628 - DNA, 496 bp, Sorghum bicolor
  unsure (1)..(496): unsure at all n locations
  Clone ID: LIB3481-018-P1-K1-A2
ccgaatcccggtcaccacgcgtccggaattctctgctaccaaaccgggagtcccaacccaaggcagcggcagctcatcaccggcgcgcgatggcggcagcagctgtaactccaggaggcacgggcggcaccggtgcggcgacaagccggttcgcggcggcctgcggggctctcagccactacgtcaagcaagcggccgaagccgagaggaagcacgcgaggccggcagccgtgcccgtgcggcctctcccgctgatgccgggcgccgacgtctccgactactgcagccgcgacggcggcctggaccatctggctcaagcggcgcagatgatgaccatcgtgtacggagggcgcgtgctggtgctcgacgacgtcccagcggacaaggcggcgggcctgcttcggctcgccggcgacgccaccggcgcagcagcagcgcaagaaggtgcaggtacagaggcgacnggcggtgccatgcgcgggagagggcaggtctc

SEQ ID NO: 16629 - DNA, 564 bp, Sorghum bicolor
  unsure (1)..(564): unsure at all n locations
  Clone ID: LIB3481-018-P1-K1-B7
cgtccgaccacgagtgcaaagtgccctcagtgcgctaaacgatttgcactcgagcatattatcaacctctatgcaccaggaaacctgtgggatcgccatatacaggcaccggtgactagtggaccaagtggatccgagactgatttgttgaaacaggtcctggatatactccaggaacctgcgagcattgagaaagagtatggggtgcatttcgatgaaatagtcaagcggtttagactgcctgagaggaatatctgggatgctctcatgcagcatgtggatatgggaaatatttacaatacaattgatgactttcacttcatgccggctgtcttcgaatggcatccttctgtacaacaatcttattatcaacagagagtgttaacattgcaggcacccgtgactagtggaccaagtggatccgagagtgatttattgaaacaggtcctggatatactccatgaacctgcgaacattgagagagagcacggngtgcatgttgatgaaatagtcaagcgattcaggctgcctgagaggaatatcaaggatgctatcatgcagctt

SEQ ID NO: 16630 - DNA, 223 bp, Sorghum bicolor
  Clone ID: LIB3481-018-P1-K1-B8
cgtccgacttcttgttggtgccagctgctgccatggcggagtcaagcgcgcgttcttctcgtggctcggcttctgcaggtcgtggcggtggcggcggctacgatgggcgtagggtcgccgtgtacataccacgtaaacccactggactacactccggccacatactcttatcgacaactggcataatatcgaaaaggcccataccgatcaaatttatttaata

SEQ ID NO: 16631 - DNA, 301 bp, Sorghum bicolor
  unsure (1)..(301): unsure at all n locations
  Clone ID: LIB3481-018-P1-K1-C6
gggacgtccacctcgacgggccggggctgctgctccagccctcgttcttctgccggggcaccccggtggtgctgcgcgaccccgcgctgccaccggtcctcgtctaccccgtcacccacggcgaggcgccgaccgtccgcgcccccggcggctcctcgctggccaaactggtcggccagacccgctccgccgtcctncacgccatcggcgacggcggcacgaccagcgaactggcccgcatggccggcgtgtacctggcctccgacagccagcatgccggtgtcctttcgaggcctgtctt

SEQ ID NO: 16632 - DNA, 161 bp, Sorghum bicolor
  Clone ID: LIB3481-018-P1-K1-D3
cgtccgcacaaactctccagttatatgggaaagtggaggaacgatggtctttgggagcattctcatcacccgaataacggtgtggaggacgggactcggcggggaatattgactgaccaacctcaaaaattcagatgctgaaggagtgcgacactggccta

SEQ ID NO: 16633 - DNA, 303 bp, Sorghum bicolor
  Clone ID: LIB3481-018-P1-K1-D6
cgtccggaaaaggatccatggataaactaagcttaactgcttatataaggtccaaaaaaaaagtagaaaaagatgtgggtatcagggtgtggtatagatagacaacagagcaaagcaaaaggagccatgtctgaacaaagatgaggtcactggcttcctcatggttcagatcattcagctcaaattactactatttttttttgtcagatactatagtagtatctcattcttgttcactgtgagtctgtgactcatgccaggaactcaaagatgctgtgtttgatgtaaattccagaagttgca

SEQ ID NO: 16634 - DNA, 401 bp, Sorghum bicolor
  Clone ID: LIB3481-018-P1-K1-D8
cgtccggacactcgtgcggatgcttcgaacgctgtatcaagtggtatacaaactgtcgcacacagggtagctgacacggtggaaccgacgctggaacttatagaaggagttgtagatggtggtgtaacaaatcttgcagatggtggtgtagttgatgttgcagatggtggtgatgatggtgatgatctgggtgtgatgctggctatgatcagatgctgaacgacatactgacggtggagttgggctgagcatggggcttgcttggcgtgttgatgggctgcatgcaagtgtgctggagcgcaagctgcagtcagtgctagagccattagtgctgggcatggaacatgatatgtttgttggcgggttacgaggcttatacggtgtggatcagggtcgagagc

SEQ ID NO: 16635 - DNA, 162 bp, Sorghum bicolor
  Clone ID: LIB3481-018-P1-K1-D9
cgtccgcccactcatcacgatgcattcaacgcacgaccaagtggtatatttattgacgcatacaaggaagttgacacggctgaggatactctagaaccgagagaagggggccaaaaaactttcatacaccctagacaacattgaaatgatgatgcaaagatg

SEQ ID NO: 16636 - DNA, 235 bp, Sorghum bicolor
  Clone ID: LIB3481-018-P1-K1-E4
cgtccgccgaacctgaagatggcgcttacggagacgctgccgctgcacccgacgaggacgctgctggtgcccctggagacgatgcgggacacgaccatctggggctactacgtgacggccaacacccgcgtcttctgcaactcctgggccatcggcagggaccccggagctggccgcccccgacagttaaccccgaccgttttggggagcgcgttactctacgtcgccttggcta

SEQ ID NO: 16637 - DNA, 309 bp, Sorghum bicolor
  Clone ID: LIB3481-018-P1-K1-E6
cgtccgcccacgcgtccggtcgttgggttgaacttggatgagagcaaagtacgccgtgctggacctgctgagaatgttcgtgtcaaattgtccggagttgaagaggaggatgtaatggctggatttgtactttcaagtgttgctaatcctgttggtgcagttagtgaattcatcgctcagttacagattcttgagttgcttgacaatgctattttcactgctggctacaaagctgtgttacatatccactctgttgtcgaagagtgtgaaattgttgagctcatataggaaattgacatgtagaaaaag

SEQ ID NO: 16638 - DNA, 480 bp, Sorghum bicolor
  Clone ID: LIB3481-018-P1-K1-F1
tcgacccacgcgtgcgtctccttcggctacaccttccaccaacaacgaaacgacgacgaccaccaccaccataccggcgacgccgagctcgtcgccgcgccgccctgcccgagctcgccggtgtccaggcccgtcgcgcatccaccgcctacgaccgcggcgccgcggctgtacccggcgatagagtggccgctgacggaggagataccaatttaccatacaccgctaccactagctggggctgcggccgtcacgctcgctaactcgcggtactaccctcctccaccgtcgtcggcgactccagtggaggtggagccggtcgcggtgtacccgccggcgccagagacgtccgcctgcagcttgtacccgtcggtactgccggccagcgcgatgtacccaccggtagaccttgctccagtgagctgctatccgccagcgccaagatgggatgatctggggttgtacagctgaagtcggcgt

SEQ ID NO: 16639 - DNA, 122 bp, Sorghum bicolor
  Clone ID: LIB3481-018-P1-K1-G1
acatacacaacttatcctatagagatgatgtaattaaagctttgcctaactaaatgcaataatcttgccgacgctataatcgattcctttcataacgtcaactaagtttaggttcaaataga

SEQ ID NO: 16640 - DNA, 520 bp, Sorghum bicolor
  Clone ID: LIB3481-018-P1-K1-G10
cgtccgctcgtttggcttctcagtttttgtcaccacttgatgctaggaatggtcgcagtgtaatgcaaaggctggtgcctggtcctggtagttctgctagtgtaaatcaaaggttaggaagcagtgcagggctgaatcatgtcaatggagctccaaggattagatcagttgtgagcatacccaatagggaaaggcttgatggtagcacacatactacaccccctaggcccagtgaggattcttcccctgttgaaagcagcggcaaagttggactccctttgactgacactaacaaggctgaaggaactagtgtagagaatagaaaaactagtgaagctccagcgtctaacggttccgtattgtctcctgccgaggacaagaaccagcccaggattgaggataaagatggttttcagaagaagactttctctagaatgcatgatggagagacagtggggtcagctacaaggatacatacccaagagaccccggcctgcacgaggaactgcacgctgaaatg

SEQ ID NO: 16641 - DNA, 272 bp, Sorghum bicolor
  Clone ID: LIB3481-018-P1-K1-G2
ccgtcgacccacgcgtccgaaaaaaaaaaaaaaaaaaaaaaaaaaaaaaaaaaaaaaaaaaaatagaggggcggccgtttaaaaattatcaaaattaacaaccacatgcttccaacgcgcgccctctttttaagggccccctggttctatttccctgcccctgatttaaaacttttttaatgggaaaacccttgtcttttccgagctcattgttttaacccacatcccctttaaccactggccttataaaaaaaacccttaaccaataccct

SEQ ID NO: 16642 - DNA, 132 bp, Sorghum bicolor
  Clone ID: LIB3481-018-P1-K1-G3
cgtccgactgacgcgtgactgatggacctactactttctactggaacagaggactgcactcttacataaactttgtacctggggactcatagcgggatataagttatgttcataattcatttcacctatttg

SEQ ID NO: 16643 - DNA, 314 bp, Sorghum bicolor
  Clone ID: LIB3481-018-P1-K1-G9
cgtccgcacaaccacctgcgcgtgcaggcacaccgaggtcgccggagccgttctcggtcgtgtcggcttacaattatagggcggccactacggactgacctacaacgaccgcagcatatcatgactactgacgctgtctggtctgtatcaagcacacaccaatgaattgtattaatgaaaactacttcctgctgtcaagctcagactatattctgatgccattgcatatgccttgagcaagtatatgtgtaaactgatgacctcttgttgaatcaccttgaagaagttgaaatcactggatggagaggtactga

SEQ ID NO: 16644 - DNA, 402 bp, Sorghum bicolor
  unsure (1)..(402): unsure at all n locations
  Clone ID: LIB3481-019-P1-K1-A11
cgtccgagaacactgaaaaagcaattagaatcacaaaaatatcaatgagatcatattgctaaaaacatattgataacataatgcttgtacacacttagtcgttttgtagagaaaatgtggtgatttggataaatgcaatgatttcctattgcttcagacatgcatcttgctttcagttgtcagaaagcaatgatatcatttttccatgagagataaatattgctttgagataccataatgtgacagatgtgttatacaagagagaacagataatatatactgtaccctaaattattggagtgtgcacgtgtaagtgtaactatccagtaggctaatttcaatttggccccgagttagactcctctaatgttgattacttatntatctacgagataaaaagaa

SEQ ID NO: 16645 - DNA, 241 bp, Sorghum bicolor
  Clone ID: LIB3481-019-P1-K1-A4
cgtccggaacgtcacctatcattgctagtccaaagcggccagctaacatagactactctccacggattgaggctatagaatttaccatcgagcagagatgatgtgggctaagcacaaaatcttacacgggcagacattgtacttgccacagtgtgacgtacagggaacacaccatccacaatgtatcgaactgctagggtatacataggtgcatatgcgccaactgtgatgggagagaaac

SEQ ID NO: 16646 - DNA, 276 bp, Sorghum bicolor
  Clone ID: LIB3481-019-P1-K1-B1
cgtccgcgctcgaagccgcccgcccatcgcatcgcactcgcacgagacgagaccgccaatcccgtcccctgacccgaacggccgccgcagcggagaagagagggagagttgtgtgcgatacgcacgcctctcgccgccgcctacccttcccgaactcccccgaccaaacgcctcttatcctcccggcatcaaaatcgcgccgaaatctctccggattcgcgtgcgcgggcttgggacagatcgggggcggaggaggccaaggccccgggcgggcca

SEQ ID NO: 16647 - DNA, 320 bp, Sorghum bicolor
  Clone ID: LIB3481-019-P1-K1-B11
cgcgtccgcggacgcgtgggctgcgctgttcgcatttggagcatcaaaacaggggagctactatttgcacagagcatgtcagacactcttttcacggcattttgttggcccgaaagcagccatgacttgtgcagttcttcgctgtttgatctaaaccacagctggggagctaggttgggatcacgtgctgggctgttctatatgcatgggacttgagtgattctgcactagtactactacactactaacttggagccttggaaggctggagcgaaaaatggtgggtgtattctcaaagaacatgggatcagtgaacatac

SEQ ID NO: 16648 - DNA, 269 bp, Sorghum bicolor
  unsure (1)..(269): unsure at all n locations
  Clone ID: LIB3481-019-P1-K1-B3
cgtccgcccacgcgtccgcccacgcgtncgcccacgcgtccgtggagtgttccctgataccaacacatacaatgtggtcctccagctnttgctggagggaaggaagctccgagaggcagctgcaatatttagtgagatgatcaagaatgaatgttggccaaacgaggaaaatngttcacttgcacttcgcatgtgtttggtacacgctattgggagactgggatcaaagtctggagctgcatggtggagaatggcttgccacctttaga

SEQ ID NO: 16649 - DNA, 279 bp, Sorghum bicolor
  unsure (1)..(279): unsure at all n locations
  Clone ID: LIB3481-019-P1-K1-C11
cgtccgcccgagaaggacgaggccgaggactacctgggcatcgacctgcacctgccgttgttgcagatggtgaagagctggcaggacggggaggccagcatgacggacggcggcagcatcctgagcctggaggacagcaagggcagcatccctgctcgccctgctgggttcgcggagtccttcaccttggccgacggccggngaagaggactggatgaggaagaagacagagcgtcttcttggtatcgatcgcatgatctgatcatatctaccgggagg

SEQ ID NO: 16650 - DNA, 114 bp, Sorghum bicolor
  Clone ID: LIB3481-019-P1-K1-C7
cgtccggacatgaacagttacgggtcattggtgcgacctctgcgcatctctttgctgtgctccaaggtctcttacaagtgctggcggggatcgacacaaactgcacggtcgcat

SEQ ID NO: 16651 - DNA, 252 bp, Sorghum bicolor
  Clone ID: LIB3481-019-P1-K1-D2
cgtccgatgcgactatattaccaggtcatatccagtgcggcagacctacacgctacacaacaatcctcgagaattctatatatttcttgcatgaggagggcgctattgactgaactggtgagacacaaccccctcctaattacatgacctcaaactaaaacatcattatccggtcaggatgcaatattaaggcttcttctctctatctacatggcaataggacgacgacaagtctatgttccttggatgcac

SEQ ID NO: 16652 - DNA, 160 bp, Sorghum bicolor
  Clone ID: LIB3481-019-P1-K1-D4
cgtccgcgaagaactacatcaaggcaatcaattcgatgatacgaagcttttatttgactgcatttgtgaagctgtgacagaaattcacgatatagactgttgaagccctccatgcttatcttcttttacacacagcataagggcccctccagcgggacaa

SEQ ID NO: 16653 - DNA, 244 bp, Sorghum bicolor
  unsure (1)..(244): unsure at all n locations
  Clone ID: LIB3481-019-P1-K1-D8
cgtgggaaaggtcacatctcgatcactatccactactgcacacagcacacatggcggaggagaagcaccaccaccaccacctgttgcggacaggaaggactaggagcagctggagcagcccgtcnccngctgcgggtacgggtacggcgaggccgccgagtacacggagaccacggngacggaggtggtgtccaccggctgcgaggacgagtacgacacgtacaagaaggaggagaaggagcac

SEQ ID NO: 16654 - DNA, 147 bp, Sorghum bicolor
  Clone ID: LIB3481-019-P1-K1-F10
cgtgcgatttatcaaattcgcgaggcaaatcaaatgattgaagagtttatgttggctgcgaatgtttctggtgctgagaagattttgagaggggttgcccttatgttcattggtaagggggcattctagcccaacaaaagagatgct

SEQ ID NO: 16655 - DNA, 261 bp, Sorghum bicolor
  unsure (1)..(261): unsure at all n locations
  Clone ID: LIB3481-019-P1-K1-F7
cgtccgcaaggttctgatggcagatttcttcatggctgaccagctaaccagccagatcccactngtaagacacctcgagttcacggggtgttgcttcatggctggaacttttagaactcacgaatatggaagctgtaccagcagctctctatacaaaaacctggcgtacgtgcttttcttgctgtcatactactggagagcaatggcacgtttgagaaggtacctggaagaaggccatgatcttaaccagcttgtttatgc

SEQ ID NO: 16656 - DNA, 206 bp, Sorghum bicolor
  unsure (1)..(206): unsure at all n locations
  Clone ID: LIB3481-019-P1-K1-G4
cgtgcgcctatggaaattgtattatactgaaggctactaaaacatggatagctctngacacattctgcttgcagagcaactgtataagcctctgaaaattgcatttctacattcttgagtaatatcttcaggtttataaaagcttggaaatttgacactgggaactgggaaggctattcaaatggggcatatcattttcagagggg

SEQ ID NO: 16657 - DNA, 298 bp, Sorghum bicolor
  unsure (1)..(298): unsure at all n locations
  Clone ID: LIB3481-020-P1-K1-A10
cgtccgcattattgccgtagattgtgacacaagcagataagagatagatgggtgtgcactagtatttctgcaatagcctagttagaggataatcagacagtgtataggaaatacaaacgaaagtgctactattcatattgtgaaaaaaaattggaagtaaacaaggcctaacaaatctaaaccttctgtcgngagcactggctgtctgtcgctgtaaattcnattcttgtgtnngctctttgtatttgtcccaatattaaaagattccggagaccgaatattattgatcaatcttagg

SEQ ID NO: 16658 - DNA, 227 bp, Sorghum bicolor
  Clone ID: LIB3481-020-P1-K1-A12
cgtccggacgaataagacaaggttcataaggtgtgttcatctaacgtgaatagcttggataggataggcgtctaccaatgggatagcgagcgactgctagatcttgaatgagaaatgttaaaactgggagactaaaaaatatttctttgtagggaccatctaatcaaggtctaacggtgggtcaatatacagacagaaatgtgcactgttggacaccatatcggagt

SEQ ID NO: 16659 - DNA, 289 bp, Sorghum bicolor
  unsure (1)..(289): unsure at all n locations
  Clone ID: LIB3481-020-P1-K1-A3
cgtccgcccacgcgtccgcacaactttatgatatcttgtgcccatatacttcttgaaataatgataaaaacacgttgaattgtctggcaggtcgcaagtgcaacagcaacattcgtgatgatgttctgctcctgcttctttgtggtggagttttactttctgcacagattccgacctccttttggtaaatccacgntagaaatctctaaacattttcaaatgngtgattgttgnaatgtgatgctctgtttctctatctgcagctggctacctcatctttaatttcata

SEQ ID NO: 16660 - DNA, 230 bp, Sorghum bicolor
  unsure (1)..(230): unsure at all n locations
  Clone ID: LIB3481-020-P1-K1-B6
cgtccgattaagcacggcttcagctataatggaaaagatttcttgtactcaggaattcttggtcagccacttgaggcatacatcttcatgggaccaatctagtatcagaaactgaagcacatggttcttgatatgatgcatgctcgagctagtggaccacgggtgttactgacctggcaaccaactgagggaggaaaccgtgatggatgcttgcgtctngnngaaatgga

SEQ ID NO: 16661 - DNA, 113 bp, Sorghum bicolor
  unsure (1)..(113): unsure at all n locations
  Clone ID: LIB3481-020-P1-K1-B8
tcgtccgggcgcccacacggcgtgccagcagtgccgcgaccacgaatgcggcggcgaggacncgccggctggcatcgngngcctggagaggctgggggctctgacgaggtgcg

SEQ ID NO: 16662 - DNA, 298 bp, Sorghum bicolor
  unsure (1)..(298): unsure at all n locations
  Clone ID: LIB3481-020-P1-K1-C11
cgtccggtggttcaactaccgcgtggccagggcggcgccggagtcgtgcgccgacttcctcgggagcttcgtcgccgacaagaacaaggcagagttcgtcaagggtggcaagtggctcgtctggaagtttgagggggacagaacgttggccaattatatgagtgaccgcgggttcccgtcgaacctggagccgctcatgttcggacgcgtgctgcanggtctgggcacccatgatcgcgacgcgctggtggtgaagcaggtgatgcggcagctgatcacgtcgctgaagcgcattcac

SEQ ID NO: 16663 - DNA, 382 bp, Sorghum bicolor
  unsure (1)..(382): unsure at all n locations
  Clone ID: LIB3481-020-P1-K1-D11
cgtccgctcggagcaagataggactagttagctacatacaaggcaagaaccagcagtggagcgagggagacactgagagagagagagagaggaaacaatggcggacaaggaggatcttaagctcctcggcctgcagctgagcccgttcgtgatccgcgtgtgcatggcgctgaccatgaaaggagggagtttcgagtacgtcgaggaggacctgaacaacaagagtgagctcctggtcaagtccaacccggtgcacaagaaggtgcccgtgctcattcacaacggtaagcccgaccccttcgaacagctgnacgtcgacgagctgttcgcttgctcgacgatactttcagacgcgaccccttcgagcgcgccaatggtcgct

SEQ ID NO: 16664 - DNA, 467 bp, Sorghum bicolor
  unsure (1)..(467): unsure at all n locations
  Clone ID: LIB3481-020-P1-K1-E12
cgtccgcaggggtgttttcctgatgtttgtacatatacaattctcatgaatggttcacataaggtgaggaaccttcctatggcaagagagttctttgatgagatgctgagcaaaggtttgcagccagattgctttgcctataatacaaggatttgtgcggagctaattctaggggatactcataaggctttccagttgagggaggtgatgatgttgaaagggatatatcctggtacggtcacatacaatgttattatcgatggactgtgcaagactggtaacctgaaagatgccaaagatttgaagatgaagatggtcagtgatggtttacagtctgactgtgtataatcacttgcttgattcatgcacactgtgaaagatgactcctaagtgaagcatgtgaactncttaattgcatggtctcagatggtttgcaggccctcctgtgtgacctacactatattaat

SEQ ID NO: 16665 - DNA, 118 bp, Sorghum bicolor
  unsure (1)..(118): unsure at all n locations
  Clone ID: LIB3481-020-P1-K1-E9
cgtgcgatataatctggatttgggctttgctacgctactccgtaacgacggtggactcttgatctgtatggcnnntatcacgnattgcgttcgaggaggttcatcacacaagcagcca

SEQ ID NO: 16666 - DNA, 231 bp, Sorghum bicolor
  unsure (1)..(231): unsure at all n locations
  Clone ID: LIB3481-020-P1-K1-F5
cgaccgaatccatgagtggacctccaaaggtgataaacaagacagtggatggaaaactactagagccttatgagatagctgctgnngaggtcccagaagagtgcatgggatcagttgttgaacttttgggaaaagagcgtggacaaatgggtgacatggaagctgatggncctgagggaacaacatgggtaaattacaagatttctaccagaggcctnattggacttcgga

SEQ ID NO: 16667 - DNA, 183 bp, Sorghum bicolor
  unsure (1)..(183): unsure at all n locations
  Clone ID: LIB3481-020-P1-K1-F6
cgtccgccgacgcgtccggtgaaggaacgtgttctgcaaccagacgctcaggtaaacggctggctctcggacaggtactcacaaagctatgcgcgggccacggcgctggaaacccttgatactcggactgagacttacattctgttagatcttccagaggaactggttgtngaaaggctggtt

SEQ ID NO: 16668 - DNA, 197 bp, Sorghum bicolor
  Clone ID: LIB3481-020-P1-K1-F9
cgtccgcacgatcgtgtgttggcatctcctgggatcagtcggtctcagagtgcgcaagagcagatgcactccagggggctgaaatactgttcgagcccactgcactaggatctgaaccccacgatgctaacctggatccccgttaacattgtgagcgggtgatgcaaggccatgctggggccaacttggtccctcta

SEQ ID NO: 16669 - DNA, 338 bp, Sorghum bicolor
  unsure (1)..(338): unsure at all n locations
  Clone ID: LIB3481-020-P1-K1-G6
cgtccgctaaggcacaaagagcttgattttaaatttaatttaatatctgtttatggccctgcacaaaccgaacataaagctaacttcttgtctgaattggtgcgagtatgttcaaaggacaccttacctatcgttataggcggtgactttaatattattcgtatccccattgagagaaataacgataattattgtgacagatggctcttttatgttcaatgcagtaatcgacagtctcaacctaagagaaatagagctgtcaggaagaaaatttacttgggctaataacatgccaaatcagacttttgagaaattnnatagggtattagtttgtacag

SEQ ID NO: 16670 - DNA, 123 bp, Sorghum bicolor
  unsure (1)..(123): unsure at all n locations
  Clone ID: LIB3481-020-P1-K1-H10
cgtgcgggcctnccaactcttcctcgcttgaggttcaataaagaaggcaatcttcttgctgttactacagtggacaatggttgtaagatacttgcaaatgctgatggactcagaactctacgc

SEQ ID NO: 16671 - DNA, 177 bp, Sorghum bicolor
  Clone ID: LIB3481-021-P1-K1-A1
ctgtgcgtttattgtgtgcttacctgtggaggctcttttgaaatagtgcaagaccactgcactgtctgcaaacataccggttatttgtgaacatgcacatggtttacaaatagattgtattacagctcaggagatgggaagatttctgaaaaagatatcatgatgatctgtgatcaa

SEQ ID NO: 16672 - DNA, 269 bp, Sorghum bicolor
  Clone ID: LIB3481-021-P1-K1-A4
cgtccggatctactgtcagcgacgtcgtgaacttctatgtttcaggacacttcgacgccgtggactaccatggtttcatctgcggtataaacggacgtagagatcaacaccatggttgggtggaccacttgtccttgcgcaccctgaacatggaccagaagcttgtattttggatgcccttactcagctagcccgacaaggtccttcccatagacaagcgtaatatggaccccgttaactcctacctctacaaggtggcgaagaccaac

SEQ ID NO: 16673 - DNA, 135 bp, Sorghum bicolor
  Clone ID: LIB3481-021-P1-K1-A6
ccggattccgggtcgaccacgcgtccggatcatattatttgcattgtacatattcaaacagagaaagcttgttaagaggcacgcaccataagattgtcacatgagtttccattggagctacattatgtctgtact

SEQ ID NO: 16674 - DNA, 226 bp, Sorghum bicolor
  Clone ID: LIB3481-021-P1-K1-A7
ggtccggattccgggtcgcccacgcgttcggacctgtgcttcagtcttgcagcggttcacggccgcacctggagcacggcatgcacccgcgggttccagcccagggccagctatgagaatggcgcgcgccgagatccgtcgcgcgaagagcggatgcagactaatcgtgctattttgtgtgtgggaagcgatatcatatcatctgtgcgttatatcgtgcttttga

SEQ ID NO: 16675 - DNA, 301 bp, Sorghum bicolor
  Clone ID: LIB3481-021-P1-K1-B11
cgtccggttgcattgcatgcacgactgcacacccaaagcgtgtacttgactcgtctctcctccgtcgttcaatttgatctcgcagcgtgcagtgcagtgctagcacgaaacgacaacaatggcgtacacgaacaaggcggccgtcgtcgtcctcggcgcggcggtggtggccgcgttctttctcgcagctgagagccgcgacatctcgcggcggaaggacctgggcgtcaacctctgctgcagcagccgctgcggcagcagggttggcgtttgctgcagcctgggcatcggcacatggatc

SEQ ID NO: 16676 - DNA, 267 bp, Sorghum bicolor
  unsure (1)..(267): unsure at all n locations
  Clone ID: LIB3481-021-P1-K1-B3
aaattaccggaaagcactgaatgtcggcacatacccagaatttaaagataggactatgcgctaagcggagcattctggagcacacatcccacttttgtgcgtgctgactttcagggatggagtgccgcggtcgcggccagcggtgcaatcgtcgcgaacaccgctggttncggtgtcgcagcattcagaagctcttgatgctgntggaattgagtggcagatatgtcctggctgatagtagatacgtctacatacacacaaactcac

SEQ ID NO: 16677 - DNA, 301 bp, Sorghum bicolor
  Clone ID: LIB3481-021-P1-K1-B6
cgtccgatggcaagccagtcagataaccttcttgtagaaatcgaaggaactttactatctacactgtctgacaagtcatctggccactcccttacggaccaattaactcacatgacccagaatgactatctacttaatagtgggctggaaggtatagggtctactggaaagaagtggaagtgctcgccgaaaatgattaaaaccactagcgaagaagcagaaaggcaactgtgcacagacatgacaagaggagtgatatgaccagagttcaattgacagtatgataacagtatcagtcata

SEQ ID NO: 16678 - DNA, 385 bp, Sorghum bicolor
  Clone ID: LIB3481-021-P1-K1-B7
cgtgcggtgagggataaatctaccccattttctttctctaatggaggaaatccccatcggggatcggggcccgttgccatcttgagtcttggacgtaatatcctacctaaaaaatacgtctttggtgaacttggaagaatctagaagggtgtttggatgtaggaacctaagttcattagatgtatatctcggatgtcacatgaggtggtctattgagtatccgatacttataaaaaaataaaatattgatttcattattaagtcacgagacttatttgttaagcctaattaatttactattagcaatttttacggtagcagtcatagattaatctatcattaattattaattagatctaaaaggttattttataaattaggatct

SEQ ID NO: 16679 - DNA, 437 bp, Sorghum bicolor
  Clone ID: LIB3481-021-P1-K1-B9
ctatattggctgagaatgattgtgattccggtgtttgcatggaagtttataagaacaatcaacttcatatttttgtggcacaaggcttgttttctcgaagatcaaacgagctcaaggattcaagctggggtgaccagtctctcattcgccaagacagcgctgacgaggaaacagcagacatttgattgctctgggaaacaagatacaatacagaagtgagtgtgggccactcgatcttaatgtaagtgatcaaagggctagcaatgttatgtgtacccaaagtcaaatgctttctgactaatgatttggactgcaaactctcgacaagtgatgattacttcaatgaacaagaggaggaacttaagcatagggtacaacttgaagcaaaggaaagaaagctggaagagattctggaacaataatggcgggaagggaga

SEQ ID NO: 16680 - DNA, 187 bp, Sorghum bicolor
  Clone ID: LIB3481-021-P1-K1-D11
gctgtgcaaggaatctcttgccgcgtggtccgcggccactcggcggacctggtgactcgttacttgctgagccgggcctgagtgtggactgtgacgaaccgcaatgagccggtgatcgaccttcagtctcgcgaaatcaccgtgagctacacggggtggctcacgttcggagtgcagctatcacggc

SEQ ID NO: 16681 - DNA, 160 bp, Sorghum bicolor
  Clone ID: LIB3481-021-P1-K1-G1
tccatgctcgcgtctaccgaacgtacgttctgaagagacgtgccgcggagacaaccccgctgcgcaggtgtcaggcagtagactcagcgagagtcgagcactgagcatccagcagccctccaggcgagtgaacacctgcggctgtgacagtgaaaaacca

SEQ ID NO: 16682 - DNA, 225 bp, Sorghum bicolor
  Clone ID: LIB3481-021-P1-K1-G4
cgtccgaacatgttattacacttcctctcaaattagcccactctgagacatgatggacatgtatttcctgctgtggtaattcctgctccaagatgtttggggaaacatgtgcacacatctatgcttctatgacagcaaaataaaacagttcctgcccgacacataatagtggattaatctctctgtcaaatgactagatatatcatagcctagtgccagattttg

SEQ ID NO: 16683 - DNA, 205 bp, Sorghum bicolor
  Clone ID: LIB3481-021-P1-K1-G9
cgtgcgctcacgcgtacgatattgcctaccaaactactttcatatattgaactcctgagtgaactaacatgacaacatacgttgcagatatgggaaagcatcattgcttgtaacccaacatgcaacacaatacaatgccttgtgagaaaacctgggtccattgctaggactcggagagataaacagcattatagtgtccaatgga

SEQ ID NO: 16684 - DNA, 185 bp, Sorghum bicolor
  Clone ID: LIB3481-021-P1-K1-H10
cgggctcgcgcagtgcaccgttcccatggccgattcagccgcgctctccacctccctcccccgctcgctggcgtccaggaggcccctctcgtcccctctccacccgggccagagccgtcccagctcgattcggctcgctcacggtgcgtgctcgcggaagcatcgagccttcgcctcctgccgct

SEQ ID NO: 16685 - DNA, 134 bp, Sorghum bicolor
  Clone ID: LIB3481-021-P1-K1-H12
cgcgatcgtgccacctcgccctcgccctcgccctcgaggcgttagatcagtctcctgtgacgaagttttggacaattatatgcggttacacgggctggaaccctggtccactatgctgagacatcccttgcagt

SEQ ID NO: 16686 - DNA, 323 bp, Sorghum bicolor
  unsure (1)..(323): unsure at all n locations
  Clone ID: LIB3481-021-P1-K1-H3
tcccggtcgaccacgcgtccgattgctataccaatgggcgtctcaacatgggaacttggcagggtatctggctctgtgaacatcgagaccatgctactcctcgacagattgggatcacgctcaatgggatctaatctaaagtgatctatgttatagttggaaatgcanatgctgcaatttcaacatgtttaaatcatatgcaccgaaatagaaactttgtcccaattgtgatatgagcttcaatggagaatgttacttgccatatgatgctagcctgaccggaacaggattttttcacgggctttttttcatgttgagcttgt

SEQ ID NO: 16687 - DNA, 278 bp, Sorghum bicolor
  Clone ID: LIB3481-021-P1-K1-H8
cgtccggaccaccgcagtggcgttcgtgacagcggcagcagcagccgtcagggacgacgacgggggcggtggcgggccttctgctccgtcgtcgtctccggcgacgccgccgtggccggagcagttccacgcggtggtgatcacgaacctgagcgcgcacggcggcggcggcgggctgcagctgatcgacctctactacgactggccgcgcgggcgcgatctgaacatcgttcgcgaccaggtctccggcgagccgcaatggaacgtggagtggacca

SEQ ID NO: 16688 - DNA, 211 bp, Sorghum bicolor
  Clone ID: LIB3481-022-P1-K1-A5
actcaacaacctactaagagatgcagctctacgcttcaaagattttgaatacaatagcaagattctcaaagaggaagttgagaagtataaaaggcatgctgaacgattggaaccttgtatcactgataccgtgcatttcatgaaccagtcgattgtgcagaagaagaaaatattggttgaaggtgcgcaagctaccatgttagacatagac

SEQ ID NO: 16689 - DNA, 177 bp, Sorghum bicolor
  Clone ID: LIB3481-022-P1-K1-A7
atccatccagcgcgtgcgcgcgtgctctacctgggcccgctctgcgtcgagaccccgagctacctgactgtgcgagctccccaacgactacggctgggacacggccgggctgtcgactgacctcgagacgttcatcaagaaccgggagctggaggcgatccactcttgatgggccat

SEQ ID NO: 16690 - DNA, 300 bp, Sorghum bicolor
  Clone ID: LIB3481-022-P1-K1-B3
cgtccggtgactgccactgctctccctgcatgactggatgggtcttgatgtcgtccctgatgcctccaaaacattcaatgacagcattggcacacgacgcagactatgattaggaacggtccgatggtagtgtttgagttcccgtcgtctgcagctgacactgaggcgattgacacgaagctggctgcgcttacaaccacaaagggtgtcaccaccatcatcaacggctgtgattctgttgctgctgaacagaaggctgacgctgccgtccagacgcaccacatttcgaccggcggtggt

SEQ ID NO: 16691 - DNA, 113 bp, Sorghum bicolor
  Clone ID: LIB3481-022-P1-K1-B5
cgtccgtggacaggcagttccgaactcggcaggggaccatgtcgacagcgcactcgtacacggacgaccagaggctgttggacgcgtaccaccgtgacctcctgtgggaccgt

SEQ ID NO: 16692 - DNA, 184 bp, Sorghum bicolor
  Clone ID: LIB3481-022-P1-K1-B6
cgtccggccaagaacggcgtcaagttcggcgaggcggcgtgactcaaggccagtgctcaaatcttgtccaaaggctggctgaactacctgagcagcacgtacctagtgcacgcgcagagcatcctgacaatctgggcatgccaagtcgtgctcataggctctgtggagggctaccgcgtcagct

SEQ ID NO: 16693 - DNA, 441 bp, Sorghum bicolor
  Clone ID: LIB3481-022-P1-K1-B7
cgtccggcacttattacattgttctcttgaaaatatttcaaactttatttggtctccttcagtctactgaagtgtaacagcctgtagttaatggaagctcatttcttgcactgagatgaatttcccatttttatcataaccttggttatttatctgccacactaacattgatatcagcatgcttttatttatgcatttagaggatataatgcggactacacttgctgggcttatttcatcgcctttgctgtaacttaggggcacattatggaaggtgatcctgaacttattgacgattctgagttttatcaacaacttcttaaggagtttcttgagtcatgtgatagaagggccttagagtcggcactttatgccctaaaaaagcagcaagttaaaaagagaaagcttgttgatcgtcgtgcttcaaagagcacaaagata

SEQ ID NO: 16694 - DNA, 173 bp, Sorghum bicolor
  Clone ID: LIB3481-022-P1-K1-B8
cgtccgcggactcgtggactgacgcgtggacggactcgtggactgactcgtgtgcgcgtgggaaccaagcagaccccagtcaaggagcgggtcttacgataagtgagaagagccccacatgatgtcttgccatacgtacgtatacgaccacctgatgtgcgagatcgattgcc

SEQ ID NO: 16695 - DNA, 250 bp, Sorghum bicolor
  Clone ID: LIB3481-022-P1-K1-B9
cgtccgcggacgcgtgggcggacacgtgggcggacgcgtgggctgtctcgtggtctcgtgggaaccatgcagtacccccagtctaagaagcgcggtcgtttactgagaacgaggaggaagagcgctgaacaagatgtcatggctgacgtacgtcgacgaccacctgatgtgcgagatcgatggccatcacctcagcgccgtcgacatcttctgccttgaccgcagtctatgggctcagtccacgggcttt

SEQ ID NO: 16696 - DNA, 303 bp, Sorghum bicolor
  unsure (1)..(303): unsure at all n locations
  Clone ID: LIB3481-022-P1-K1-C10
cgtccgngactgatgatggacttaagttttttgaattcctccaactagcacaaaccttgtgcttgcccattgcttgtagggaggggccatcatctatcaagaggcttcatcatcaacaatagctgcattcttaaaggattgttgtaatggtattgagttagccagggtagacccctagactgcatagggttcattacttgcaacaatgggacattcagagccctttcatctttattatgnnttaattggaaatctagaatgttcaaattactactattaagataactacttaaagttctattc

SEQ ID NO: 16697 - DNA, 321 bp, Sorghum bicolor
  Clone ID: LIB3481-022-P1-K1-C11
cgtccggtcaacattttggtaataggagggtttagcttatcactagcagtcaaatcttctccattgctgcaagacgtccgaactgcctcaagatgttagcgtggtgattagatcccagaaccaagctcagttctatgctgatactcttttcacatgggtcttccaccatagcggtgggtgaacaagtcatcaatcaccgggtttctttgagcccccattcgttcatctcctgtaaatggcatcatccaccgatccaggtatttaaatcttgccgactgtggacttgttgcgccgtgccgtgatacactaatactgtgggaa

SEQ ID NO: 16698 - DNA, 168 bp, Sorghum bicolor
  Clone ID: LIB3481-022-P1-K1-C5
cgtccgggtgacctggacccggcgacggcgaaggcggtggcgggcgtagcggggccagtgctgtcggcgttcggctatctcattatcctgcggatcgtgatgtcctggtacccgaggctccccgtcacggagttcccctacatggtggcgtacgcgcccacggagccg

SEQ ID NO: 16699 - DNA, 413 bp, Sorghum bicolor
  Clone ID: LIB3481-022-P1-K1-C9
cgtccgggactgatgatggacttgggttttttgaattcctccaactagcagaagaccttggtgcttgcccagtttgggtggtaaatgatggggccagcatctatcaagaagtttcatcagcaacaatagctgcattcgtaaaggatgttgttaatggtattgagtttgccaggggagaccccgagactgcatggggttcagttcgtgcagcaatgggacatccagagccctttcagctttattatgtttcaataggaaatcaagaatgttcaaagtactactataaagataactacgtgaagttctattttgcaataaaagcatgctattcagacaataaaatcatatcaagctgtgacagatctgcaattcaccaatcaacccaactgatttggatgaatgtcaagtctata

SEQ ID NO: 16700 - DNA, 301 bp, Sorghum bicolor
  Clone ID: LIB3481-022-P1-K1-D5
cgtccggttagctcttcactattaatatatgatccacttattcctcttacaaagtttcttggttttttttttgcctaagctggctataagcctgcgttgtgctctctctcatgacttgtctccttcacacttatcatttagccagcttacagcccatcataatacttgctcttatagttaggtaggtggtcaatattaatacatggctcatttatctctcacaagagtgcttcatctctctcctctatctcagcatttagccggcttgtagcctactataataattcggctaatacaatca

SEQ ID NO: 16701 - DNA, 220 bp, Sorghum bicolor
  Clone ID: LIB3481-022-P1-K1-D8
cccgaatcccggtacacccacgcgtgcgggacgcgcgtagggtgtgtgtgagagacgaccatcccaccctctacaacaacaatggccctggagacgtgcttcatagcgtgggcggtgcacgcctcccctgccgctggtggcaaagacagcatgctcctcttcgtcggcagcagcagcggcagcggcagttacctggttctgtcttcgaagctgtccgact

SEQ ID NO: 16702 - DNA, 273 bp, Sorghum bicolor
  Clone ID: LIB3481-022-P1-K1-E12
cgtccggtcaaatcgaatcttacggcatatgtatagaacattaaatatagattaaaaataactaattgcacagtttgtctgtaatggacgagagaaatctacagtgtccaaatctaaaaaaaatagatctaaacaagtcccgagtaaaaaaccaaggatgcgagctggatcagtcatcaccaaagatctgggattcgactgaaatactcgtcacatcgtatcccaagtctattcttcctatacgtaaaaattagatctaaacaagtcccgagc

SEQ ID NO: 16703 - DNA, 175 bp, Sorghum bicolor
  Clone ID: LIB3481-022-P1-K1-E3
cgtccgcagacgcgtgggttttttctttttttaagaggaagatcaacttgatgcagcactatgcacacgcaaatacactacttgaccaaatgaaagagggtccgagcatgatatacatgcatcaacgcacagacaaacacacacacactacagaatacaagctcaagagacacgg

SEQ ID NO: 16704 - DNA, 245 bp, Sorghum bicolor
  Clone ID: LIB3481-022-P1-K1-F2
cgtccgaaaaaaaaaaaaaaataaaaaattataataaaagattaaaaataataaaatttaggtcattttaaaaaaatcttatataaattacaaaggggggtggggtaatatactattaaataagatcacataaatttaatttgggttgcccctaatttaaatccacatttacttacctaaaccctttccaatacttaaattttttttttttgcacccaatttaattttccttcgctgcttttata

SEQ ID NO: 16705 - DNA, 223 bp, Sorghum bicolor
  Clone ID: LIB3481-022-P1-K1-F6
cgtccggtgaaccgaccgacagacagacatggccgcctgcgccgtctccagcctgcccgacgcattctccatggccagacacccggatgtctggaccagctacacgaggagcagccgagtgacggcgacgaaccctcagatggcgcgcaacccgcagaggaacggcaggatcaacagcaagacggtaacacatgactgacagcggaggtacctgagcatcatc

SEQ ID NO: 16706 - DNA, 283 bp, Sorghum bicolor
  Clone ID: LIB3481-022-P1-K1-G10
cacacatgacacatctgaatgtgtatctaatatacctaaatcatagaaaacactgggccttgttgtgtacactttctgaggatgccaattcttatgacaggtacataaccgttcattagctatgcacctatcgactcaattttacacaagatgtaaccacaacgtcgacaccatccacattatacaaccatcattcatactatacatgatcgatatatatagctaatccaattgtcttagttcccattctctttccacaattatgacctggccgggctctttt

SEQ ID NO: 16707 - DNA, 113 bp, Sorghum bicolor
  Clone ID: LIB3481-022-P1-K1-G6
tggattcatggaataggataaaatgtattgaatctgacctggagcgaacaaagaaagtagctgaagcacacggtgatgaaacaattggaaatttccgagtctctagaggaagt

SEQ ID NO: 16708 - DNA, 196 bp, Sorghum bicolor
  Clone ID: LIB3481-022-P1-K1-G7
accgtccgatatcccgttcgacccacgcgtccgcggacacataggtccttcggttcgtgcagaattcgatcagttatagatagaggtaacttacatgctaagtcaaaaatctgcggcgagcggatgcatcaatccgatccgatcctacttatgcccacaccaatgaggccgagccaggttccaagatatgaaagga

SEQ ID NO: 16709 - DNA, 366 bp, Sorghum bicolor
  Clone ID: LIB3481-022-P1-K1-G9
cgtccggtttgttggaatgacagatatagccacaaaagaagcttttgattgggtatctaatatacctaaattggtgaagacactttgcattatgttgagactttctgatgatgtgaaatcatatgaggtttcctttttcgtgcatgagcaaggtacaaaactacccaaattgaagggggaggggttaatctgggtgatagcatccatattaaacaccaaacatggttgcgatacaggcaccacttccacccccatgccatttgcctcagttcccatcctctctcccaatcggtgacctggcaggggacatagaagcagaacctattccctctgtaaatttaggctttatagattcttgttcatgta

SEQ ID NO: 16710 - DNA, 180 bp, Sorghum bicolor
  unsure (1)..(180): unsure at all n locations
  Clone ID: LIB3481-022-P1-K1-H12
cgcgtgcgcccacgcgtccgctataggccggacgtaccacgtgcacctcgttcgcctctacggattctgcttcgacgcgaacacgaaggcatgagtctactagtacttggagaatggctcgctcgagaagtatctntacggcgatgtggacggcagcacatccacgaggctagagtggga

SEQ ID NO: 16711 - DNA, 317 bp, Sorghum bicolor
  Clone ID: LIB3481-022-P1-K1-H3
cgtccggtgagctacatgatccctccatctgacaacaatgcagaaaccatggtcagacctaatcgtacttcaggagctgaggaggtgactggccgccttgcagacatagatgcctatagtgatgtgctctatgatgagctttctttcaactcaagaagacatagtagcaggagccagccaccaacagctcgagctctggaagctattgcctgtggctttcttgcgactaaacacaagggcagggaggcaagtatcccatcttcaagcaagagcagcagacctgttcgtctgccacgacgatcacctgatgttgcact

SEQ ID NO: 16712 - DNA, 310 bp, Sorghum bicolor
  Clone ID: LIB3481-023-P1-K1-A10
cgtccgcggacgcgtgggcggacgcgtgggcgccaggagggctttaccggacgcctctgggccgcctgatattcaaaactgatgagatgattcaggtggtggaagcacctgacatagtgaggaacaaggtgtcattctccatctttggcctagagggtgcagtatcattgaaagggtagctgaatgtgttggaccagtaatggattcaagtcatatttgaagccccggaattggaaggaggcttcttggggttccaattccgtggcgagagggaagtcaagcttgagatcacctacctcgaccagaagat

SEQ ID NO: 16713 - DNA, 163 bp, Sorghum bicolor
  Clone ID: LIB3481-023-P1-K1-A2
cgtgcgaaactgttgttgttttctacattctctcttataaataatgcaacgaaaaccatccttgattaaatatctctgccgttttttgttggtgagcttgtgcacctcctgaaagcaagctaacccaactcgtgcgttgcttcttctgattttgacgaactga

SEQ ID NO: 16714 - DNA, 356 bp, Sorghum bicolor
  Clone ID: LIB3481-023-P1-K1-A3
cgtccgatcatggttaccggcaagatctattgtcctggagtgtttgaaatcaagagaaaatattgatctaagtggagaaatcatggttttggatagattctgcgcgtggaaacttcatctatttgagcttgaagaggagctgaagactgatcctctgaccaagtatgtgctgtatcaggatgagaggagcaagagttggcgagtccaagcagttggagttgctcctgacaggttcgagagccgaaaggctctgccagaaaagtggaggggcatgagagatgacgaactttcagcagaaaacggcattcctggttgtgtgtttgtccatatgagtggcttcaatgggggcaacaaga

SEQ ID NO: 16715 - DNA, 298 bp, Sorghum bicolor
  unsure (1)..(298): unsure at all n locations
  Clone ID: LIB3481-023-P1-K1-A8
cgtgcgaaaggatatgcaatcattttctaccggggtaaaaactacaggcgaccccaaatcatgaagcctaggaatctattaacaaggaggcggagcattggcacgctctatagagctgcaaaggcgggaggccttgaagcatcacatctctagtctgcaaggcaagatctggaagttgcagtcacaacttgtacaaacaaaggttgctagcgaaaagcangatctgaagctgcttcaaacagttgaggatgacctgtcatcagatgatgatgatgatgtaaagggatgatgggaggag

SEQ ID NO: 16716 - DNA, 268 bp, Sorghum bicolor
  unsure (1)..(268): unsure at all n locations
  Clone ID: LIB3481-023-P1-K1-B1
cgtccggcatgatggagctgcaggaggctttgctcgagagtaatcaggctacaaagggtgccaatgaaattccttctgccgcaaatggagacaatgacgagtggtcagaagtacagagattgcagacaaggataacaacatttcagaatactgagatagatanatggcagaggaaaatacaggtgacaacaggtgctgctgcacttaaaggaaagctacatgcatttaatcagaacattagtgaccaagttgctggttacatgagaga

SEQ ID NO: 16717 - DNA, 136 bp, Sorghum bicolor
  Clone ID: LIB3481-023-P1-K1-B5
cgtgccgactagttctcgtacgcgtgggcggacgcgtggggtgcaaaaggccgaggatgttattggccctgaagttgaaaagctggtcgacggccttcccgttgatggggtttaactcctggaaaacctattattt

SEQ ID NO: 16718 - DNA, 254 bp, Sorghum bicolor
  Clone ID: LIB3481-023-P1-K1-B8
cgtccgcctacgcgtactcctgtaactactccattaattctatccattgatctgcatacttaacaattcatgttactcctggggacgcttggagctacgccagttactaggatatcccctctcatgccactgctctctcttataatgacctcctcaagagcttccttacgtgctatatccccttggaatttaccatagctgggaccatcttccaaggtcgtacccaagctaagacacttggaacgcatcttttt

SEQ ID NO: 16719 - DNA, 211 bp, Sorghum bicolor
  Clone ID: LIB3481-023-P1-K1-C9
cgtccggtgaaaatgtcaccaccattattcctgctgctaaatggctgacatctaccgagctcgagggtggtgtagaaacatgcgttcttggtgccctgtgccttataggacactgtttcttggtgggtgcttatctagtcatgcaggtaatggaaagtttggagagcttatatatctatgcttgattatcgatcctttgtggttgtagact

SEQ ID NO: 16720 - DNA, 213 bp, Sorghum bicolor
  Clone ID: LIB3481-023-P1-K1-D10
cgtccgggcggtgcaggcccgccactacagcccccgaccccacgctcatccggatccagccttacgtccacgaagcacacttaccggatcctagggggatgtccttccatacgtctaatacaccgatcgcgcttataaggactaaacacggctgataccgtatgacaagaacagtactactactggtgctactagcgagtaccgtctactact

SEQ ID NO: 16721 - DNA, 240 bp, Sorghum bicolor
  unsure (1)..(240): unsure at all n locations
  Clone ID: LIB3481-023-P1-K1-D7
cgtccgcttcgtggaggacgagcgcgcgttcaactcgtgcgtggacgcgcggttcgcggcgctggacgcggaccgcgacggccgcctctggggcgccgagatgaccggngagctcatggcgctgcgcgtgcgggaggcgcacttcggcgccgacgcgccggcgcccgacgccgagctcgccggcctgtacggtgcgctcttcgcgcgctttgaccgcgacggtgacggcgccgtggacag

SEQ ID NO: 16722 - DNA, 330 bp, Sorghum bicolor
  unsure (1)..(330): unsure at all n locations
  Clone ID: LIB3481-023-P1-K1-E1
cgtccgattacagagcacatcccgttgccaatgatgcatttattcggcatagattcatatagttgggtggttgcaatgggaccctttgtttaggtttggtgcagatctatcctctntgttttcttccttatatgttttggtagcttaacctgcactgcgcctgctggtcagtacaatntggtggttagtatattgtgccctttgtactatgtntacctcagtattgtttttttgtgctatacgttctaatcaagataacactgcatangatttcaccataaaacaatactggctcactgacattatttctagtttatctgtgagtcattc

SEQ ID NO: 16723 - DNA, 521 bp, Sorghum bicolor
  unsure (1)..(521): unsure at all n locations
  Clone ID: LIB3481-023-P1-K1-E10
ctgcgctccacactaagaccggccccgagggggagaaggacccgagcgccccccgtcccaatgggagccctctggcgaggctgcctcctattccttgtcgacagcaaactcntcttccatacgctcgaaaacatcgtcgaacgcgccgtcgtcccgtggtatgcagagtttcggaacactgggctggagagatcaaaggcccttaaaaatgatctggaattgttcaatcaacatggtcacacaatttccgtaaccatttcccctggcactacatatgcctttcttcctgaagagcttcttataagggatcccaagcatttatttgcatttctatacgtttcttttcttatactcttgaatccttatgtttgtaaaaagtttttatataattcatacaaaaataacttgattttctatttgaggctattttctattttttaaaactctaaaaaatttaaatattatttaatatttttttttttaaatttctccttttttacttctttattttttttttattt

SEQ ID NO: 16724 - DNA, 335 bp, Sorghum bicolor
  Clone ID: LIB3481-023-P1-K1-E5
cgtgcgctctcgcgttacgcgcaaccacttctccctcgactccaagtccaccatcggcgtcgagttcgccaccaagtccctgcagatggagggcaaaacaggaaaggctcagatctgggacacagctgggcaggaaaggtaccgtgcaattacaagtgcctactaccgtggtgccgtgggagccctgcttgtgtatgacatcacaaagaggcagagcttcgagaatgttcacaggtggcttcgtgaactccgtgaccatgctgactccagtattgtgataatgatggtcggtaacaaatctgacctaatccacttgagagctatctctgaggatg

SEQ ID NO: 16725 - DNA, 434 bp, Sorghum bicolor
  unsure (1)..(434): unsure at all n locations
  Clone ID: LIB3481-023-P1-K1-F2
cgtccgcgtacctacaccttctggacgggttcgccggctccgggaggccgttccgccccgacgcgagccgcagcgtggcgcggctgctggcataccagcgggcaagcgtgaagcgggcgtacgtggagcgcgcgcggatgctcgggttcgagccggcgtcgcccaggacggccaccgccaacggcgccgccgccgacggccagtacggctacctggccagccccacttgactctgtactacgtagctacagtagaaagcaagaaaacaagcatgcatgcatgcatgcaaactccattcttaacagaggatatgcacgtgtttcttgacgtgcaataaattaccgtgtgcatatatgtgactataccatgcatgcatatgtggctataccatatgcatgcatnctgacaataaattgccactgtccacttacttt

SEQ ID NO: 16726 - DNA, 363 bp, Sorghum bicolor
  unsure (1)..(363): unsure at all n locations
  Clone ID: LIB3481-023-P1-K1-F5
cgtccggaaaggttcaagctacttagccacttgaaattcccatggtcggtcaatgatacgtctgcgagtcctgatggcaaactagttgctgggcttggcgatagctctgagtgtttggtagctgatgctcagtctggcaaggaaatcgcaagcctcaatgggcacctagactactcgttctcatccgcctggcaccctgacggccgcgtccttgccaccgggaaccaggacaccacctgcagactgtgggacgtgcgcaacctctcgcggtctntcacggtgctcaaggngagaatcggcgcggtgaggggcctcaagttctcgtcggacggccggttcctggcaatgtcggaggcgcggact

SEQ ID NO: 16727 - DNA, 219 bp, Sorghum bicolor
  Clone ID: LIB3481-023-P1-K1-G12
gtccgatcccgtcgccacgcgtcgccacgcgtcgccagctcgctgctaccaggctcggcgctcagcgaggcgcgcgcaagctacgctgacgcatcctgaccgttcaggtggcttcagccgggagcttgatcgcgaccggccggctccgcagaactctggggagatcacgactacactctctcgcacgctcaatgtgggggtcagtccgtcacatgctct

SEQ ID NO: 16728 - DNA, 337 bp, Sorghum bicolor
  Clone ID: LIB3481-023-P1-K1-G6
cgtgcggacaggtttaatagatcagtggtacgtgtccaagctttgtttcgttctcatcgttcacagcaggagtaccggaggatgaaggttgcgtcatgaggaggccaaggtggaattcagtcaaaattagttaagacgggcataggttcaggatctgaagtgacttgtaccttgtaggggttggccagttcttctaattcttgtatatttgaaggaataggcgtagcttgctgatggtgtacattttaggaacatctgacgctcgtggccagtctgccaaatgtacctgccgttagccttcttctatggtgtgtatttggttggttttagttgggcg

SEQ ID NO: 16729 - DNA, 331 bp, Sorghum bicolor
  Clone ID: LIB3481-023-P1-K1-G8
cgtgcgcaagtatgcttgggtcttggtgactaggcctattgaatttggcggcctcggaattctggatctggaaaaattcaggagggcactaggcttacggtggctgtggttttcatggaccaaccctgaacgtccatggaatggcacgaaactaccgatcgatgtagtggatgcaactctttttgcagctgcgacaagagtcacggtctgcaatgggagaaaggcttccttctggctctccagttgggtagatgggcaggctccggctatcatgtgccccctgctttacaaacatagcaagcgaaaaaaacgatcaattagagaaggattg

SEQ ID NO: 16730 - DNA, 291 bp, Sorghum bicolor
  Clone ID: LIB3481-023-P1-K1-H1
cgtccgcaattttggtgtggcgcgcttcaaaggatggatccggtggcataggtaactacgtggtggtggaaaactattttgttccttcgctggtctaaaagagagctatattctttgaacggaacagcaaaaaaggtacttttagtaaactagatgttgatcgggtatcatttgaatttgtgaaacttaaagggatgctcttacaatcatcacaggaaacaatatgaaaacatttttaaaaaaaatctttaggtaagggttagcgtgaccattctaggctttcacatggta

SEQ ID NO: 16731 - DNA, 225 bp, Sorghum bicolor
  unsure (1)..(225): unsure at all n locations
  Clone ID: LIB3481-023-P1-K1-H10
cgtccgttcatttgtttactgttttgtcatgcagatatggttcgtggattgatgtgcaatctgatggcttctgaagttcgtgatattttacgtctggagtgctacgtgaccaaggatatagagttcatgttcgtttgcttctggatgatgctgcgtaacctgttgcaaatgtgtcttatggatgatgccacanatgatccactctcattttgtgttgtatttaat

SEQ ID NO: 16732 - DNA, 250 bp, Sorghum bicolor
  Clone ID: LIB3481-023-P1-K1-H5
ctcgacccacgcgtgcggtgaaggagctcaagaacggccgcctcgccatgttctccatgttcggcttcttcgtccaggccatcgtcaccggcaagggcccgctcgagaacctcgctgaccacctggctgacccagtcaacaacaacgcctgggcctacgccaccaacttggtcccggcactaaagctgtcagttgctatcactccatgcttcgagagcgtctgatgatgagctagtatactgatgggttg

SEQ ID NO: 16733 - DNA, 371 bp, Sorghum bicolor
  Clone ID: LIB3481-023-P1-K1-H7
cgtgcgcccacgcgtccggcataaagcaaccgtggctgaatttctctccaacaattatgattgggtcagtatttttaccttgggaacattaggcaaacttatttcatttatgaaaattttgtatccttcctctcgctgtatatgttcgaaccatacatgaccttactcaagttgtagtgcaacattaaattctgtggttaaatgtgtcaatatctacctggttaggtctaacctgattgaattggttacatggtcaaattgttggcaagctgaattcactgcatggactctttagaggcttaaaccggagtggtgaactactagaagttttgtatcgatgaatgatgaatcttaattatgaactataaaaa

SEQ ID NO: 16734 - DNA, 325 bp, Sorghum bicolor
  unsure (1)..(325): unsure at all n locations
  Clone ID: LIB3481-023-P1-K1-H9
cgtccgaggacattgacgacccttacagtatagctaaggtgcacagacgataagacactctcaagactacagacgctcacagacactacatgcgggctacgaaacaactcaatggagtctgacccaccctgcaaattcgaccataccatgaagaactgattgctacaaccctctcacaccatacaaggatcctactaccgagtgctggtctcttgtatacctagtggataacacaactcctgaccttcctatattgcaggatatttaaaaactaactaccgctccaacatgatccatatntgacgtatttttgggtctgatggaa

SEQ ID NO: 16735 - DNA, 221 bp, Sorghum bicolor
  Clone ID: LIB3481-024-P1-K1-A11
cgtccggtacatgaacaaaagatcaagataatatggctagatcgaaatcgcaccttatagattgatactatgaaaaccgagtcaaactgtgtggacctgttgaaggattgcgagcattggctgcatgctcctcacactgcagggctaccttgagctattacataatgccttgacaagagatgcatgatcgacgctttggatcgggtgtcactaaacaaata

SEQ ID NO: 16736 - DNA, 444 bp, Sorghum bicolor
  Clone ID: LIB3481-024-P1-K1-A5
ccggtcgaccacgcgtgcggaagaaatctcagtggcaagatgtaattgatctcaatcttacaggtgtcttcctgtgtacacaggctgcaacaaaagtaatgatgaggaagaaaaaggggaaaattatcaacattgcatctgttgttggccttactggcaatgttggccaagctaattatagtgcagccaaggctggggtgattggtttcacgaaaacagttgccagggagtatgcaagcagaaatatcaatgtgaatgctattgcaccagggttcattgcatctgatatgactgccgaacttggagaagagcttgagaagaaaatcttgtcaaccattccattaaggagatacggccaaccagaagaagttgcaaggcttgtcgagtttctggcccttaaccccccaactagctatttgaccggacaggtgcttacaattgatg

SEQ ID NO: 16737 - DNA, 283 bp, Sorghum bicolor
  unsure (1)..(283): unsure at all n locations
  Clone ID: LIB3481-024-P1-K1-A8
cgtgcgaatacaaactctgacattttcctacaaaaagatgaacccattttgtctaccttttgcaactacaaacatacgttcgtgctatactcgctatttatctcnaccttcttttcactaattactctatttttacccttttacctactaacaacttttctatcttcaacttacttaaacttataataacactattaacatatcaatctttcttattttatgtaccatatctttttattctttttaaaatctttatataaatatttatctattatttattaaa

SEQ ID NO: 16738 - DNA, 275 bp, Sorghum bicolor
  Clone ID: LIB3481-024-P1-K1-B10
cgtgcgcaagagtgtacaaggaagaagaagcaccatcagcttctcttgatgctaccttgatccatcagcagcagcttcttcgtctgcttttgggggagattattaagagtaggagtaggattactagttattattactagtgagtgagtgaatgagtgatcgaacgaggatgctggccgtgtccatccgctgactaacatctgaacttgtccggccgcgaccagcaaagcacgctggtgtctgaggaaattgctgaatataatgggaggtctttt

SEQ ID NO: 16739 - DNA, 120 bp, Sorghum bicolor
  Clone ID: LIB3481-024-P1-K1-B9
cgtgcggtacatccgttccagcctacatccatggcggctcatcccctcctatcctacacagcgctggtttgttgccgtcgggcacctgcacgcgctgtatgggaaaggagccaccttccc

SEQ ID NO: 16740 - DNA, 272 bp, Sorghum bicolor
  unsure (1)..(272): unsure at all n locations
  Clone ID: LIB3481-024-P1-K1-C12
aattccccggcgacccacgcatacgaccaaagctataatttaattattctaatttgtaccatctcttattctgtctcatccacatncaccaaaanaacgaagatttttatttacatttaatttntatccctcaanacatacannctttatanaactccatcaattatataatatctcatttcctcttctctattaatcacattttaatattccaaactaaactctctatatcattatttatataatcattatatcatcttacacaaatatta

SEQ ID NO: 16741 - DNA, 280 bp, Sorghum bicolor
  unsure (1)..(280): unsure at all n locations
  Clone ID: LIB3481-024-P1-K1-C2
cgtccgttctggtacgggcaaccggcgtgttcttctgttggctctcaggatgaaacctgaatcttctaatggtgttacagttacagcagtgaattangcttggaatttgattgacagatcaaagaagttaattacaagtgtaaatacagtatacaaagttgtttgggtaggagtaggacaggcttttattgttcagttgctcttgtctcggtcaacctgtaaacagatcatgcgaaagatgtacaatgaacaatctatggagtgttagagttacacacaa

SEQ ID NO: 16742 - DNA, 526 bp, Sorghum bicolor
  Clone ID: LIB3481-024-P1-K1-D12
cgtcctatataaaattaatataataaataatttaacattatatcataaattattaactacacatcttaatttcacaaataaagagtgattattctgagacttttctaacttaatcaccttataatattctctctttttcttttctttttaaaaacaaatataatgcccccccttctttaaaaaaccaaatttattctccacttttttaaaaatattacttttatatttctcacctatataatatttctctcccctcttttataaaacttttaatttaaaaaacccttgttttcccaaattttttttctcttaaaacaaattccctttttcccactttttcaaaataaaaaaaaaacccccactatttctcctttcaaaatatttccctctttttattaatttacacccctttttacccctttttaatccctttttttttttatccccaatttccctttttttttaaacccttaaaccccccttttgtttttctcctttttttcccacaatccctttttccaaaaat

SEQ ID NO: 16743 - DNA, 249 bp, Sorghum bicolor
  unsure (1)..(249): unsure at all n locations
  Clone ID: LIB3481-024-P1-K1-D7
cgtccgcgacgtctggctcccgttcctgacccgccgcggggtcggntacgtggcggcgatgtctgcgtgtcggggtgtcatgggagacgcgggcctgcgagctcgggcgaacacatggctatcaagtctggcacgtgggcgcggcgaacaacacagcggcggggtggtgggacggcccctctgatagaacccacggagcttttgctacctcgggcttctgtgttgtggttttgagcgggcttggtgcgt

SEQ ID NO: 16744 - DNA, 199 bp, Sorghum bicolor
  unsure (1)..(199): unsure at all n locations
  Clone ID: LIB3481-024-P1-K1-D9
tccanattcccngtcgacccacgcgtgctaaaaaaaaaaaaatatcagcctctctaaataatccaaacttacttactcgtactttctacatcataattcttcccgattatttccgaaattctattcttttcctctctttttacaactcctatcactcgtaaatccctttcttaacctaatttatactccctttatcaca

SEQ ID NO: 16745 - DNA, 370 bp, Sorghum bicolor
  Clone ID: LIB3481-024-P1-K1-E1
cgtccgatcgatttcaccaccgccgagcacaagatccactaacacctcgcccgcaacccgttcggccaagttccatctttgcaagatcgcgggctccacctatgggaatcgcgtgcgatttgcaagtacactgccctcatgaacaagccagcagagctgctgagggaaggcaacctccaggagtcaaccatatgtggacgtgtgagctcaaggtgtaatccaaccattacaccgccgccctgaaccctatcctgtacgagtgcctcgtcagtcctatgttctgcggcaccaccgaccagaaagcggtggaggagaacctcgagaagctgtagatggcactggaggtgtacgaggcgcatttagacaagca

SEQ ID NO: 16746 - DNA, 342 bp, Sorghum bicolor
  Clone ID: LIB3481-024-P1-K1-E11
acgcgtccgcaagcagctcaccctagacctgtgcagccaccccatctccacaatcacacacttacatcaaacactgccagtcgaggagcatcatggcgttcctctccatcatgtacactcaacgaccactactctcctacccagcaccaaggccagcacgaacctatccgactacctatcgtacgcctactttccagcacccacgcctggcgccagcgcacaccgcccgttcggcgacacctacgtctacagcctggacttcttcctagaccgctgatcgccggcatactacaacgtgctggccaagcgcctgtggagctacaacaagcacttccgatcccc

SEQ ID NO: 16747 - DNA, 420 bp, Sorghum bicolor
  Clone ID: LIB3481-024-P1-K1-E5
cgtgcgagtagtgccaaatggcaccaaaccctttccaaagtccataccgcacttggtggattaaatatttatgaccttcttgaaccattcctggaccggaccaacaccaaagaagggattccacaaaagaaccaactggcttcaaggttcaaagatcttggggtgacttggaaggccctttcagttagaaattgaatgcctggaccggcctggcctttgagagcttctggaagagatgggcgtgttccattatggcaagagcttgctggattaagtccccggggaattccatggatgaatgatgaaagtgcaaccgcatggcttaacaatgattacctcagatctgcgattcatgctgaaccaggcaggtcaattggaccctggcaggtattcacagaattagattttgatcatgatgct

SEQ ID NO: 16748 - DNA, 409 bp, Sorghum bicolor
  Clone ID: LIB3481-024-P1-K1-F3
cgtccgcaaatggggtgacaaatgccactttgcacatggtgaaaaggagcttggcaagcctaagttgatgggcagctatatgccacctcccgtggggccaagacgcgcactggtcattttgcacctccaccaatggccagccctggcttggccactccagctagcttcggcgcttctgccacagccaagatcagtgttgatgcatcccttgcaggtggcatcatcgggaggggtggagtaaacacaaaacagatatcccgagtcaccggggcaaagctggccatccgggaccatgaatcagacaccagcttgaaaaacattgagcttgagggcacctttgatcagatcaagaatgctagtgctatggtcagtgagcttattgtcagcatcagtggcaatgccccttcac

SEQ ID NO: 16749 - DNA, 385 bp, Sorghum bicolor
  unsure (1)..(385): unsure at all n locations
  Clone ID: LIB3481-024-P1-K1-F5
cgtccgggactgctacgtggactccatggtgaagctgaccatccccgaggacggcgggaggccgctgacggacggcgagatcgtgagcctgggctccgagttgctcagcgccggcaccgacaccacggccaccgcgctgcagtggatcctggcgaacctggtcaagaacccggcgatgcaggacaggcttcgggacgaggtgtccagcgtcgtcgttggcgccgacggcgaggtgcgggaggaggacctgcaggcgatgccgtacctcaaggccgtggttctggaggcgctccggcgccacccgccgggccacttcgtgctcccgcacgccgtgcacgaggacacgacgctagatgggtaccgngtgcccgccggcgcgcccgtg

SEQ ID NO: 16750 - DNA, 254 bp, Sorghum bicolor
  Clone ID: LIB3481-024-P1-K1-F7
cgtgcgcggacgcgtgggcggacgcgtggggggtcgcgcatgttgtcgtcgccgcattcaggaagtgcggcgtcgaggtcgccgaagacgcgtcgacgctgcacgagtgcgaggacctcgacggcatgttcgcgatacaggggagtcgccggctcgcgcacaccgatcagttcaggttcctggacaaggcagcggcggagactgcggccctctaggctgcgcgtccctcgagctcgttgcttttgttcacggtg

SEQ ID NO: 16751 - DNA, 193 bp, Sorghum bicolor
  Clone ID: LIB3481-024-P1-K1-F8
cgtgacagaccattcatagtaacatgcagaaacacactcagcagcctatctggaatgtggatatctaattgatctaccaggggcacttgacgagactgaatgtatgaaatgttcaccaatataccaacatgtttttataaatcaatctaatatgattgcttttgactcatataagatcaatgcacatgcatcc

SEQ ID NO: 16752 - DNA, 226 bp, Sorghum bicolor
  Clone ID: LIB3481-024-P1-K1-G11
cgtgcggcatcctcaagtccaacggcgaggactggctgcaccagaagaaaatcatcagcccaaagttattactggacaggagcacaggcatggcagatctgatagtccattctgctcaaccactgctgaagtcatggaaagagagagtagatagaaatgagggcatcacacacattaacatcgatgatgacattagggcttactttgcacatgttatctctagaac

SEQ ID NO: 16753 - DNA, 259 bp, Sorghum bicolor
  Clone ID: LIB3481-024-P1-K1-G12
cgtccgcttcgcggtcgacgagcgcccaccattaatggtgttgccagtctcaacaagacactatcaacaatttcctttaggactaaacattgccatggacataccagatagatccaccctgtagtcaaaatgtgtggcatcacatcagctagagatgcataattggctgtaaaggcaggagctgaccttataggcttgatactgtggcccaactctaaaccctctgtctcgtttttggaggcaaaagaattttcaagag

SEQ ID NO: 16754 - DNA, 351 bp, Sorghum bicolor
  Clone ID: LIB3481-024-P1-K1-H6
cgtgcggttcaaaacgaaatatgttgtagtttagtttagagcaacaatctacttggcaagtgacaatgcaactcgcagtattctctaactcagtgaactcatggcagtggagtttttacttaactgatgatccctgattattttgcaataaaattgtaatcactgcgtattttctgcctcttttataactgctaatcggatctatcgtattaccaacaagacttatgtcagtatagaacttccatattcagagttcgcctattttgaattgtttctaccaagtgattgatctgctgtcattttatggttcgcacctgtcaactttatgtgccagctttacttcacatgtta

SEQ ID NO: 16755 - DNA, 272 bp, Sorghum bicolor
  Clone ID: LIB3481-024-P1-K1-H8
tccacatacccgggccgacacacgcgtgcgaacataaaaataaaactaaacatccctgactattatgctcccacacagctgttcaaacctaaataaaaattacggagcgtttcttcgtgactttttttctatcctcaatttaacctttttccctattttcatcattaacctttccttctacaaatttcttattcgccctgctatgtactttgatctcatagttgatagccagcccattgttcactactacaacatttgaacaacattgtttt

SEQ ID NO: 16756 - DNA, 170 bp, Sorghum bicolor
  Clone ID: LIB3481-025-P1-K1-A4
catccagtacaaagaaacatattgctatccacgcattctcacacatctttatctacagactttgagtgctgcaaaaatgtactctgtcctacataggtggagctgggattgatattacgaatgcgaatattgacattaaccatatttggaattatgctgaggtgcttgtt

SEQ ID NO: 16757 - DNA, 237 bp, Sorghum bicolor
  Clone ID: LIB3481-025-P1-K1-A5
cgtccggagtctggacgaccgttgcctcatgcacatgttgaggtttcttagcccaagcccagatggcgcttgcttgcatgccaccctcagctgtggctgcgtgtttagaggccaatcagagatgctatggagcctgcagtttatccaaatcgtgaggccgccgtatttgctgctgggcctggtgacaccatttgtattgcggttggtggtgcccatgttgcgtgtaacattcaaatt

SEQ ID NO: 16758 - DNA, 305 bp, Sorghum bicolor
  unsure (1)..(305): unsure at all n locations
  Clone ID: LIB3481-025-P1-K1-A6
cgtccggaggtactgggcggcacctgtttaactccagcacaggacaaggtagtgcaagagaaagccatggccatcaaagctgaagtgtccatgggtgtggcgaccatgaataagaaaattcttggctacaacaactaagcgttcatcctagacttcagtgatgccgctgagtatttgcccgacgggaagcaatctcttacactaccttggcaggggcaaggaaggtcatggcgcacagtcttgcncaacctgctgatgcttgccaccggagaatggcgcgagtttgtgcgcgacagctgcctata

SEQ ID NO: 16759 - DNA, 182 bp, Sorghum bicolor
  Clone ID: LIB3481-025-P1-K1-B1
cgtccgaaaaggaggtgtattggaagcaagctctcgggcaatattctacctgcagttattcaacaacttaatacacaaataatgagtttgagagagcatggggatctttaaatgcgggttgcagaccagtgaagtttcttgcaactctgaggacatggtgccgtggaggcacatggtggact

SEQ ID NO: 16760 - DNA, 157 bp, Sorghum bicolor
  Clone ID: LIB3481-025-P1-K1-B6
catccagcctgggctggcttctcttcttggatgggccgtttcctctgatctgattgaaccatgtcccactacatgtgctgtgtgattatgtggggaggcgggtgcgatgaataaaacgttcagattctggatgctatatccaaaccatacaaatgga

SEQ ID NO: 16761 - DNA, 328 bp, Sorghum bicolor
  Clone ID: LIB3481-025-P1-K1-B8
cgtgcgggtctttcaatcagatcaaaccaatgcacacatataacagcatagattaagtcagtaatatcaaaataatcggactgaacatattaggggtagatgagcgcccaatgcagaataccctcttgacaccaccttttgcagatgttgttaacatgtcaccaacacaattcggattgcagaaacaaaatcaattgccacttcaaattcctagatccttccctgttcctggttattcaagaatggtttacaaagaagatagggacgacgactactactatgatggtagtgacaatgtttagttgcatgagacttcaccaaattcaat

SEQ ID NO: 16762 - DNA, 250 bp, Sorghum bicolor
  Clone ID: LIB3481-025-P1-K1-C5
cgtccggccaatgactgggataataaaaggctaaatccaggaaatgacaattatccactttcgacagcaggtccaaataatttgtttttgggtgttgagcaaggagctggaagcagcaatggccagggcgccttttccaagtttgacaatgggagctcaatggcattaccatttgggccggggatgtgtggtctgatgggaaaaggggcaaaatggcgcgatggggactggtttggcaacaactggaaca

SEQ ID NO: 16763 - DNA, 168 bp, Sorghum bicolor
  unsure (1)..(168): unsure at all n locations
  Clone ID: LIB3481-025-P1-K1-C8
cgtccgggaaggtggcgagggcagaggaacgaccagcgtgctcttggtggccagagggagggtggtgacctatgtcgcgaagaagaggctgagccanattgtggtcttgatcttcatcgagctgaagcgggtactggtgagcaagaacaacanatgaactgctacatt

SEQ ID NO: 16764 - DNA, 137 bp, Sorghum bicolor
  Clone ID: LIB3481-025-P1-K1-C9
cgtgcgtattattggaactggtcgatcaggaactatgtacagagcaacactttcagatgggttatgtcttgctatcaagaaggtggaggacggtgaacattcataggatcaatttacatttgagatgtgaacactag

SEQ ID NO: 16765 - DNA, 341 bp, Sorghum bicolor
  unsure (1)..(341): unsure at all n locations
  Clone ID: LIB3481-025-P1-K1-D7
cgtacgtaagcagaatcgcgagcaccaccatgatgctagtcaaattgggatgtgtgtaaatgcttaccctggtgtatatggggctggggaggtgagccagatacctatagctgtaggacagatgtgtcattatgccagaaattattgtaccaaactacattctgtttgtacaaaatcttgtccacgagacaacacctatgatgcttcagatgctcttatgtcataccatgtctttaaggtggttttgttggtcttggcttagcctgtgattgtttttttggagtatggagacgaggggcaagccactgttgccatgaacaaccttnaaagcttcaagattt

SEQ ID NO: 16766 - DNA, 157 bp, Sorghum bicolor
  Clone ID: LIB3481-025-P1-K1-E1
cgtccgacgatggcagcaatggccaacaccacatccttccgttcccgcctgctcgtcctctcaccgtcaccggcgccccgcaccgtcgtgtgctttcgtctccgcccatgcgctaccacggtcttctcgtgctcccagaggaggaggaggccccgcc

SEQ ID NO: 16767 - DNA, 153 bp, Sorghum bicolor
  Clone ID: LIB3481-025-P1-K1-F5
cgtccggccggcgggccgatcggctaggtcgtcgacccgctctacccaggcggcagcttataccccctcggtctggccgatgatcccgagggcttcgggcggctcaaggtgaaggagctcaagaacggccgtcttgccatgttcttcatgttc

SEQ ID NO: 16768 - DNA, 332 bp, Sorghum bicolor
  Clone ID: LIB3481-025-P1-K1-F8
cgtccgctcttcacaagctcggcagaaaggtacttcgggctgtagtgccggctgccgttccatgtagagttgtcaacaaggatatgaaaccgcctcactgcattgcttggcaacctctgcacctctacgaagtacagcaacaggaggtatgatgtgttggcattgtttatgggggaattctagctccatgcgaagttgatctgggtttcattcactggagtggtggcactccctagtatcttggttgacgtgtggaagctgctgatgttggagacataaatgggtgttgagctttgtattgttggagcatgcattcatgtcggcatatgcct

SEQ ID NO: 16769 - DNA, 449 bp, Sorghum bicolor
  Clone ID: LIB3481-025-P1-K1-G12
cgtccgacctaccctgggttcgaacactacccatgccatggcatcctcgacccaatcacacgaccttcctcgccgcgagcgcgcgaagcacccagccatggtagccctccccaccccggcacgcgttctacccccacccctgcgccggccctaaacatgtccgatggactccatggtgtcctggcccctaccaccccatggattcggcagcgcccgttgtagggggcattcttcctccatgtgcatactacccaatgccggcagcgacctagatgctgcagctgactcggatgattgtgatgctgttgcggtacctctaaaagctctccttgcggcttgtgtggaccaacgggccaaggaaattgttgaaaagctgttcgcttacttgggacagtgtgattgcacgaagaaagctagcaatgctgcaaccggcatgtgtgataagcaca

SEQ ID NO: 16770 - DNA, 368 bp, Sorghum bicolor
  Clone ID: LIB3481-025-P1-K1-G2
cgtccgacacgctcctcatccaggtctgtgccttgctttttgtttgttgatattgattcgaaggtcatcactgccccagtgtatggtttcaattggtttaagttgattagacttttattctgctaccgatctaaattagcaagaaaccactatattgtagaataaaaaggaaaaacaaaattactgtgtacacacgcaattgacagatgtttatttttaatgtgaactttccattggcaggagtggaatgggagttcaagtcccactgctttagtttatgacgaacaattttaaggtactttttggaccattttcaggctcgcttttgtgagacacattttttgtacttcatttacaggtcctaaact

SEQ ID NO: 16771 - DNA, 357 bp, Sorghum bicolor
  unsure (1)..(357): unsure at all n locations
  Clone ID: LIB3481-025-P1-K1-G5
cgtccggggtaggtagttgtgctcttctcccctgtcccagaggccgcctgcgtctccgcttcgtctcaccacccaccaccttcttcttgccgggggacgcctcgccggagccaccagagcttccggcgaagaaatccggcgggcacaccacaagggggcggagcaggggggacggtggcgcgcgcgccggaatggggggccagcggccggtcgtcgtcagcgctggtgtcgcgtcgctctagggttaggtaggtgtacagtgctttcttacctagggttggctccccgcggccagggctgtgctggcccggcgtcgcattgggggtncccggccgaccgtctggccgtgtgattcac

SEQ ID NO: 16772 - DNA, 175 bp, Sorghum bicolor
  Clone ID: LIB3481-025-P1-K1-G7
cgtgcgggttattaatgctatgactctattcgatgaaatgactgatgatgggatcagtcctgatgatgccacattatgggtcactaggtgggggggtctgtaagaggaacatggccgaaggagcactggagcttttgaatcatatgcttgctctcagctttgaggttaaagcaac

SEQ ID NO: 16773 - DNA, 339 bp, Sorghum bicolor
  Clone ID: LIB3481-025-P1-K1-H2
cgtccgtgaaaggcgagaagcaacttgtggaaaaactactgcaaacagaaataaatctactccgctcaatcagggatggttcggctcttatgcagcacatggaagacttctactatgtcacccttcttgagaatgtgaaatcaaggtatcaagtggtagatggtgccaatgatgaataccgccaattgacaagcgtatcctagtaaaattgcacagtgatacacagttatttgtgaagggtgtcaagcagtctgggctttcaagtgtcgtgcacagtgatacctgatacggaattattgaggccgaagcaacaaggctgtttgtatttagctattttgg

SEQ ID NO: 16774 - DNA, 441 bp, Sorghum bicolor
  unsure (1)..(441): unsure at all n locations
  Clone ID: LIB3481-025-P1-K1-H5
cgtccgctagaggcatcgtatacccgccggcggcggccaacacccaccagttcaagaggctgaacctgaagaaaaattattggaggcctgaccatactaccagagagctggaacatcgtcaccaaggtccactaccacgccgccatcgaggaccaatgccacatccgctcaaccattgctgataccagtctgtgccgttgctgaaggtgtcgccgtgaggggaagctgcgccatcacagattgccagaggggaacaaacaagacctaggagtggcgacgacatcgcgtaagccgagcggtagcggcaacacgcattggtgacgagcgttgaaggccacgcataggcaccgagattataagagctagaaaactactattggaggactccagtttaaaacaataaaagatactattagcttgtcatcttagcnaagagagaaa

SEQ ID NO: 16775 - DNA, 141 bp, Sorghum bicolor
  Clone ID: LIB3481-027-P1-K1-B11
gcacgcgtccgagcgaagccacacaacgctctgacacccgacacggcggaagcagaggccaaatatcacgagaaagccatttttgcccagatggggtgcgactctatctaccaggggattggcacacaaaaatccacaatc

SEQ ID NO: 16776 - DNA, 395 bp, Sorghum bicolor
  Clone ID: LIB3481-027-P1-K1-B3
ccggtcgacccacgcgtccgctaaggctaagcaattggatattgtctcttcagaactgcaatcagaattgataagtttggaatcacgatatgattgtcctgacgtgaatggcagtcttagcctagaaggtctttcctcggtgagagcagcagttgttcttcctctcaaaatggataaaggtggacctcggactgcactttttaggctatgcaagagattgcagtggccaattccagaatttgaatttgtggaacaaaggttcaggactcctattgttctggatggggttacaaccacaaacttcaatagcttcgtttcaactattaccttgcacatacctgatgtgactgtcattacacttcaaggtgagcgccggactgacaagaagagttctc

SEQ ID NO: 16777 - DNA, 378 bp, Sorghum bicolor
  Clone ID: LIB3481-027-P1-K1-B4
cgtccgtgatcatcagagaacacattctcatcacgaacctcttcacatgtctgtggttcaatgaagttgaccgcttcacctgcagggaccaaataagtttcagcaccgtccgggacaaaatcagggctagagttggctggatgcccgaaatgttcatggactgcgagaggcgcaactttgtcgttcaggtattgccgctgacccaaacccattatgtcattcggtcctgccccacctttttctgttgcacggctgcctgacagttagtgcacaaataaactagtgtccctattaagttgtgtgtactcctaccggccgacatgttagctcaaagtcatctgtcgctgtgcattgaccagcgtacaccggagctctgag

SEQ ID NO: 16778 - DNA, 350 bp, Sorghum bicolor
  Clone ID: LIB3481-027-P1-K1-B5
cgtccgggtacccctccattattttggccaaacgtcgtccaccagcctcccatccatggatccaccagcctcccatcaaacctccttcccaccggcgtcggcgagcctcccctcactggccgcggcgggcctcgcccagcccccaccggtagcagcacgatcaggtcagcgcgctcggtggcgctcctcctctagcagatccagccgtgagtggctcgcctcgtgcaggtgcggcccgttggtggtgcggctccaccacaaggcaacaacggcagttgcccctcaacctttcccagcggatccaccgcacagggctcgtccccttcatcaatatggcgtagggcttccgt

SEQ ID NO: 16779 - DNA, 283 bp, Sorghum bicolor
  Clone ID: LIB3481-027-P1-K1-C11
cgtccgccaaggtgatgcccatgggcaccttgtatccgttcagtcctcaagctggatggtgaagcgtctgtgtaccatgtaccttgttgtgccttgcgtgatgggctataggatccccgaggagacaatgacaccaaagagcagtgagaagttcacgatgtaggctgggctctttggtgcttgccttcatagccagaagcgttggcaggaaagactagagcggttgtgcatggtgacgtggtgtccgaggtgcaatggaggtgggtcagtgatgacatgtttt

SEQ ID NO: 16780 - DNA, 302 bp, Sorghum bicolor
  Clone ID: LIB3481-027-P1-K1-C5
cgtccgatttcggttaatccatcggcccaataaccagttggatgaaaaaaggcgtttaaggatggcacttgatgtggcgcgtggtatgaattatttacacaattgcacccctgtcatagttcaccgggatttgaagtctccaaatctacttgttgacaaaaattgggttgtgaaggtttgcgattttggtttatcacgtctgaaacatagtaccttcctctcgtcaagatctacagctggaacagcggagtggatggcaccagaagtacttcgaaatgaaccatcagatgagaaatgcgacg

SEQ ID NO: 16781 - DNA, 318 bp, Sorghum bicolor
  Clone ID: LIB3481-027-P1-K1-D10
cgtccggtcgcattgtctgaggcattagggacatgcactcgtctgaagaaacttgatctccgggacaacttgtttggtgttgatgcagggttagctctcagcaaaacccttccaaagcttcctgatcttgttgagctttatctcagtgatctcaatcttgagaacgagggcacaatcgcaattgtcaaagccctcaaacagtcagcaccgcagttggaggtccttgaaatggcaggaaatgaaataaatgccaaagcagccccagatttggcagaatgcttaacagcaatgcagtcactgaagaagctgaccttggct

SEQ ID NO: 16782 - DNA, 205 bp, Sorghum bicolor
  Clone ID: LIB3481-027-P1-K1-D11
gtccgatccgcagccgcccagcgcgccacctagcaccgcgcgctctctctctggactttctcttgcgactgcactgcggaccgcggggtcgggcaaacaccacgcgccgagcttaatcaacctgcgagcttgatgtggacgacacgctaacaagaatgggctatgcaacactaccatttgtgaaagggctgacactagcatcacc

SEQ ID NO: 16783 - DNA, 381 bp, Sorghum bicolor
  unsure (1)..(381): unsure at all n locations
  Clone ID: LIB3481-027-P1-K1-D6
cgtccgcgcacgccgacgacgccgcggacgccgccgtgctgctcatggagaggtactccggggccgagcacgtcaacgtcgggagcgggcgcgaggtgacggtgcgcgagctcgcggagacggtgagggaggtggtcgggtacgaggggcgggtcgtctgggacacaagccggccggacagcgtgatgaggcggctgctggatagctctaagatggcggcgctggggtgggagcccaaggtcgagctgagggacgggctcaagaagctgtacgagtggtacctgagtggccgcgccgcaagcttccaaccatgaactcatgactgtgtgtanacgtagctcaacaacttgtctactttttaatgaacactcgatctatgat

SEQ ID NO: 16784 - DNA, 304 bp, Sorghum bicolor
  Clone ID: LIB3481-027-P1-K1-D7
cgtccgcttttgtaatgaaaggttaccttggcgaggaggattctacatctgagatcttcgacagtgaaggatggttgaggacaggagatctctgttatattgaccaagacgggtttggttacattggtgaccgactgaaagagttaattaagtataaaggctaccaggtagtatctgctagtgttactagtattctaatcagcattctaatgacccagcattccatcagagcatctgatctgttacagacttgcagtgtcagcttgccttcgcccttgaatgctgatggcataatatatgtttc

SEQ ID NO: 16785 - DNA, 133 bp, Sorghum bicolor
  Clone ID: LIB3481-027-P1-K1-D8
cgttcgcttgcgtcttctacgtgctaccacggctcttactcgcctacataccatgcctttgccttcgccagatgacatgaagacacgaggtgtccgctcatatcccagatattcgagcgactacaaatgcgac

SEQ ID NO: 16786 - DNA, 208 bp, Sorghum bicolor
  Clone ID: LIB3481-027-P1-K1-E11
tttttaaacaaatcctgaacgtaagatgagtataagcgtaactgggggatctggcgacacgatgatcgagcactgaacatgaacatgaacatagatcgtcttctatggatgcatgctcccgtaacggttcacttagcctggtgccatgcccagtgtcgcatggcggtgtagttcctacagacaacagcatggttctgaggacagtgag

SEQ ID NO: 16787 - DNA, 175 bp, Sorghum bicolor
  Clone ID: LIB3481-027-P1-K1-G2
gcgtccggatgatctgatgtagatttacgcctcctgtgtgtagcggtggtcgattgtgtaagctgggggttgggtggtgttggataccggcgccgccgccgcaacaactggcggacgcgtggccgggccggtgactctgattttttattttaattaaatctcgccgacatttcaa

SEQ ID NO: 16788 - DNA, 280 bp, Sorghum bicolor
  Clone ID: LIB3481-027-P1-K1-H7
cgtccgcacacgacaggcctgacgcgcagctactgtttcatatcactgctcgcgcaactgtgcaccgaacatcactacatccatcgtgctggctgagagctgctggtgctggttgtgcttcacttgccacgagatctgcgtcgccttggagagcgccgcagccatcatgggcagcatgggcttcctgtgcgcagcgcgagaccaggacaagaacaaaggagacagccggtaccgcgcggtcatgatggtgcgccagtgactctaccggcttgctgtctgc

SEQ ID NO: 16789 - DNA, 296 bp, Sorghum bicolor
  unsure (1)..(296): unsure at all n locations
  Clone ID: LIB3481-027-P1-K1-H8
cgtccggtaggatcagcagagattatattcagcgggaaagctcaacctggcgttactgcatcggatgtcaatgtggaagaggtgagaatgatagtcgacgaggatgttggaggttttggtttcaccagcgagaatgaactgatcaatggaaaagccgctataatcggctntctcttgttgatagatttcgagcttttaactggcaagggcctcctcaaggngactggtttcttggacttcatctatgcagtttcgggagctttcaactgataactatgtttgttcctttgtatcag

SEQ ID NO: 16790 - DNA, 199 bp, Sorghum bicolor
  Clone ID: LIB3481-028-P1-K1-A12
cgtccgatctaatctacatccacattaaacgccccgcacgacatgctgtcatccactgcacacgatctttcacaaacgaatgccatctcacggttgtggactttgctcaccgattctgcagcactgaccaaactcttcctacactgcctcggacgacgtcagtcatcccctctttgatgaactgccacacccaaactca

SEQ ID NO: 16791 - DNA, 161 bp, Sorghum bicolor
  Clone ID: LIB3481-028-P1-K1-B10
cgcgcgaccacatgaggctgagagctggggcggctacttcctctttcggtgggagaccgggggccgcacgggctgtgctggggcaacaggccgcatggcgccggcgcaggtggcgcgcagcactacaactgaagctctgaccccgaggggaggtggagctg

SEQ ID NO: 16792 - DNA, 192 bp, Sorghum bicolor
  Clone ID: LIB3481-028-P1-K1-B7
cgtgcgcctcctcctccccctcggcgctggacgcgcctccgggcggcggcgtcgagttctggcacggtgcggagcgcgcgggttgggtgaacaagcaaggcagtcataagactggaggcgggtggttggctaagcagggaggcttttggtaagacctggggaccgcctgggcgggggtatccggcttgctaa

SEQ ID NO: 16793 - DNA, 136 bp, Sorghum bicolor
  Clone ID: LIB3481-028-P1-K1-B9
gaattcccgctaaccacgctgcggcacgataaaactttcattaacccaacaacgatctgaaaagtacgagactgttcctcctacctatgagctgtacacttggcgctgttgtttaattcatcgctagccacaaaaa

SEQ ID NO: 16794 - DNA, 211 bp, Sorghum bicolor
  Clone ID: LIB3481-028-P1-K1-C10
acaaacccagaaaggccatgccgctgtactctattggttgaagaccaacgtatcatctcaagaagactctagcactcgaataatctatggacgttctgcgaatgcattcaatagtgcatagctagcaaagaaagaatatatcgatggttttcttgctggcggtgcctccttgaaggctccttatttcgtcaccattgtcaactctgtgact

SEQ ID NO: 16795 - DNA, 198 bp, Sorghum bicolor
  Clone ID: LIB3481-028-P1-K1-C11
gtcgaccacgcgtccgcggacgcgtgggaaaaaaggcaccagcaccaccgccgcgacgacaacgatggcagcctcgttccaagccgcggccccctggaggcagggcggccaaaatcggcggccgggcgcactccgcctcgttgccgtcccggccgtcgtcgaacctcgccggggcgttcggcgtcaacgccggcgccg

SEQ ID NO: 16796 - DNA, 179 bp, Sorghum bicolor
  unsure (1)..(179): unsure at all n locations
  Clone ID: LIB3481-028-P1-K1-C2
cgtgcggaggcaccgaagcaacaacaaaggcgcacgcgagaaacaagaacaaggcggatcgcagcaacaactgcaaactgcgcatggcgatgtgcgtgagcgcggagaggtggacgcgggtgctgacgctgggccgcggcgcgttcggngcagaggtgttcctggccaccgaccacgat

SEQ ID NO: 16797 - DNA, 274 bp, Sorghum bicolor
  Clone ID: LIB3481-028-P1-K1-C5
cgtccgcctacgcgtgcatctcctggaatacaggcaagcacggaaaactctcgatgtatgtcttacacaaatgaaagcttttgcagatagatgggcaagcggggccgatgttgtcatcgcatatgaccctctctgggctatcaacactggataagttgctactcctgaccaggcccaggaagatcatgccggtctacccgattggttgacgaccaacttattacctatagtcgcctctagcactcgaataatctatggaggttctgtgaatgca

SEQ ID NO: 16798 - DNA, 221 bp, Sorghum bicolor
  Clone ID: LIB3481-028-P1-K1-C9
tgacatctgtggcaccttcatgctgaggtacaccgcgttctcggccactgatgccaagaggaatgccggggactgccatgttcctatgtcttgcgccactgccaattgggctcaaggagctcctggtacaggttggcaccattcgcattactggcactggcatgaacccagctaggagcccttgcgctgccataatctacaacagggatcatgcctggagc

SEQ ID NO: 16799 - DNA, 361 bp, Sorghum bicolor
  Clone ID: LIB3481-028-P1-K1-D5
cgtgcggtagagccgacgccgctccaccttcatcctcactagccagccacaacgaccacggcggggagagatgccggcgacggctctctcggcgaggctggcggtgaggcgctgcgcgtgctggcgcagctggaccggaagctcgacagcctgccgtatgatctagccgccgccatcgatagcggtcggatcgggggcgacataggggaccgattcaacgaactataggcctacggattcattaaatggcttctaaccttcaagggcttcacggagagacttctctcctaccaacggttgcttaccaagctcgggatacagtgcggcatcagtttccagggccagactgccccttagtttc

SEQ ID NO: 16800 - DNA, 172 bp, Sorghum bicolor
  Clone ID: LIB3481-028-P1-K1-D6
gaccacgcgtccgcttgttcaggccccgccccgcccggaggtaggcatacgcggtaagcctcatctcttctcagtcgcctcgctcgaattcaaaccagggggcgaggtttacttaggaagcgaggcgcgcgatcagtctgctgaagccaatatgttggctgggctggtgacc

SEQ ID NO: 16801 - DNA, 366 bp, Sorghum bicolor
  Clone ID: LIB3481-028-P1-K1-D7
aacatcaaacacatccccgccattctttataaaaaactgggtgaagcactcacataactatttcaaatacatccatcaaccatcccaccctcaatcagacgcgcctcatcattcctcaaaacaaagatgggggagaattcccacccccaatttttggccctcttcaccccattgaacaaaccaaactcttaagtacaacattaaatcaacgcctggtataaactttacccttcaagaacattatacaccatacattccaaaaaaactctcccctaccattcgcatatttactgaatcacccacccaagaacaaatcccttcaggtactgcactccaatttccaaaagcttaaaacatacaatgcca

SEQ ID NO: 16802 - DNA, 201 bp, Sorghum bicolor
  unsure (1)..(201): unsure at all n locations
  Clone ID: LIB3481-028-P1-K1-E5
ccgcccagaggtaggcgtangcggtaggcctcagctcagtctcattcgnctcgctcgaagtcgaaccagaaggccaggcttancataggaagcgaggcgcgcggtctnncttcngtggctaatatgtcggctgtgctggtgacctacgaggccatcgtggggcggttctaccagatccggcgcacggtgatgcagatgctg

SEQ ID NO: 16803 - DNA, 279 bp, Sorghum bicolor
  Clone ID: LIB3481-028-P1-K1-F7
gacgacccacgcggccgaataaaccacgctaacacattggtctggaagaactctaccatcatcacaacgctacatgcacctatcacacaagcttatatggcgcctggcgtatcatatatacacactgggatctaccgtcacaatcttattacataacgtaatgaaagcatcaaagcatctaggaaacagaatgctgaactaaccctagcttgacaaatatgcaaagacatcaaatctgatacttcaaaagcgatggataccttacagatatcattccat

SEQ ID NO: 16804 - DNA, 357 bp, Sorghum bicolor
  Clone ID: LIB3481-028-P1-K1-G3
acgcgtccgagaggatcgccaagtagtatgccttatagcttatatagagtatgatgaatgaatattaacttattctcaattcatcgagatagaagatggtgagggctgacacttcttggcgatacaaggaaataaatgactctagaaaataagaaagataaccaaaggctcgtcttgagcacaactatattggcacattcctggggattctgtctgcccttgggcttctcatagctcaatgtcacgtcctcattatgtttgcatcatttctatttcatattctgctatggatctcctttgccaatatgtcatgcaatgctggacttcttaatttatcaataagtaggacatcatttt

SEQ ID NO: 16805 - DNA, 337 bp, Sorghum bicolor
  unsure (1)..(337): unsure at all n locations
  Clone ID: LIB3481-028-P1-K1-H4
cgtccgggagccattcggtggcattcggaactggaggcatgaaaagaccaggcaggacaccttttgctggtccacagcgattgatctccgtggaggatgtcatttgtgcccttgagagggagcctcanatgacaaaatcacggctcatctaccggctgcacgagcggtttcctgtagattcaactgtagattaaaccggaataggcatatactccgcactggtgcggtgcatgcccaattgcccttgcatggtactccgtaattaacaacgaataagcatacctgtcactccttccaattggggtggtttggagtggcactggatattggtagaaaa

SEQ ID NO: 16806 - DNA, 254 bp, Sorghum bicolor
  Clone ID: LIB3481-029-P1-K1-A7
aaaattaaacggaacaaaactaattaaaccctaaatccaccacattctaaacccatacaacttcactccactccaacacccttaaaacacaccacactcacacatgttcatatccaaaattaaatctaaaactttaacccttaccgcattcactttaacatattcaaccccactttcaacatatttcaaaaaacccatactatctcctacaccaccaataacaacttcaataaccccaagttttaaccaacctt

SEQ ID NO: 16807 - DNA, 490 bp, Sorghum bicolor
  Clone ID: LIB3481-029-P1-K1-B2
gaggggaaacatcacaatcttatttcaaaaatcatagagagaccatgcatcaacagttgaggaccagccatggggtcaacaataacacaaggaagcaacagaaattgttgtaaaaaaaaaagaatcaacagaaatttcggtgggcattttacttgtgtacttaactattactatattattataataggataatcctgatcttatttcacaaatcatataggtgacctattacagatggtacagtccaatgccaatgcaattcctccaggagaatgacttagatgtagatcagcagtcagcagattgcaactctcaaccctcaacctgggtccccggcacaggctgttcctgttgttgcatgaatgactcgtaggtctccaccctggtctttgattcaagcttgttaagtcaatgcttgaaaccatttgtcatcgcagggaaatccttcatatgcagtttcttccactcctcaaaatcccattcgccataa

SEQ ID NO: 16808 - DNA, 465 bp, Sorghum bicolor
  unsure (1)..(465): unsure at all n locations
  Clone ID: LIB3481-029-P1-K1-B9
tacggaccgnattccgggtgcgacccacgcgtcccccacacgtacaaactttacaactccctttctaaatattttaacttgagcggggtgggttttacaccaaaagacaatcacatacctcttgcatctgaccatcaaactgcaactgctgctcaagctacatgttcaacaacaagtacccccacactaagcacaaaaacacactccagcaagccaccatcttcctaattgtcacctccaaaaacacagctgctacctcaattctaatcctaccccaattcctgcaaccacacctcccaccactgcatctgctgcacacagctccaagtgcaacccctacaacttcttatcgacccactaccactcattggaaacgaagacctacaatatgcatgcttctgattatttaatagtgatatctatcttctacctgctacgtaccgcactactagctactacactaca

SEQ ID NO: 16809 - DNA, 371 bp, Sorghum bicolor
  Clone ID: LIB3481-029-P1-K1-D1
ccaggcgtacgcccacgcgtccgcaatctcgcctctcgcatcgcaatctcaacacccaatcaaagcaagccgcgctgtgtttttatcaaccggccgatcgcaatggccatggcaccgtgctcacctgtctcctccgttcccttggccgcccgcccggctgctacggggtctccttcgtctgtccgtccgcgcgccgccgccgccgtcgtcgctggggttgtccccacggctggggcgacgtagggcggcacgttgttggcgccgctgctgaagtggtcctggatggccgactaccttcaggccccggcgccggcggtgccgcatgacgaccaggctgtctctctcttcatgcatttcgtggatggccttac

SEQ ID NO: 16810 - DNA, 444 bp, Sorghum bicolor
  unsure (1)..(444): unsure at all n locations
  Clone ID: LIB3481-029-P1-K1-D10
atccgcccaactctcnctccagaccagatctctataaaaagtaagcccccaccttccaccgacnacatggcggggaaaggagccaaagccacggccaccaattcgtcagacaaggacaaggggaataaagcctgcatccccgtctcacactcctcccacacctcacctcaagagaaggagaagtcatctcccaagaaagatgtttatcaattattcactgagaatgttaatgataacaaacaactgtaatctagatagtcaatcatgcaagaaacccgtgtagagtattttcttgaaaaaaatttcaataccttcatcaagaatcatccataattcaagaaaatttctccgccacataatgatttataatttaaatacattgtcaacacttttcttaccaaaaacccttattaataaaatttaatccaattatttaaaaacttt

SEQ ID NO: 16811 - DNA, 429 bp, Sorghum bicolor
  Clone ID: LIB3481-029-P1-K1-D12
cgtccgcccacgcgtccgaaaaaaaaaaaaaaaaaaaaaaaaaaaaaaaaaaaaaaaaaaaagagaaagagtattttaaaaaaaaggaaaaacaacataaaaaaaaaaaaaataaagggcggatattttttagtttccaagctttctatcccttccatccaacttcatttcattttctctagtttctccaaaatccaatccattaccccccttttttcacctacctaacttgcaaacccctgccttccccttttttaatctcttttcataacttacccttcttcccaattttctttttacctaaattgcccatcctaatcgccctttcaaacactccctatacctgaatattaaatgcgaccccccttttagcccctctttattccccccgtcctctgtccttccccctagaatccccttctttctttt

SEQ ID NO: 16812 - DNA, 503 bp, Sorghum bicolor
  unsure (1)..(503): unsure at all n locations
  Clone ID: LIB3481-029-P1-K1-D7
aangataatttcgattcatttttttttatagggaggcccacaaactccaattggatgaacacgaatttccatttaaaatgtgaagttgcttcatgcttcaaagaagcagagtccaacacatatataatcatcgaaaaagaaaggaaaatcctctcaaaactctaatgcctgttactcacacagtaacatgttacaatcacaaaatgtacaattgcatcacaggcaatttgcatccttgtcgcctgggctctgcaatttcagacaaccatttttttcttctgttcctgtctgcactcgccgccaatcaaatcagcacccatacaaggcatcagcagggcctcaacctcaagttcgccatgctgacgatttctcctgatcaacattctcttcccaccaagtaacattcttgtatccttcttttaaaaaatctaatgagctttccttgatctttttgcaaaccaaaaactcttaacagttcttccttaacctgtcccaaagtgaac

SEQ ID NO: 16813 - DNA, 559 bp, Sorghum bicolor
  Clone ID: LIB3481-029-P1-K1-F5
cgtccgggaagccgtacctgcgggagcactcctgcctcatcttcccgcccccgcgcggccgacgcccgttggcggtcatcaagttcctcggcggcgccttcatcggcgccgtccccgaggtcacctacggctacctgctggagctcctggcgcgggagggctttctggtcgtgtgcgtaccctacaacgtcaccttcaaccacgaggccgccgcgcgggaggtcttccagaggttccatgcctgctacgacgcgctcctcgcgtcggggctcccggaggccggccttagcggcctggacatcgcggagctcccgctctactcggtcggccacagcaacggggcactgcttcagctgctagtgggaagctacttctcagaaaagataccaaaggccaacgctattgtctcattcaacaataggccggcttcggaggctgtgccttactttgaacagatagggcccctttttaagtcacctgatgcctatgatggaggcctcacctgtttactcggtggccagaaatgcatcaggagatgcatggaaggctctgtttgatt

SEQ ID NO: 16814 - DNA, 398 bp, Sorghum bicolor
  Clone ID: LIB3481-029-P1-K1-F7
tttttgaacaaagaagataagggcgctttactactaatggaaaaactcaattacaagtttacaattgcacatacgcatcatgaaatcgaattaattaagccaacacaaacacgtacgtacacgtgcagcaaaagtttcatgcagctgcactaccgttctcttgtagcatacagaatttgaagccatggatctcatgtcatacgtcacagctacgcaaagaagcagctatatcgatcaggtccgcttgacggggtcgaagttggagacggcgacaactgcgccgacgatggcgacgagcacgacgccgccggacgcgatgctgagcaggaagttcttgagcgactgcgacagcgcctgcgccgcctccgccacctcgagcaccgccagcgccgtcgaca

SEQ ID NO: 16815 - DNA, 545 bp, Sorghum bicolor
  Clone ID: LIB3481-029-P1-K1-G1
cgtccggccgccgccgagcggcgtgtcgtcgttctacggcggcgagtcccgggccccgtcgccggcgtgacaggccggcgccgacgccgagcctccagggccggcacgcccggaccgtgccggacgaggtgtcgcggctgcagcgggagaacgaggagctcaagatggagctgctgcggatgaagatgcacatgagggagccgcccgcggcgctcccgcagcccagcggcgctccaccgccggggcgccgcccgccgccgaagaaggccgcgggtggcagcgggggcttcatgaacaacgtgtccaagaagctcgggcggctgaacccgttcctgcggcttgatgccgtgggcacggagccgcccaaggatcggagacggaggcgctccatcgaatggtgattggtgaagttgcccatgctcatgtggcaggcttctttcgtcctgaatttttttgacgggaaatttcatctttatgtaacttaaaaaatgacttggatcgcgggaaatggtttcgagtttgtggagttaaaatataaggtaggc

SEQ ID NO: 16816 - DNA, 446 bp, Sorghum bicolor
  Clone ID: LIB3481-029-P1-K1-G4
cgtccgcccacacgctcacttttacgcttacctctctttcgatctacaatacgacccagaccaggcgactgggcagctcactcggccgagcacgcgccccaccacgggccggacgcaaccctcagcgcaaccctcacccgacccggccgtcgaggtggcactccgccgcgcgagcccccacccggcgggccaccactgaggacacgactgatgtaacgaccagtgcaccaaccaggccacgaccggtgcgcatcggcgtcgccatcctttgcctcttctcttgctcctcctgccctgccttgggtggcggggccacactcaggcccatgctctccgggatcgactccatcggtcggaccactattgatagtactatagacaaccgctgaatcgaccattgaatagcacattcaccacgcatataaacacgcactcccaattgcacg

SEQ ID NO: 16817 - DNA, 179 bp, Sorghum bicolor
  Clone ID: LIB3481-029-P1-K1-H6
cgtccgctatcttattgactaagtgactctcacgagagctcctgcctcacatgtgccaacatcatgagcagcgcttcctgcacgaccaactgcctcacgccattcgtcaaggtcttgaacaaaggggtccgcaatcttaaaggatacaatgacaacaccccactattacacgggtgacc

SEQ ID NO: 16818 - DNA, 550 bp, Sorghum bicolor
  Clone ID: LIB3481-029-P1-K1-H8
cgtccgaaacaaagcgtccaataatcggccggctaacaagtgtactacgttgcagctaataactgggtgtgtgttcctgcagtacacgttcgtgcgcgtgtgacacagagagcattagagctcagaactgagatatacagatggaggcgaggaggagcagcgcagcgctggtgggcgtggccgtggtcgcgctgctggtggtgctcgtgcccgagacgtcccgcgcggagcggttcgtcgtcggcgacgcggcgcggtggacgtgggggtacaactacacggactgggtcatcaagaagggacccttcttccaaaacgacaccctggtgttcatgtacgacccgccgaacgcgacggtgcacgcgcacagcgtctacctgatgcgcaacgccgcggactaccagtcgtgcaacctcaaggcggccaagctggtggccaacgtcatgcaggcgccgctaaggttcgggtcgtgctcaagaagcgaaagcagcactacttcgtgtccggcgagcgcggcggcttccactgcaccatggggaacatgaagttc

SEQ ID NO: 16819 - DNA, 299 bp, Sorghum bicolor
  Clone ID: LIB3481-029-P1-K1-H9
tcccgtaaccataacaatacctttcaataatccaccctttaacaattttactactttgcacctaatacgtaggtttttttttctacaatacacctcccatctccacacacacatacaccattatatctcataactaagacatacacatcaactccataaaaatcatcacaacacttctactctcatccttcacccccctcctatcatagctctatcccaacactttccaccctaaactccccaagcctcaaactcatccccaacttctacctcaccatatacaacgtcccttccttcaa

SEQ ID NO: 16820 - DNA, 234 bp, Sorghum bicolor
  Clone ID: LIB3481-031-P1-K1-A5
ggggtacgcgcccaggtcgccgagcagaagacagcggtgcagaaggcccaggaaaactttacccgtcgcaagaacctggcggccggtggcgcgatttcccaggaagagctgtcccacgcccgtgacgacctgacctccgcccagagcgcgctgaacaacgtccagcatcaactcaacagcagcaatgccctggtggatgacaccgtggtatccaatcacccggatgtcaaagcc

SEQ ID NO: 16821 - DNA, 441 bp, Sorghum bicolor
  unsure (1)..(441): unsure at all n locations
  Clone ID: LIB3481-031-P1-K1-B3
cgtccggccagctgtgtaccacatctggaagatggacaagatggattttctggtgtgtgtttgtgcgttggccggcgtcatcttcatctcagtccaagaaggcctggcaatagcggttggtatatctatatttagggtattgatgcagatcacaaggccaaagatgatggttcaaggaaacatcaaagggactgatatttacagggacctacatcactacaaggaggcgcaaagagtttccgggttcttgatcttggccattgaagcaccaataaacttcgctaactgcaactacctgaatgaaaggattaaaagatggatagaggaagaatcttttgaacaggataaacatactgaactccatttcataatcttggatctatcagctgttcctacaattgacacangtggcatagcgttcctcattgacataaagaaatc

SEQ ID NO: 16822 - DNA, 576 bp, Sorghum bicolor
  unsure (1)..(576): unsure at all n locations
  Clone ID: LIB3481-031-P1-K1-B8
cgtccgcccacgcgtccgctttttacatttcctagagcacaagtaaaaggttttgtgtgcagatcttaagctagcagatctgaagtgtgtggctgcagtaccattttttttttgaaaggagattacctctgcttttgagaaagcaattagagtttacatactggtgataccagtttatgagaacgtgaaaagacaaaacagatagcaaccaagccacactactaacatcctcaacatgaaacactattacaagatagcaatttctgaattaaaagtttgaagccgatcaagcttgctgatccatgtctctaggccctccactatcttagaagattgtatcttgtcggcgtccttcgtaagctctctccacatttgcagaagggtgattgcgttgtaaagtaccacatcagggtttgcagggaaaactttctgaataaccatactgttcctatttttccaaattgcccatgaaagggcggcaaagaaaattaacacaagtcttcgagggacttncagcctnnctggcaatcaatcatacatgatatttatgtttgacgtcngaaagtcatgccaccc

SEQ ID NO: 16823 - DNA, 400 bp, Sorghum bicolor
  Clone ID: LIB3481-031-P1-K1-C2
ccggattcccggttggttggttcgattctttcttctttttttttttttttttttatctttttttttttttttttttttttttttgggtttgtttttattcaaaaagaacgacccccccttctaaaaaacccaaatttacccccccctccatgcaaaataatatctcttttattgggcaccccaaattcaattaactgcccgcctaaaacaacccaatgactggaaaaaccctggctttacccaaataaaaccccttccaacacatccccctttccccagctggcaaaaaaacaaaaaggcccccaccatattcccttccaaaaaaatgcccaacctaattggcaaaaggaaccccccctttatagcccaataaacccccccgggtgggggggttaccccc

SEQ ID NO: 16824 - DNA, 364 bp, Sorghum bicolor
  Clone ID: LIB3481-031-P1-K1-C5
cgtccgcaccaacaaccactccagaaattcagagggctaacttggggtggacggttcttaatatgagaggcagtgggaataaatgaccttttgtcatttgacttcatggatcctccagcatctcaagcacttatatcagctatggaacaactgtacagtctcggtgccttaaatgaagaaggtcttcttaccaggctagggagaaaaatgtccgaatttccacaagaaccacctctttctaagatgctccttgctagtgtagaccttggatgcagtgacgaaatactgacaatcattgcaatgattcagactgggaacatattctatcgaccaagggagaaacaagcacaagcagatcggaaaa

SEQ ID NO: 16825 - DNA, 450 bp, Sorghum bicolor
  Clone ID: LIB3481-031-P1-K1-C7
cgtccgccgctgctccgctggtcgacaacacctgcagcgacagcttcgacctctacaacgggcggttcatgtacaacaagaactccaccgagctgctcaaccgcgtcgagtgggccatggactccgtcaagaagaagctcttcgacggcctccacgacgtgctccggaagcagctcttcgaggggtcgccgcacgcccccaatgtctcctcctccaacgtccgcaagtaaccaccgtgcttgctgctcatgtcatgatcgacattgtaccagtctgtatctgtattcttcaccccccaattcagatttgactttgttgagaggggttcgttcccgtactctttcttccttgtcagttctgctgtgttccatttccaagtgagggagaaaaagaaaatcttatctgtggtagcttgacactggaatttgtgatatggtcacgaataaaatg

SEQ ID NO: 16826 - DNA, 330 bp, Sorghum bicolor
  Clone ID: LIB3481-031-P1-K1-D5
cgtccgcccacgcgtgcgctgttttacttggaataggcacaacattccttctctcaggatacacgcgtgaggtgagtacgagagaggtgcactacacccaaaacatcatcaaagtgcttgaaaacgtgcttaaaagcgtggactctgcacgcgctccatgtcattaatagaaactacagcaggttcttacagaactgaaacacaaggacataacacaagtacctgcttctggcagggaaacggtctgccgtctgacttgacgtggcgccgctattcgcatggcagctccgcatgctgcagccggtggatgtgtacctgttcaagaacccc

SEQ ID NO: 16827 - DNA, 434 bp, Sorghum bicolor
  Clone ID: LIB3481-031-P1-K1-D6
ggcgcgttcgatcgatgggcacaaggacattcttgaaggcgatacttacctgaagcaggggctgcgtctgcggaggctctacatcaccaccctgaacgtgttccaggcctacacgctcaagcggataacggaccccagctttaagagtgacacctcagtctccgatgaccaacgagttagccgtcaagaacaagcccgccacactgacgaagctgaacccggccagcgagtacccgtcgtggctggcagacacgctcatacttaccatgaagggtatcgccgccggcatgcataacaccggctaggccgctctcccttcactcaccttgaaagaactgaaccggaataattattacacgctccagatggcggcgttttgtcagctgtcgataagaatgctgaaaactgacaccacctgttttcactatatgcat

SEQ ID NO: 16828 - DNA, 263 bp, Sorghum bicolor
  Clone ID: LIB3481-031-P1-K1-D8
cgtccgaaaaaaaaaaaaaaaaaaaaaaaaaaaaaaaaaaaaacggtctgacgatataaaagggtccaggcttacatacacgtacgtgccacaccatagctggtcccatctataacctaaaatcatttcactggccttcattttacaacctggtgattgacaaaacccccacattacaaaccttaatcgccctaaactaaatcccctttttgccaaatcccttaatagccaatagtcaatcacctatcaacctttccaacatt

SEQ ID NO: 16829 - DNA, 504 bp, Sorghum bicolor
  Clone ID: LIB3481-031-P1-K1-E5
cgtccgcagacctctgggagccgagctttcctcatgccctgattctgagcctcttggtcgtgttggcttgggtctctatggtcggcttctccccgttactactgccaatttcaaagctacgtgtactgcagctgcatataggggcactcttgtccacaagctccttcaaggacagttttttgctgctggcagacaaggttctcggcgtgacaagggtgaggtcgagcctccctcgggccttgttaggaattctgagactgttaaccctaaagcattcgaattaaggcatgcaaggcctggcacgctttccttatgccttggacagaatgatgatgatgatgacatcaagctcaaccctaattatcacaatgttgaattcttggttactacagggccaggaccctgtcccgagcttgatggccagaatattgtctttgggactgtattggaaaggatggatgttatcaccagcattgcaaccatacctacctacaaaccagctga

SEQ ID NO: 16830 - DNA, 295 bp, Sorghum bicolor
  Clone ID: LIB3481-031-P1-K1-E9
cgtccgttaatgctccgccatacagtctaatgcaaggagatttgccttgcagtgttgattgaccatgaatgaacaggagacgatggatccgcagttgcctatggcctgactgtagctatgataagtctacatacgttcaaaaagtgatatgtagacatatagatggttctacggatggtgtaacattgtagacttgcagtagtagcagggtttagtgaaaagaagtggttcataaaaaaaaaaaaaactaaaaagcaaaaacaaaaaataaaagataaaataacaaaaaaacacc

SEQ ID NO: 16831 - DNA, 347 bp, Sorghum bicolor
  Clone ID: LIB3481-031-P1-K1-G5
cgtccgagcacgcgagcgggctcaccagcgtctacatcctcttctacatgctcatggtcccgcatgacgggccggctgacggcctgtggtccagcttactgttcacatgtcagcaataacgtgagcgaaaactctctcgatatgaaacaccacattgattaggacattaaattgctcatgtgattggttatgatacagcatataccacaccagatattaccagcatgtctaccgacatacatgtcagacatcatgacagagctatgtgttggactatgagcacgactcgttgaaataatcactggcatacgagcatgcacgccatcatgcaggccatggacgatata

SEQ ID NO: 16832 - DNA, 420 bp, Sorghum bicolor
  Clone ID: LIB3481-031-P1-K1-G7
gataggaaatcttgaaaagggttttattttaggggtgaactaaaccaggcctgaatttacattgcactcggtcgatctacccggagcatcgtcaagcatgttcttcatatctcctacaactataaaaagaacaaaagtaagaccaccatatgtggggtcgctccccccacccccgacgtgcgatacccgtgcttaggaggtggaagggtcaaaattgaataaaaaaaccagataggattcctgatgcaaatttacaatacagaataatatataacagagaggtggaagggtgtgaaatgaaataaagaaaaaaaaagaattcctgatataaaatctcagtcctgtaaagaaaacaaaattaatcgcacgctctaaaggaaggaatcgcgcacggtaccaatccttgcccgacgcccgacg

SEQ ID NO: 16833 - DNA, 530 bp, Sorghum bicolor
  Clone ID: LIB3481-031-P1-K1-G9
cgtccggaggcatgcgagctatcgcagagcttctgatccctcagttggagttcctcaacgaggaaggagcacaggctgaactctgggcgttgtcaaagattttcctggacacacttgcacaagagacaggacagaaagttactgccattttccccgacgctggagcagctgcccttctcaagtatcaatggaaagatgcgcaattcaagtgtgccagcttaggtgaccggaagccagttgatcctgaagatgaggtcgcagttatgattatccctgatcatcagatgctggaagctgttgaacgcatcgcatctcaactctctgatgatcctataaaacctcttgtcatgtggaacccacgccttgttagtggagatgttggagtaggctctaatgtccggaatctgcgcagaaatttcttaagtacttttaccactgtttactcaatgaggccattgccaactggtgcagtctttagatgctttccagggcagtggaaagtgtttatgatgatcaaataggccaaatcg

SEQ ID NO: 16834 - DNA, 458 bp, Sorghum bicolor
  unsure (1)..(458): unsure at all n locations
  Clone ID: LIB3481-032-P1-K1-A12
cgtccgcagatcagtgccggactacgacggcctcagccggctcaaaatcgtgaccatggtgctgtacgaggtcctgcggctctacacgccgctggcggcggtgcaccggcggacgtacaagcccatggagctcgggggcgtcaggtacccggcgggncgtgatgctgatgctgccgctgctgagcatccaccacgacaaggacgtctgggggccggacgccgacgagttcaggccggagaggttcgcggaggggatcgccagggcggcggcgtccggcggggacgcgccgccggcgttcttcccgttcggctggggtcctcggacctgcatcggccagaccttcgcgctgctggaggcaaagatagggctcgccatgatcctggggagcttcgtgttcgagctcttcccgtnctactcgcacgcgccgttccccgtcgtcttgctgcagccagagcac

SEQ ID NO: 16835 - DNA, 537 bp, Sorghum bicolor
  unsure (1)..(537): unsure at all n locations
  Clone ID: LIB3481-032-P1-K1-A2
ccggaatgacccacgcgtctcaaggtgagctggcggggcgccgacgaggcgaagaggctggtggacgaggagggctacacggtgctggacataggacaggaccancgcgagagggcacagggaagtcctctacccatgtgcctctcttcattgagaaccaagacaacgacattgggaccatcgtgaagcgccagctgcacaacaacttcgcggngctcttcttcggtctgcccttcaccaagctcaacccggatttcgccaggacagtcaaggacaagttctcgccggagagcaaggtgctggttgtctgccaggaaagtctcaggtcagcagccgctgcagatgcgctggagaaagaaggtttccaaaatattgcgtgcattacgtcaggtcttcagacagtgaagccaggaacgtttgaatctgtcggaaaaagtgagctgcaaaatgcggngaaagctggtcttgtcaccatccaagggaagatttcagtagtcctttgggactgtactgatcagtgcctatcttgttataaca

SEQ ID NO: 16836 - DNA, 133 bp, Sorghum bicolor
  Clone ID: LIB3481-032-P1-K1-A3
tttgcagtgctatacgaaagccgccgtcgcttcacatgcagctgatggatggcccctgacgcataccggtgggtcccgggcgtcatgcggcaccctctgtttctctttcatgcgttcgagtaacggtctagtc

SEQ ID NO: 16837 - DNA, 216 bp, Sorghum bicolor
  unsure (1)..(216): unsure at all n locations
  Clone ID: LIB3481-032-P1-K1-B10
ccagcgccctctactnctaangatactcatttccaatcatnatccatactcttcttcttgattccaatcatcatataaaatcaggccagcgcggtctctatctaaaatctagcctccttctatgcccactgtaattcagctttatcatataacaatcctactctttactactactaacaactcttcatacttaataaaaaaaaaaaaaaaccctct

SEQ ID NO: 16838 - DNA, 480 bp, Sorghum bicolor
  unsure (1)..(480): unsure at all n locations
  Clone ID: LIB3481-032-P1-K1-C3
cgtccgcccacgcgtgcgccgtcttctgctacaccgagttcgccgtcgagatccccgtcgccgggggctccttcgcgtacctccgcgtcgagctcggcgacgccgcgcgcttcatcgccgccgccaacctcatcctcgagagcgtcatcggacggggccgtggcgcggtcctggacctcctacctcgcgtcgctcatcaacaagcccgccagcgcgctgcggatccacgcgccggagctcgccccgggttacgacgagcttgaccccatcgcggtggtcgtcatcgccgtcaccgccacgctggccatgctcaccgccaagggcacctnccgcgtcaactgggtcgcgtccgctggcacgtcgtcgtcatcggcttcgtcatcgtggccgggttcatccacgccaacccggccaacctcaggcccttcatgccgtacggcgtgccgggcgtgttccggcggcggcgatcgtctacttcgc

SEQ ID NO: 16839 - DNA, 598 bp, Sorghum bicolor
  unsure (1)..(598): unsure at all n locations
  Clone ID: LIB3481-032-P1-K1-D5
cgtccggacatatcaggatgcattggtacctaccttcttttactaattaatttttatttatttgtctagtcatcactgtaaaagtttaaggttaaagctggctagttgatatatgaaagtcaacctactggaagactcatattgatcataaatcacattatctaaatgaaaaaagaaaagtgtcatgtgcatataagattgttgtattggtatatgtgaacacctccagttactttcagatttagtcagcttcatgacaacggtcaacatgtgcatatataatccagctgttcaatgaagatttctgattntctaagtctgtctgtcaggtttgcagtgtaaatctcatggagggtgacataattgtgagtggttcagatggactttttgacaatatttttgaccaagagatcctttccataatttctgagtcaccaggtgtagatgaagctggntaaatttctgcttccacaacaggggtcattggaccacatgttccagtccctttctaaaaccatgtngaacttttacacagcaaaagcgttggcagagcttgcaagaaaacattccgtggatgtcacattcgattcaccctact

SEQ ID NO: 16840 - DNA, 439 bp, Sorghum bicolor
  Clone ID: LIB3481-032-P1-K1-E7
cgtccgtgtgcttgtactgagaacaatttgcttgtacttagaacaatttgcttattatcattgcatcagattactaaaaaacttggaacaaaggtattggggctttcaaaaatagtcatttacatacaaataagtgagtacaatattatttatgaccagatttgcatataaatagtctctcacgccttcaagggcattacagacatttctacacatcctacagtttcacagctgctctaaccaaacggttttcagcttttcccacagctctcagctcacagcagattttccacagccacagttcacagcagctgtttcaaaatctacatctcaaccaaacagggcctgatgcggcaacttaagtgggttcgataatcctaaaactctgaataatgatcttcttacaactctgcgtgtcttgaaaaaaaaacaaattaca

SEQ ID NO: 16841 - DNA, 162 bp, Sorghum bicolor
  unsure (1)..(162): unsure at all n locations
  Clone ID: LIB3481-032-P1-K1-F10
ataaaaagtaaacaaatttacatacacatacnttcggcggccggggttttctattctaacatccgcatccattccactcnacctctctttctattttancgtctcttaaattcattgccctgcccttctcaatatcacttgctggacaaacccttttctccc

SEQ ID NO: 16842 - DNA, 332 bp, Sorghum bicolor
  unsure (1)..(332): unsure at all n locations
  Clone ID: LIB3481-032-P1-K1-F11
caaatcttaacctanacaccccatctttcttcnttatccaattctcaaatattntttcacgcgcaacgcttctaaatattaaagtccttcacaacccaaaatattacaacttcttttaatacactttcattaacaatnaactcacttacatttttattccaaacaaattctatctttttatacttctaaactgatctcttatattcttctacacattgcattcaatacaacttctattgttcccatctttcaaagttaactaatttataaaatacctctttaaacttttatgcaaattacccttaaactcactacatttctcataaaattaa

SEQ ID NO: 16843 - DNA, 416 bp, Sorghum bicolor
  Clone ID: LIB3481-032-P1-K1-F3
ggtggaaacaggggtattggattataattccatttacaactcttgttgtttcaagtcacctcacttcacaacaatggtggaaaatcctaaacaaatcctatcagaaatacattcacaagccaacctagacacctagttcacctaaagaaaaaaaaaacagtatttgatatcaatctgatagacttccaatttcctatccaatatagacctacagtgtttgcttttttaaatgtcgacaagttgcctgtttgcactctaacctcgtaataatactgaaatcaactacttgttgatatcagcaggagtgaaggaccatttcaactgtcattcaagaagcttgttgcaagtgccaatgccaatctcagcagcaagatgccatgcaccgtggatatatggagtcttggggaagcaatcgt

SEQ ID NO: 16844 - DNA, 627 bp, Sorghum bicolor
  unsure (1)..(627): unsure at all n locations
  Clone ID: LIB3481-032-P1-K1-F6
cgtccgatgcaactgagagtttcatgtttaaatagtgtatcaaatcttaacgtagacacgccatctttcttcgtggtccaagtgtcaaatattgtttgatggtcaacggttcgcactttgtatgtccttcatgaacgcaagatatttacaaactatctttgagtacactttcatgaacaatgagctcactggcatttggtttccaggcagttctatctttgtatgcttctaaacggatctctggtattgttgtgcacattggattcaatacaacttctgttgttcccatctttcaaggtagggtaatgtatgagataggtgttgaaactgtggggcaaggtgcccttaaactcactggatttctcaaggagttaatgcagcggagaaatatatcctgtgagtcgctgtacacagttcgaaccatcaaggagaaactntgctacgtggctgctgattatgaagctgaattacggaaagatacacaagcatcctacgcggntgatggtgaagggtggttcactctgtcagaagagagattcaagactccagaaattctatttcagccccatatgggaggaatgcgtgctatgggctttgcataagcagtaactctatgtatggatcact

SEQ ID NO: 16845 - DNA, 270 bp, Sorghum bicolor
  unsure (1)..(270): unsure at all n locations
  Clone ID: LIB3481-032-P1-K1-F7
tgcatccacgagtacatgcgctcaaagtacttctgcacggactaccggaacaagaacccggataagacgctcgctacggcgatatccacgccgatattctgcggcaagttctaccgggagttcgagcacaaggtagacgactagccaaacgaattcgccgccgacattcacgacgaccggaagaacaacgacaagatgacggtcgtggtgtaggacacnccggaggatcgcaaggcggctgtgaagctgaagctgaccccggacacgacg

SEQ ID NO: 16846 - DNA, 524 bp, Sorghum bicolor
  Clone ID: LIB3481-032-P1-K1-H4
gaatgacccatgcgtccacccactcgtccgggagaggggaggagagaagagacaccgcaaccgcattgccatgagagggaagggggccttgctgctcgtgcgtcgtctgaatgagctcgcgcactgccgccccccggcccaggtatgcatgccatattccggcatctctgaattgaagatggcggcagcagcatccatggcggcccgtggcggcgctctcgttgcgatcagcaggccgagcaggaggatgggtggctgcagggcggaaccgccgcgtttcttggtcgtcagctgcgacgccaggacagcggacgtctactcctccctggctgcaaagattttgggacctcccatgaccttcaatgcggcgaagctcaaggtggagttcgccggggaggacaagcagccgccttctttccctcgagcctacactctgacccactgcgacttcacggcgaacctgacgctggccgtgagcggtcccatgaccaccagcgagcagctgcgcagctggcagtcgacgc

SEQ ID NO: 16847 - DNA, 118 bp, Sorghum bicolor
  unsure (1)..(118): unsure at all n locations
  Clone ID: LIB3481-032-P1-K1-H6
ccgtccgaatcagattaagaagtctttaggagcaaagcgcaggagttnngttttgaattccaagcgacttccacttcgcttgnncaatcgattatttgttctnntgatgtnntgttga

SEQ ID NO: 16848 - DNA, 256 bp, Sorghum bicolor
  Clone ID: LIB3481-033-P1-K1-A3
tagagactacgcttctacaccaaatatccaattccatcgagatatttcttctacaatcagtgctgctatgaacggggggcgtcatatacaccgggataatatactattttaattaaacacatgcatcatcttaattaactctacgaaaccattacctatcagtttctctacactatattcttcatgtctgttctaccttgatgactccatctaatctaataacaccattcatttttctttttacacatacaccttt

SEQ ID NO: 16849 - DNA, 538 bp, Sorghum bicolor
  Clone ID: LIB3481-033-P1-K1-A8
taaatgatgtcattactccccaaataaaaaacccaaatcctgaaaaaaaaggtcgggtgttaaccttgcggaacacctttcttattcccattatcaaacacctaacttacatatactttccgggacctatgtcccaaaagaatgctcactttcatttcctaaaatcaagatccacgtcagactcattctaatataaaaacacctactgtttcttattctctatacaacttctgatttggtaaatccccagagtactcttcttccacagcatacctgttctgatcatggcagtcgcatctgcagggacataccaatcgtggtcccatcattattttttttttgaacaagaatcaaccaaaactaccgtggcaagcatatatacagattactatcaacgtattgctcaaccaaggatccatatgcattcctcccaccggaataaacctaccttctctttttttccccaccaaaaccccccgcgcgggtattactactaatatgcatgcctgtgtgtgtgtgacccgtctatactctatat

SEQ ID NO: 16850 - DNA, 202 bp, Sorghum bicolor
  Clone ID: LIB3481-033-P1-K1-C1
aaaaacgaatacctccttctatcctactacatactatcaaccttaaaaccatattcccagatacaaaaaaaaaatcattaaccaaaacaccgcctcttgctccagactcaacactaacactgcacaaactcccctcccttaaacaaactaactaatcaaactaaaacccttctgtgaaaccaatataacatccaactcttaa

SEQ ID NO: 16851 - DNA, 556 bp, Sorghum bicolor
  Clone ID: LIB3481-033-P1-K1-C10
cgtccgcttatttcttatccatggagactggtgcgctcacctcccactcgctatatagggcaggtgttgctgctgctgcggcgcatgacaagcgccggaggggatgaggagcgaccatcttaccacgccggtgtcatacgttcaccggcaggatccaggctctgccgtcggctgacgtcatcaccaagatcctgtacccgaagctgctgcaccgctcgccctccgacaccggcgacgtattctcgctcgttcaggtcagtgctctcaagctgatcttctacttcatgtacaactgcgtggtgaccgagctgctcatgaagcgccttaaccagcccaaccccgtggacaacaaaacatctgctgctgctgcatccatgagccagtccagcacatcggacggcggccactacgctccacagcagcaacagcaaataccgtctacacgtcaagaagaataagaactggagatcagccatcgcgaatgtatcgtcatcaggtaatatgcacaaccacacgcatggaacctacgaagacgacaacctctaaacacacatcc

SEQ ID NO: 16852 - DNA, 537 bp, Sorghum bicolor
  Clone ID: LIB3481-033-P1-K1-D11
cgtccgcggacgcgtgggaaaaaaaaaaaaaaaaaaaaaaaaaaaaaaaaaaaaaaaaaagaaagatttaaaaaaaaagaaaaaacaaacaaaaaaaaaaaaaaaaaaaaaacaaacgcctccccctctaaaaattctcaatctttcttccccttccttcccccttttttttttttttttatcgccccctaaatccatttcacttcccttttttttccaccctctcttctcccaaaaccttcccttttcccaacttattagcctttcaaaaaatccccctttccccatcttacttactatccataactcccctcccattctcctttcccaacagtttctcctccttaatcactatttgtacccccctttttttgtccttttaaccccattggttgtgtccttacccccaggttaaccctttcactttccatctccttaccccccctttttttcttttttttccctttctttttttaacacgttcccctgttttttcccctttaatttttaaatcccagagtttcttttttgcgttaa

SEQ ID NO: 16853 - DNA, 567 bp, Sorghum bicolor
  Clone ID: LIB3481-033-P1-K1-D4
tggggcccacccttccgggaagcgcaagatgcttagaaaatctcttcaacatctatgctcttcttctgagatcggggctgctcttgacaacattggtcttccagttacagctagaccttctgatctaattttggatgatttcgtgagattgcacaaccatttgacgaaagtatgactatagagtgccttcaaaatgcctaaggaattgcttgttggcatggtgttgaacagttgaagtaacttaggcctgaccgcctgagagttgctctgcaggtgccttcagctcagctgccgcagcacaggtttggtattctggcgtgcaggctgcagttctcctgcatagttgatcatgttcaaacttcaaaccaacagatttccatgccatggaaaatgcagaatcgtcctgaaaagaagggtgctacatctacgtgtgccgcgtatttacagttcacgatctatgatgtacataacgggatctgctggttcatcccttcgcaaataaaagaaggccaaaagatgctggagcaatgcgaatgcatatcaatgatggtttgccggtgcatgtgc

SEQ ID NO: 16854 - DNA, 559 bp, Sorghum bicolor
  unsure (1)..(559): unsure at all n locations
  Clone ID: LIB3481-033-P1-K1-D5
cgtccgcgacaacgaggtcaagaactactggcggacaagggtgcagaagcatgccaagcagggggagtgcgacgtcgggaggcaccggttccacgacgccatcaggaacctctggatgccgcgcctcatcgagaggatccacgccgacgaatcatcatcagccgccgtcgccgccgccgctgccgctgccgagaacgtctctcgctactacacgggcgcgagcccatcgcacgagctgtcgtcgtcccaaccggcggcggcgtacggaaacgctgtgcccgtcggcaactgcgcgcgcgcgccgtccccggacgcgtcgtcgagtgtcaccgggtcgtcgtggtcacgggaggcgtcgccgccgtcgcagctccaatcgagcagctgctcgaccatggcgggatgctctacttctaccgaccaatgccacaacaacggatgctccagcgccacgagcgtcgtcgacatgttccactagagcntgtcggagctttttgctcgagccaaccatgacgacacggaattcggattcggattgggagaaaccggagacaactgg

SEQ ID NO: 16855 - DNA, 451 bp, Sorghum bicolor
  Clone ID: LIB3481-033-P1-K1-E6
aaaaaaaaataaataaaaaaaaataaaaaaaaataaaatataaaaaaacaacacaaataataaaaaaggccagagtttatataacaacatgcatccaaaccaaaataaccccttctttaactacccctctaaattcaacttccctgccccctccttttacaaccctcgttactgactaaaacccttcctattacccaacttaactcccctttcaacacatcttccctttcaccacccttgcctaataccacaataatccctcatccaatccccttccccaacaattacacacccttaatagcaaatcccacccaccctttacccccccttaacctcaaacattctcatcgttactcgcaccattaccgctacactttccttcaccctaccccccgctcctttcactctcttccctccctttatacccacgttcctcccatttccccctctt

SEQ ID NO: 16856 - DNA, 555 bp, Sorghum bicolor
  Clone ID: LIB3481-033-P1-K1-F11
cgtccgcccacgcgtccgagcagttactcgacggaggacgaacagcggctgcccgtctggaggaacacgtcgttcgacaccctcgacgggacgaaaggcgtggggcggctgcatcgactgatggggtacgggtcagctagcgagctgctgcggcactcccctgacctgtacgagagcttcagcgagcggacgacgcctgacgtgagacagcacgacaggaaagggaaaggcgtttgcatcgacgacggagacggcgacgacgactacgacgtcgatgactcggatgaggaagacattggtgcgctgaagagatcagcgaggaaagggtccggttgggcgctcccatggatgcccggcaaggggactccagcagcgggagccatcaggatcaagtaaatagcagcaaaggcttgtgtatattgcaggaataggttcaggttttggaattcgaatgggaattcttcttattatagggatataatagttggactattcattttaggtgcggtattggatttataggctgtttgtttgccattttttgaagcgtgacaa

SEQ ID NO: 16857 - DNA, 453 bp, Sorghum bicolor
  Clone ID: LIB3481-033-P1-K1-F2
ccgtccgcctaccgttcccttttcttcaacgaaagctggaaagaactcgccaacgacatcgagggaggcatgaaaaagatcgctggatcaaagtaaaatgcagatctatagaatgttctcggacaattctttcgacaacactcgttagagcctgctgtctagactccagagtgctactcatatttccacttggaataccacttgtatgtccttgtgtaccaactgcgaggctagtaccatgatggagaataacactggacaccactctgggcatgttttcttaaatgaattgttccaaggattgccaccatgactgcacacggtaatggacactagcatgcctgatagcatgctagcttagctcttctcttacgagagaattagcattagaactcggacgaggaccttttccctgccttgctaaatcactggttccacaactgttaccggctt

SEQ ID NO: 16858 - DNA, 450 bp, Sorghum bicolor
  Clone ID: LIB3481-033-P1-K1-F6
cgtccgaaaaaaaaaaaaaaaaaaaaaaaaaaaaaaaaaaaaaaaaaaaaaaaaaaaataaaaaaaaagaaaaattaaaaaaaggggggccgtcactacacacatacaaactcccagcctccctactcttacataaataaccttttttttattttatagctaaaccaaatccacatttccctgcctaacattttacaaccctctcatttccaaaaaccttccattttccctacttattcaccccattcccattttcttttttccacatatcttaataatttccacactccttacccattcccaattccaaacaaatactcaatcctgaatttaaatattatactttaccctaaaccccacccattaatcccgtcgatttttacatatacccccacccataccctttcccttacctatctcctaatgcttttttttttatttcaccccttc

SEQ ID NO: 16859 - DNA, 559 bp, Sorghum bicolor
  Clone ID: LIB3481-033-P1-K1-F7
gcgaacgccgttgccgcccggtgcgtggaagtgcttgacggtgcccgggctcggaatgaacttcgtcgggtcctcggcgttgatccggcactccagggcgtgaccgcggatcaccacgtcgtcctgggtgtaggacagcgggttgccggcggcgatgctgagcatctccttgacgatgtcgatgcccgtgaccatttccgataccgggtgttccacttgcacgcgagtgttcatctcgatgaagtagaagttgccgttctcgtagaggaactcgaaggtgccggcgccacggtagttgatgtcgatgcacgccttgacgcagcgggcgaagacttcctggcgggatttctcatcgatgcccggggccggtgcttcttccagtaccttctggtggcgacgctgcagcgagcagtcgcggtcacccaggtgaatggcgtggccctggccgtcggacagtacctggacttccacgtgacgcgggttggtgaggggatttttccagatacaccatcgggttgccgaacgctgcaccggcttcggtgcgggtcagtttggccga

SEQ ID NO: 16860 - DNA, 556 bp, Sorghum bicolor
  Clone ID: LIB3481-033-P1-K1-F8
cgtccggtagagcttcatgctctggatgctcaaagtctgcatttcttggggcccaaacagacctttctttgggcgacgtctactttcacaatgcccgtgcttcagagagaggtcaacatcatttatcaagcctgggtgggctgcactttcatggaattgatggtgggcctagaaatatgtccctgggaggcttccctggggcttcgtcctcatatggaagaagtggcagcaggcgcagaagggcatccaagctccataagtcatactacgagaacaagtcaccttggttccaagaatcatcagacagggtgccccagctccttctcaccaaccagcaaccgatcaacagccttccccagtggcttacaaaggatgctgaaaccggcaccagtcgaatcaacgctgacatgtggccgagcatggtgccagcaccaggtcgttcagccgcagatccaccgaggggagggttctctctctttgtgacgacgtgaagccccatgtcctccctggagcttccctgaagcgcgcgatgaggaggaatgcggattggcggtcg

SEQ ID NO: 16861 - DNA, 561 bp, Sorghum bicolor
  unsure (1)..(561): unsure at all n locations
  Clone ID: LIB3481-033-P1-K1-G3
cgtccgggagtcgataatggagaagccgacgatggacgccgccgcgggcgccggtgccggcggcggcggatgaggagggatcgggcggaccaagtcggagcagctggcgccgttgcagtcgctgagccggacgccgtcggcggagacggtgctgagcatgccggcggacgccaccagcctgtcgcgcaagcccagcttcgggaggaagcggcgctccgcgtcggtcggcggcggcaacaacaggacccacatccgcaagtcccggagcgcgcagctgaagctcgacgtcgaggacctcgtcagcagcggcgccgcgctcagccgcgcctccagcgccagcctcggcttctccttcaccttcaccggcttcacctcgccgctccagcacatgtgctcccccgacccgccgccgcccttcagcgacgacgacgacagcccgatggacatcgaggccggcacacggcgggaagaagctgatgacngagccgaccttgccgatatacctcaagtttgcggaggtgaagtacagggtggcggngaaaggctcgccgcgggagatcc

SEQ ID NO: 16862 - DNA, 439 bp, Sorghum bicolor
  Clone ID: LIB3481-033-P1-K1-G4
cacccgccccgaaattcccggggggggggactcctcccccaactcgtccggcaaaacacacggctacacatggcccatgataaaatttcccatgggcggaacctgtgggacgccgatcatatttcatactaaaagctaccaaatgaaactgaaatcaaaaactcacgccagagcgctcttgacaacgggcaccatgaactcaactaacgacattatcctggtacatgacacttgaatgatgcaatacactaaagatgttaaatgctaaatgcgctctacacgaccaagctatcggactcgtcttctattgatgaatctactatattggaaaccaaagtgaatcaactggccgagcctttacaactcattgactcataaaacgctggtttgaccctaataaatctcctagcacaacattcgactaacgctatatggcatg

SEQ ID NO: 16863 - DNA, 415 bp, Sorghum bicolor
  unsure (1)..(415): unsure at all n locations
  Clone ID: LIB3481-033-P1-K1-H11
cgttcgggaaaatgcttctgaaaagtagtaaagaagaaactcgccgattagcactgttaccgcttgtttttatataggtgagacctcctatntntntttttacaattattctaaatataacaaactaaacaacattttatccggagcttatatatatttcttatttcagtcgccaaaacaaataaaatacaaaaattttttacaaaatattaatccactcgttttcaaaatttttacaacccaaaataaacattcctcaattttcgcaaaatcaaaaaattattctcatcgtctacaggaagataaaaaaatacttaattttttcaacatctatatacaatcttatttaattttccaaaaaaaaaaaaaaaggccggccttcttacttttacattctactttaaacctcttttat

SEQ ID NO: 16864 - DNA, 490 bp, Sorghum bicolor
  unsure (1)..(490): unsure at all n locations
  Clone ID: LIB3481-034-P1-K1-A10
cgtccggcctcgcctcacagcaccggttgcgtgttaggagggaggaaggaaggaaggaggggatggtttttttttttaaacgaggcgccaacccanaaanaaaantnntnttacanaacttaattatctttcctcacatgcccctttcccctgctcgcgtgacacctttttttccctctcctatctccctctccaaccgctcttctttctcaattcctaacgttaccccccctttctcctcgcattcaccgccctcctctctcttctttctctcatccttaccaattcacttctcatctccctatctcccgctcctttctttttctatccttactttatgcccactttcttcctcttctcccttctagctttttatctgatccttcctttctatcttcccctttctctttttctcccctttcaccccctcatccttatttcttgcctatctttctcttttttctcccttcactctcctcttcctttttct

SEQ ID NO: 16865 - DNA, 383 bp, Sorghum bicolor
  unsure (1)..(383): unsure at all n locations
  Clone ID: LIB3481-034-P1-K1-A3
gcccacgcgtncgcccacgcgtncgcccacgcgtccggagcgctttgcttggaggtgtatgcggttgggatgatgcttagatcctactggacatatgccgctctgcaagactgcaactgccggtcactgggcagcctgatattccggagcattcggtatttccggcctgaaagccgggcgaagtggtccaatttgatggcccagcacaatctcatcagcttctgcctcctggacaaaccaaccatgctcaccaaagttttgagcgtcctcgggctcaaagcacactgtgacagctggctgtacatccggcacatcgacgtgtcattggagctcaaggtcttggtcttcaaggagctcaaagataaaacggtgggcatcgtgga

SEQ ID NO: 16866 - DNA, 601 bp, Sorghum bicolor
  unsure (1)..(601): unsure at all n locations
  Clone ID: LIB3481-034-P1-K1-C4
gcgcgtccggcgacttcgtagcatatttccggaggaggtttctaaggacgctttcgatggcgtcgcaccaccatggcgtcacttacgagctcaacgagggtcgggaaatcatcaccggctacgcagaatgggctcgccgtcatgctggagataaggaacagcttggtgatactgcaacaccagaagcgtctgaaaatcgcgctgccgacccggcacacgcggacatgtttaaacgtgcagccgtcttcacgcagggttactggacgggagcacgtgcggaaacctggttacttgatcttcttgtggtggaccctccgcatcagcgcaagggctttggacgcagcttagttctctatggagtggagctcgccgataaagatggcgtgtgtgccagcatgatcgcttctgaagctggtgacggactntacgcttcctgcggtttcaagggtctaggctggatgcaagaaggagaggggaatcctttgcgcgatgtacctggttggcgaaatctttttccgtgatcctgcgagtgattagatgatcgtcgaacaaagctgaacccactttgtgggatagtatcggtcaatgtgatactccactc

SEQ ID NO: 16867 - DNA, 482 bp, Sorghum bicolor
  Clone ID: LIB3481-034-P1-K1-D2
gcgcgtccgattttatttcccatgtatttaaaactatggtcttgaaattttgtatcattcaaacattccgtgatggtattgaattcatgcagctagtgataaaaatgaatcttgatagctacaaaattgcaatgctagtggggtggtggaattggccaacagcgttttatttttagaaaaaaatgattgctattgcaccaaggtgtcgtaaactctcctttttcgtatgatgcatacattgttaggtttacaaaagaaacatcttcctcagcatctgcatacgttatcaatagctattgtcagcagaaagtcgtgaaggttttgttctttttcttatgactgcagcttatagattaactaaattgacattgctgggaaggatgtgattgagagagttggaggctctactgcagtaatttgcattgccttgtcatgctcttgatattaatcagttctttaagtgacatgcagccccaccccca

SEQ ID NO: 16868 - DNA, 270 bp, Sorghum bicolor
  Clone ID: LIB3481-034-P1-K1-D6
caccggttttgcattttggagcgcagcccagctccaaccgttctcatctcaggccatgatcagtatttctcatttacttcagcaaacactagcatgaactcgtctccacagcctgcatttggaatgactaataccaacacagccttcggcatggcttcccctgtaaatgatcagatgaacgaagacagcatggcagatgacactagtcaggcggcacctgcgccagcgcctatatttggttcttcatcatttggacagcagaatatctca

SEQ ID NO: 16869 - DNA, 382 bp, Sorghum bicolor
  unsure (1)..(382): unsure at all n locations
  Clone ID: LIB3481-034-P1-K1-E8
cgtccagccgccctttttttttttttttttttttttttttttttttttttttttttttttttgtttgtttttttaataaaatggctctccaaataataattnaaaaaaactttataaaaactctttgaaattctcttactaaagttaaaaaaacattttttaacatttttttttttttcaaggcttcactaaaatcaaatttaaaaattcaaagggttcttattttccttaaacaacttcctttttaacttctactttacatttcttaaacatttaaataccattccatccaattgaaccagcactccattttattcaataaccttctttttgatggttttaaggtccactttaaagttttagttccccgttcccttccttt

SEQ ID NO: 16870 - DNA, 473 bp, Sorghum bicolor
  Clone ID: LIB3481-034-P1-K1-F12
cgtacggagacagggagcttagcatcaggcaagctgttgttgattgggtgatcgatcgatcgagggtgtgtactaggggccactggagaccgtcagaggacgagaagctgaaagagctcgttgcgctgtacgggccgcacaactggaacgccatcgccgagaagcttcaagggagatcaggtaaaagctgcaggctgaggtggttcaatcagctggacccgaggatcaaccggagccccttctcggaggaagaggaggagctgctcctcgcctcccaccgcgtccacggcaaccggtgggccgtcatcgccaggctcttcccggggcgcaccgacaacgccgtcaagaaccactggcatgtgatcatggcgcggcggtgcagggagcggatgaggctctcaaacaggcgtggcggcggcgctgcaggtgcggctgtcgccggcgccggtgctgtggaagatgacaataaccct

SEQ ID NO: 16871 - DNA, 245 bp, Sorghum bicolor
  unsure (1)..(245): unsure at all n locations
  Clone ID: LIB3481-034-P1-K1-G11
cgtacacaaccaccctttttttttttttttttagtccatgacaaaacanaancttgtttnttgtttcgtttctatttaaaaattgcgtcgcccctaanaaagaaaaagagaaactantantantantagtattactcctgaataattaatcacatttaggtccagtgctttttttttttaacacgaaacaccctaaaaataaaaactcttttcccagcacccttaaacttccttcttcaaatccc

SEQ ID NO: 16872 - DNA, 349 bp, Sorghum bicolor
  unsure (1)..(349): unsure at all n locations
  Clone ID: LIB3481-034-P1-K1-G5
tccacaagatatctatattattgtcaatgaccccccacaacaaccctgtgttcttacattgtcaatatttttttttctgnttngaaataccaacacaaacataccctaatttcaattttatcggccgtcttcttgcaccaagattaaactctttaaagaggatttaagcctctacagtctgtcttcttttcatcagacctacaccctcaattaaatattctttcaactactaacaactcaacgcaataacttcctatcaacacttcatctaacccctccatatcttcatttaatctgacttaccctctaatctcatttattcaaaactttcaaaatcccatcacatcct

SEQ ID NO: 16873 - DNA, 340 bp, Sorghum bicolor
  unsure (1)..(340): unsure at all n locations
  Clone ID: LIB3481-034-P1-K1-H5
cacctcgccacctcgcaacccccaaccccaaccccaagctattcgggcggttcagcatcgggatcccnacctttaggcctcctgcagctctaccgcgcgacacttatccgcctaattacgtgttcacacgatctttctactcccaagcacgctgccatgaaattcacctacttagacaacgcaggaaccggcgtcagagactctatggccgataagaagcacgtgcttttaaagctcactgacgcatacatcaatcactcatctcattgtgactgtgtgtagagggcaaaattaatctcacgtcaaatggtacttgtgataggagcaaagagcattatac

SEQ ID NO: 16874 - DNA, 478 bp, Sorghum bicolor
  Clone ID: LIB3481-035-P1-K1-A7
gtggctgcaccctggctatgattactgttgatgatgctactactgctgacaatgctgctggtgcttctactcactgtctccacttccttgaacaatgcgccgtcgtgcttcttttgcctcccgctgctccagaaagctaagccgcagatcagaaccaccacagtcaatatcaccaccttcctcttatagattcggaatctcatgataggggctcagcctctgtgcgagtggagagaaagttgcaggcgagctgaagagcaattgcaggtgatatgatgtgctcggctcaagaagcgggcccggagaggaagaagtcgtgccggggctaattattggcaaaacgagctcttgttgtaaacattgatccaactggaatgtcactaatggcgaatcaatattccataaagcatgatggttgctcagaggcaggagaagagcaacgaatacgatcctattaaagataaaaccataaataaca

SEQ ID NO: 16875 - DNA, 446 bp, Sorghum bicolor
  Clone ID: LIB3481-035-P1-K1-B6
cgtccgcttccagtcatgtatgttttggtggtttcaagcacaggttatattttttgagttaatgtgggatggatgctcctgggctaagtgcatctaattctatccctggtcaatcaagaacacggaatacgccgccaaatatataacgcgatatatatatatttaattgcacctttactgtgcacccaccggcgacactgctggtgccccaaaaaggcgcgtgccgctctaccaggaatcaagctttcctacgcgtccatccaaactcatatcttttttatcgcgtgacctatattcaattaactggccagctgtttacaacctcgacgactggaaaaaccctgcgcttacccaactgaatcgtcttgtactacatctcgctcttggcagttatactaatagcgaacaggcccccactcttccccctactcaacatttgcgcaacc

SEQ ID NO: 16876 - DNA, 448 bp, Sorghum bicolor
  Clone ID: LIB3481-035-P1-K1-C2
ggcggccgcccagattctttcgattctttcacggccccacacctctctccctctctcgtgctccatcgggcgcgtcctcctcctgcgtgcggcccccatggcctcggcgaacgacgaagatcgcgcggcggcggctggcatcctgcggctactgatggggatggcggcggcggcgcccgcctcggcattgcctcggggcggcggaggtgccggggggcctggcctggtggtggtgcagcacgtcttcctcgacggcgacggggatctgttctcgggcggggtcggcggcggcgtgccgccggcgtcgaaggccgcgatcgccgcgctgaaggaggtgaaggccggggaggtcgagggcgggggcgagctgggcgagtgcgccatctgcctggacggggtggaggacgccggcaaggagatgccgtgcgggcaccgcttccacgggggc

SEQ ID NO: 16877 - DNA, 643 bp, Sorghum bicolor
  Clone ID: LIB3481-035-P1-K1-C5
cgtccgggctctactggtcaaagagatgctcctggaagggttttcaaaaacagaaaaatgcctgggcgcatgggtggtgtgcaacgcacagtgaagaatgtatgggtttaccaaatagacccagccaggaacttactatatctgaagggccaggttcctggtcctcaaggtagctttgttttcgttaaggattctatatacaagaaacctgacacagctttgctcccatttcctacatatttcacgcaagaaggcgagcctgaagacttggagcccctgattgctgatcttggtgatgttgatccattcatggcagctgattaaaagacaatggacaaagttggcgaactcccttagtgttttatgcactccttgagcttgtctgttccacgagattgtgaaattctcgatggatttgtgagcagttcctgaatcacaagcttcatccggttactggccagcctgatcaatgttgttccatgtacattaccttggcagtataccagggccccaactcaattagggtttttagattattgttttgattgactgagttgaacaccttttttttaataaaaattgtaagcgaagccacaggtagtagtatataaaattggaatatttcactcctgatagtgagatc

SEQ ID NO: 16878 - DNA, 415 bp, Sorghum bicolor
  Clone ID: LIB3481-035-P1-K1-D8
cgtccgcacaagcgtcacaggagaaacacaccagaagaacactagctgctacctttgaggatgggggaaccatcagcagctgcttcttcggcagattattaggaagatgattaggagtactagttagaatacctagtaatataactagtgagtgagcgagcgagtaatctagcgaggatcatcgccgtgttcatcgacggtccggcggaggtgccggcggagctaatcccgacgccaagccccacgaccagggccaacaacactgcgtgccagctcctgggtcccttccaggctgccttctagccgcacgtctacgagcaactccaccacctttactaccacactaactaggacatcaaccaggcaatgttgctcccaaggaaagacgaggcgaaagaccaggtctactgtctgc

SEQ ID NO: 16879 - DNA, 520 bp, Sorghum bicolor
  Clone ID: LIB3481-035-P1-K1-E11
gagttttcgccaccagctgatccaagcgagaaaaaggctgatgatgctggaacaggtaaagatataatgagggaacggcgccggcaagtgtttttcagtggtattatcactgctgttggaattgtcttgcataatattccagagggaatggctgtatttcttggatctgtcaagggtcttcatgtgggtctgaacttggctgttgctattgctttacataacataccagagggggttgctgtagctcttccaatctattttgctaccaaaagcaaaaagcaggcatttgttgtggcagccggctctggtttggccgagccactaggggttattgctgtagctttcttgtttccaagcagtttgaatcctgacattcttgaaggcctacttggatctgttggtggtgtcatggctttcctcactttgcatgaaatgctacctcttgcatttgactattgtggccagaagcaagctgtcaaagctgtttttgtgggcatggcctgcatgtctgcaagcttgt

SEQ ID NO: 16880 - DNA, 654 bp, Sorghum bicolor
  unsure (1)..(654): unsure at all n locations
  Clone ID: LIB3481-035-P1-K1-E2
ccggattcccggtcggccaggcgtccgcccgtcgcgtccatggcgggagcctgcgcggtcgccgtgcccgtggccactccaaccgcgcgcgggcgaggcatcgacgggtgcggctccancttggcgccncgaggaggcagcaacatctcccgccgcgtgaactgccggcgtgatagcccccgcgtgcccgtgcccactaggagccgcgtcgtcacccgtctcgccgggcgcgaccccggggaggccgggaccgacacgggggtggggcaaattctcaagggtgattctggctatctatggacattggtgcttggatcccttggtggcgctgcggtcataaagtacggaagcatcctgctaccggacatcacaaggccgaacatcgtggtagctctgctgatggtgtccctgccggtggtagctgcagtcttgcttttgctcaaagcgagctcggcggactgatacgatacgaggactcctcgaaaccgagaattcgagactactgaagactctttccaatattaataaaatttcggccccatcttgtaagatggaaaagtttgcaactctgttaaatgaaaaaaaaattgaggcctccctcaatgcaagtttcgcagctttagaaatcagaaaaaagattgtccggtgatattg

SEQ ID NO: 16881 - DNA, 273 bp, Sorghum bicolor
  unsure (1)..(273): unsure at all n locations
  Clone ID: LIB3481-035-P1-K1-E6
ccccccatancaaactttctacatctttccaaaattagtcttaatctttctaccaactttaaggaagtgaatttatttttttttaacctttncataataaactaaaccaactctacctcactagatatcctgaaactttattgcccaatatttaccaatctccaacttcttgcttacaccatatttcaaaattaataattataatttgcattatccctctcaaatacatataaaatccttaatattcattcttttccaaacattaattctctt

SEQ ID NO: 16882 - DNA, 500 bp, Sorghum bicolor
  Clone ID: LIB3481-035-P1-K1-F12
cgtccggccatcactagcgttagcttctgcgtgtggccgtgggcgcctgcctgcttgcgtcggggggggacgaccgggagcggcatcgtcgccgggcatggccttgccctgcgccgcagcctccccctccctaaccctccagggcgagccaccacctctgtctccctctccgcgcgccctgtcactcccgcccgctgcatgattgttccgcctactagcccgtcgccgcggtcgcgccggtgccggtccatctcgtccgagagctccaccgccgcatccgccgcggctgacatcgccaacgaagaagcggatcccgtggacgaggaggaggaggaggaggaggaggaggtggtggacccgcaagcggaggtgtgctacctggaccccgacgcggacccggagtcgatccgggagtgggagctggacttctgctcgcggccgatcctggacgcacctggcaagaaagtgtgggagctcatggtgtgcgacgcgacgctgtc

SEQ ID NO: 16883 - DNA, 448 bp, Sorghum bicolor
  Clone ID: LIB3481-035-P1-K1-G11
cgtacgctcacgcgttctctcaggcgctatttggtgtattcgatggccacgccggaaaaaaggcgggtgagttcattggggagaacatgcccaagtttatcaccaaggagttcaagaaggtaaacggtggagagatcgaaagagccttcaagaggagttacctgaagactgtcgaggagttcctgaacagggacgagagctgtggcacatgctgtgtcacaaacggtctacaaaagggttgacttgtcgtctacaatgctgcagacttccgtgcggcgctcaacccagcagggaaggccgatgcactcacctcttaccaccaggactatcaggaggacaagaaggatagaatttagaattctatatgtcctactagccttataatctcttgcacaaactctgctaatgcaattgaattatgcatctctctgaatcaactagatgattg

SEQ ID NO: 16884 - DNA, 435 bp, Sorghum bicolor
  Clone ID: LIB3481-035-P1-K1-H1
acaactctgactggaaaacctgcttccactaatcttcacacatccttgccggtggctatagcgaagaggccccaccaccccttcaacattccacctaatcaatgacccccttgcgccataaccgcgtgtgtggtcgccactgccctcctgccacccctaccccctctttcctttcttccttcttttcccactcccgctttccctcaacttaaatcggctccttaggttcatttatcttacgacctgcccaaaaaactattggtgatgtcactatgcctcccctatgacgtttcccctttgacttgatcactctaatatgctctgtcaacgaacacctaactatctgttatctttattataggatttgcgattcgcctatgtaaaaatactgattacaaattaaccgatttacaaaataacctacaattagtgcac

SEQ ID NO: 16885 - DNA, 173 bp, Sorghum bicolor
  unsure (1)..(173): unsure at all n locations
  Clone ID: LIB3481-035-P1-K1-H12
cgatccgttcacnnagttcacaaagggttnnaccccccaccttcgtcccgcgccgccggtgnnngttcgtgtgtagggccggggtcacatgtcacagcgagcagcgcnngtttctcttcttctttcttcttctttcccccggagggnnngatggccgnngtcgccggagccag

SEQ ID NO: 16886 - DNA, 600 bp, Sorghum bicolor
  unsure (1)..(600): unsure at all n locations
  Clone ID: LIB3481-035-P1-K1-H3
cgtccgttcaaatctcaagatgtcattgggacgacatttcccctggatggaggtgatcgacatcatggggtcgtcatgaaagtcatgcgaagatcagtttgaaacagagcatctaaatcgcaaactcacggaagaaattgcaattttgagatttctggctcagatagtgcatgatgcttgacaattttataatggaattttgtttgaaacagagcatttgcagggcaaagaagctattgaccttagtatcatctgtaactccgtcacccttggctccaaaatcaaccacattgaatactgcaccctgcgaggttgctggtggcggctgcgatggctgttgatgacccttcccacagcttgaagtcggcggcagcttgggagtggaatgcctactgccattggcagggcttggaggggcattcgggcttggttggtatggattctgatttcctttaccagcaccagagcttggcgtggagctgaccggtggcttcngacttggccggttgctgccgtgtggccgcgggagctgctcttttttctttgcctttcttgagcttagaggagcctggtgagcttctcgacgaccgccaatgcttg

SEQ ID NO: 16887 - DNA, 468 bp, Sorghum bicolor
  Clone ID: LIB3481-036-P1-K1-A8
cgtccgccgacgcgtccgcccacgcgtccgaaaaaaatattacaatagattttgaacaagattactgataaattttgaccatgaacaattttggagattttgaggagaaattaatggtcgaaatttgtgcagggcagagagaaaaaatattgtatttataatatcaataaataggtgtaaaataaaataatatgtttcctaaaattttaataatacttatttaatgccatgaagattagcacttataaatatttatatctagatatagtgtatacctaagtgtatagaaaaacatgtatctagaaaaattaaaatatcttataatttggaatagcgggagtgttatggtgtatttggttcgtgccccatacttcataaggtgatacatcatgagtcaattctatgattttggtggaatcaatatattcctcatacatatactatttaatagattatgaggaatgagat

SEQ ID NO: 16888 - DNA, 504 bp, Sorghum bicolor
  unsure (1)..(504): unsure at all n locations
  Clone ID: LIB3481-036-P1-K1-B1
gacccacgtttncgtcttgatgggagctcagttcaagcaccattcatgtccagtacaaaaaagcaatatattgtgtcttacaacaacttaaaggtgcttaaacttccatggcagcagttgggtacaagaggcaattctccatgtacattcttcttccagatgcaagatggcatctggagcttgtctgaaaagttgagctctgaaccagagttcctggataagtatatcccaatgcagaaggttccagttggacagttcaaggtccccaagttcaagatatcctttggatttgaggcatctaaattgctcaaaggtcttgggctccagcttccattcagcgcacaagcagacctatcagagttagttgattcaccagagggacagaacttgtctgtttcgtccgtattccacaagtcattttgtcgaagtgaactaagaaatgaacttagggccttctgcgcaatttgtttaaccagttgtgctccggtcattctcgatgcctta

SEQ ID NO: 16889 - DNA, 532 bp, Sorghum bicolor
  Clone ID: LIB3481-036-P1-K1-B4
cgtccgcagggtctcaagatgttagccatcttcaagaaccatgaagctgagacaagcatccttgaggacttcgacttctatgagcaacgagagaaagctgtgctgagtagcagacagcaacagaagcaacagtgttccaagactgggaagcaggtcagcaggctcagtgccaccagtgaacaaattgtgactggtattctcggaccgcctttgcagaggctgtccaactggaagaaaccaatgacaaagaagacaaaccaaggattgaagatgctgcagctgctgataacgttcctgctgctcctgtgaagatcgaagaagccatgctgaaaacagcggaagtgggaggcctcttgaaagaaagcgggtgactgctcgttctcctttcatgactaatccagagcagcagctgggtccatttctgatggtatttcagggagagaatgaaggttatgcaaatatcgcatcaggtgcatcttttgtacagcatggtatgctagaggcgtaaaccttgtttcacctttaattaggc

SEQ ID NO: 16890 - DNA, 519 bp, Sorghum bicolor
  Clone ID: LIB3481-036-P1-K1-C1
cgtccggcgttaagggatcaagttccatgagctcaggaccagatggagtagtgcatgaagattcaatggatcaccatggagatactgattctgacacatgcgacttaggtgtgctggtggatacaaaggcagctttgaatgcaaatatatatgacttagcctggaaggcaaaagatagttggaaggaactcaattgtgaaagatcaagtcaatgatccactgactgaaaagatctctgaacgtagcgaacccacatttacattggatggtggaagagatttgcaggatgatgctagtcatgagttaccacaacaattggaagacaataatgttgccaaaaaggaaaccataccattgcaatctctgctccctttacctgtcccaaaatcaccttcagagtcatggctttctcgcactttgccatctgtgacgaataagccacctttgccatcttttttttgaattcaagtacaatcaaagaaacaagctccctgggtgacaatgcaaccaaaggagaat

SEQ ID NO: 16891 - DNA, 354 bp, Sorghum bicolor
  unsure (1)..(354): unsure at all n locations
  Clone ID: LIB3481-036-P1-K1-C10
cgttcggtgacaccttggtttctaatgaaggcgatcgcaaagcggttccaggatacaaaatctggtggatctattgtgttcttgactcaaattgtgggtgcgttatagaggatggtatccaggttctncaacatatggtacaagcttaggagctattcaccaattggtcctactgtctgcaatggagcttggcaagcacaagataagggttaacgcaccctgtcgcttcctgcatctgcaggacaagtaccctatctttgttggtaaggagaatgcttataaagcaactgcagaggtgttgcccctactgaagatagctgagatccatagaagttccttatctttcattgttct

SEQ ID NO: 16892 - DNA, 498 bp, Sorghum bicolor
  Clone ID: LIB3481-036-P1-K1-C4
cgtccgggggcaagtacgctctgtatacatcttgccattttggttggtgcttactaagtgttaaccttaggcttagcttgctgcaagaggtttgacccgcggtgccgatgctgaccttgggtaccgctgtcggtttacacgtccacgtcatgggcgggccaggccagtcggtttctttattctcgttgatgtcagcgtaccaacaaaggtgactcgtaaacaacaaccacccctgctagtacatagcgacgtcagtagcagtaaatatttaacgcggaaaggatagtagtaaaaagcaagcagaaggatcgctttcattagagttaattaattcaccgggcgttcttttcactaattgctggtcccttttttgtgacggacaaacgtgcagcatgaaatcgtcgggtggccctggagcaactacggtggcaccgacaggcccgacgccgacgctgtcgggggcgacgccccatatgccgtggtcggcaggtgctgggc

SEQ ID NO: 16893 - DNA, 221 bp, Sorghum bicolor
  unsure (1)..(221): unsure at all n locations
  Clone ID: LIB3481-036-P1-K1-C8
aaaaaacccccanngggaggaaaagaacggaaaccggccgagccccaacannnnagggaggggacgggcccanggggggggggaaccacaccaaacangcggnaaggaggaccaccgaccggcaagcagccaaggggagggacggaggacccaccgggacaccagccggagacnggagacaacaaggccgaaccacgagngaaaaacgagagggggagggg

SEQ ID NO: 16894 - DNA, 386 bp, Sorghum bicolor
  unsure (1)..(386): unsure at all n locations
  Clone ID: LIB3481-036-P1-K1-D1
ccccgtcgaccacgcgtccctggaccatgagggccgtggcggtctcgtcgtcgtcgtcgctgaacccggacgcgccgctcttcatcccggcggcgctgcttcangtgagaaactggtcgccgcataattttacctcatgggcaccacctctcttttcctcaacactgtccctcgagcacgcccacctgtacgagatggccgagcagctcgactcggctggcctgctgcccgacgaagaggaccttttctactactaccagctcgagcaggccccctcctccttctacccatcgcccgccttcatcttactcaagacaggtacggatctacctctctctctcgcttctattctagatttgccttgaagacaaatttcagtgagctca

SEQ ID NO: 16895 - DNA, 481 bp, Sorghum bicolor
  unsure (1)..(481): unsure at all n locations
  Clone ID: LIB3481-036-P1-K1-D2
gtcgacccacgcgtccggagaggaaagcgggagcggagagcgcacgccgcccgccccgcccaccggctagaaaagagaggtcctgagaggagaggagtcccaccacctaccgggcgaggcgtgacctcttaaacgccatggatgtctccgtcgtcgtcnntctctctctcgtcgtcgtcgtcgatgggaggctcactcgcgctcgccgccgccacggccgtcgcgttctccggctccctcgtcatcttctcgctctgccgcgcgcacctctcccacgccgccgacccggagccggagactgagacggagctggaggagggcgcgacggagcacgccgccctgcgcccatgcctcttgtcgtcgtcagagaagcggacgctcggtgggaaggcgaaggctaggagactcatgggctaaaggcgggtgcggttcgcggccgacgtcttcgacaattaaggcgcaccgtccgcccgtcgtcacc

SEQ ID NO: 16896 - DNA, 427 bp, Sorghum bicolor
  unsure (1)..(427): unsure at all n locations
  Clone ID: LIB3481-036-P1-K1-D3
cccccggtcnacccacgcgtccnccgacncgtccgcngacacctntaatcnanatcactccatcncaccttttcttcnttatcgccatctatggcttcttcgagttcctctccagcgaggaaggtgtttacaattttgctacgtatccanatcctcnaaattccttctcacatcgctgcttaatcatacaaactatggctggagcactaaaacatgacagattatataacaataatcattgtgcatatcctatacatggaaaattcaggtcctgcatggagtgacaaagcggactatggtattgtctgggcatcaatagctgtgcacacaatacagtcagagatacctgtattttttcaatcataacaagtcacattaacagatctgcttctactgtaatccaatcaccttcttctgtctcttcaac

SEQ ID NO: 16897 - DNA, 626 bp, Sorghum bicolor
  unsure (1)..(626): unsure at all n locations
  Clone ID: LIB3481-036-P1-K1-D4
gtcgacccactcctccngccggccggcgtcacacaagtgtcagtcatcacaacctanctagctagaaggaggcagtacagtacacatggctccctccgtgatggctacatggcgtcgtgggccaccttcggcgtcggggctccattccaanggctcaagttaccgcggaggactccccatcgcccgccgctccaccaacggcgaaaggatcagctgcatgcaggacacgtgtggccgatccaaagcatctaccagctgccgccattgtcgactgaggagctgctgaagcagcatcagaagatggagtacctgctgcgctccaactgctgggtgccctgccgcctcgagttcagcaaggtcggcttcctggaccgcgagaacaactcgaggtcgcccgggttcaacgactgcagacactacaaaagatattttattttttgacattgtatatatctcatagtatatacaacttatctcatatatagctggctgtttatgacatttgtttcacgcaaatagtcaccttaaaataaaaaaaaaaagggctggctctctaaaagatccaaacttaccttcttcttcattgcaatattataagttttttttttaatgtcactcaaatatta

SEQ ID NO: 16898 - DNA, 535 bp, Sorghum bicolor
  Clone ID: LIB3481-036-P1-K1-D8
ccgggtcgaccacgcgtccgaagctaagggtctccccaaatgtgaactactcggtttctacattctagtgaggacttcatttatcagagaaccatttctctattttggtctctcgctctatatatatgctctggacacatgagcaaaactctgatctgtcaatatatttgaaggcactctcaatatatgaaactattagcagtttctatagcattgaacatcataccaagaaaccatccttctcagtacaagattttctacagtacacgacataagtggtgatagaaaccatattcgcgctcctaattggctatgagtagtttattatctattgacctagtttcttagttagatctggtttcttggattttctctctctcttcgttaaatctattgccacatcagcaaattatctacgtgatattgtaaatatctatagaaactaccatatagtttctgcattgtgaaatcctaagagaaatataaactacaattaatataccattgggactgccctaattacaaaacattgtac

SEQ ID NO: 16899 - DNA, 363 bp, Sorghum bicolor
  Clone ID: LIB3481-036-P1-K1-E1
tcccggtcgacccacgcgtccggacgcgacgcaggaggtaagcaacacctctccataccgctcacaagatgatacactctcttctactctctctgacctcacaccgccgacaatatgagggccacgtgggatattatagatggactggaaaatcacaggcataattactttcactcacattcacaatttacagcatgtaatattggaatgtacgcaaaggattgtatagggcatggtggaagtgatagtctccacagctatataccttcactaaatcacattatcgaagacatataagtgcttcttgacaaaattataaatgagaattcatgtgtcccttgatatcttctaggtcactccact

SEQ ID NO: 16900 - DNA, 473 bp, Sorghum bicolor
  Clone ID: LIB3481-036-P1-K1-E10
cgtccggggcggtgaccccagcggttgggtcgtgccgtgcgtgtccccacctcgccgccatcgtttctgctccaccttcagccaatcccagccgggcccagccatgtctgcaacggctctgctccttcccagcctcgccgccgcggccccacgcccacgcagcagctccggctccggcgcggctccctcgactgttgctctcggtccgtccggcctccgcggcggcggctcgcggtgtcggccgtgcaagagacgaaggacggggaggcgaagacggccgaggagatcaccgagaagtacgggctcgagttcggcctctggaaagtgttcagctccaaggacgacgaggaaagaggcggcgaggggaagaagtcgcggacggaccaggccatagagctcctggcaaagtacggcggcgcctacctggccaccttcatcttcctctccatcgactccttcaccctctgctacct

SEQ ID NO: 16901 - DNA, 553 bp, Sorghum bicolor
  unsure (1)..(553): unsure at all n locations
  Clone ID: LIB3481-036-P1-K1-E4
cggtcgacccactcntnccggacgcgtgggaaagaaaatnctaacaccanttnangtacttgattttttagatcaagggacagtgcatttttaagtccccataatcccatcagttaatgggctattcaaataacatgttatggtatcnattttctgtgataataacatccaaattccttaacaggtcctctgtaaatcgtatccatcagagtttactgcatactttcattactgtagatcactacgattttaatataaaccggattactcctatttgaagagactcttccgtgacttatttatccactagggtatggttaaacattagaaatctgtaattgatgttccttgcacctttatttttgtttttttatgtagcttattctggatactttcaaggtaccaactagattatgtatttgactggaccattattaaatatcctcagtttatagataaaaacaaacttcacgtatgcatgcattttatttatttacatccctttattaaccaatgcgatttttattttgtcttacatttttcaatttttctt

SEQ ID NO: 16902 - DNA, 453 bp, Sorghum bicolor
  Clone ID: LIB3481-036-P1-K1-E9
cgtccgtcgatgggaacaaacatctcatcaaacgattcatcaaaagaacaaataattcaaccatttgctctacaacttcaactacaactactgctgccatgtctacattatgtaaaacatgatcctatcttcattcatctcattaccttaacattgacgtctatacatgatttatgtacaagagatatttcacagacactattccaaacattaaatttactaataaatatacttattaacatattactaaatttgtctctaaacttatatacaatataatcatcaacatagttaggatccctgttcttaatacaatgctcaatacacttttcagatccctaagtgacattagctcatacatttcatcatttttctcaccaatttttttcacctacataatcatcaacataagcatcaattcatgtgccaatgcatttacaaaaaaaaggctgc

SEQ ID NO: 16903 - DNA, 314 bp, Sorghum bicolor
  unsure (1)..(314): unsure at all n locations
  Clone ID: LIB3481-036-P1-K1-F1
gcaatctggctatgagaccaaagctttttcatcttgactcgcacctgtgccctgacttctctcggatatgctactcgctgggtgaaaatcctcccttacacaaaaactaccaaatgaatagccaccaagtaggctctctggaaatcgctatgccatcgccaggacccatccttatcatctatcgctccaccacctgcccggtccggcacccccttcacgtcactggtgctatcacatacgaccgtcacctggaaccgcctactgggtgcgcctgntacatccccgggtgcataatacccgcactgcacagccta

SEQ ID NO: 16904 - DNA, 264 bp, Sorghum bicolor
  unsure (1)..(264): unsure at all n locations
  Clone ID: LIB3481-036-P1-K1-F2
gtcgacccacgcgtccnaaggaagctagggatgagacacttaaaataaactttttacttcttctataacacaaactcaaatttcttcagtcaatactcatcatcttcaatataggttcaagagatataaataacctgatggcgatatcatcatcttttaaagaattccaactttncaattatctgcangtctatcctaactatattatcatgcttctcatatcatgccacatgaaaaccaccacaatgtctttaattactcttc

SEQ ID NO: 16905 - DNA, 468 bp, Sorghum bicolor
  unsure (1)..(468): unsure at all n locations
  Clone ID: LIB3481-036-P1-K1-F4
aaccccccggtcgacccactcctccngcagcttctcggacagatcgctnaacacaaggacattcttgaaggcgatccttacctgaagcaggggctgcgtctgcgcaatccctacatcaccgcccttagcgtgttccatgcctacacgctgaancggataagggaccccnacttaagtgactccgcatccgccgctgtccaaggagttcgcctacgagaacaagcccgccggactggtgaagctgaaccctgctagcgagtacccgccggggctggaagacactctcatcctcaccatgaagggtattgccgccggcatgcagaacaccagctaggccacttccccttcactcacctgcagagtactgcacggcaataataatcacatcttccggatggtggcgttttgtcaggttttgatagagatcttaaaaacttacaccacctgttttcactatatgacattttt

SEQ ID NO: 16906 - DNA, 438 bp, Sorghum bicolor
  unsure (1)..(438): unsure at all n locations
  Clone ID: LIB3481-036-P1-K1-F6
acccactcgtccagggcgtgctgggggcggaaagtcaacttttatccaatcacttttcaggatcgttgaaccaaggggaggaacaatctaaatctacaatgttnacagcgttgaggatagntcttcatgatttaagaggaagactaatcatcattccgcaggatccaactatgtttgatggaacaatgatagggaatctggatcccctgaatgagtaccctgatcatcgtgtgtggtatattttttacaaatgccagcttggtgatatatctcggcaaaacccaaataaactggactctacagttgtcgagaatggctaaaatttgagtatttctcagattcaactatttttccttctaatggttcttctaaaacaaaataatcttcttgttcttgattaatcaacttctttaatttactcctcttctattgcgatta

SEQ ID NO: 16907 - DNA, 186 bp, Sorghum bicolor
  unsure (1)..(186): unsure at all n locations
  Clone ID: LIB3481-036-P1-K1-G9
atctcccccttttacaacatcttgagtgttctgtttttatttttacaaaactttatcncctctcancacattcccctttcccaacatgtcataatatcataatatacccaacacctatctcccttcccaacattttctcatccttaatgtctaattttactttttcttttttctctcattaatcac

SEQ ID NO: 16908 - DNA, 103 bp, Sorghum bicolor
  unsure (1)..(103): unsure at all n locations
  Clone ID: LIB3481-036-P1-K1-H4
cattctactatagaagaaatctaaccccacaaatccctcatttaaaccaanctaaataaaatattgataatgcaatttaaacaatccaaactaacttcaacac

SEQ ID NO: 16909 - DNA, 284 bp, Sorghum bicolor
  Clone ID: LIB3481-037-P1-K1-A10
cgtccgccttcctcaccgtgggcgcccgaatctacaagctgtccgtagaaggcgacctggccgcgctcgcctccgcgccggcgctcggctccgatcccctagcctcgctcaccgcgcacgtgagccgaggcttcctgctcgtgggccagcccagcacgggccgcatcctccgcgtcgacatggaggacggcgccacgaggaccgtgtcctgccccctcacgccccccacgccgaccgcggtggcggtccggaccgatggggcggaggtggtgggtggggccgaa

SEQ ID NO: 16910 - DNA, 483 bp, Sorghum bicolor
  Clone ID: LIB3481-037-P1-K1-A4
cgtccgcccacccgtccgagccgtcgtggtagagctagtggcccagacagcgccggcccactgccgggtcgcttgcagggtcacgagcaagtacctgcggtagcaccacacgtcggtggacatgcccctggacgcggacctgttcgcggtgcccgcgcgccagaacgcgcccaagcaggtgcacatccagctggccgaccacacgggcacctccatgttcacgtcctgggtcaccggcgacgccacgggcatcagcagcctcctgtacggcctggtcgacgtcaagctcgacctcaccatcaagggctccatctcgcgctacacctactacaactacatgtacgagtacatgcaccacaagacgctgacaaacctgcagtaccgctccaggtaccactacgccgtcggcgtcacggtgcgcaacacgttgcgcacgtcctggttcaggacgcctcccgagctcggtctcgacgtgccgctgat

SEQ ID NO: 16911 - DNA, 533 bp, Sorghum bicolor
  unsure (1)..(533): unsure at all n locations
  Clone ID: LIB3481-037-P1-K1-C8
tcggaaaccgcgcggcgggccacgcgtccgccgacccctccgcccacgcgtccgcccactcgtccgtggagcgatttgtctggttagtttcgttacagagctaccntcactccagagcacacccgtgctgccatgacgtggagccgaggccgtgccatcacgggcacggctgctgccgccaccactgcaaaccggagtgcagcagctgccgaggatactgctgcaggcccagagcgcaggagccgtccgcgccgcggaagccaccggcaggcaaggagcccaagcggcgcctgccgccccgcaaccactgccggccggtgctgaagggcgcgccgttcatcgtctgctccagctgcttcaagctggtgcaggtgcccgccgacttcgccgtctcgaccaggacagtgcgcaagcttcggtgcggctcctgctccaccgtcctctcctactcctacagggacccggccaggaagaaggcctaccaggactccgtcgaccagtgcagcatatacggctccgagctgcacggcggc

SEQ ID NO: 16912 - DNA, 454 bp, Sorghum bicolor
  unsure (1)..(454): unsure at all n locations
  Clone ID: LIB3481-037-P1-K1-D5
gccgcacgcgtccgcggactcgtgggggtgaacggccanaancccctgcccgcgcccgcgcccgctccaggcctggangaggcgacgccggcgcccacctanctngatctggtgcctgtgtccaacctcccccgcccgctcagcatcagcgacctttccccggcgcccatgcacgggtcgcagctccgcgtggcgtaccagggcgtcccgggcgcctacagcgaggccgccgccgccaaggcctacccgggctgcgacgccatcccctgcgaccaggtcgaggtggccttccaggccgtggagctctggatcgccgaccgcgccgtgctccccgtcgagaactccctctgctgcagcatccaccgcaactactacctcctcctccggcaccgccttcacatcgtcggggaggtccagctccccgtccaccactggcttctcgggctccccgggg

SEQ ID NO: 16913 - DNA, 368 bp, Sorghum bicolor
  Clone ID: LIB3481-037-P1-K1-D6
ctgttaaaaatcccgcggcgcgacccacgtccccccactcatcctcccacgcttacctcatccatttggctgtcccgtatcccaccacgccgttcctttctatagtggcgcctcatcctaattatttggtgctcttctattccaagcaaacaaattttagatctaggttcacatgctcattgaccagactcctcttcttgatatcaaggacaaccattaatacgatattaatgcctctcatattataagccactcaagaacatcaacctacttgtcctcttccgctgagcataaatttatatcacgccacccaaaaacaaccccaacatcgaaattaccaccctttctgccattccctttatcttttt

SEQ ID NO: 16914 - DNA, 162 bp, Sorghum bicolor
  unsure (1)..(162): unsure at all n locations
  Clone ID: LIB3481-037-P1-K1-D8
cacgcatcccattgctcttgaatacatccatcgtttttctttgccagatgttataacnntcaggaggtctatttcaaaaccagttcttccacatatcctacanaaagtatttctttttctcccatacttacattaattaactcatctagtgcatagagatat

SEQ ID NO: 16915 - DNA, 434 bp, Sorghum bicolor
  Clone ID: LIB3481-037-P1-K1-E7
cgtccgcccacgcgtccgctgagataatcgatccttcactggagtcatacgagaggatggatgcttcagtgcagtcataccgagatgatatagatgtcatcggggtggtcgcgggccttgtgttcttccggaagtggactcatatattcaccattgatcttgaaactatgaagctcaagaggttgcctaaagcggattgcctgggggcgctgatctacccttacacagttgcgtggccaccctctttgtagaatcctgctgaacaagacaagcgcttgatttattggggaactagtcactggaatattactgttagcaccagtattagatgtttttgcagaggatattttggtaaatgatgaatctttgcttttctttttatgaagacttgtgagactttatagcacaatattcgtgtattgtttgttttttct

SEQ ID NO: 16916 - DNA, 485 bp, Sorghum bicolor
  Clone ID: LIB3481-037-P1-K1-F12
cgtccgtgcctaacctcaaagctagcactgcatctccaaacatcactcaacctatccaggagtggaataatgggaaggacgaatacattgtttcttaatcacgaattgaccatattgccttcgacaaggttgactttccggacgcagatctgatcgcaaacttcatggacattgtacgctccgctgtgaggaacacgccatctggtgctaaggggatatactggaaaacagcgtacttcatctcatccatggtaccttctatcaagctaaacatcaaagaaatgcttgattatggttaggactgatttgactagatgtgaccacaggcaccagttaagtcacattaactatctgcctcttgctacaaatgagcggagacatccacgtggggtatggcaagtaggtgcttagctacagtttgttcagtatttcgggcacccatcatcagagcagttgaagtatgcccagattgacaaccaggtggt

SEQ ID NO: 16917 - DNA, 642 bp, Sorghum bicolor
  Clone ID: LIB3481-037-P1-K1-G3
cgtccgcaaagcaacaacatgcctggtcttgacaacatcccttctcgtataaagaaaaaaacagcctgttcatacagggagttagaagagaggaagcagcggcttcaaaagcttgagaaattgtatgcagacatggcattgcaaaaagaattgaagaaacctggacgcaagaggaaactgaaactcaatgaagatgaggagacggataatcaaacatcacagcctgtttataagtggcgagcacagaggaagcgatgatatgaatgggtgacagagtaaggaaaaggcaaggcattagtagtggaagcatggtcatagtggcgtacttgctggcgattgatcagctctttttcgatccaaaaagacttacctgcaaaagtagccctccgcaagaactactatggctttgtcaaactgttggagtgttgggaaaaaagaattaggataagatgtaagagtaactttaatttatacaagatcagattctgtatgattcaatcctatgtatcatgtctcaattcattgctctctatgctgttgaattcaccttaggatgggctgttgaattcgacccaacattaacatgtatcatgtaaaactattgaatttgatccaacaccacatgtttaatcccgttgggct

SEQ ID NO: 16918 - DNA, 271 bp, Sorghum bicolor
  Clone ID: LIB3481-037-P1-K1-H11
cgtccgcggactcgtgggcgcgcacggacgcaggcagttgaagcagcacgatgtggtgggcaggatcaacagaggctcgcgcttcatactggctaaagtctagtttcccggtgagctattcgttaacatggtcgcggtcttttttactgatgttaacaaggttctatgccctcaccagatcgttattttccaacaattaccagtatgaattgtgaatgggacgctccctgtatctgtcattaaatgcagctgttgttgtggttatttttaa

SEQ ID NO: 16919 - DNA, 362 bp, Sorghum bicolor
  Clone ID: LIB3481-037-P1-K1-H7
cgtccgagatgagtacctttatgtgtcaagaattgcagtcttgccatcgttcatgaggaggaaggttggtaccgaactgctgaaggcctgtgagtcacttgggctcaaatggaggcacacatgcatggttctgagggcatatgaggatgacgacggggctcgaggtctctatgccaaggcagggtaccgggtcgtgtcaagggatccagactgtgtcacctgggtagggaggagacggcgtgtcgcgatgataaaagagaaaccggtgccatgggatcggattgggtaatatataacaaaaaagttttcttggttatttggtaatcatataagagtaggaaaacttgtgacttatgattttt

SEQ ID NO: 16920 - DNA, 346 bp, Sorghum bicolor
  unsure (1)..(346): unsure at all n locations
  Clone ID: LIB3481-038-P1-K1-A11
cgtccntaatttacttccccatcttgaacactaaagtcatactctactttcccttccaagcaccaacaacaaagatgggaaattccacttntacaatatattaagatctgctaaattatcattcttctcacacacacaagtacgccatacattctttacctgttaataatcaacatccaaaacacaaagtgcatcaaaacaattctcttcaagactttggcatcaaaatcaatcaacattctacatattctctgtcatagctacaatcatttaactcaccctgtcaatttcacctacaattaaaatttacctgcattctatctctcacaatcacaccaaattccta

SEQ ID NO: 16921 - DNA, 295 bp, Sorghum bicolor
  unsure (1)..(295): unsure at all n locations
  Clone ID: LIB3481-038-P1-K1-A6
ggccgcgcgtgcggaagcaacaagaagcctgtacctaatggtattgtctatggcaaacccaancaccacattatggcgcatgggaaattccagaggaacaacatttcccttccttaaaataaaactggacttaatcttggtacattgacaattcttaactcctactgggtgaatgatgttagttcctacaagtactttgagatcatcctcaattatattaaccacacagccatctaaaccaatccaaagatcaactttctatacaacctctatccacaaacaccatgagctactt

SEQ ID NO: 16922 - DNA, 416 bp, Sorghum bicolor
  unsure (1)..(416): unsure at all n locations
  Clone ID: LIB3481-038-P1-K1-B11
cgtccgcggacgcgtgggcgcgccgtgaaccttcactgttgtaggggagcggangcttgggtatatggttttgctagagtcgcggtgtctcttggatcgtgctgtcatgcccaacttcggcctccagcagcaaaccacagtggtccaggacatgttgcagctagccaagttcacctgggcgctctgcgacaagcctcgcccatcctcggcaccagcaaggtcgaaccttgaactatgtcgacgcccttcgtgacgtcgacaaaacccttgtccttctttcttatacctttgtataccggtgatacttgatcagtcatctccgatctcgtttaatgcatgatctgtctctattatatctttgcctgtgccgtgccttcgcgccggtctactctatctcttttggtcgctatggaaaa

SEQ ID NO: 16923 - DNA, 629 bp, Sorghum bicolor
  unsure (1)..(629): unsure at all n locations
  Clone ID: LIB3481-038-P1-K1-D1
cgtgcgcgtntctggcctctcttcttctttcttttgtcttttgcttccttgagttgccattttctgatagccgggtggcctggctctcggctggcgggtggcggtcaattgttgccagccggcttcttcattgccatatccggttggttcttcatcccattccctgattgccatgcatatctgtagatgcacagctcattcaggcatcctcaattcaattcctgggggaaaaaaaacgaaaaaagacaagacaaaacagggctcaaatttggactgttgtttctgaattgaattccaagactgcacaaaaattgcttgccaaggcccaagggaaagggattctagggagggaggcagaagcttcccggttacaaggacatctttgtatgctcttctgcttgctgctgctggcctggctggctttgtgctggtaaatggatagacgcgtatgaatnggtggaattggaattgactgggtgaagggagatatgctgctgagagtcacacggcatttccaatttcttccctttccccgcagcagccttggcttgtttttccacagtgtcccttgtctgtacctttgcatgcatccccttatacttttacagatatacgcttccatcctcctt

SEQ ID NO: 16924 - DNA, 649 bp, Sorghum bicolor
  unsure (1)..(649): unsure at all n locations
  Clone ID: LIB3481-038-P1-K1-F1
cgtccgcctgatcctgatgttccctcaaatgctaataatctgaaccaggagctgaggtttgatggaagagcccatagcaaacctgatcctgatgatagtactaatgaagttgttccggaatctggaaacaagatggaagtggatagtgaactgacaaacagcgtcacagtcttgaagtatgaacctgaccctgctgattcctcaaatgctattgtcaaacaggatttggtcatcgatgggaagcatggtgaagaacctgatcctgatgatactgcttgtcaagatgttttaaaatctggaaatttgacagaaaggataacagaacagagcagaaactccacagttttgaagtctgaacctgatcctgacgatcatgttgttgattcaaacagcaatgagctgcaaaggattgaagaaccagtggcagccctctgttcacgactccagaagtcaattgagacgctccggttgcaagcgacacctgcagaggcagagtctgctattcatacactctntaaagatatcaagaatgttatagagcatccaaatgatattaagtataagagattgcgtaagtccaacccacatttccaaaggagtgtagcaaactataaagctgcaatggaggttcttgaatngattggtttct

SEQ ID NO: 16925 - DNA, 497 bp, Sorghum bicolor
  unsure (1)..(497): unsure at all n locations
  Clone ID: LIB3481-038-P1-K1-F10
cgtccncggacgcgtgggtgcaactccagtgattcttcctacaaacatatcananaattgctggttgggcacatagttgcttgccnanaaaatcaatgagaaatcnaggctcttaattctatgctctccatctaatccaacaggatcagtatatccaaaggagctgcttgaaaaaatagctgatatagtcaagaagcatcctaggcttctggttttatctgatgaaatttatgagcatattatttatcagcctgcaaaacacacaagctttgcttcactgcctggaatgtgggaaagaacattaactgtaaatggtttttctaaggcttttgctatgacgggttggcgtcttggttaccttgcagcccctaaacattttgttgcagcatgtggaaagatccaaagccagttcacctcaggtgccagcagcatatcacagatggcagggcttgcagctctgaaccttggctatgctggtggtgaagcagtattaaata

SEQ ID NO: 16926 - DNA, 320 bp, Sorghum bicolor
  Clone ID: LIB3481-038-P1-K1-F2
cgtccgatcgatgttaggaaggcaaggaaggagcagctgaagaaagaggaatccatggggcaagtctggcgctattgctattgttgtcggggtcattgcattggctggcctgtacttctacctcaacaatgtctacagctaaacgaagaatcgtgcatgagacccatttggtgccgggaacagaggattcgttccattttgcagttctttttcctttaccactgcaaatgtgttgtcttgctattgctacatatatatactactaggtctcgaagactgtataaaagtcgttgttaatcttgaaatatcacacattactt

SEQ ID NO: 16927 - DNA, 506 bp, Sorghum bicolor
  unsure (1)..(506): unsure at all n locations
  Clone ID: LIB3481-038-P1-K1-G1
tcagatacaagggctattattatggatgaattccttcaacgctacaagtggtgccctgggcaagaagcanagtgtctgaagttagtggaacgcaaagtagtcagacaattcaattcaatcctgtgtgatgagaagcgaaaggttagggtgaaattggttgcatcaaggaaatctaaggaagcgttggatgctgccaggtccaaacagacaaatttggctgggaaagagttgaagcagcagcacagaaatccagcttcagcggggagtgaggatgatgacccattgcagtggaagcctttcccccctgaatggatgcaaccaaagtggtgggaaatgctatgtgagcactgggcttcagaagaagtcctgcaagtctcggcccagaagaggaaaaacagatacacaggaggttgtgcccagcacacggcaggctcgcggagcatagccatgcaccgaaaacttatgataatagaaaatggtggaaagccagtatcagatattgaagt

SEQ ID NO: 16928 - DNA, 646 bp, Sorghum bicolor
  unsure (1)..(646): unsure at all n locations
  Clone ID: LIB3481-038-P1-K1-G12
cgtccggtcatggagcacagagccaagtacaacgacggtgatgacatcccaccattggtgattggggtgagtgctcctcaaggaagtggaaagaccactcttgtcttcgcacttgattatctttttcgggttgctggtaggaattctgtcacattgtctatagatgacttctatttgacagcaaaagaacagaatgaactgagggacagaaatcctggaaatgctcttttagagctccgtggaaacgctggaagccacgatctccaattctcagttgaaacacttgagtcactgatcaaactaacaaaggaaggtatgaagatgaaggttccacggtatgacaagtctgcttttgggggaaggggtgaccgggctgatccttctgtatggacagaggttgaagggcccttagaggttgttctgtttgaaggatggatgcttggatttaaacctcttccaaatgaagaagtgaaaaaagtggatccacagcttgaggtggttaacaagaaccttgaagcatactatggtgcttgggacaggttcatccaatcatggattgttattaaaataagagaacccaattgtgtataccagtggaggctgcangcagaggtagctatgagagcagatggaaaacctggaatgt

SEQ ID NO: 16929 - DNA, 641 bp, Sorghum bicolor
  unsure (1)..(641): unsure at all n locations
  Clone ID: LIB3481-038-P1-K1-G2
cgtccgcgcgagacgaccagcgtggctcgtggtccaagaatccctcgtctctctagagtcgcgttgtggggtggagtcgacnagcgagacgatctanttgagggcgcgcgtgcggagggagttgagggcgcgtgggaatagattttgcaaggcagtgggcctcttccccgttggaggcagatccggctcggcacccggcctcccctttggccgcggatccggcgcacctcttttccccatcagcggcggcaatggcgaagcatcagcatcatcctcatccatggctgcatccagcatggagactcgttccctatcagcggcttcactagccacggcttccctatcgaactagcagggaaaaagttaaagaaggaacccatggtgaatttctggacactataaggatgattttgctagttttgttagtaatcagctgatggcatgatgattttgcttgtgaccagtcttttgcttgtcctgttgccttggtatgctcgggctagtgctgttatatgtcttttgggtgtgaacctgtctcctgtgtatgcacaggctattcaaatacttcacaagatacaagttcaaacctatctagcttattctgtttaagtaatgaaatttatggatccaagttctcagtt

SEQ ID NO: 16930 - DNA, 345 bp, Sorghum bicolor
  unsure (1)..(345): unsure at all n locations
  Clone ID: LIB3481-038-P1-K1-G3
cgtccggcgtacatgtcagggatgcaacatcacagcaaggggagcgggtcgaggtcgtcctcatcgtggcgccaggtgaaccctgggtcatcgttcacnccatgcccttccctgccctactcaaccagaaccccgacgggcaagtgccccgttaacacgctttagctgctgtcgtgcatggacacgctcaactgcctcttgcactccattatcccaaccaaggccagacacacctgctggccgctgttatcctgcgtgagctatcttgactccccgctctgactgtgtactaccatcaagggcaaggcgctcagagtcagtgtctgctaccttacccatcttgtg

SEQ ID NO: 16931 - DNA, 463 bp, Sorghum bicolor
  unsure (1)..(463): unsure at all n locations
  Clone ID: LIB3481-038-P1-K1-H11
cgtccacacacacataccaatgaacataccagcttacatatgaaataccatataaaatggggataatgcttttaatcaacacgatacacaactctatncattaataaatactctaataaacactgtgaataacacccaatattcaatcacaccagcactaacatcattgacggcatcagcaacacgcatagcattacgcatagttgcctggcatattaacgggcaaattaatggggaatctccagtatggtaggcactaccataggcgccaccactaccgcctgaactacaccacgaagcacaccacggaacaccccatcgaactgcccacggacatgaccaccaccaacagcaacaggcacccccacgccaagtgccaggccaaggacgtgcgtcacaccctgccgaacacccagtctacagagcccaccgcctgaacccccaactgatcactgactgcatg

SEQ ID NO: 16932 - DNA, 316 bp, Sorghum bicolor
  unsure (1)..(316): unsure at all n locations
  Clone ID: LIB3481-038-P1-K1-H12
cgtccgcccacgcgtacgtgaatattgaactacatatataaacaccagtgcttgactgaggaaaaaggggaaataaaaaaaaagggaaaaaaannnngggcnncccctctaaaaagaacaaagcttacatacacatgcatacaaacgaaataactgggggtgtagggttacagaaaataaaattaactgcccgtggtggaacaacaatagtgactggaaaaacccacccaaaaccaaactaaaggcccttgaaaaaaatccccttattggaaaaaccgtaatatccaaaaggacaacaccgatcgacctacccaac

SEQ ID NO: 16933 - DNA, 647 bp, Sorghum bicolor
  Clone ID: LIB3481-038-P1-K1-H9
cgtccgcggacgcgtgggatttcagaacaacagcaatgtcaggctgcttttgaagtatggggatgcggggtcacatatgatttttgcagcatcagacatgttcattgttccttctatgtttgaaccatgtggcctcactcagatgatatctatgcgatatggttctgtgccaattgttcggagaactggtggtttgaatgacagtgtctttgatttcgatgatgaaacaatacccatggagctgcgaaatggtttcacctttttgaaggccgatgagcagggttttgatagtgcactggaaagagctttcaactactaccatagaaaacctgaagtttggaaacagttggtgcagaaagacatgaagatcgatttcagctgggatacttcagcttcccaatacgaagaaatctatcagagagcagcggctcgagccagggcaacagcgtaaatagcagagacagttccctactgcctctgtgaagtctcctagatgctgtgcttaaccgtttggtaaagaaatatggttgtatcagctctaaattaagcatatgctgaagaagcacggtgcttccctacttgggtatactaagggcgacttggcgctacgtgcagttcccaacgaagcaaaaagataagaggaaatt

SEQ ID NO: 16934 - DNA, 514 bp, Sorghum bicolor
  Clone ID: LIB3481-039-P1-K1-A1
gcgcgtccgcatgttttacccttttcttcaatccttgctgctaataaatgccactctcacaaaggaatgagccgtgtttgatgagatgcataataagtgaagggttctaaggtcatttgatctactttattaatctttgtgcaccgagtcgaaattccatatttggattggtgggggtcattcacagcaatattttggcaatgcgttgcggtattaacagtttatacataagatgacatttgtacatttcttgcagttgtcatctttaacatgttagagccgggtaacatctctagagcaatttgtggagatcaaataggcaccttagttgatcagtcaggaaggatcacataaaattaggaggattaatggtagcagagctccaggacatgctgatactctgggggacatcatggattatttgctcttggatcttttccggatagaagagaagcatgttcatcagatgggaagccttcaccttgatttgcctgggatgcctgttatgtactat

SEQ ID NO: 16935 - DNA, 317 bp, Sorghum bicolor
  unsure (1)..(317): unsure at all n locations
  Clone ID: LIB3481-039-P1-K1-A11
atttccaatgcattnaaaatnanccacccaacanagggtccgcttttatataaaaacagcagcatcaccacntccattattacctccatnttatnacacanaaacagtcatcaatcnaccntatatcatcagatgttcaatgtttttcttcaaatgtgtttgatcctactaattaaaaacattctgcaaactatagtgtgaatgggggtgtctcaattaatcataatgggtgcaatttccataattaaactaacactttccccaatattgcaataccaaacatataaagtattaattttaccattatccaaaatatc

SEQ ID NO: 16936 - DNA, 162 bp, Sorghum bicolor
  Clone ID: LIB3481-039-P1-K1-A12
cgtccactcacacttacagacacgcataccattacactataacacaagtacacaacaaaacccgcgccgaacctatcacactatgggccctctcacccacatctctctttgaaatttcttgtccatgacacgtacatctatctatccattaacaacctcatc

SEQ ID NO: 16937 - DNA, 198 bp, Sorghum bicolor
  unsure (1)..(198): unsure at all n locations
  Clone ID: LIB3481-039-P1-K1-A7
ctaacaaaanaatcatgtnttgttatactataaacaaggcgttcactcaaattacattcttannanaatcancttatacacaccgataaaacacccacaaaatctttacgacagatgttttttttttcttacacaaaaacttccaacaacctttcccccattactcacataccagcaccctcttaaccatctcctccc

SEQ ID NO: 16938 - DNA, 262 bp, Sorghum bicolor
  Clone ID: LIB3481-039-P1-K1-B10
tccgcccagcgtccccaaaaaaacacatacatacaacaacatacctattctataacatcacctaaatccaatgcactggtctttaaaaaaacaacgtcataacattaaaaaaccctaaaccttacccaacttaaatcaccttacaacacatacccctttctccccctctcctaataaaccaattttttctcacctatcctcctacaaaacattctttcatttattaatcccaaatttaactcccccttccactcttcataaa

SEQ ID NO: 16939 - DNA, 495 bp, Sorghum bicolor
  Clone ID: LIB3481-039-P1-K1-B11
cgtccgctctaagcatatccatctgactacctgtacaaaaataggtatgaactgcactgtcttgtgaggacttttggaaaggtgcgcatatattctaagtgagtaatatttacgttttgccatgaatatttttcaactctggctgtggttgattgacttcatgatgcaggtagtgtgcacaaaacaaaatccaaactgcagagcttgtcctttcagtggaagttgtatatattacaatagtttacttgccagaaaaccgcttcctcttccagagaagcatgaatatgaacaaggagaacagcaagcaaagatgattgcttctgggagttgcacaccaagttttcaacaaatgtatcagtatcaaattccaataagcagcactactgaaacaccacccatccataactgcgagccaattattgagatgccaccaagcccagaatatgaacacaacagaacacctaacgagcaagaaaattcctacggagattatta

SEQ ID NO: 16940 - DNA, 399 bp, Sorghum bicolor
  Clone ID: LIB3481-039-P1-K1-B2
taccgtccgaatcccggtcacccagcgtcctgcaccttatctcatccttttctttttgttagaataactcagacctccccatgtgggaagttttttaaccggtttcaaccattctacacattcttatttcctcaatacatttcagtctctaactaccctcatgctgtttgatattaatcacatctagcaaataccatcatccttacatatttcctgacactctcccaaatcttttaactgcgataaatctacacctcttaataccttcccttctcaacttcacgtgttctcatcttaagccaaacaattactgcttcaacacctcacacgtctttttcacatggagagatctactacaactaaaatacattcattacccatattaatgcttttgattct

SEQ ID NO: 16941 - DNA, 223 bp, Sorghum bicolor
  unsure (1)..(223): unsure at all n locations
  Clone ID: LIB3481-039-P1-K1-B4
cgttcgaaaaaccaaacttacatacaacatacatacaacatcataatctcttctataaaatacacctaaagtcaagttacttttcaaaattttacaacaccaaccctacnnacaaccctatccttacccaacttaatcctataacancacatacatctaattccatctcccctaatatccaatattcccactccgaaaacccttcccaacaccaactcaatct

SEQ ID NO: 16942 - DNA, 420 bp, Sorghum bicolor
  Clone ID: LIB3481-039-P1-K1-B8
cctacgccacacatccatgcaaatagattccttaatagatctataaccctccagggtgggtgttttaaaagcgagctgaaacaattcatatctctacctaccaattaaacagaaacatctaaaaacccacctattgggctactggtgtacatctacggctcatactctcaacaaacctacctgcagagctaaacaagcagtctcacaaattgatgcaaatcaaactatacatcccaagccatacattccaaacaaactacctactacactagatgacctgaatggtcattcataggtttacctgcaatctaccatcaaacttaacaaaaatatctccagatctctcatacatcctgacacagttaaagattacattctctacagagtgaacatcattcaaggacacattcacagctgaac

SEQ ID NO: 16943 - DNA, 339 bp, Sorghum bicolor
  unsure (1)..(339): unsure at all n locations
  Clone ID: LIB3481-039-P1-K1-C10
acatccacacacncntnttaactactaaccaacaactaataaacttaacaccaacaaacanaccgaatgtattctaatcttaaacccataccatctancccttttactcccatcccattattctttacccattactctcttacgcctattaactgatcctctactattttttattatactacgatgagaacaactaaaatatcattccatacattatttacttcattcttcagatatcccacattatcacccaagtatccaacaacgtcacataatatagcactattaaccactcctctaacctcactatctcatcttatccttttctatctccccact

SEQ ID NO: 16944 - DNA, 402 bp, Sorghum bicolor
  Clone ID: LIB3481-039-P1-K1-C12
ttttgacggaaagtaatcttctcttgataggattatatacatacatggagatgaaaagctaatacagattaagagaagcaatagaattgaaaaactaaaacggattagaggaatcaaagtaattaggcatgataattttgttttaagcagaatcatatcatcataatgaaagaaagttgattagtccaagataagagcaagtctgcaagtggaaggcggcatcccaccaaacaacataaatttctttctttttccttctgctaacatctgctcgaggtgatcggcaagcgtgattccttcccccaatgcaaggtagcggcagtcatagtgccgccttcaccaatagccaagaactcagtggctgctcagcatggaaagcgcaaccacctgcgcccactgctt

SEQ ID NO: 16945 - DNA, 429 bp, Sorghum bicolor
  unsure (1)..(429): unsure at all n locations
  Clone ID: LIB3481-039-P1-K1-C4
cgtccgcatacactcaaaaccgcgctacagctcattatagatctcttactggattactaacaactacaggtgggatgtaccttcttagctcaggatctnattctctattaagactcttaaatatcaattcatgctccaatactctcatcaattttgaagctataccattgcagacatccaacccattacaattaactctcactcacgatccttcacttgtatttattccatatatggcaagcatcaacgcatacaatatatggtctcatacaacatttcgaacatttacagcgcactatcaacttcataatcgctgctactatagttaacacgaccaagaactttatactagctgaaacgacactcaaattcttatcttgactccatcaactccagcttntacttaaattgaacatcattacaagaccc

SEQ ID NO: 16946 - DNA, 387 bp, Sorghum bicolor
  Clone ID: LIB3481-039-P1-K1-C5
cgtccacctactcctacacatcatcctattctactccatatactgatcaatgcaattcttcacacaaggcctgtgtataaaccgtggcaggccctgattaaaaaccattttgcacactatgttctacagaaatttctagacctataccatgaccagaacctttaatagattcttttccacatcaatgcacactaaaataccccctacagatacactttcgtgaaacatattgagacacttattgacaaactaatacccccaatataaccccccatctgctcctcatacttctgctaagatacacattaacatacatactaacacacatacaatcacacagactatacttttgactaataccactactattacctattgtccgaattc

SEQ ID NO: 16947 - DNA, 414 bp, Sorghum bicolor
  Clone ID: LIB3481-039-P1-K1-C6
gcgcgtccggcgggagactagtgcggagatagccagggccgcctagtcgtccctgtaaaagaaggcagcgggctgtgtcatccggcatggcccccaccgactggagccgttctaggtcttcatcaagtggcgctccatgttcagcattgcggtcttccgaccggtgtctctctgctcttgcatttcaaaacaccttgtcatggcccgcatcggtctactgtcggccagcttctcagtcaacgcgtagaacagcttgctcccgctctattacaaggaactcgtggttactatttccgttgagtaacactataccacctgcactaacacctggacaagcagcccgccattattgccgactctaaatcgtactttacataattggcgctattgctctgctcgtactattttttacct

SEQ ID NO: 16948 - DNA, 356 bp, Sorghum bicolor
  Clone ID: LIB3481-039-P1-K1-D11
aaatattggcctttttttttttttttttttttttttttaattcttattttcttatattatttattacattatttgcttcatgtattacttttttttatcttcaaggacattaactttataaactaccgttaaataatctactctgtatatttgaaaacttccttaattaaagaaattgatgctttattttaaaacctaaattatttacttaaaaatttttttcagaattatagactcatttgctaataaactttttaaaatttttgtattattccattttcccttttttaataattttttattaaaatatttaaatattttttttaccacttgaataatttaccgtttcttattct

SEQ ID NO: 16949 - DNA, 464 bp, Sorghum bicolor
  unsure (1)..(464): unsure at all n locations
  Clone ID: LIB3481-039-P1-K1-D2
gcgcgtacagccaaacctcacaaataaatgatttatatcttattcctatgctctactccctctatctctggggagcgtttaataaacaggctaccatctcaaccaacaccancttttcatcaaattattcccacccttatctattcaagaagatccaaaacctcctccacacaatctttttctccccacataaaatacaacgacaagctaaaactcatccaagattgcaacgcactatcaaactcaacacggcaagaattattattaatttatgcttacgtgtttgaaatcaattaatctctttattttctccaactaaagaagtcatctggagactgctccctgtacacaaagctttatgagactctctcagaggacttgtggacactcaaaatccatcaatttttaaagcaggattctatccgacaagagataggttgatacaatagtagcttttaacaaaa

SEQ ID NO: 16950 - DNA, 421 bp, Sorghum bicolor
  unsure (1)..(421): unsure at all n locations
  Clone ID: LIB3481-039-P1-K1-D5
tcatccaattcataacactcgcaataacnttcaatctcaacttttngatcacgttcaaatctactagataaccaccacaatacttatcaaangatcacttatnatcgaaatatgacttaatcatgggacacaacaaactctgatgctaatcgtatttctaatttgaaaagaacacacacatcttttattcatcatgaccatcacaatcactaacttttcattaccagaattattaccaaagaatgtcttaccaaatcaaattttctataaaaaaaacctctttcacaattatctacttctatttccctcccacttctgatctccaaacaactttcataatgaccacctatctttttcacacttcccattgccatatattcttcacataaacttcattcttacctacaatttcatttttact

SEQ ID NO: 16951 - DNA, 394 bp, Sorghum bicolor
  unsure (1)..(394): unsure at all n locations
  Clone ID: LIB3481-039-P1-K1-E10
cgtccaggccgacatccccaagtggctctatttgctgtattcaatggccacacgccncaaaaaggcgggagagttctctgctgaggacattcccaagtttatagcccatgagttcaagaaggtaaaccctggagagatcgaatgatccgtcaagaggtgttacctgaaaatctactactatttcctcaatagggacaaatagcagtgcacgtgctatgtcacaaccgttctccaaaagggtggactggtcctctccaatgcttgagactgccttccggttctcatcctagcatgtaaagctgaggcactcacctctaaccacctgacctctcgggaggacgagaacgacaaaattgacaatttcggtggatttgtggtgaattaccttggaaca

SEQ ID NO: 16952 - DNA, 488 bp, Sorghum bicolor
  Clone ID: LIB3481-039-P1-K1-E12
cgtccgcgagaaatctaccgaggaagcccagacaacccatgagagacccaaaggtatcatgatggtgtgaggatgggttcttttggtctcatgctcaactctgtcgtccttggattcacctctgttgtgctagaaaagttatgtaggaagtggggagctggacttgtatggggtgtctccaatattataatgactttgtgcttcttggcaatgcttgtaataacatatgttgcacagaacatggattatccatccactggtgaacctccgactggcattatcgttgcctctttggtggtttttacaattttaggggcacccctggcagtgagtaacagactgctttttctttttcatcataatgatctctatccacttccagctctatcgaatattgtccatgtggtatattcaattcatttccttatttgcagatcacatacagtataccatatgcaatggctgctaatcgtgttgaaaatcttggt

SEQ ID NO: 16953 - DNA, 468 bp, Sorghum bicolor
  unsure (1)..(468): unsure at all n locations
  Clone ID: LIB3481-039-P1-K1-E2
ggcgtccagtgaaattaacctccaatttntcattcacaattcagaatctcataanattttnntaanaggggttggtttttatataatgccagagaaaanccaaactntccatcctcatnactcaaacantnctcannntnnatcntatnatatatcactggaaaatgacgtaaattccatctctagttccaagagtacacatcaagagaagcaatcttctaagagcatttcaccatatgtttggtgttcattgacttatgctcaaactgaactccaacctgacaattgtgctaaaattcctctaaaagtgtgcatattcgcaccatttacatacaatttttccaattataagctgcaatataaagtgcatccatcttagggaccacatcttgattaaaatgataaattgttatctcgtacttgtctaaggcatactttctatcttactcttccttcaaaatgtctaat

SEQ ID NO: 16954 - DNA, 361 bp, Sorghum bicolor
  unsure (1)..(361): unsure at all n locations
  Clone ID: LIB3481-039-P1-K1-E4
cgtccgcacacacntacaaaaacatttatctactcctctatcactaaaccgcctagctccttcaatagggagtgcacacaacatagcacagcctcccccttcgtatctaatcctacatcactacactctataatataacattaccaacatcactcatatcccacaattctagatccccttatcttaccaacaaatttctctgcttgtctataaactataacgtttcacgcatgaccacagaccctcaattctcatatccaatcccctgcctaacttaactaatcaccatacttttcaatcacacaattcacttgcattctatttacattactattcgaaaaaaaaacaaaaaaaagagctc

SEQ ID NO: 16955 - DNA, 415 bp, Sorghum bicolor
  Clone ID: LIB3481-039-P1-K1-E5
cgattcccggtcgccgagcgtcccccacccctttcctgtcttcccagcgcgggagcgttctccgccatcaccggcggctgcggaaaaactatgagaggtcaccccccttatctatcccccagagggcatatgtgcagagaagaagcccccctcctctagaggggtatggagacgcaacaaaaggcatgaagcctttgtcccaatatcccattaagcgtcagacggagacttcagttccttttgaaagttgcccttccggatgttacattccaaagactatacttgggagcctcagatttccttttcagtttgttgaccctatatcctctgaacccatatacataatcccaagtttctttgccggagatactttgtcttctctgatccgaaaagccaagaaatcccacaactagat

SEQ ID NO: 16956 - DNA, 420 bp, Sorghum bicolor
  unsure (1)..(420): unsure at all n locations
  Clone ID: LIB3481-039-P1-K1-E6
gcgcgtccacccacccccttctccatgtctctccncaacagcagcagcgattctcccaccatcaccnggcggaggcggaataactatgaggaggtacanccccccttatcntantccccccaagaaggcatattgtggcagaagaagaagcccccctcctcctaggaagaggtatgtattactcaacaaagatggcaatgaaagccttttggtccacaatatcccattaagcgtcagatcggaggagcttcgaattccttttcaaatgtttgaccctctccgggatgtttacattccaaaagactattactctcaggagcctcgaagattttcctttttcgaattattttacccttattattcctcttaaacccagtatcacatcaatccccaaattttctttttccccaaaaatacttt

SEQ ID NO: 16957 - DNA, 479 bp, Sorghum bicolor
  Clone ID: LIB3481-039-P1-K1-E7
cgtccgaaagactgaagaaatgataacggcttggcttgaaggcagagagcttgctaaggcgtgagttggctctaagggtgggtcagtgtctctcaagcttcccaaaaagtaacaagtttaaggttagcccttatgggcaattcataaaataaatgaaacaaggtaggagggcgcttattgttattcctgaagaactgctaaaagttcaaagagatatttttactgcacaggaaatgggtgctactgtatgtttggcctagttgttttccactttattgataagttgaaaattggaattacaatggcaaggcatgtccaacttcaaacatacaagctgcatgtgattttctgtatttattcacatttacattttagtctgcaccctgcagtcctgcactgactacatgctcaattattggcatacaaaacttatcctgaagcatggagggctcatgccttctaaatacttccattaatgt

SEQ ID NO: 16958 - DNA, 446 bp, Sorghum bicolor
  unsure (1)..(446): unsure at all n locations
  Clone ID: LIB3481-039-P1-K1-E8
gcacgcgtccaaatctcttctacaatgattatgtttatgaatatacctatatatccaccatanaaaggggaggaatctataaatagttctatgctatcatataccctcaattacaacaacttttaagtaactccattatataacaactactaaaacaaatgatcatgtaaggagtcttctcattgctattctcgaaaacttgttaacaattataacagatattattactgtacaatatacttgtacacctgcaccaatatcctacttccaaatcactaccatgccatgtgcatcaactgatacccaaactcatatacaatatcaccattcactacatccaactctcatgtgatcctctaaatttatccatacatacacctttgtctgctcacctgcagaccaccatcttatacactactcaatccttggagatacaaaaacttata

SEQ ID NO: 16959 - DNA, 287 bp, Sorghum bicolor
  unsure (1)..(287): unsure at all n locations
  Clone ID: LIB3481-039-P1-K1-E9
acgtccggtccaacaccatataaatgatatccatccccataccagaatcaccacaccacatataggttggttctcttaacaagcaagaacatctcatcnaaccatcnactctaaaatttcctgccaatccttcgattcatctctgatcgatcacacctctctcaaacaagaacctacctctccctacacgtaatctccatgcaggtggagacagtcagcttcaattgctactacctggaaaaacattacacaagctactacatccacatcctaccatcctatttcca

SEQ ID NO: 16960 - DNA, 344 bp, Sorghum bicolor
  unsure (1)..(344): unsure at all n locations
  Clone ID: LIB3481-039-P1-K1-F11
acgtacaaaaaccacccaaaatcacccctctttccttccataaacctctnccctcacnnnatatgaacgttcctattctaaaccctgctcttccccccccaccccccaatcnaatcaactccattctanttaaaaatntatacaataccatatatcgatgtcanaatctaatcttttctttacaanannatnaacaccnnttcatccatntcntcntcttctcttaacccaaactctcctctcttcatcccttcatcatacattcatntttataacttctctccctatttatataaactcttcaataccacctcttaattccnctaccactaattcctcccaca

SEQ ID NO: 16961 - DNA, 577 bp, Sorghum bicolor
  unsure (1)..(577): unsure at all n locations
  Clone ID: LIB3481-039-P1-K1-F12
cgtccgggcgagtcgaggactcgcggcgccaggcgtgccgcgttggcgatgggctgcnggcaggggagttcacaaggacttgcgagcggcaagcnacnggcgtccgcggcggcggcgtgcggcggaagcgggtcctccactcgtcctcgcgtcgacctgatctggcttgcagcgtgcggctgccccaggctgctctgctggctgttccaagctctccatctcccgcactccaggagtacaggtccaggcgtttccctgctcaagtcccaggtccagaactccggacttcagaatccttcatcagcgtcctgctcaagtccagttggtgacgccttctccacatggctaatgagagatttaggtgtccagctacagacttgaaggtggcaatagccgctgaatgtatcaggcagagagttgatgcccacgacggcaagtgggcagctacagaggtgatgaagccgacggccgctgggaacccgcacatgaagctgatgatgaacacatgacggtgtgtgctttatgggaaggcctanaaggatgctgtggattttataatcttgtggtggaagcaggg

SEQ ID NO: 16962 - DNA, 278 bp, Sorghum bicolor
  unsure (1)..(278): unsure at all n locations
  Clone ID: LIB3481-039-P1-K1-F4
cgtccgccccaacatccacactgccccccactcccagtaaaaactcttctccactcaatgctacatgagccagatcaactcaaaccaacgggtaatagtacaatacatccnactacgtcaaccactccctccccctcaacaaaccatgccaactgtacctggcccaacaagatatctctaatgtcgccaaaaattacgccgcgaacactaacttgccccacatcctgcttcacaacgcctgcaccggcagctaccctactcacctcgacatcctttcc

SEQ ID NO: 16963 - DNA, 267 bp, Sorghum bicolor
  unsure (1)..(267): unsure at all n locations
  Clone ID: LIB3481-039-P1-K1-F8
gcacgcgtccgcccacgcgttccaacttgtcctacaacctctaacccaggctcaactacanctttcactacggcttaaacgtcatccagttctccttattttactactattttaagctgaacttcctcaccaaccccgtcaccaaccacgtccagaacacccagcaccacaaccagttcttaatcttcttctgcataataacttcaaggacaattgataaccccatcataatcttaaacctattttcctcaactttcttaatcccct

SEQ ID NO: 16964 - DNA, 170 bp, Sorghum bicolor
  unsure (1)..(170): unsure at all n locations
  Clone ID: LIB3481-039-P1-K1-G4
cgtccgataaaaatctcacccaacattcctaactccatcccttacaactactnccacactctcacctgcgaatgtactttttaataatcagaccatctacttctccatttccgccctacatataccaacaaacccaactagcccttccaccaccaaccactacccactct

SEQ ID NO: 16965 - DNA, 435 bp, Sorghum bicolor
  Clone ID: LIB3481-039-P1-K1-G9
cgtccgcccacgcgtcctaaaaaaaaaaaaaaaaaaaaaaaaaaaaaaaaaaaaaaaaaaaaaaggaaagtaaattaaaaaaaaaaaagaaaaaaaaaaaaaaaaaaaaaaaaaaaaaaaaaaaaaaaaaaaaaaaaaaaaaaaggggcggcccttttaaaaaatcaaaatttactttccttttttttaaacttaataatttttttatattgtaacctaaattaaattaattggccgacttttaaaaactttgtaattggaaaaaccttgcctttaccaaattaaatccctttaaaaaaaatcccctttttccaaattggcttaataacaaaaaagccccaactaatctccttttcaaaaaatttccaaacttaaattgcaaatggaaccccccttttacctgccttttaaacccgggggttgtgttgtttaccc

SEQ ID NO: 16966 - DNA, 407 bp, Sorghum bicolor
  Clone ID: LIB3481-039-P1-K1-H10
cgtccgaaatctatcaacttccaccaacacctaccaaggatcatctcatgtagagacactggtggcagtgttctacaaagcaggaggcgtgcaactctgcactcaatgccataaacgcactctaagttgtcctgcagattgcctccttcatctacggtcaatttctcgccattctctttgaaaccctgctcacctctactgttcagacatccgcgatcctgttctcttccgttctatacttcactaaaccattgatacttattcaacttcattcacaaaatcttttactcccaagattacatccacgcctacaactatcccattctcaaatacctctgatattacttattgtttctagtagtcaccattttacacttcaaatgcaccttaggcacctttagaaagca

SEQ ID NO: 16967 - DNA, 422 bp, Sorghum bicolor
  Clone ID: LIB3481-039-P1-K1-H12
cgtccgcccacgcgtccggctgttccgcgccgagctccggcgagcgctcgagttgtaccgcggcgtcgacggctccggctaccggtccccggtccccgggccggtccccggcgaggacgacgcgctctacgaccccttctacgagcactgcgacgccgacggcagcggcgccgagtaccacgccgagatccgagacaagatgctacgcatcatgctcggcgtcggctacgggctcagctacgaggccatccacgacgacggagacaacgagcgagggagtgtcctgctccaggacgccgaacatgacgccgccaggatccaagccagggtccaagacgaccatagcaaggtcaaggccgaggccgatgccgctgctggtgccaacggacgacctaagtgacgacgtgcacacatgccgacgt

SEQ ID NO: 16968 - DNA, 295 bp, Sorghum bicolor
  unsure (1)..(295): unsure at all n locations
  Clone ID: LIB3481-039-P1-K1-H7
cgtacgctcacatcctcacccccttcctatttctctagctccacccctgctcacagcnactgtggctgcgtcatctgagggcgggtcgtcaaccnatgctgagattgcgtccgtggccgcggcagatggcgcggcggcggcactccgctcggttctgtcgcgcgcacaccttcttttgtctctgacgttgctcgctcccacatccgtacgcgtgtcatcagttagcaagactaaaccgatcctccccaacccaaacacatccaactctcttaacatatattcattcaacaacaat

SEQ ID NO: 16969 - DNA, 251 bp, Sorghum bicolor
  Clone ID: LIB3481-040-P1-K1-A10
ttttatttttctatctcccttcccaacaaaaacacagcctgaatttctaatttgacactccctttagcttctcattaatcacggcacttcttgtctttacactcagcataacccttacactttccatctccctaactcccactccctttgctttcttccctttctttctccccctttctccagctttccccctcaatctctaaatcaagatcttcctttatttttcctattaattctttacatcacctcta

SEQ ID NO: 16970 - DNA, 269 bp, Sorghum bicolor
  unsure (1)..(269): unsure at all n locations
  Clone ID: LIB3481-040-P1-K1-A8
cgtacgtttcaatggtgttgatgctgatgtgtttgcccgatttaaggttttgcantcccgtgctgatgatgtaaactgcttcagtgagattnactgtnnngagccccaagaagcaagcaagagaccatatgcagtcgaagatgatgttatggtgagactgaaagttttgaagtctcgtcctgacaatataacctctttgattcaagaaagcaacaaacaccagctagatgcaagtgcaaacagtgcagataatgttgatgatgctgtta

SEQ ID NO: 16971 - DNA, 405 bp, Sorghum bicolor
  unsure (1)..(405): unsure at all n locations
  Clone ID: LIB3481-040-P1-K1-B11
accggnccnnaatncggcgggtcggccgacgcgtacacaaacactaacaggcctgccccccctccccctctcacacntcgtaccaccaccagggtcatgtncaattatcaagccatggaggcccangcnttcccnatactgttcacgcanggcgtgcgagcctactggcgtcgccncaagtaccaccgcctggcgtatttctccttctgcaccaagccccagtcacagtctctgcatcttttctcggccttcttcctctgctgtgcacttatttctcttcttatttctcttacttttttttattatatattttttttttttttttttttttttgggtgggtgtgggttttttatttattattattctttttatatttttttctatttttcttatatttttttttt

SEQ ID NO: 16972 - DNA, 429 bp, Sorghum bicolor
  unsure (1)..(429): unsure at all n locations
  Clone ID: LIB3481-040-P1-K1-B8
ccttattctcacaatatatagatactccaacttcccatcnccccgttcttgtttaatttataaacacacttccccctctctctcttccaaactaacaatttcatcccacaaccacaatagactacttcacaaccttaacaacactaaacctaactttttttcatataaaaactcatcaactactatcccttctttccatttctcctaacttgcaccagttctaactcagacattctgacagcataacttttcttaacataccattcctacancaactcaattacctcgactgttcatatatctccaatcatctccaatcaataccaaccaaagctccaaatctctccactcttaaattcctatgtgacctccgaattcctctctcactttataacacacatccctttaacatattatacacacaccact

SEQ ID NO: 16973 - DNA, 212 bp, Sorghum bicolor
  unsure (1)..(212): unsure at all n locations
  Clone ID: LIB3481-040-P1-K1-C10
gactctccctgtanctgcccattaaagcccgccggtggtggtggtactctcaacgttacctcttccctttgcaaggccctaacccccccttctttccctttcttccctttctttcttcgcaccttccgccgcttttccccgcaaactttaaatatcgggcttcctttaagggtcccatttaagggtttaccggaacttgacccccaaaaact

SEQ ID NO: 16974 - DNA, 363 bp, Sorghum bicolor
  unsure (1)..(363): unsure at all n locations
  Clone ID: LIB3481-040-P1-K1-D2
gcggggagcaggatgtaatcggtcagcggctcgttgtgcaattggccgcgaatcaccaggaagccttcttcgaggcgcgcgctgataccgctcaacggcgcgtcnggctcatgggtgctgagcacctggtaggtgccgatggtgtcagcccacgccactggcaacggcggcggttcgatgcgttcaccgatggcaaggcgctggccgtggctacgggcagtgagcatctggcggccttgcacggtgaccacgtccaactgcacgcggcccagttcgccgaggtccttgagccagaagccgaggacttttttctgcgcgcgcagccagccgtgctcatcgcgcaatagttcaaagtggaacccg

SEQ ID NO: 16975 - DNA, 398 bp, Sorghum bicolor
  Clone ID: LIB3481-040-P1-K1-E11
cgtccgagtagactgtctggaaaactgctgaaggaggctgcaaattatgagataaagaaagagctgggtaagcatggtgggcgggtggctgcagttaacctggagtctagagctggtttgcttgcagctaggcagggtttggctcgtgcagcatcgagatatgttggactcaggagtgtcatgacatttcttggaccaataatgtgggggacgctcttggctgatattgtgattcaaatgctgggcacggattatgctaggatcgtccaggcaatctatgcatttgctcagattcgtctcactcggacaagttacatagaacctgatgaagaatgaccagagtccgatcgttactggactagcctaactggcattctgatctaaaatttattaccacc

SEQ ID NO: 16976 - DNA, 229 bp, Sorghum bicolor
  unsure (1)..(229): unsure at all n locations
  Clone ID: LIB3481-040-P1-K1-E12
cgtccggttcggcaacagcagcacaagaggtacccgagcgagtcgttagaggcttgcgtgcgtgtagttgtgtatgctagtgctacngcgtacggcgcaacagcagcagcggcagccatgagcaccgggcgcgagagcaccaccagcagcaggtggcccgagctggcgaccctgcgggcgctggcgcgcgacgccgcggagcagctgcagctgccgcgcgtcagcatgt

SEQ ID NO: 16977 - DNA, 325 bp, Sorghum bicolor
  Clone ID: LIB3481-040-P1-K1-F2
cgtccgaaaaaaaaaaaaaaaaaaaaaaaaaaaaaaaaaataaaaaaaaaaaaaaaaaaaaacaaccgatgcaggagtgtcaatatcttacatacacctacatccaaacatcataccttttttttactttcacctaaatttaattcacttcccctccttttacaccttctaaccttataaaactcttactttacccaacttaatcaccttccttctcatccccctttccccaaatacccttatatcaaacaaccctaaacccatcccccttcctaacattttcccaaccttaaataaaaatggaacaccccctcctatcttttca

SEQ ID NO: 16978 - DNA, 432 bp, Sorghum bicolor
  unsure (1)..(432): unsure at all n locations
  Clone ID: LIB3481-040-P1-K1-G2
cgtgcggggaaactaaaatcgcagttgcaaggaaattctcgtaccacgagctgtcctcggcgaccaacgacttgtccaaggacaggaagctcggcgcangccanttcggggaggtgtacagaggggagctccttggcccgcatcaagtggcggtgaagaggttgatgaggcagatggaggtgcggacccagaaggactacaagacggagattatgaccttgggccggatcagccaccggaacctcgtgaagctcgtcggctggtgccacgacgacggcgagctgctgctcgtgtacgagctagtgacgaacaggagcctcgacgagcacctncacgggtcagagcggctgctgacatggcctgagaggtacatgatcttgcgcggcatcggctccgccgtcgagtaccttcacagcagcgacgacaacccca

SEQ ID NO: 16979 - DNA, 450 bp, Sorghum bicolor
  Clone ID: LIB3481-040-P1-K1-H10
cgtccgcggacgcgtgggcgcaacctggcagcacagatgaaataagttaaagtttattggtgggaatgaattaaaaggttggagtctcttgatcataactgtgcaaaattgacatggtttctctttgatgatcgacaaaaaatgtgcaaattgattttaatcaagaatactatttcatctatccatgatcaaagctatagaaatttgactgccaagaatctgaaaatcatttttatacattttggatttgaggagtattagtactactccctccttcccgtaatacagtgcattcttgcatttaaaacttcttcttaaatataatgcattctaaaaggataaattccattttgcattaaatactttccatttatcaacccatcaccattaattattttgattaaacctcttcttaaatattattcattctaaaagattaaattccatttt

SEQ ID NO: 16980 - DNA, 393 bp, Sorghum bicolor
  Clone ID: LIB3481-040-P1-K1-H12
cgtccgctttttcaattcaaatacaggcatgtttgtctactcttttcagatcgaaatacaaggagcgcgtcaacccttttacatttatatcttatcattttatacttagattcttatttagagtacttggagaagaggggtctatttagattaggatatgattcttatggaagaaagtgtctacatcaaggatggttgtctctgcctaccgtaagataagatcaaggccaccaccgctaaatatagataatgagatggacaaaacttagaaatcgacaatgatcctgttgcaacgtacgagcacttttgctagtatatatatagaggaccctactatttagcatcctggcttataaaaactgagtaatatttgagcgcaccgtcgtgatacca

SEQ ID NO: 16981 - DNA, 356 bp, Sorghum bicolor
  unsure (1)..(356): unsure at all n locations
  Clone ID: LIB3481-040-P1-K1-H7
cgacccacgcgtgcggcaaacaacaacttttcattntcttcctaatcacattcctcaccacctctaccatnnacaaggtccagatgactctataaaaaagactagccccacaccacctattcancctttatccccagccacaccccttcccttccttctagccaaccatacactggcccaacatacacataaatccacccctataaacacacctcttctaataacccttacccctccttcataactccataaccaccatcatcatgcttatccttattagatatattccttaaaattttttttctctcacaatccaattattctgaaaaatattcaccactacatttttcataaac

SEQ ID NO: 16982 - DNA, 282 bp, Sorghum bicolor
  Clone ID: LIB3481-040-P1-K1-H9
cgtccgctgtatcggttatgttggcaccagatttgccgttatgtgctattggtgatgaaaggagactgatgcaaactattctgaacatatctggcaacgctgtaaagtttaccaaggagggacacatcacgcttgtagcttccattgtgaaggctgactctctgagagagttcagaaccccagaatttcatccaactgcaagtgatgaccatttctatttgaaagttcaggtaaaagatacaggctgtggaattagtcctcaggatctacctcatgtattta

SEQ ID NO: 16983 - DNA, 193 bp, Sorghum bicolor
  Clone ID: LIB3481-045-Q6-K1-A3
aaacgggaccccccctgttctgtggccttaaatcgcggcagttgagtgggttacgctcaacaagaccgttacagtgacaacccccctagcgcccaattttttcgctttgttccttttctttcttgccacgtttgccgtttttccccataaacctttaaatagggggctcccttaagggttcccatttagtgtt

SEQ ID NO: 16984 - DNA, 190 bp, Sorghum bicolor
  Clone ID: LIB3481-045-Q6-K1-A4
gcgtgggcgacctggagcggaacgcctccatcccgacgcccccacatcgcgtggccggcaccggcgggagccgagacgggagctccggcctgtgcgctccatcagaatcacaggggcacggacgaggcctgcacaggtccggcgccgatggcgccagcaagaggagaggaaagcagcaccgaacgacacc

SEQ ID NO: 16985 - DNA, 393 bp, Sorghum bicolor
  unsure (1)..(393): unsure at all n locations
  Clone ID: LIB3481-045-Q6-K1-A8
cccgggncgaaccagcgtttcgttggacagnngttagcaaggcacggggggagggggggggctggaaagacagaaggacaggacagcgggcagcagggggaaagtgacagacaagacgaaacgcagcactgagagggacacgcgcctaatcaacaaaagaccaacagacaagcagacgaccaaccacagagggacgagacggaggagcaagcatgcagcagaggaacagagaagcacaacatgcaagcaggacggcaagctaggcaggaccaaaccgggacaccagacagacatgacgggcaccaaccacaggggccagaggcaagaagaacaaccacaccacggcacaaaaaacgaaaagcaagaagaggaccagaacaacggaagaacacc

SEQ ID NO: 16986 - DNA, 345 bp, Sorghum bicolor
  Clone ID: LIB3481-045-Q6-K1-A9
aggagggtatccccccagaccagcagcgtctgatcttcgctggcaagcagctggaggatggtcgcacccttgcagactacattctttcttaatgagagcaccccccacctggttgtggggggggttttttttttaaagccatcagtcgttgaagctgatgccgcacatgggttgtttagtgcctctcgttccggccatgtccagtctttgaagtatctgtctggtccgacattgaagcattggtcagtctcaagtctttgtgtggaagcattcgtatggactgtgccgtgtctgagttactttcatggaccggttgcgttcctctgtgctttacccaaaactata

SEQ ID NO: 16987 - DNA, 189 bp, Sorghum bicolor
  Clone ID: LIB3481-045-Q6-K1-B1
cgtccgtggttacgcggaagagaacagagctgccgagggcttaacagctcacatactgattccaccaactgtgctgccagtctatagctagtgctgggaagtactcagcaccctatcatatgatgagatggctccccctttgtgatctggtggcagaggtatccttgcagcacccctaggcattcgcgt

SEQ ID NO: 16988 - DNA, 595 bp, Sorghum bicolor
  Clone ID: LIB3481-045-Q6-K1-B2
cgtttgttggaactcagaataccttataacgatgtggtcgcttgaatgctagtcaagacgaagaccttcactgaatgctcaattatttagtacctaggaacgccaatagttaaagactggttgctcccctcgcaagggagtttaccaaagcttacagagctgcaccatgttacacataatcagatcggtgaaaaaacctagtccgcggatactgattagttggtcgacttaatggggatactgcggctcaagaacctctttaaactgggaagcgaaccaatctgcactgaataaatgagttgggggtgctgagattgcatgctcagacacacaccaaaggtagcaaactggactttacacaaccttatataaccatgacatactgtggtctaagaaacaaggacacaggctactgcatctcaacactactatgagatcactgacaattgcatctgtgtggaaagttgcagcattcgacaaaaaccatatatccatgaggagtgaagcttctatgaagcatagacagctaataacataggtcgtgaaacattttcatgtatatcctgacacaatgactatcatgtttagaatgcaa

SEQ ID NO: 16989 - DNA, 215 bp, Sorghum bicolor
  Clone ID: LIB3481-045-Q6-K1-B4
ctttgttacactcccgctggaccatgctgggcgcgcgcggatgcgtcttccccgagctgcttgcccgcacggcatcaagttcggctaggccgtctggttcaaggccggctccaagatcttgagcgagggcggactggactacctgagcaaccccaaactgatccacacacaaagcatactgtgccatctgggaacaaacaggacatgctaatggg

SEQ ID NO: 16990 - DNA, 338 bp, Sorghum bicolor
  unsure (1)..(338): unsure at all n locations
  Clone ID: LIB3481-045-Q6-K1-B6
gggggggggggaaaacaaannngaagaaagagacgccggggagncgcacccagcaaaacccngggcacgggaccaaaggaaaggaagcccagaaaggaggagggggcctaatcacaggagggggcgacaccaggcggggggggggggggggcagtgacaaagccaaacgaaaggcaccagccggggcgggggagggccaancangcgcancnggcgcngngaagaaggggaaagggaaccagcnccccagccgcaaagggaagcagggcaaaaccgggggaancggggcacgggcncggaaagcnaagcgacccgccgcggccgcncgaaaggcgaag

SEQ ID NO: 16991 - DNA, 203 bp, Sorghum bicolor
  unsure (1)..(203): unsure at all n locations
  Clone ID: LIB3481-045-Q6-K1-B8
ccggcagggagaaaggaagccgcgcgcacccacggccgccggggagcacgcaagcacccacgccgcccgcanccacagcgacgagggcaccgccagcaccgccgagaagacgccacgagcgcgaaggcggccaacancaaggggggggggccacnggccggcgcacggcgccaagctccttgagaagcgcaacgaacgaggac

SEQ ID NO: 16992 - DNA, 344 bp, Sorghum bicolor
  Clone ID: LIB3481-045-Q6-K1-B9
cgggggggggggagtggttgaacacaagtgcaggcagaggcaccagtccatcccgtagcccttcagaccaattttaccaaggcccagacaccatacccctgcgagggagcccatgatttttttttttaaaactaaccgcgacctttttttatggggggcggtttttttttttacgacgaaaacttgtcttaatgccgcccgaaacggggagttgtgtgaccaagcgactctacaggcggctggtgacacggtcgtgccaaagcctccgggtccacatcatcccaagcggctagggacactaagatccacccctggggccacaggctgaccaatggggcaccacc

SEQ ID NO: 16993 - DNA, 577 bp, Sorghum bicolor
  unsure (1)..(577): unsure at all n locations
  Clone ID: LIB3481-045-Q6-K1-C9
cggtaccggaactctcccgggtcgnnacccacgcgttctttaaaaaaaaaaaaaaaaaaaaaaaaaggggggggggggagaaaaaaaaaaaaaaaaaaaaaaaaaaaaaaaaaaaaaaaaaaaaaaaaaaaaaaaaaaaacacaaaaaatgggggcggccccttttggtggggtcccccttttgtgggccccgatttttctttttttttgttcctcctatttatagtgccctcttagtggggggggcccttcccttgtttttcaccacccgcgtgttttgggcaaaccccgggggtttccccacttgattncccctccctgaaccccccttttttcccactgggcgtccccccgaagggccccttgccaatggcccttccccattttttccccccctgagggcggagggggccccccctttgcgccggcctttttggccggcgctttagggcctacccccctgtttttccgcctcttttgccccgcccctagggccggttccttgggtttgcttcctttcgttggcccccccccccgcgggctttcccgggggggttttccttgggggccccctttt

SEQ ID NO: 16994 - DNA, 237 bp, Sorghum bicolor
  Clone ID: LIB3481-045-Q6-K1-D8
caaaacccgggggggggggcggacccaaaacaagaaggctcgggcacccatagccacggcgaccaccacctgcacccccgcaccgcggagcagcgaagaccaaggtgacgcaagcaggagcacgaaagaaaacagccgaacagagggccacccgcgcgagggggggggggaaagagggtagccagctacacaagcaggaggacacaagaacggtggagacaggccggccgcgcacgg

SEQ ID NO: 16995 - DNA, 585 bp, Sorghum bicolor
  unsure (1)..(585): unsure at all n locations
  Clone ID: LIB3481-045-Q6-K1-D9
ctccacctcgctagcgagnaacctgtggaggcactatctgacctagaagaaggagagagaaagcctaccacaattcaagaatctataaagagagaacaaaacgatggcatgataagagaatcaagcacaaggagtttaagcctggagataaggttctactattcaattcaagagttaagctctttgggcatggtaagctatgaagtaagttggatggaccatacaaggttattgacacttcaactcatggagccattaccatccaagacgacataggtaacacttttaaggtaaatggtcaacgcttgaaaatctagctcgagccacaaaacaacctagtagaggaacttgatgtgattgagttcatagaattctcacattaagctctcataagctctagacaattacctaacccttaacatgctccacgagttttgttgtctatttgggttgtgcaggattttgaggcttaagaagagtgagaccgaacatgcaggccacaagagtgaacgactatgtcaacatccagcttgggggaggcacccccacgtgtatctagataagtattacttttctttcttggtt

SEQ ID NO: 16996 - DNA, 566 bp, Sorghum bicolor
  unsure (1)..(566): unsure at all n locations
  Clone ID: LIB3481-045-Q6-K1-E2
cgnnctgttttagcagtgtagtgaaaaccgggtggacgcacgacaccattcgtgtagcgctctggggctggcgctcaccaagggctacagggaggaacagacccacggcgctcatcggcgacgggctactcaacgcggcctcggcggggctgctccactacatggcgctcgaggagctcttttttgtcgacttcatggggcccaagctgcagggaagcgtcaggctccagctcctctccttcctcgccgncctcctcggcgccggcggcatgtccatcatggccaagtgggcgtagatgactgcgcgtgagctgaggctactgtgtgtctactgttacaccaacaccgtcgccgtatgtatctgcatcgctgttgtatcattacacgcgccctttgttggttgctccgtgcttctgtctcatcgtcaatcatcagactctaataagctaggtagaagaagcagattagtgttgttgtatgtcatgattgtgcaacgtccacggtagactatccgtcggtagtcggcattaccatgtgcaatgcaagtagtactctatgtaacacat

SEQ ID NO: 16997 - DNA, 580 bp, Sorghum bicolor
  Clone ID: LIB3481-045-Q6-K1-E3
cgtcctgatatgtaaaaatatgttaaaacacacagcgagagaaggaactatcataaaaaattgaagccctaaagaactaatgacgggggccggtccaaagtagatccctgctttgctatgcgggcccgcgatcaaaaacatgctcattatctggcgacactaatgtgaggaagggtgctacacattataatctaccagagctagaaaacccgagcttgacccaaaaaattagtgttatggaaaaccccgcctttgccactagatttggaagctatgaggcctgggcacaaaacgttctttaaattggccacataccaaccgaaaaacggggcgtggcccaagttaacagcgacaatggcgccacgaaacctaccaaaaggaagcgcggacctgcaacctaaaccatgttgagaacacccgatcatatggctcacggataccactataccagcgccagtgccgtttgtccttcttatgtgctattctgaggcactcgtagaggttacctgactatgacaaaagagctcctgctccacaaaaaagtatttagggggtggtgaaacgtcatggccctttctcc

SEQ ID NO: 16998 - DNA, 238 bp, Sorghum bicolor
  Clone ID: LIB3481-045-Q6-K1-E4
aggctactaacaagaagctatgcgtagctcggcgctcttgagggagaggctgttgacccacattataccagggatgtgcattagtgacagctattcgtttttggcgaggttcaagccctggtagacactgattactgatggcacattgcatgcagtaggggaagcgcatgcatgtaaccatctgagaccgacacgatcactcaggatcgtgtgaccctaacacggcacgttctcgaag

SEQ ID NO: 16999 - DNA, 321 bp, Sorghum bicolor
  Clone ID: LIB3481-045-Q6-K1-E5
cgacaaagaggggcccacaaactaggcccaacactaaggttaacatgagaggggacattggtggagagcatggaggagaggctttattagccaatgtcggccccaatgttttttttttgttgcgcttctagttttcctatcgcggggcttattgctactcaagctcttgttcaggggttttgctgatggcccttcatgcgcctccggatgatcaaccgcttgatcgacatctggtggctcataatgtggttactgagccatgatctgagaagataactgggaacatagctcataaaagctgcaataacaactattatagca

SEQ ID NO: 17000 - DNA, 220 bp, Sorghum bicolor
  Clone ID: LIB3481-045-Q6-K1-F4
tcctctgcgccgccgccaccgggggcgagccgtggcaccgcgaggggcctaacttgaccaacttggtgggggcgcagtgtcggccgtctttgtttttttttgacgcggaccccgcgtgcttttttttgggggggtgttttttgggcacgacactggactcttcctaactgagtgtgaccatgggggctcaactctacgtgctatgtcacgcctagtgcgc

SEQ ID NO: 17001 - DNA, 404 bp, Sorghum bicolor
  unsure (1)..(404): unsure at all n locations
  Clone ID: LIB3481-045-Q6-K1-G10
gcgtccggtgaanagttggccttatcttatcactacattgcacaaaagaggagaggaccaagaagtaggaccatcaatcatttgtacaatcatggttcataactcctaactgaacagttactgccattttctgggtatcagcttcacgtgctaactggtcaggtaaaggataactgaaattgtcggtttgacagtggcttttattgggtgggttttcagaactggaattggtcagtgactcagtcacctttcattttaggtgcccgattcaaacgaacaattcagatttaaacctgtagcttaactgggaatttattttttccaaatttggggccgaaactttgaaccaagctttgaccccccttaaatctttaattcattaactgaaacaaaaaatggggggg

SEQ ID NO: 17002 - DNA, 495 bp, Sorghum bicolor
  unsure (1)..(495): unsure at all n locations
  Clone ID: LIB3481-045-Q6-K1-G3
cggggggaaggagaccaacaaaagaaaaaagaagcccaaaagcaaacagccaggggcgggcccaaaggaacgaccccagcaaagggccgcgcgcccgcgaccaaaaccangcnacaaccgggcgacaccaaagnaaaggaagggcccacacagnacaagcgccagagcgagaaaacccggagcgngaccccaaaacacagcgggaggggagacgccgccnccgccaccaggagnggaagcgaagcgggccgggcacaaaacgcnccccacaagggccagcgaccaacccaaaaacgggacgcggcccaagngaacagcgacaagggcgccacaaaaccgaccaaaaggaagcgcggggcgcacccgaaaccaggccgagaagaccgancananggcgcacggacaccacnacaccagcgagagcgggggngccacccgccaagcgccaaacggaggcagcacagagagggcacaggaccaggacaaaacgagccc

SEQ ID NO: 17003 - DNA, 327 bp, Sorghum bicolor
  Clone ID: LIB3481-045-Q6-K1-G6
agctctggtggcgccgccggccagggcgcagggcctgccgtccctcggccgccgcgccttctccttcgccgtcgtctgcggcaccggcaagaagatcaagaccttttttctcttcgggattggaggtggcctgtccgggggggaggttttttttttgaggaaggtcaagggcaagggcgtgtaccagttcgtcgtctagtaccgcgctaacgtggacggatacagcccaatgtacaacgagaatgagtgggctcccaacggcagcgtgctcgtgagtggaacgactggactactgaatctgagccaagaccctaactggactcctcg

SEQ ID NO: 17004 - DNA, 319 bp, Sorghum bicolor
  unsure (1)..(319): unsure at all n locations
  Clone ID: LIB3481-045-Q6-K1-H2
ggggggggggttttgttagtagaaaattctactttcggaagctttcagagttatttgcatgagctccaaatgttttaatttggtttctcctagctcaaggtgtctatagaatgttttttgttttttttagtcccgaagataccctctttgtgtgggagaaactttttttttttcnacggacntgnttttggcctaaagggggttgatgtgtttttaaaccacttttaactgctgcggggggcaacccgggcggttctccgggttggtggttgtgaggtttcagactgagccgcggtggtgggtgggcaaatggtcttta

SEQ ID NO: 17005 - DNA, 305 bp, Sorghum bicolor
  unsure (1)..(305): unsure at all n locations
  Clone ID: LIB3481-046-Q6-K1-A3
ncgttcttaaaaaagaaaataaaaaaaaggggggggaaaaaaaaaaaaaaaaaaaaagaaaaaaaaaaaaaagggggggccgctatgctgatccaatctgacgtacgcatgcctgcgaagcaatagcagtcgaatgcattcgcctatactatatctgaggcccgagcgaaacaactggttgggtggggaaaacctacttttacccatatttataccccttgattatattccgccttcgctcagaggggataaaaggaggggggccgttctagagggccctaccaaactaaggcgcgctctggaag

SEQ ID NO: 17006 - DNA, 603 bp, Sorghum bicolor
  unsure (1)..(603): unsure at all n locations
  Clone ID: LIB3481-046-Q6-K1-A6
gcgnctgagagcatatagttttgttttttcttttcttttgtttaatacttcctctgttcagaaatggtaaccgtcgaaaagataaaatttataattattgaccaacagttaattaagctatataaaagtttaattagatcataaaacttgtatcaatatattttgtgttttttaacctgttaactttgtatactataaaattaatagtcaaaatctattctgtacgactttgtctccggactaataacatgattaccattttttaacagagggagtatagtcctattaacatatgtatttattattattacagtggattttgcataactggaatgatgaagattgtgtgcgcatcttgaaacggtgcaaagaagttgtttctacccgcgaaccaaagggaaaggtggtaatcatagaggttgtagtggggtcccaatccaagcaaatgttggaagctcaatttgtttcggatctatgtatgatgttgctaacaacaggtgaagagcgagacagggacaagtggcaaaggattttccaagacgcaggcttcactcaatacaagattagtcctgtcctaggatttcgatcactcattgagctcta

SEQ ID NO: 17007 - DNA, 256 bp, Sorghum bicolor
  Clone ID: LIB3481-046-Q6-K1-A9
tacgtacgcgttgcatagcgacgtgggtgggggggggctgatagtgtcacacttaaattcaatttcgactggcgcgtccgtgtttacagacgttcgtcgacttgggaaaaaccgctcgcgttcacccaactttaatcgcctgtgcagcacatgccccctttacgccagtctggctgtaataggcgaacagggcccgccaccgatgcggggttgcccaacagttgtcgtcagcctggaatggctgaatgaggacgca

SEQ ID NO: 17008 - DNA, 208 bp, Sorghum bicolor
  Clone ID: LIB3481-046-Q6-K1-B2
ggcatgcatgatctttgtagaagacatctgactggcaagtaccatcacctatggtaggatgagcagcctctgacaccattgtataattgtcaaggtccaagcaggcaggtacaagggagggtcatctcccctcattaccagcagccggcatgatctttcgcatggctaaacagcatggtaggtatgtgctcgtaccctgcgtctgact

SEQ ID NO: 17009 - DNA, 609 bp, Sorghum bicolor
  Clone ID: LIB3481-046-Q6-K1-B3
tcattctgtttgtagtacatgtttaaataacaacagtgttgtatatttttaggagcatccaatcacataccaataagtaggatgaagatagacttatcatgcttttacactaaatggaaacctgacacactggtaacgaccatggggaactttcatacaagagtggcctacagtctcagaccatcatcggactgcggaattcccttccttaacgtaagttattttgtgaccgacaataatgtctacctcattatttttgtgatatgcacaggcgctcgctttacatgaagaaaatcaacgatctgtcatgtgcatgttaaactctttgtcttattagaacataccttcaagcgtgcgcttgcttagctacaagatttacatgcctaggctcaccaaacaatgcaaatactaactccctctatccttcacaaaatccttttgtggtactatgcgcgaggttttctcaaatcatctgaactaaacatgggaaacttagctttggcaccttacggaagagcatacaaggcgcagattgaagttgccctatgcagggttgtgcttgagtgatactcactgattttatgtgcttgtaaccattgactgttaaaa

SEQ ID NO: 17010 - DNA, 232 bp, Sorghum bicolor
  Clone ID: LIB3481-046-Q6-K1-B6
gggggggggccggccgttttaccaacgctgggcacacagccggagctggcaggcagcatgtgcgtgctctgcgtagtgagcgcgtccgcgcgctggaccgggggcgctcctgtgttttttacccaaaactctggtgcgacctctttgggtggggggaaatattttttacgccggaacttttaaatgtgtgctgaatattgattattgctatgtcagtcaattttactaaaac

SEQ ID NO: 17011 - DNA, 443 bp, Sorghum bicolor
  unsure (1)..(443): unsure at all n locations
  Clone ID: LIB3481-046-Q6-K1-C1
gtaataaaataagaaatacatggtgtgtggtgttgcgtcggaagttgtaactaggcactcattagcttctggcccttgtttatgtggtagctgatgaatgccctccaggtgttgtgttgttcatgctcttcaaatatcagctgagatggttccacctgttgttgagagatgcattgcacattaactttgtttatctgtgggatagctgaactcttctccctccccttgttcgtggaaaatttcgtctgggagaaagtgggtaaatggtttgacaatttggtgggaggaaacacagtgcgtcatagttttgggtggtcgcttatctgtaatatcctcctgcttagcggagtgggggtagttctaagtgttttctttctttaagtgactgtgtgcctgtnttttctatcgtatggtgtcactgtgtgattgtgttgtgttgatct

SEQ ID NO: 17012 - DNA, 609 bp, Sorghum bicolor
  unsure (1)..(609): unsure at all n locations
  Clone ID: LIB3481-046-Q6-K1-C10
cgtctctcccacgccgtccgntgnacaccactttttgccactgacgaatgcctnnttgtagtaagccgattatggncagcactttatnnccccatttgagatcttcatnncatcagttatggggttttaaanctttatgtggttgaaattctttcttatttggcgctacttccggttttggtcactggttggaggagtcgagacacctgaaaacatgcctaggtgcataaataactgtcacgatctggagagtttctggaaaagctggcatgcttcttttaacagatggttggttaggtacttgtacattcctcttggtggttctcgaagaaagctactgagtatctgggtgatattcacgtttgtagcagtgtggcatgatttggaatggaaacttgtttcgtgggcgtggttaacttgcttattttttgttccggagatattggtcaaatctctatccaacaaatttcaggcaagtagttcccttgggatccttgttcatcgtgaatttaaagcaattgctggtgctgtgacaatcagctgtcttatggtggcaaaccttgtcggttatgttgtgggaccatctgggattaaagttctgctcttcaa

SEQ ID NO: 17013 - DNA, 595 bp, Sorghum bicolor
  unsure (1)..(595): unsure at all n locations
  Clone ID: LIB3481-046-Q6-K1-C12
gtcgacccacgcgtttggtcacgacccttcccaaccggggggggggggtggggggcntaaaaaaaatccattccttcaacctncaaccntcctcctactatatcttcctntgccttcccactcctntcacctgctnatctatgatgtgttctctgcatttttccgttctttgagcgttctctgcaagtggggggggggggggggtcctcttcaatngcanctaggtcttatgacactaggaggtaattaggcaaaaattctcatatccatgctgttggtagcctggtgctgtccacatccatgtcttggattttgcacaaagaatgcctaaatttttggtccttgtatctgatgtgaaaatggaatcattgctttgtcaagatggagtccactggcctatcagttatttccaccagaggatgtccatgccgcaaaaggccctggttcctcaactaaaagtttccagttgaagttggtcgataaaatgcatgacaacacaagaagggatgttaagtgcggcggatattttgggagcagcaggcttgcagtgtatgttatcaaccgcagttctaccattttgaaactagcagaacct

SEQ ID NO: 17014 - DNA, 314 bp, Sorghum bicolor
  Clone ID: LIB3481-046-Q6-K1-C2
cgtcctgttgaaaaaatatataaaaaaacaaagggagtaggaaaaaaaaaaaaaaaaaaaagaaagaagcaaaaaaagaaaaaaaacaacaaacaaaaaaaaagcagggtggtgcgttttagagggcccagcttaaggtccgcgggggaggccagggtttttttcttttccggcggggattattttgttgtggcgggcggtatttgtcgagcggcgcgtagggtaaaggccgggggtggccgaactgaatggccttggagcaaacccccttgcgaacggttggccaaatgggaagggggttgggacgcgtcgtg

SEQ ID NO: 17015 - DNA, 297 bp, Sorghum bicolor
  unsure (1)..(297): unsure at all n locations
  Clone ID: LIB3481-046-Q6-K1-C4
aggccattgtagtgagggcttggtgctcgaaaacacgctgtgcgttgtccaacttttagacacattgtgtgtgggctcacttctacaagcacttgaagatgtgcacggttgtgtttgatgcagattgctatatctggtggaggttgcncgcatgataagtcaaaccctacgatattcttgaaggcttgtgagctgttgggatgtgaaacctgaggaagctgtgcctattggtgatgactgtaagaacgacttatgtggagcaaggtgagcatgatgtaatgcctggcttaggggtac

SEQ ID NO: 17016 - DNA, 599 bp, Sorghum bicolor
  Clone ID: LIB3481-046-Q6-K1-D10
gcgtcctagaaaccctacgatttggatccacaaaggtgggagggagttacgcatgtgatatgttgtacctggaactacagcatttccatctaaacgctgggatggagataatactccagaacgtgtagattgggatggcatcagaaatcttgtaagtgccttgccacagacaatcaagagactggggcttgtgtcatctgttggtgttacaaaatacaatgagataccatggagcatcatgaatctctttggtgtgctcaagtacaagaagatgggagaagactttgtccgcatttcagggataccattcaccattatcaggcctggaagattgacagatgggccctacacttcgtatgatcttaatacacttcttaaagctacagctggagagcgtcgagcagtagtcataggcaaaggtgacaagcttgtgggggaagttagcagacttgtggtggcagaagcttgtatccaagctttagatattgaatccactgaaggacaaatatatgagattaattcagtgaagggtgaaggaccagggactgacccagagaaatgggaggagctattcagatctgttcaatgagactagtgtc

SEQ ID NO: 17017 - DNA, 137 bp, Sorghum bicolor
  Clone ID: LIB3481-046-Q6-K1-D7
tacaacactttcgcggggaggcagcggaccgaggaaattcatggaagtactcatgaccttgaacaaggtgtctgtaacaatgtaggctgactcagacctggaacaaggtcaggaaatagtaaagtaatactaagaac

SEQ ID NO: 17018 - DNA, 462 bp, Sorghum bicolor
  unsure (1)..(462): unsure at all n locations
  Clone ID: LIB3481-046-Q6-K1-E12
aaaaaaaaaaaaaaaaaaaaaccgggggaaagaaaaggggggaaaaaaaaaaaaaaaaaaaatcaaaaaaaacaaacaacaaacatacaaaaaaaataacatattttttaaccaaaacactaattccatgtcccttcccctcaaaaacaacttctttttctcctttttaaaccctaacccaaaccggggggggggggggggagttttttttttccccccanccccccctttctttccctagaggaagaggacccgccccgcctcncccatacccaacagttgcctcaaccgtgaatgggaaatgcccacccgccctgtccctttcccatctaagcgcgcccggtgcttgcgcctctctcgcaacctgtaccgcctcccttgtgcacacccctacccccccctgctttccctcttttcccttcctttctggccaggttccccgcctttcccccttaaacttta

SEQ ID NO: 17019 - DNA, 257 bp, Sorghum bicolor
  Clone ID: LIB3481-046-Q6-K1-E3
cgttctgattgaatagttttttaaaaaaaaagtacgtgagaacatcttaactaaaaaagaaaaatgcatatagaaaaaaagggggggctaccttgctgaccccaaagaagcgtacccttgcttccaagaacattaccttggtattgcgtcaccttattctatttcagtggcccgcgataaacaactgcttgccggggaaaaccctgcttttacccatctatatctctttggagcatatccccttcccgctcgatgga

SEQ ID NO: 17020 - DNA, 280 bp, Sorghum bicolor
  Clone ID: LIB3481-046-Q6-K1-E6
tcggctcatgttccagtactttggaagtatcgtgtatggttccgtctattgtaagcgttaggtcagctcttgaagtatcttgtatgggaagcatcttgtatggtactgtgtccgtgtactagagttcgtattcatggcaccgggtttgtgttccttctgtgcttctactccaaaactatagtcgcggcagacatatggtcttaatgtctaaataaatgtgatgttgccaatttaaaatatgtgttgaatattgttttttgctatgtcagttaattttact

SEQ ID NO: 17021 - DNA, 471 bp, Sorghum bicolor
  unsure (1)..(471): unsure at all n locations
  Clone ID: LIB3481-046-Q6-K1-E8
gcaccccccggaccagcagcgggggatcttcgctggcaagcagctggnggatggccgcacccttgctgactacaacatcctgaagagnccacccttcacctggtgctccgcctgcgtggnggcatgcagatctttgtcaagaccctcaccggcaagaccatcaccctggagggggagtcctctgacaccattgacaacgtgaaggccaagatccaggacaaggagggcatccccccggatcagcagcgtctgatctttgctggcaagcagctggaggatggccgcacccttgctgactacaacatccagaaggagtccacccttcacctggtgctgcgtcttcgtggtggtatgcagacctgcgtcaagaccctcaccggcaagaccatcaccctggaggtggagacctctgacaccattgacaacgtgaaggcaaagatccacgacaaggagggcattacccccgaacca

SEQ ID NO: 17022 - DNA, 503 bp, Sorghum bicolor
  Clone ID: LIB3481-046-Q6-K1-F10
aaaaaaaaaaaaaaaaaaaaaaagggcggcggggtcgtacaggtttccaagcttccaaacttccttcctgcgtacttcctacctcttctatagttgtcacctgaaaccatttttttgtttctttgtccgacaacgtaacaatttggtgggggggggggggttttttttctcaaacctttttcgtcttatccccctttcccctgttgcttttttgccgaaaaggcccggagccctcgcccttcccactttctaccatcctgaatgctgaatgggacacgccctgcaccgtgtcattaacccctaagcgcggggggtttacgcgcaacgcgcccggtacactttccagtgccctagcccctggtccttgcgcttttttccttttctttttcgccacgtgcgccggttttcccctttcccctttaaattgtaggctcccttttcggttccgggttactgtttaagggtttctggaccccaaaaccttaaaaaggggtatgggtcac

SEQ ID NO: 17023 - DNA, 592 bp, Sorghum bicolor
  unsure (1)..(592): unsure at all n locations
  Clone ID: LIB3481-046-Q6-K1-F11
cgttctggtanaaagggctgcgcacatccactggcggatggccgngacactgccgcacttacctcaccagggtggctgggtgccggttaaggaacccgaggtggctgaaggacacaccggcagatgctggagctgatgatgaggagttcctggaggattccatggacgctcaggacctggcactccgtctgtccatcgatggtgagaagagctccctgaacactaacgacccactgtcgtcggacccgcaggatcaggtgcagaagatcatgaacaagatcaagcagtcatcagcgcttccgccgtcgatgtcctcgggcggtgacggtgccaagaatgcagccgaggccacaggcggcaccatgaacaagtacccactcctgcgccggcgccggcgcctgttcgtcatagctgtggactgctacgaagacgatggccgtgctagcaagaagatgctgcaggtgatccaagaagttttcagagcagtccggtcggactcccagatgtccaagatctcagggttcgcgctgtcaactgcgatgccgttgtccgagacactccagcttctgaagctcggcaagatcccagcgac

SEQ ID NO: 17024 - DNA, 600 bp, Sorghum bicolor
  unsure (1)..(600): unsure at all n locations
  Clone ID: LIB3481-046-Q6-K1-F12
ttcacacaagaaaccgggnagctggnagggtgatcccactcccgcnntgggccatgcctcnnggcgcgctcggcntnngcgtgttcctcgggagcttgctncnngcccgcaacggacgtcatagttttgtgcgtggcnctttntggnttcaacggcnnnnttgtggggggggggggggggannnncnnnnctgnnnactacctgnngcaactccgaggcctgagggcgaggcgcagcacgcactcctcgccatactagggccatagccaggtcgtggctcatgnnggcgcgcgtcgagggggtacccgtcatcgcccggcggccctactcggcgagggctcgtcgacccgcttctaccccggcggcagcgttcgacccactcggncctcgccgacgaccccgaggccttcgccgagctcaaggtgaaggagctcaagaacggccgccttgccatgttctccatgttcggattcttcgtccaggccatcgtcaccggcaagggcccgctcgagaacctcgccgaccacctcgccgaccccgtcaacaacaacgcctgggcctacgccaccaacttcgtgcccggccagtgaggaggtgtcc

SEQ ID NO: 17025 - DNA, 118 bp, Sorghum bicolor
  Clone ID: LIB3481-046-Q6-K1-F2
ctctggcagcattttccgcgggtaggctgggagaactgccaaatcgagtaagatttagcgaacaacaggtttcacacaaccacgcaccttatactgttccctatgaccgtgcctcccc

SEQ ID NO: 17026 - DNA, 523 bp, Sorghum bicolor
  unsure (1)..(523): unsure at all n locations
  Clone ID: LIB3481-046-Q6-K1-G12
tctctatctctctccccgcgcgccatggccgcctctggggaccacgtcggcggcgacccgccggagtcgacgcagctgcgcctgggcgacgacatcgcgtggtctttttttatcggcgtgtacgaccgcgacgggggggggggggggaactcctaccccaagnccgtcgtcaagaaccacccgggagacgtctccggcgggtcctcgcagcggttctcgggcaacctgaagccgacggcggcgcccatcatcgggctgtcgaggaagctgggcgggtccgtgcggcggcaccagcacccgccggccatgttccccaagaaagccaagaccggcggcggcgggcgcgcgcccaaggctgccgtgcccgagcccgggtcccccaaggtgtcctgcatcggcaaggtgctctcggaccgcgagcgcgcgcgcctcggccaccgcccgccgcgcggcggcgcgagggcccccgggtgctggggcgggctcggcctcctcatgcgccgcagccggtccaggcacagcg

SEQ ID NO: 17027 - DNA, 449 bp, Sorghum bicolor
  unsure (1)..(449): unsure at all n locations
  Clone ID: LIB3481-046-Q6-K1-G3
aaaaatttttaaaaaaaaacggcgggggggggggggcngaaaaaggggaaaagcaaaaagagaagaaggggggagaaccaagcggccgggagaagcgnacgggggcacggaagagcaagggcaggggaaggcggccgccaaaacaaaagcaggggaccggagagaaacaacggggggggggggaagacccggcggtaacccaacgaaacagccttggagcacaggccggacccgcccgaaggaaaaaaaaaaaggggggccgcacgagaggacccaagcaaacgggcgcgagcctgcaaggccaaggggccgcgccggggcacgcgaaatcaagccagggggcggcgggggacaccggcgggacggggaaaacccgggcgagagccaaagcaaccgccccgcaggacagcccccgtgcgccaccgggcgcgagagcggaagaggcccgg

SEQ ID NO: 17028 - DNA, 460 bp, Sorghum bicolor
  unsure (1)..(460): unsure at all n locations
  Clone ID: LIB3481-046-Q6-K1-H12
tccggtagcaatctccatggggggggggggtgggtgcactgaataggtagagaaagaaggcctggaatgtcgaccaagttctgagagtgggaaggacatgtgctagtagaagtcaaaatgtgcaatcttgctataatggcagtgctcttcatgttttattctcttaccaaataggcgctagtatatgtggggtggggtgggagattntttgttgacaacagctcgcttcttcaatggatcttgtggggagcataacatatctgcatgaagggtaaggaatcgaccttcctttttggngagggaacgcgccatggcctataaattggtattcccgtttcctaccttttttggtgggattaaacttgccatgggaatctgttcactgtaagaatcaattcaaaccccagaatgggacttccctgaaaaaaaaaaaaaaacatgggtcctaaattcgcgagcg

SEQ ID NO: 17029 - DNA, 241 bp, Sorghum bicolor
  Clone ID: LIB3481-046-Q6-K1-H6
ggcctggatcggcccgtagaacacttccaggttcttcagttctaggataggttgactcataccaggtcctcttcatcggcgctccttttttttttttaatcactacaccggtcgtttttgttgggtgccggttttttttcggcaaccacgttgccgtggtccagtacctttatgtggtctttaaatactcatgaccatgcccatgtagagctcgatcaataccacggacaggtcatgctca

SEQ ID NO: 17030 - DNA, 489 bp, Sorghum bicolor
  unsure (1)..(489): unsure at all n locations
  Clone ID: LIB3481-047-Q6-K1-A11
ccgggtcgnacccacgccgtttttgtcaatattgaaactgtacttatccagtggggatggctgggtggttttttatgctgcatttcgtagttgcccggaactattgtggtnnatggatcagcaacnntaccccaatcgaattatttttgggcctacnntcgttannncagtgggatcagggnatacttttcatgctaagaaatatantcgaagagttagtcgagtggggggggggcgagaaattncttatgtttatcaagaaagctnntggtctttaaaattcccggagaaaattagcnnccttttatgattatttattgnngtaataatccaagcaaaggggggggattattcanngagcaggctcaatnggacaanntggggatggcanntagctgttggatgggttaggaacatccggtctttangaagataaagaaggacgtcgagctttttgtaccgtcgtatgccctacnncattataatagt

SEQ ID NO: 17031 - DNA, 397 bp, Sorghum bicolor
  unsure (1)..(397): unsure at all n locations
  Clone ID: LIB3481-047-Q6-K1-A12
ccggngtcgacccacgcgtctctctgcanagcacaacagcggaaagtcgggggggggggggggcactcattcttggtattttataggtcagcacttaccggcaagcgctcgattccatctttgagagcttctcggaccaaaatacctggttttcttgatgctgtgaaacagaattgggaggctctggtacaatctaattgtgcgggaggggggggggggattaatctgcagcgtctcagcaaggggttgcaaaagtgggggcaatggaaagttgggaatatcagtagctcagttagaattggccaaggagatccttcatcgtttggaaatagagagagactttatggcgcgctctgctcatgaggataggctgggaacgaaatcgaaagttaactgc

SEQ ID NO: 17032 - DNA, 269 bp, Sorghum bicolor
  Clone ID: LIB3481-047-Q6-K1-B10
cattcacaagcaagtaataattttctgtacccgaaaaaaaggagcgcagagggggcgcgcgctcataggactctccaaggcctccagccacctgaggcagccaacttcgagaacaagacgaccttcaacgaactgaaccagctcgcggaagaagcccccaggagagcccagaggccaggccgcgagaagtgagcaccccgcaagggaagaaggagtccctggcgaaacagaaagggctggacatggagaccacccagcagtcctacacc

SEQ ID NO: 17033 - DNA, 464 bp, Sorghum bicolor
  unsure (1)..(464): unsure at all n locations
  Clone ID: LIB3481-047-Q6-K1-B6
gttggggtttttctgacaactcatcaatgcatttcacaaaaccccagtttatgaaccaacatgccatgtctttctgattccatcggtgatcggtacatcaatatttttgctaaggtgaaccattaaggtaaacatgccccattctcctatgctttatctcttaaattttatacatgtcttgtatatattgattttaaaaaatgagaatgacctaattatgtagcactatattgccgttattttctccaatttcctccttttgtaatctgaccaagttgttacgatttaaatatatgattcatttaattgctcttattatggttggcggttgcaaaaaaaaaaaaaaaaaaaaaaaaaaaaaaaaaaaaaaaaaaaaggaaaaaaaaaaaaaaaaaaaaaaaagaaaaaanaaaaaaaaagaaaaaaaaaaaaaaaaaaaaaaaaaagaaaaaaaaanagggggg

SEQ ID NO: 17034 - DNA, 602 bp, Sorghum bicolor
  Clone ID: LIB3481-047-Q6-K1-D6
cgttctgcccgcagctctgccccgcgccagctgtggggcggggcccggtggacgcgccccgcccgcgccccgtgccggcgctcgcccgcagcgagtccgcccgcgccgcagcgagcccgaccgcgcgccccccggtggacgcgccggcgctcgcccactcgtaccccggtcgacgcgccctgcggggggggggcgcgccccgcgccccgcaccggcgcccgccccccacagctctgcccggtggacgcgccccgcccgcgccccgcgccggcgctcgcccacgcggaccccggtggaggcgccccgcgcccgcagcgagccgagcgcccgcgccgtgcccgcgccgatctccggtggccgagagcccgcgccgatctacggtggccgcgttgcttcaacaggtggatatgtgattgttgatgaaaagttgcctagatttgtggtccctgacttgactggtttcaagttgaagccatacatatcacagtgcgctagggacctcacagcttcaacatctgctacttcagcagaaactactgaaaacaagagctgagttttatgtgactgctcgtcaatttgccggaagtctgatcagaatggat

SEQ ID NO: 17035 - DNA, 284 bp, Sorghum bicolor
  unsure (1)..(284): unsure at all n locations
  Clone ID: LIB3481-047-Q6-K1-E1
cgcgtccggctatatttgttactgataggatttcaacttagagagtataataaataagaaaacatggtgttggtgttgctaggaagttgtaactaggcactcattagcttctgtcccttgtttatgtggntagctgatgaaattggccccccccccccctctttttttnnnccccccccccccccccnnnnngggngnnnnnntncnnggggaaggggtttttttttttttgggggggggggggttttnnnntttttttttttttttttggggggggggggggg

SEQ ID NO: 17036 - DNA, 635 bp, Sorghum bicolor
  unsure (1)..(635): unsure at all n locations
  Clone ID: LIB3481-047-Q6-K1-E12
ccgggtcgnacccacgccgttctctacgggtagnnctaatttttttattatatagagtgggggatgttattttttactttgagcctgaaaagaaaaattatanaatattttgtaaaaaggttgnccttcaattttcttcttgcaacatttttattgtcattttgctagatttatttggaatactgttcatgccacatttggaattcaaccggcggggagcgatgggtaatatacatatgtttggttcttggcttttgggtttttggcctaagtataaaaatcaaattatattaggaacaactgctatttgttaggctatatggttgaatagaaatgatatggtattcaacaaagctaaaccaaacatctttttgcaggaagttttcagagcaacatattggactgaatatggtcgctgctacataaagaaggtgaaagattgaatatcaataacaattgctggatcttggaaaagtcattatggaggtctttacgaagtttggatggaagttacaaaatagaattgaatcttagtcttggttcttttccttctttgaacctcttgtgttttgtctttgtttatcctctcttttgagatagctgagcttaagtgcccctggatgtaatgaatctga

SEQ ID NO: 17037 - DNA, 543 bp, Sorghum bicolor
  Clone ID: LIB3481-047-Q6-K1-E2
ccacgcgtccgtaaaaaaaaaaaaaaaaaaaaaaaaaaaaaaaaaaaaaaaaaaaaaaaaaaaaaaaagaaaagaagacaaaaaaataaaaaagaaaaaaaaacaaaaaaaaaggggggtcggaccgttttgggtggtcccaaccttaaggccctcgtgctggcggactgtttcttcgtttttttgggggggccattaaccttgggtgtggcgcgggcgttttttctacagcgtcgtgatcggcgaaaacgcctgggggcgaccatacgttaaggggcttggagcaattcctctttttccaacggttggcttaattgggaggggggcttgggcacgcgccttgttatcgaaggcttttgcgccatggtgggtgggggggatggcccccctccctgtacccgctcccttgcccgcggccgtgcgggctgtttcctcccattttgtccgtttttttggcggggctctaagcgggggtcccttttggggttttcctttgggttttccttaggggctcgggtttccccctttaggttttaggggggg

SEQ ID NO: 17038 - DNA, 710 bp, Sorghum bicolor
  unsure (1)..(710): unsure at all n locations
  Clone ID: LIB3481-047-Q6-K1-F12
ttcatcctcaacgacccaatgctgggggagtggggggagnaaggtctaggaccttcctcatggnnaaatggagagcgccatcaggnnaaccatctgctctggngccaatcgtccaccaactaggagnnatcgaacacacactcaaggggcaactgctgttgttttttgtnnttcattanntgagtcnnanngggcttggtgggtgggaggggagcnnnaaagggggnnntggctanatggatgccagnaagcatagggcaaggcaagcgcactctctcaacatngcnncatagcctnnatgccaaagagnattgtaacaaggcgnnttaagtggtngnnaccgtgatnnttgtaaaggattggacnnatctgagggatnntactggtcnnnagtgtccccatatatcnnatatagggtnntgtaaagggtatctngnntgcagccccctttccagaatnntttttattattnntcgcaaaccagcataannnactcactatnnggagttcaaaannaaaaaaaaaaaaggggcgnngccgctctagnnaggatcccaagncnnttacgtacnngcgtgcatttgcgacgtnnncatagctctttctatttagtggtcacctcannnattcaattcactgggccccgtcggtttttaacaaccgtccgtggacctggggaaaaaacccctggccggttaccgcaactttaa

SEQ ID NO: 17039 - DNA, 564 bp, Sorghum bicolor
  Clone ID: LIB3481-047-Q6-K1-F2
ccgtccgtaaaaaaaaaaaaaaaaaaaaaaaaaaaaaaaaaaaaaaaaaaaaaaaaaaaaaaaaaaaaaaaaaaaaaaaaaaggggcgggccccttttaagggttcccaggcttttttaccgcgttccttgccaacgttttgagttttcttatgtgggacccctaaattccatttcatgggcccggggttttaccaaggtaagggctggggaaaacccttggcgttccccaactaattcgcttggcataaaatccccttttccccagtggggttattagcaaaggggcccctcccgaccgcctttccaacctgttggccacccggattgggcacggggcccccccttgtagcgcgcctttaaccgcgggggctgtgggggttccccccaccttgcccgttccctttgccagcgccttagcccccgttttttttgttttttccccttcttttttcgcctcttccgccggttttccccgtaaggttttaaattgggggttccttttagggtcccaatttagtgtttaccggaacctcccccctaaaaactttgtttggggtaaggg

SEQ ID NO: 17040 - DNA, 568 bp, Sorghum bicolor
  unsure (1)..(568): unsure at all n locations
  Clone ID: LIB3481-047-Q6-K1-F8
cgttctttgtcgcgtgggnaaaaaaaaaaaagagagggggaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttttaaggggtccaatttttggtggggggggtttccaggttttttttttttttttggggcccctaaattaaatttcctggcccggtttttaacaccttggggttgggaaaacctttggtttccccaattttattcctttggcgcaaattccctttttccccggttggttttttagaaaaggggcccccccggatcccctttccaaaagttgccccaccctaatggggaatggggcccccccttttagggcccttttaaccgcggggggtggggggtttccccccaggggaccctttccttttgcaaggcccttagcccccgtttttttccttttttccctttttttttcgccccctttgcgggtttttccccaaaaattttaaaatggggg

SEQ ID NO: 17041 - DNA, 573 bp, Sorghum bicolor
  unsure (1)..(573): unsure at all n locations
  Clone ID: LIB3481-047-Q6-K1-H11
ggctgcagtaaggggaggaggaggaggatgnngcgccattaagggcagagaccgccgtnctcgccatggcgccagggcgggnagcccttgtatagtgtggcggttctctttttcttttttgttatggcnncgatttatcaaacgtagggggggtggcggggncgnacatgctctctttcgnntggcggnagnaatcgnntcgtcccattgaagtgacagaaggagggtcgttncnnacaggnnggtcacngnntccctnngatggnatgtcnnggtggcggcgaaacgggaacccgatggcnnagcggccatttcgccaagnngcgttcccttcagnataagggtgnnctcggtgctnnggagctgnnccccatgtcgtggnacgccggnncgcctgctgatnntgtggggttcaagttcaaattgctgnngcgacatgatnnggagttcaatcccttccggcnnntgatggttctgttacctcaaannntggattttgcatttaactggnannatgatgaagaatnntgtgtgcgccatcttgnannaacggtgcaaagaaagttgtttcta

SEQ ID NO: 17042 - DNA, 312 bp, Sorghum bicolor
  unsure (1)..(312): unsure at all n locations
  Clone ID: LIB3481-047-Q6-K1-H6
ttgcccgcgccgttggnagccgatcaggctgacggtttcgccttcgttgatgtgcaacgagaccttcttcaggcctggatcggcccgtagacacttccagttcttcagttcgaggataggttgactcataccagttcctcttcatcggcgcccaggtaggcggcaatcactttcgggtcgttgcggatggcttccggaccgccctcggcaatcacgttgccgtggtccagtaccacgatgtggtcggaaatactcatgaccatgcccatgtcgtgctcgatcagcaccacggtcaggtcatgctcgtcgcgc

SEQ ID NO: 17043 - DNA, 543 bp, Sorghum bicolor
  Clone ID: LIB3481-048-Q6-K1-A12
actacaagttcaacagtctgggggggcgctgggggggggttccaacgagcagttcattgctctacaaggaggagtttgagaagatgaaggagaaagcaccggagaatttccgggttgactacgctgtcagcagggagcatactatttcttctggggagaggatgtacatccgggggggggggggggagtacaaggaggagctgtgggagcttctgaagaaggacaacacctacgtctacatgtgtgggttgaaaggcatggagaagggtattgatgacattatggtgtcactggctgaaaaagacggaattgattggttcgactacaagaagaagttgaagaagggagagcaatggaatgtggaggtctactgactgttcaattttgcatctgacgttttgtgttgtgtgtatctgtacttgaggcgaaggtgtactgcgtatataatgtagatagtgagtttgttctgtgttttactatggttattttttgggggttttatatgtactcttatattatgtctattcgatttttgttatgagt

SEQ ID NO: 17044 - DNA, 306 bp, Sorghum bicolor
  unsure (1)..(306): unsure at all n locations
  Clone ID: LIB3481-048-Q6-K1-A7
cgtcctccgcttggccgccgcccgcatccgtccgcctctcctcgtgaacgagaccgacgagcgagcgagcgagccagcccgcgaccgtacccgagagccgccgccgttttcgtcgtcccaccccgactcctcctgaggggggggggggggtgttttggctnctncaccggcgacgacaccttncccggcgtgcgcgccaccaccgnctgctccgtttgggggggtagtcgggggttcgggcttggtgggtagcaaagncnnnttnctnacagcaagatccaaaatacngtnctagagttcttttac

SEQ ID NO: 17045 - DNA, 152 bp, Sorghum bicolor
  Clone ID: LIB3481-048-Q6-K1-C7
aattaagggtccaggctgaatgtacgcactgcatgctgacgtcttaggctcttcttatagtgaaacctcaagtccattgcactggcccgtttgttttacaacgaacgcgccttgggaaacccgtgggggggggccaacttaatatcatcttc

SEQ ID NO: 17046 - DNA, 439 bp, Sorghum bicolor
  unsure (1)..(439): unsure at all n locations
  Clone ID: LIB3481-048-Q6-K1-D2
gcgtccggngttactaaactatcctaaacattgtggttgtcaagactcttgttgcntgaaagnaaacgaccctgtgcagaccatactttgcctcaggaaagtggctagataagagctggatgcttccctagttttggagttcacctcagcttacaatgctgcaccaagtcaccctcaagcagtcctgggctccgagcatgtaggcagaagttgattatttggtctacattctcaacttactgcagtttcagttctttttatcgttggaagcgaaccgggaatcatttaaaaaatgtttttgcctgcggcagttggttgagtagaaaacacatattagcaagctattttttaatggaccatttgtccatagctgtttggtaaaaggaaagttttacatgagtagcttatgccacaaaaaaattcccttcggttggccctt

SEQ ID NO: 17047 - DNA, 608 bp, Sorghum bicolor
  Clone ID: LIB3481-048-Q6-K1-E3
gcgtccgggaggtgaaaaaggcttgcctcatgcgtgagaaggagctttcatatgtgattgaagccctttgcactctgccaggtgttggtccaaagtcgctgcctgcattgctctgttctcccttgatcaaaaccatgctattcctgtcgacactcatgtttggaaggttgctacacagtatctactaccagagctagctggcaagagcttgaccccaaaacttagtgttattgttgccgatgcctttgttactagatttggaagctatgctggttgggcacaaaatgttcttttcattggccagctaccagcccaaaaacttgtggtggctcaagttaacagtgacaatggtaccacaaaacctaccaaaaggaagcgcggggtgcaaccgaaaccatgttgagaagatgtgatcatatggcgcacggataccactataccagtgatagtgggtttgtcattcttctgtgctattctcattcagtaagatgatttcatatgactatgacaaacgatcttctgcttaacagggaggtatttggtggctgctgaattggcatgtcgttttctcgaaatcctgatgaaatcaagtgcagataaattaaaat

SEQ ID NO: 17048 - DNA, 429 bp, Sorghum bicolor
  Clone ID: LIB3481-048-Q6-K1-G10
aatataaaggagccaaaaatcacaaacaacgggctgcctgctatcttgagttcttcttttttgggcccccccaaaccattttttttttgcttttttttacaacacccctaattgggggggggggggggggttttttttctttattcgcctggtggcaaaaacccccttttgtccaactgttgttgttattagacaaaggcccccccctgttggccgtcccctaacaatagcgccagcctccagggctgaatggggccccccccccgttgcggcgcctcaaaacgccgcggtgtgtggtggttttctcgccgcgggttccactaccctaggcggcagcctattgccccctccttacctttatttccttccctccctaaccgccagcgccggcgttccccgccaggcttttattcgggggttccctcttgg

SEQ ID NO: 17049 - DNA, 470 bp, Sorghum bicolor
  Clone ID: LIB3481-048-Q6-K1-G5
cgttctctccaacatcacctctcaaaagacctctgagcggatatagaccacaaactagttaactaacttacaaagaggggtccacaaagtggcctaactcgaaggctaacttgtaaggagacacttggtggagagacatggatgagaggctttattagccaatgttttgctgaatgtacgtgctttgctacgcttttaggtcccctattactgggctaattgctaggctagctctagcttaagggcgctgatggtgcctcttaaggcgcaacctgatgatcaactggtggagccgcatctggtgattcataatgtgattactaatccatgatctgagacaataattaggaacatgactaataaaaggtacaataacatctattattgcatccatgtaaaactttaaaacaaactatgataaaaaacattcttaaaaactgtatcattaattgtatcttcaattatcgatt

SEQ ID NO: 17050 - DNA, 511 bp, Sorghum bicolor
  unsure (1)..(511): unsure at all n locations
  Clone ID: LIB3481-048-Q6-K1-H11
cgnnctgattaaaaaaaaaaacaaaaaaaaaccgggggggtagaacggggggaaaaaaaaaaaaaaaaaaaataaagtatctaaaaagattatgctgggccccccaatgtagcgcttccagtttcacgccctcccatttacgactgaggaggcccagtttttttttttttttatccaaaacgatgacctgggggggggggggggggttttttttttaaccccactgttccccaactgagtgggagatgagagcccccggctcacgcccttggacacaatcgcgaagaggaccccaccttttctcctttctgagatcttgcccggctttaacggtgcaccgtactccccctgtagcttccctttagccccgtaccacttctctgctatctctaatatgcccgatacattcattacggcggacaatccgcatattttgcttatttaccctncccttttcgcccgttaggccgtctatcccctctactgctaaagtctgggactgctttaagag

SEQ ID NO: 17051 - DNA, 592 bp, Sorghum bicolor
  unsure (1)..(592): unsure at all n locations
  Clone ID: LIB3481-048-Q6-K1-H4
cgtttcgtacaaacttcaccgtanagacgcgctctcctgtgactctgatcctactgctcctcctctgcgccgccgccacggcggccgtgccgcggtaccgcgaggcgccgcacttcaccaactcggcggcggcgcagtgcccgccgccgctgcatccgtcggacgcggacgcggcgtgctcgccgcacgcggcggtgcacgtggccatgacgctggacgcgtcgtacctgcgcggcaccatggcggccgtgctctccgtgctgcgccacgcgtcgtgcccggagtccatccacttccacttcatcgcctccgcctcccccaagtccagggcgacggcggaggagctgggggccacggtgcgcgcgtcgttcccgtcgctggcgttccgtgtctacccgttcgccgacgaggcccgcgtggcggggctcatctccacctccatccgcggcgcgctggaccgcccgctcaactacgcgcggtcctacctcgcctccacgcttcccccctgcgtgcgccgcgtcgtgtacctcgactccgacgtcgtgctcaccgacgacatcgggtncctcgccgngaccccgctcccggggga

SEQ ID NO: 17052 - DNA, 574 bp, Sorghum bicolor
  unsure (1)..(574): unsure at all n locations
  Clone ID: LIB3476-001-Q6-K1-C8
atggccgccgtcttcttccaccacgtggtcggcgacctcaccgtcggcaagcccgaggtcgccgagctgcacgacaccgacacgctcgacgacgccgcgcgcgccatcgccgccagccccgagggcgccgtgcccgtctggcgccccagggccgcgccctacgatccgccctccggggccaggttcatcggcatgatctccgctctcgacatcgccgccttcgtcgccgccgcgggggtcggggaccgcgccatgcgcgccgtcgtcggcgaagtcgtgcagcccaatcctgcgctgctcagggagatcgatccgggtaccaggttgatcgatgctctggagttgatgagacatggagtgaagcgcttccttgttcgcaagagtgggagctggaaaggcattaccaagagattntcagtgctttttaatggcaaatggctgaagaacatggaatcaacatctccaaatgcagccagcagcagcagcatgccgctatccccgccttctggttctgcagacangttttgctgcctatcaagggaagatgttctccgggttctcattggatgccttg

SEQ ID NO: 17053 - DNA, 356 bp, Sorghum bicolor
  Clone ID: LIB3476-001-Q6-K1-D5
gcgtgcatagaagccagtcatagacgtgagggcgagttccagatggtatagcctgccctgaaagcgaaagccatctgtgtcggtgagcatggaggatgacacgatcaccctgcagcaccagggcggtgaggagcagcataacgccgtcagctatcaggtggaggtagaaggacaggggactgcttgacagcctgctagacaggaagaggcacgaggaccagcacaagaagcaggtggacgagctggccaccgacatggagaaggccaccgcggccgagcccgagacggatgaggaggagcacgaggcccgcggcgagacgacggagagccttctcgccatgctgcaccgcttcagc

SEQ ID NO: 17054 - DNA, 226 bp, Sorghum bicolor
  Clone ID: LIB3476-001-Q6-K1-G5
ctcacagacgcggcggcgccttgagcatgaggaggctgaagctagggcgagggcgcgagggagggacaggagcaccagccatggtgcacgtgagcttgtaccgcaactatggtgaaacattgaagaaaccaaggccgccttcggagaaggagccgcctgatgctgaactgaagctggtgggggagtatggcctgaggtgcaagcgtgaactatggagggtccagta

SEQ ID NO: 17055 - DNA, 391 bp, Sorghum bicolor
  Clone ID: LIB3476-001-Q6-K2-A5
tgcggcggcgtctccatgcacaagcagcagcgtcgtggcgggaaggcgctgcggcgggccaagtcggagcccaaggggcccacgcccaggttctccgtcggcgggagggcctgcgcggcagtgcacgcggtaggcgacgtggagggcggcgactgcgacgagatggtcaggtgggaccgcctgttccaggacctcaagcccaactgacgccgccaccgtttgccacgcgatggaagtgctgctgggactattgggacgacgatcagtgttcagagtgctaataacggttgtgcttgtgtttcgtaagtgagtctagttgcttcgctgtcgatcttgtttgcgtgtaatgtacaggctattgtagtctatgcttggaactgtccatcggacg

SEQ ID NO: 17056 - DNA, 476 bp, Sorghum bicolor
  Clone ID: LIB3476-001-Q6-K2-C1
cggacgcgtgggcgacacattgggtggggatggaaatgtatggcttatatactgggaggccctttgctccatccatttacttggaaacatttggccatctcttttacatcacatactctatggtcctatttctgtgactcacaggaccaaggctgttcatttaccatattggacccgccgatacgcattttatgttttggtgacacttattctgccatgcttggctggtttgctgccatttgcatctctgtcagactggaaagagcttgcagttcaatatttgaagtccagattcagtggaagtaacattgaggattgattatttagaagattggttgtggttatcggtgtaagctcaaccccattttgtgaaggtgtaaaagggtttgccagtttagccactgttgttcaataagaccacatgaattggatttcagtgtattaaaggagggaagctatttttggttggcttcatt

SEQ ID NO: 17057 - DNA, 275 bp, Sorghum bicolor
  Clone ID: LIB3476-001-Q6-K2-D1
tcgccgtcctgcctcggccgctccctcgtcgtcgccgacttccccaacgccggcgggaggggcctcgcggcggcgcgcgacctgcggcgcggcgagctggtgttatgcgcgccccgcgccgcgctgctcacaagcgaccgcgtcacggccgacgaccccaggattttcgtctgcgtcagggcccacaggccccgcctctactatgagcagatactcatagcgtgcttattggctgaagtgttgaaagggagaaattctttctggtacccctacct

SEQ ID NO: 17058 - DNA, 514 bp, Sorghum bicolor
  Clone ID: LIB3476-001-Q6-K2-D3
cggacgcgtgggtgctcatctgcagctccatcctgtccacggagggcgtcgtccgagccatccccttccgcaagctccgccacgacaccatcgtcgccgacgtgctctccgtcaaggagttccctcgcaacctcctcctcgaggttctcccaccgggatttgggatcatctgtacgcaccccatgtttgggccggagagtgctaaacacggctggggcaagcttcccttcgtctttgacaaggtccgtgtcgcggaagacggggatcaggcagcaaagtgcgaccagttcttgagcatatttgaacaggagggatgtaggatggtggagatgtcatgcgcggagcatgatcgctacgctgcgggaagtcaattcatcacgcacacaattgggagggttttatcacaactgaacctcaagtcaacgccaatcaacaccaagggttatgaaaccttgctgcaacttaccaagaacaccgtaagcgacagtttcgatctgtactatgggctcttcat

SEQ ID NO: 17059 - DNA, 496 bp, Sorghum bicolor
  unsure (1)..(496): unsure at all n locations
  Clone ID: LIB3476-001-Q6-K2-E6
gcaatggcgaaggcctggntgagctgtgggggagctctgggcggagaagctgttgacctgtagcccccctgctaactggcaatgtctcacagccgctccaagagcgattctatcagagtgctcagaacggatagcgcggattcggcttcgccgaggtgccacgctcagcatcaacaggaggccggagaactcaaggaccagaatagcaccaccaagatgctgtccagtgctactgagcttccatgctccttgaagcgtgaggtccaagtccttgaaaagcgactaaatgatcaattcgtcatgcgccgtgctcttgagaaagcactaggttacaagccttgtgctattcatgcatcaagtgagaactgcattccaaagccgactgaggagctaataaaggagattgcagtgctcgagctagaggtcatatgcttggagcaacatctcctaacactataccgaaaggcctttgaacaacaatattcccctgtgaatt

SEQ ID NO: 17060 - DNA, 337 bp, Sorghum bicolor
  unsure (1)..(337): unsure at all n locations
  Clone ID: LIB3476-001-Q6-K2-F12
cttcaccaaccgcatcccgggctngggatggcncgtgtcgctgggcctcgccgccgtcccggccgccgtcgtcgtcctgggcgccctgctcgtcccggacacgcccagcagcctcgtcctgcgcggcgacaccgacagcgcccgggcgtcgctgcagcgcctccgtggccccgggggggggggggacncnnagctcaaggacatcntccgcgccgtgaaagacgcgcggcggaacgacaagggcgcgtacgagaggctggngcgcggcaaggggtacgggcactacctggtgatggtggnggccatcccgttcttcttcgaactcaccggcgtcatc

SEQ ID NO: 17061 - DNA, 424 bp, Sorghum bicolor
  unsure (1)..(424): unsure at all n locations
  Clone ID: LIB3476-001-Q6-K2-G4
ggcttcaaccaagacacctacgcagcttccatagacgctggcggcgatgctacactttcctttccgggcgctcctccgttcaaggcgtcggatctgccgggagtagttgacagcgaccccgaagcagccatggccatcctccagacgctccatcggatggcggcgtccgacgggatcgtcgtcaacaccttcgtggagctggagacgcgggcggtgcgcgctctgcgggacgggctgtgcgtgcccggccgtgccacgccaccggtctactgcatcgggccactggtgtccggctccggcggcggtgggggaaatggagcacgagtgcctncgctggctggacacgcagncggacagcagcgncggggtcctttgcttcgggaggcctgggacgtttttcgagaggcagctgaaggaggtcgcc

SEQ ID NO: 17062 - DNA, 445 bp, Sorghum bicolor
  Clone ID: LIB3476-002-Q6-K1-D8
ctggtatctgcctgaacaccaccagatagaaactgaatctctctctgaatattcagccaaaaaagaaggagaagcaaccatgatcagtgccaagaggattgtttggatggcaaagaagtggcagagaatggctgccctggcgaggaagcggctcacggcgactccgcggaaagaagacgccgattgtccgtgcagcgcatcgacgtcggtggccgtcaagggccattgtgtcgtgtactcctccgacgggaggcggttcgaggtcccgctggcgtaccttggcacagcggtgttcagcgagctcctgagcatgtcgcgggaggagtttgggtttgccggcgccaatggcaggatcacgttgccctgtgacgccgcggtggtggattacatgatgcatttgcttaggcgagacgcctctgaagagattgcgagggcgttcttgagc

SEQ ID NO: 17063 - DNA, 358 bp, Sorghum bicolor
  unsure (1)..(358): unsure at all n locations
  Clone ID: LIB3476-002-Q6-K1-E12
cgccggccacccactaatccatccgcgcgcgggtatggatcacgccgccgagcacctcgaccccaccactccggcaccctcgtctgcctcctcctccgccgccgtcgccgaggtaaatgcgtggctggcctccctcgccgcggaggcgggaggcccgggcggggccggagggcgagggggcggcggangtgcggcggcggagctgtcgctggggtccgaccccacaccgcgcggggtggcctacctccgcgcgctggcctctgcgtcgcaggcgcggtcccgcgccgncggaatcgcgggtgcggggctgcgngcgcaggcggncnanncccgngcccgggcggcncggnngcgggag

SEQ ID NO: 17064 - DNA, 208 bp, Sorghum bicolor
  Clone ID: LIB3476-002-Q6-K1-G1
gcgactttttactggtccagtagcctcgagagaggacggcccacccatggaatcaaccgccaaaacgctatgagctgaggagctgactcggtcgtgccgatgccgagcttgaggcactggacatcgacaggatggatccaccagatgcgactcctgacccagcgaaccagatggcgcgagacctgagtaagcacacaagagagatgga

SEQ ID NO: 17065 - DNA, 503 bp, Sorghum bicolor
  unsure (1)..(503): unsure at all n locations
  Clone ID: LIB3476-002-Q6-K2-A3
atagaagatgaagatgagaggatatcaagcctggccaaactcttctttcatgagttgtcaaaaaaaggaagcaacccaatttataatcttcttccggatatcttgggtagactgtgcaatcaacacctgaaagaagaaaccttttgcaatattatgcagttcttaattaattcaattaagaaggacaaacaaatggaagctcttgtggataagctgtgcaataggtttgctggagtaaatgatgtcagacagtgggagtatatctcttattgcctttctcagctaaccttcactgaaaagggcctgaaaaaactcatcgataattttaagatgtttgagcatgcattgtctgaagattctgtgatgaaccacttcagaagcgtaatatcaaagtgcaagaagtttgcgaaacctgagctaaaagtttgcattgaggaatntgaggagaaacttagcaaggttcatcaggaaaagaaagaacaggaggaaacaaccaaaaatgc

SEQ ID NO: 17066 - DNA, 268 bp, Sorghum bicolor
  Clone ID: LIB3476-002-Q6-K2-A6
agcatacttgctttgtttaatttcacttgcaggcttctcggtgacaaccgtgttccacctcaccctcatcctaaccaacttccgccttgtagccccatattgtgtaccttgcagtggtgcccttgtccgtggcacgagtgcggccctattgttgactgcaaatttgaggtgagtttttgaactagaacctactttgctgttttgaatgtatcaattttctatattacggatgtgtttgtgggtatggaagtgggggaaggttggggag

SEQ ID NO: 17067 - DNA, 434 bp, Sorghum bicolor
  Clone ID: LIB3476-002-Q6-K2-C1
ggcagggcagaaaaccctaaggaagactacagcagtggtgttcaggaagcagagaggaataaattggttttcttcgagggcagttcatataattttgacttggaggatttgttgagagcttctgctgaagtccttggaaaaggaagttatggaaccacctacaaagctgttcttgaggatggaaccacagttgttgtcaagagattgaaggaagtggtggttagcaagaaggattttgaacagcagatggagatagttggtagggttggccagcatcaaaatgtcattccattgcgggcttactattactccaaggatgagaagctgttggtgtttgattatgtcccatctggtagccttgctgctgttttgcatgggaataaagcttctggaagagctccattgaactgggagacaagagtcaagatatctct

SEQ ID NO: 17068 - DNA, 247 bp, Sorghum bicolor
  unsure (1)..(247): unsure at all n locations
  Clone ID: LIB3476-002-Q6-K2-C7
gacgtttctgaagccagctaggggggccggggggaacaaccaaataaaaatctccccagcagcccagggcccgccagtcgacggtctctctcgccggccttctcagaccacatcacccacaagcattgcgcttgacgcctagctataagtactcgccggacaatgctnccactccatgggggggccacctcatctcatctcatccatctcnnacctnanncaatctancaaaaanncccttctttcc

SEQ ID NO: 17069 - DNA, 552 bp, Sorghum bicolor
  Clone ID: LIB3476-002-Q6-K2-D3
atcctatcacacataatctcgttgacatcagtatcatctaacagtcctatggtatttccagaagcacttctccagcagatactgaagtccatgatacatactgatattgacactcgtgtgggagcacaccacatgttttctgctattattgtccgagggccaagccatcttcggagtgagtcggagtacctatatgaaacaaaaaagcagtctcggactacatctgtatttgcttcagctactgctctactggagaagttgaggagagaaaaggagagtttaagttcagataagcctcgaaatatcgtgcatgatgatgtgaaggaaatgcatgaagaggataaacggaaaaatccagcttatttctctaagctggtttcctctttcattgaaagatgtgcaaagcgaagtagctctgtagaggagaccaatattgccatgctaactgaagatcaaaccaaccaattgctgtcttcattctggattcaggccaatcaaacagataatactccttttaattatgaggccattggccattcatacagcctaaca

SEQ ID NO: 17070 - DNA, 430 bp, Sorghum bicolor
  unsure (1)..(430): unsure at all n locations
  Clone ID: LIB3476-002-Q6-K2-E2
gggaaactttgttaatgaaccgtcgctcagaagtgtgctctcagaccctttgtctggggcttttcttgaagatgctatggttctctcatgtgggcactcgtttggtggcctcatgctaaagaaagttcttgaaacggcaaggtgcagcatttgcaacggagaagttgatgaggcctccttatttcctaaccttgctctaagagcagtggctacagtggtgaagatggaagacgataggaggctctttcataatgcagcccttcgaaagcgcaggaaagaagtgactgagcatatggatgctcaaaggcgaagcggaagtagcaaggacagtattgagctggggttagatgctgaaagccctaaagcgttcaagggggtgcagtacccgttcgtggcggntgagagagtcgngatcatgggaaacaaaagg

SEQ ID NO: 17071 - DNA, 158 bp, Sorghum bicolor
  Clone ID: LIB3476-002-Q6-K2-G1
gtatttcttatgcagcataagcatgatagcagaggcaccactacaggcacacgtttgacaaatagccttcagctgcgaagctgctttaggctgctcctgcctagcctatggcaccacctatcgtcccgagagatccaccacagctgttgtatggtcca

SEQ ID NO: 17072 - DNA, 332 bp, Sorghum bicolor
  unsure (1)..(332): unsure at all n locations
  Clone ID: LIB3476-003-Q6-K1-A11
cactcgtctactccccaccccacctggctctcggcgctgctcgccacgcgccacatggctcccgcgttcactagcctcctccccgccgcgacctccgccgccgcctcgcggctcccctctgccggcgccggagcggcatccaccttcgcgcgtctcccgcatcaccctacaanctgggggggggggctacnncacntctccacctacttctatttcacacannctcacaccattatattcctacanaaattnnttctcaatatntatctaacacancaantacaacananataatcaaacatntaattacttntttaaaaaaaaacacaaac

SEQ ID NO: 17073 - DNA, 134 bp, Sorghum bicolor
  unsure (1)..(134): unsure at all n locations
  Clone ID: LIB3476-003-Q6-K1-A5
gaaatttcagatcatcttgttccttgtttttgttaacaacaaaacaatttnctgaaatatccagcacctccaaatatacccttggctcccatacaaaatggcattcatcatatgccagnacttgagcagcctat

SEQ ID NO: 17074 - DNA, 160 bp, Sorghum bicolor
  Clone ID: LIB3476-003-Q6-K1-A6
catacgttcgctccaccgactggctgtgcgctgtgcaccaaccaactatccttaactacgaaactcccaacaacataaaaaaccacatataccttattaaactgaacaatctaaccggcaaaatcggagctaaacaacgactcatacgtacaacaaacca

SEQ ID NO: 17075 - DNA, 166 bp, Sorghum bicolor
  unsure (1)..(166): unsure at all n locations
  Clone ID: LIB3476-003-Q6-K1-B11
ggctttttccaagatgcttcccctggtgcttggggccacctctctctttctgacctgcggtcttcttctgtctccccgctccnctcctctgnctctggtccttcngtgcggtgccctggttgccggggctcnggcttgnnngtccccctccgcccgctggggcctt

SEQ ID NO: 17076 - DNA, 171 bp, Sorghum bicolor
  unsure (1)..(171): unsure at all n locations
  Clone ID: LIB3476-003-Q6-K1-B9
ggtgcatggccgatcttagttgnttgatctagttgtctgattaattccgttaacgaacgagacctcagcctgctaactagctatgcggagccatccctccgcaactagcttcttagaggcactatcgccctttaggccaccaaagtttcaggcaataacacgtatccacat

SEQ ID NO: 17077 - DNA, 317 bp, Sorghum bicolor
  unsure (1)..(317): unsure at all n locations
  Clone ID: LIB3476-003-Q6-K1-F8
gcttttgagtagctccactgatgacttttgggcatctggcttggtatttgtgatggttcgacgccacttagcttttatgctcaatggtcaaattatgttggacagacccctggcacccagttctcatgattactgcaagattttatgtgtcaaacctgttgctgcaccttatttgggggtgaatttcagagtcgaaggttttaacctactcagtacttcctcaaggctaatttgntcatttgaaggacgttgtatattccaggaagacacggactttatagcaaagaatgctgagtgngaggatagggatatngaat

SEQ ID NO: 17078 - DNA, 346 bp, Sorghum bicolor
  Clone ID: LIB3476-003-Q6-K1-H4
cccacgcgtccgaccggacagtgtgtaggtctccttgagtcttatccgccccaaccacgcggctcgccggagctcgcccggccgcaacgccgcccaggccggcggctcggtcccgccaccggccggcggctcgcggagcccggccgacccgcccgaacgcatcttacctacacgcgggggggggggacaacacgacccaacttcaagagctcattgctaacctggaaacaattcctaacacatggtccccaggacctcatataaaccctattcagatcgagaaggatggggacacaaatcttcatatggactggatcgctgactttgccaacatgcaggctatgaa

SEQ ID NO: 17079 - DNA, 339 bp, Sorghum bicolor
  Clone ID: LIB3476-003-Q6-K1-H7
ccgagcaggtgggggacgaagccaaagccaacaaggccgcgcggcgcgcgggcggccatgtggacgccatgcgcggacgcggcgtggacgtcgtgacgacacctgccgcccgccgccccccccggcccgcaccgccatggccccgccgccgccgcaatgcgcctcaaaacccctgtgcgcgcgttccgtgctccaggtaggggacatggccgaggaggaggcgccgccgacgccgccgccgcccaagctgctctacattgccgtcgccgacggcgggggccgccgtgcgttctggtacacgcgcaacgtgctgcagagtactctgtatcttatgggatg

SEQ ID NO: 17080 - DNA, 413 bp, Sorghum bicolor
  unsure (1)..(413): unsure at all n locations
  Clone ID: LIB3476-003-Q6-K2-A11
cactcggctactccccaccccacctggctctgtgtgctgctcgccacgcgccacatgactcccgcgttcactagcctcctccccgccgcgacctcctccgccgactccaggttcccctatgacgccagactaacgacatacacctatctcacagaatatattataacacacaaacagtgggggggggacgattacanctncaaaactagtgctcnctnatacantatcaaangattatcttggtccaaagattgtttctcactatggatctcacgcatcaagtacaacacagataatcaaacaactaattacttntttaaagaacaacacaaactttgacatgggagctttttttttgggggctctaaaaaggcctatgaacgttacatngcccatgntcatgagggagaaaa

SEQ ID NO: 17081 - DNA, 308 bp, Sorghum bicolor
  unsure (1)..(308): unsure at all n locations
  Clone ID: LIB3476-003-Q6-K2-A5
gaaaattcagacatcttgttcagtgtttatgtcaacaccacacaataccatgaaatatacaacacctacaaacattcccttggctccaatacaaactaaaatccaacaaataccaacactaacagataacaaaagaaaaagctctaaaggctagccttatcaaataaaangagcgggggggtggtcttnnatcaaatcccaaggctactaacccaatnntcatttatccaagctcatctcnaaaatctncaaatgctgnttcacattttggtgggaacactgatattcccaatgatggatttgtacct

SEQ ID NO: 17082 - DNA, 158 bp, Sorghum bicolor
  Clone ID: LIB3476-003-Q6-K2-A6
catacgttcgctccaccgactaggctgacgggtgggcaccatcaactatccttaactacgaaactgccaacaagataaaaaaccacatataccttatgaaactgaacaatcaaaccggcacaatcgagctcaacaagagctaatacgtacaacaaacc

SEQ ID NO: 17083 - DNA, 280 bp, Sorghum bicolor
  unsure (1)..(280): unsure at all n locations
  Clone ID: LIB3476-003-Q6-K2-B8
acccactcgtccggatactctagttgctagaagggttcctaattgtgtagataaaaattaaatttcagtaccttgaggaaattcccatctgcatgacagtgcacaaatatggatagctgatatatgggcacctgatgtgcaaactagaaatgccagatctgtattggtcaaagataggggggggtaaaattcattatnntaactnnnnaactatctnnaanccatttnnaantactcanttattnccanaatntttatataaaacaatcatatttcaatt

SEQ ID NO: 17084 - DNA, 325 bp, Sorghum bicolor
  unsure (1)..(325): unsure at all n locations
  Clone ID: LIB3476-003-Q6-K2-H4
cccgcgtccgccggcagtgtgtaggctcttgagtcttatccgcccacccgcgggtcgcggactcgccgccgcacgccgcccaggccggggctcggcccgcaccggccggacgtcgcggagccaggccaccagccgagggtactaacctacacgcgggggggggagaaatactgcccttattcaagagctcatagctaacctggaaacaatttctaaaacagtgccaccagnatctcatataaaccctatacagatcgagaaggatgatgacaccaatcttcatatggacttggatcgctgagtgtgccaacatgcaggctaggaa

SEQ ID NO: 17085 - DNA, 334 bp, Sorghum bicolor
  unsure (1)..(334): unsure at all n locations
  Clone ID: LIB3476-003-Q6-K2-H7
ccgagcaggtgggggacgaagccaaagccaagaaggccgcgcggcgcgcgggcggccatgtggacgccatgcgcggacgcggcgtggacgtcgtgacgacacctgccgcccgtcggcctcatggggccgcactggcatggccccgccgcctacagaatgcgcattaaaaccactgtgggggggggggttactaaaagtagcgagacatgagcacatcagagaagggcttaacatagcttctaccgnaataggagcgggtatatagaaatcgaaaagcttagagaggctctatctaatgaactgtatggaaatgatgaagacattatcaatggca

SEQ ID NO: 17086 - DNA, 392 bp, Sorghum bicolor
  Clone ID: LIB3476-004-Q6-K1-F3
ctcacatgtccgttctattggagagtaaggggggcaagatgacataacaaatgatggtcactgatggatgaagcttagcttgaatacaggattaagcgatcgcatcacactctgacggagtgctgagaatagatttcatactagctgattactacaaatggacactgaagccgttctgatattcatgctggataacgagttattggataaacagaaggaacttattgacacttggagagcgagcagtacttgtgacactgctgtttgatctgaatattcatgatgcttacaagcccttggtggaagcaatatggagattcaatgttggcgatataaataattttcctcacgtggcctggagttttgtaaatgatgggctgagtcgcacttcg

SEQ ID NO: 17087 - DNA, 434 bp, Sorghum bicolor
  Clone ID: LIB3476-004-Q6-K2-F12
cggacttgtgggaccaaaaaaaaaagagaggggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaaaaaaaaactttagggggggggggataaaaaaaaaaattttttttttatggcaacaaaaataaaattaatgggccgggttttaaaaaggggggaattgaaaaaaccttgggttaaccaaattaaatggctttgaaaaaaatcccttttttgcaagtggggtaaaaaaaaaaaaggcccgaacaaattgcttttcaaaaaagttgccaaccttaaagggaaatgggcccccccctttaaggggaatttaaacggggggggtggggggg

SEQ ID NO: 17088 - DNA, 343 bp, Sorghum bicolor
  Clone ID: LIB3476-004-Q6-K2-F3
ctcacacgtgcgttctattggacagtaaggggggcaagatagattaacaaatagatcgtcactgatggattaagcttaccttgaatacaggattaagcgatcgcatcacactctgacggatgctgatactagatttcatactagctgattactacagatggaccctacagctgttctgatattcattctggataacgagttattggataaacagaaggaacttattgtacttggggagcgagctgtacttgtaacactcgagtttgacctgaatattcatcatgcttacaagcccttggttgaagcaataaggagattcaatgttggtgatataaataatttt

SEQ ID NO: 17089 - DNA, 107 bp, Sorghum bicolor
  Clone ID: LIB3476-005-Q6-K1-A10
agcgagccgctcgcctcgcaatctccgccggcaccgaccatcaaaaaaggttttggcaccgtccccacccaaccgaccggaatttcctttccattccaatttccccg

SEQ ID NO: 17090 - DNA, 436 bp, Sorghum bicolor
  Clone ID: LIB3476-005-Q6-K1-A5
gcagatgatttgctgctgcaacaagatggatgccacgacacccaagttcttgaaggccccggtattgattagattggtaagggaggttttttttaaccttaaaaagggtggattccacccaaaccagaatcaatttggttccaatttttgttttgaaaggtaccaccttatttaaaaggtcaaccacccttaattgttccagggccccacccttgtttgaggctctgaactaaatcaatgacccaaaaagactttcaaacaagcccttgcgtttcccctttaaggatgtgtacaaaattggtggtatgggaactgttcctgtggaacgtgttgagactggtttcataaagccggttatggttgccaccttcggtcctagggccctaacaactgaggttaagtctgttgagatccacaacaaggttctccaggaggc

SEQ ID NO: 17091 - DNA, 456 bp, Sorghum bicolor
  Clone ID: LIB3476-005-Q6-K1-B5
gtattctcctcgaaggcatttgttgccggggctgtggcgtattttctggacaacaccctgcataggcgagacggcaccgtgaggaaagaccgggggcaccatttctgggacaaggttaaggtccctttaagattggacccgcccaggggggagttttacttccttccatttcaacctaaccaggtttttccaatccttctgatcttgttgttgttaactgaaaacagaaaatgctgttcgattaggttgttgtttgattttgccattgccacgcccaagtggctgtttttcctacttctggtggacccttggagctggagttctgaatcttgtaaagctaagcctaccttattcggaaggaatggagaaatggctggttattttggatggaaatggggttgggttctcggttagatgaagaaatggaaaggagacctgctccagtactctttctat

SEQ ID NO: 17092 - DNA, 226 bp, Sorghum bicolor
  Clone ID: LIB3476-005-Q6-K1-B7
atcgatcgtttgattattggcgagcttaattccattccatcagttcctttggcggaggatgtcgtgctgcggaggcaactgcggttgcggctccggctgcaagtgcggcagcggctgcggagggtgcaagatgtactccggaaatggcttgagcagcaggtgactaccaccgtcaagactttcgtcatgggtgtagcaccatcgtccaaggggcacgcctagggcg

SEQ ID NO: 17093 - DNA, 280 bp, Sorghum bicolor
  Clone ID: LIB3476-005-Q6-K1-D12
cttttgcgggtgctgtttccaggacttgtgtggcaccactggagacaatcaggactcatctgatggttgggagcaacggtgactccatgacagaggtgttccagtcaatcatgaacactgaggggtggactgggcttttccgtgggaatcttgtcaatgttattcgagttgcgccaagcaaagcaatcgagctgtttgcttttgatactgccaagaaattcttgaccccaaaggctgatgagtccccacagaccttcctacctccatcactcgttgctgg

SEQ ID NO: 17094 - DNA, 408 bp, Sorghum bicolor
  Clone ID: LIB3476-005-Q6-K1-E8
gaattctgagatgcattacacaagtatgccattgctcataggtttcattacaaatttgtcaagaatgactcttctcgtgtaaccgcagaatgtactgatggagggtgtgcatggcgtatacatgcatcaaagtctcattcaaaggagttcatggtcaagaaagtttttggtactcatacttgtgaatcagagaccatcaaaagtcatcgtttggcatctcagaaatgggttgctagtgttattaaggaaaaaatacgtgatagtccaaactacaggccaagagatattgcgaatgatctccaacgtgaatatggattgtgcctcaactactcccaagcttggcgtggtaaagcaatagcccgaaaagaactttacagctcagatgaagaggcatgcaatcagctacct

SEQ ID NO: 17095 - DNA, 636 bp, Sorghum bicolor
  Clone ID: LIB3476-005-Q6-K1-F12
gttatgccaaaatcaatgaagattggcaggataaagatacaacaagtgtacctaaaagtaaagtgcgaaagaaaaagttatcagacatgcttgggtctcagtggagcaaagatgagctcgagcgcttctatggtgcctacagaaaatatggaaaagattggagaaaggttgctggtgctatccgtgatagaacatctgacatggtgaaggctctttacaatatgaataaggcatatttatctcttccggagggaacagcaactgctgcgggattaattgcaatgatgaccgatcactacaatattctggatggaagtaacagtgatcgagaaagcaatgattcaccaaaagtatctaggaggctacagaagcgtggtcgtgcaaaacttcaatctgtgtctaagacatctgatacacattatactgatctgttgcaacctcagcctgcttcatcgagctatggatgcctttctttgttgaagaaaaaacgttctggagacctgtttgtaggcaacaggccacgtgctgttgggagaggactccaagagtacctgttgcaagcatgaccatcgagatgacaggggtgcatcaaatagacaagctaaacctgatgctaaccatggtgacgatgaagga

SEQ ID NO: 17096 - DNA, 545 bp, Sorghum bicolor
  unsure (1)..(545): unsure at all n locations
  Clone ID: LIB3476-005-Q6-K1-F9
tgttctccaagctactccatccccaccatttcaaattgcaatcttgcaatcttgcagcagctgatggattagcagcaggacaaagactgatagatccatccagacaagcgcacgccaaagaccgcattcgccaagcagcggcggcgcggggttgatggagacgcggcggccccggcgcggcgggaagaagcgcttcctcctcccgctcgcgctcctctgcctcgccgtgctgctccccggcgcgctgctcccgccgtccgcctcggcgtcatcctcgtcgccggccgtgggaggtggcagcaggaagcggcggtgggtggggtttgactactatgtactggcgctgcaatggccgggcaccatctgccgcgagaccagcaactgctgcgacaccaatggctgctgccgatcgaagcctctcaagtggttcacgattcatggtctctggccacagtacaattatggnggctggccatcatgctgcagaccaaccaaattcaacataaataagatattaatgctgatgccaatacttgagaagtact

SEQ ID NO: 17097 - DNA, 319 bp, Sorghum bicolor
  Clone ID: LIB3476-005-Q6-K1-G10
gccgagttcccttccacttccagttccagccttcactcagcacggcagccttcgatcccccgagactgcagccgcccgccgcccgcgccatggagccagccgccctaccgcaggttccccgcgtcaagctcggcacccaggggctggaggtgtcgaagctggggttcgggtgcatggggctcacgggctcctacaacgcgccgctcggcgacgaggccgtcgccgccgtcgacgcgcacgccttccgccgcggggtcaccttcttcgacaccttggatgcctacggtcaccagaccaacaagactctgctggggaaggc

SEQ ID NO: 17098 - DNA, 253 bp, Sorghum bicolor
  Clone ID: LIB3476-005-Q6-K1-G11
accactgccacgctagcgctggacgacggcttcgacgacgacggcgacagcaacgacggcggcgacggagacgacgacagtgatggcgatgatggcggtgactttgacaccgtgagcggtggccatggcggccacggccgccgttgcgtccgccgttgtgtccgccgttgcatcatcactggcaaaagaggagtagttggccttggccaccgcaagcgttgtgtccgtcgttgccgccgccgttgctaccccg

SEQ ID NO: 17099 - DNA, 602 bp, Sorghum bicolor
  Clone ID: LIB3476-005-Q6-K1-G12
atttgccttccccagaatggcatatctgcaatagatgctccaggaatgccattctatgacccagaagctacatctacactattgggtgaattaaacacccttataaagagaaccgacatccgagaggtgaagctgcttccttatcatatcaatgaccctgaattcgcagatgcattggtagatgcattcttgagtatggatgtaaaggcctctagttcagcccaacctaatcaaggtcttaatataaaaaggtcctgttcttcaggacagaaaatttcagatagttctgttatatggagacctcctgtggattttccggatgcaaaaccagaaacattgcggaagacgcggtcaatattacataaactaaaggaacaaatcagtgaaggtattccagttattggagctggtgctggcacaggcatatctgcaaagtttgaagaagttggtggggttgatcttatagtgctgtacaactctggacgggtccgaatggctggcaggggctcactagcagggctcttggcctttgctgatgcaaatgccatcgtaccttgagatgccaatgaagtcgtccccgcgggtaaaaggatttcctgccc

SEQ ID NO: 17100 - DNA, 515 bp, Sorghum bicolor
  Clone ID: LIB3476-005-Q6-K1-G5
gaatcacccaaagaagctggcaagatgagaccagagacgcctgagaaagtcaacgatctgccaggggtccaactagccacggacaatttgaacgggcaccatgaacaaatgcaagaaataaaactggattgataaagacaatgtcacccagtccaaatatcttcgccaccgcgtaatatcagtgtatttatgatctgatcaaacggcgcccagttggtggcagcactgagggtggcctaagttttgaaatactccggtttccacccctcccccttttccttttgtggtttcccgaattctttttgctaccacttctaggtatgtggtttcttctctccatttttatattttgagaagagaaaaggagcaggttatatggttgtccattggttgctgccttccaatgtaaatgcatcgggaggaattgtaagaaaaatgagatttatggccaattatgacatgtttattcttggaaataatcgtattatttaaaaaaaaaaaaaaaagggcggccc

SEQ ID NO: 17101 - DNA, 349 bp, Sorghum bicolor
  Clone ID: LIB3476-005-Q6-K1-H10
cggacgcgtgggtccggtccctgctggtgcagtacccatcccaccggatgccaactcccatagtatggcgacccatggaaaaacagggtaccggcagcctcgccctgccctgcatgccgaggccctgtctcctctcccgtggtcctgccgggatgctctcgctgatcctcattggcgctaggccatggaagatgaatatgctgctctccagggcaatcatacttgggatcttgttccccgccctgccaaagccaatgtggtcactggctactggatcttcaaagcccagctcactgctgacggttctctgcagcgctacaaggcctcggtgtgtgcttcgagggtccac

SEQ ID NO: 17102 - DNA, 335 bp, Sorghum bicolor
  Clone ID: LIB3476-005-Q6-K1-H4
attttgaacccaaaccccctccttctcccctcgacctcctcgaaaccccactcctctcgtgtcgagcgagcctagggttagggtttcgtcactcccgcccccgattcgaaccaatccgcctcgccccccgccgcgccatggccgccggctccatcgtggtggacttcccctccatgggcgccgccttctgcttccccagcctcgagtcactcctccgccgacctcaccaacttccaccgcgtcttctcccgcgtcctcagcgcctacccggacctgccggtcgaggccgtctggtctcttctcacggctctccttacacgaccgccccgacgacc

SEQ ID NO: 17103 - DNA, 378 bp, Sorghum bicolor
  Clone ID: LIB3476-005-Q6-K1-H7
cccacgcgtccgcccacgcgtccggatgaggtgctgccaagaattaaaaggcttggatacaatgcagtacagataatggcaatccaggaacactcttattatgcaagctttgggtaccatgttacgaacttttttgcgccaagtagccgttttgggactcctgaggacctaaaatctctgattgacaaagcgcatgagcttggcttgctagtgctcatggatattgttcatagtcattcatcaaataataccttggacggtttgaatggtttcgatggcactgatacacattacttccatggcggcccacggggccatcattggatgtgggattctcgcctatctcattatgggagttggtaagtcttgagatatcta

SEQ ID NO: 17104 - DNA, 191 bp, Sorghum bicolor
  Clone ID: LIB3476-005-Q6-K1-H8
cggactgcgtgggcttttccccaacttctccccgatactctcgacgagagcgtctctccatggccggaaagggagacgggcctgctattgtcatcgacctcggcacgacctactcgtgcgtcggggttgttgcatcatgacctagtctagatcatctctaacgtcttgggtttccttttcttctgctcttc

SEQ ID NO: 17105 - DNA, 322 bp, Sorghum bicolor
  Clone ID: LIB3476-006-Q6-K1-A9
ctcagccgcgtcgcgtgccattcccatagcattctgcgattctaagctatctgttggcagccatggggaagagctaccagaccgtgagcgccgagtacagcgaggtcaccgagaaagccaggctaatgctccgtgctctcatcgacgacaagagctgcgccccactcatgctccgtgtctcgtggcactccgccgggacgatcgacgtgtggtcgaggaccggcggtcctttcggtacgatgaagaaccctgccgtactggcacatggcgcctacgcggtgctggacatcgaggtgcggctggtcgagcccatccaggagga

SEQ ID NO: 17106 - DNA, 264 bp, Sorghum bicolor
  Clone ID: LIB3476-006-Q6-K1-B4
cagaagccagaaccgagagcctacctccctctatcttacttggcagggtcgatccctccgtagatctgcctggacgacgagcgcggatatgcggatacacaagtgccatacctcgatcacatacagatcgcggtgtatcgaacagagagctcactctacataggtggcgcggggctataagtgtgcgagcaggcagaaccggcagctgatatacttccttagtcacactccgcacagatccggagcagagtgcatgggcggaca

SEQ ID NO: 17107 - DNA, 316 bp, Sorghum bicolor
  Clone ID: LIB3476-006-Q6-K1-C10
cccacgcgtccggatgaggagcacagtggtcccgctctaccagccagcgcggctcgccgggctcattccagtgatgcagtcgtatgtggacatactggtggccaacatcgccggctgcccggaccaggactgcatccccttctgtcagctctcgctccggatggccatcgacatcatcggcaagacggccttcggcatcgagttcggcctgtcaaagaatgccgcaggcggcagcggcgagaccgaaggcggcgagggcgacgacaacgtcagggagttcctcaaggagtacaagcggtccatggagttcgtcaag

SEQ ID NO: 17108 - DNA, 376 bp, Sorghum bicolor
  unsure (1)..(376): unsure at all n locations
  Clone ID: LIB3476-006-Q6-K1-C11
aaactggaaagctctcaccttgattagcattttaacttgtttagcaaacatgatttattcagaagtggtaaatcatggtataattcttaatgcttttttattaacattggcaacaatatgggttctgtctgtgtgaatttttcaagagagtacttctgaagtagttccatgtgatattgttatctaccatctaccttaattattgtattacctgtcaccattagcatttttttggtcttttttgttttgaggacattttctctttgaacagatttatgtctttgtacaacatggcacattttttcacatncttgagtttgggttcttaatggactgtatttattttccttggccagcttgcaaaagaaggagaaaa

SEQ ID NO: 17109 - DNA, 305 bp, Sorghum bicolor
  Clone ID: LIB3476-006-Q6-K1-C5
ctgaagcatgcgctacatgtgccgctagactctcagcaggcatctcagcgaacggcgcaggcattgtcgaacgtgctatatgccatgcgcaaagctatctacagaatgctctattgtatgcaaacacttaggagcacacgtctgaacgcagagctgatgaagcaggtccatgtggcagatcatggtgatcatcagctaaacaagatgcttgccgacatacatgccgacttcaatactgacaacattagtggctaggcatgggatatggatgaagatatggctgaagatgtggtggaagatgctgt

SEQ ID NO: 17110 - DNA, 318 bp, Sorghum bicolor
  Clone ID: LIB3476-006-Q6-K1-D12
ggttcaagggactgaagaaggtagagagagaaactcgaaggggggagaggagggagatacagaagcaaaatgttgtttggagcccagtgtcagtgacaccatcttgtaatgcctgtgcttctacgggaaatggaggatcattctgtccatcccatgtctaagtctaaccatggctccttgtcaggaaatggttatgagatgaaacattcaggcaaaaaagtttgcgataaggattcatcatcagaatctgatcagtctcaccaagaagcatcggcagtgagtgagagcagtccagctgaacacacatcaactcaatca

SEQ ID NO: 17111 - DNA, 401 bp, Sorghum bicolor
  unsure (1)..(401): unsure at all n locations
  Clone ID: LIB3476-006-Q6-K1-D3
ggactagtttcctagatcgcgagcgcccctgcgctgtcggcctgccgttgacccgccgcggcgccgccttcctcgacccctgccgtgtgccgtcaatcagttcagttcctgagttcctggactaccttgagtccgccactgccgccggcgggcgagctccgcgcgcagccccgcctccaccgtcgcctcgcagctccgccgcggccggtcgattccgctgccgtatctccgccggcacctgcaccagcacccgtagacccgccatcccctgagtccgaaccccaaccctaaccccattccatccgtcgtctctggcagcggcacccgacaacgtcgcttgccaacgctcgcggctggcgcgcgatggagactgaatangcggagatagctgaggagtcact

SEQ ID NO: 17112 - DNA, 304 bp, Sorghum bicolor
  Clone ID: LIB3476-006-Q6-K1-D4
agcttcttcgcgtgtggtcttcctccgatctcagccccgttgcggagctcgcgggccatggagagggcgtctccgatctctccttctcccccgacggccgcctcctcgcctccgcttccgatgaccgcaccgtccgcatctgggacctcgccgtcggcggcggggcccgccttatcaagacgctcacgggccacaccaactacgccttttgcgtctccttcagcccccatggcaacgtcctcgcctcgggatccttcgacgagacggtgcgcgtgtgggaggtcaggttccgggaagtgcctcc

SEQ ID NO: 17113 - DNA, 432 bp, Sorghum bicolor
  Clone ID: LIB3476-006-Q6-K1-E4
cccacgcgtccggaagggaccaatggaatatgcaccagaactgtttgatgagcagaaggatcaagctgctgttgagaagatcctgaaggttgttttcttggatgtaaacgctcaaagccctcaactggaaaaggtcaacaatcaaatagctgaggcagaagctgcacttgaggcacggaagaaacctccggaagaaaatggcccaaaaattgttggtgaagggctcgtcattgatgaatggaaagagcggagggaaaggtaccttgcgcagcagcaagttgaagtggtcgattcggtgtaaattgcattctgctgctccacaatctatgcatatggcttcaacaagggcagtgacattcttgtaaactcttaggtttcattgtagtggaatgtttgtggtagtctaaggttgcgcttgcaggatgagtcccc

SEQ ID NO: 17114 - DNA, 296 bp, Sorghum bicolor
  Clone ID: LIB3476-006-Q6-K1-E9
cccacgcgtccgcctgcctctgcctgccactagcagcagcaagcggagaggcggcgagggcgtccgtcaggggggagagctcctgccgtgctgcgcttcgtctcccgtcccgttggttcttcccgagctcgtcagcaatggagaatctgagatctgaaaacggccaccaaggtgttgccatggagggcgtcaagtttgcgccggagatggccaacaccaaccggagagccctcagtgacatcaagaacataatatgaggcccgcaccaacacttgtctgttagcaagaggggtctt

SEQ ID NO: 17115 - DNA, 414 bp, Sorghum bicolor
  Clone ID: LIB3476-006-Q6-K1-F1
cccacgcgtccgggcggccaactgaattaggacgaaagcaacgaagccgaagcgagtggagaggaagacgacgacgtcgtagcagcagcaggacgcaggagaagggaagaaacgagggatctacgggaggagggtggtgggcaggaagatagaaggtacgtgcgagcagagagccgttcctcatggaggcggcgatggatctgatgcggcggatgccgccgcggagcgcggagacggcgctcaacgcgctgctctccctcctccccgaccactccctcgacctcctctcccaggtcgacctcccgctccaggtttgcatggataaagagagcttgaaggcatacattctatgccaatataaccgtgacgctgacttctaccgatctccttggtcgaataattatgacccccttt

SEQ ID NO: 17116 - DNA, 323 bp, Sorghum bicolor
  unsure (1)..(323): unsure at all n locations
  Clone ID: LIB3476-006-Q6-K1-F2
aaaggagagcgtagatttggagcttcttcactaggaaggaagagggagagggagagggggagcgatggcggactggggccccgtgatcgtggcgacggtgctgttcgtggtcctcacgccggggctgctctgcacgctgccgggccggggcagggtggcggagttcggcagcatgcacaccagcggcctcgccatcctcgtccacgccgtcctctacttcgcgctcatcaccatcttcctcatcgccgtcggcatccacgtctacgcgggctagtagccgagccggccgttgccggngccggngcaggatacgatatgcagtg

SEQ ID NO: 17117 - DNA, 318 bp, Sorghum bicolor
  Clone ID: LIB3476-006-Q6-K1-G2
atgagcaccacctccctgctcctccccttcatcctcaccacaaccccttcctcccgtcctctcaatgcccctccctgcaagacttccgaggtatggcgccaatgctggggaagcgtccgatgtacggcgcggacgtcgtcgccggaggaggcgacgaggtgaacggctgcggcggcggcggcggcgcgaacgaggacgagctgtcggacgacggctcccaggccggggagaagaagcggcggctgaacgtggagcaggtgcggacgctggagaagaacttcgagctcgggaacaagctggagccggagcggaagctgc

SEQ ID NO: 17118 - DNA, 183 bp, Sorghum bicolor
  Clone ID: LIB3476-006-Q6-K1-G3
gcaagaatctcgtgacgaactaggtcatcaacggcagtggtgtgatcggctgccacggacaagcggatcatgacgctgccggcgtcatgagcgctgactgacaggcaagtcttcgtcgggtacattttattgtggaacaacgacaccatggactatatttatgatggagtcttggctgcgtca

SEQ ID NO: 17119 - DNA, 292 bp, Sorghum bicolor
  Clone ID: LIB3476-006-Q6-K1-G9
aaggagtcaagcaactcagatgagaagtgtaatgagtttgcatctgctgagtcggaggactcggtgtcaggtgttctatatgatatgctgcaaaaggaggtcattgctctaaggaaggcatgccatgaaaaggatcaaagcctgaaagacaaggacgacgcagttgagatgttggcaaagaaagtagatactttgacaaaagctatggagtcagatgccaagaaatcgaggcgtgagttagctgctatggagaaggagttggcagctgttcgcatggagaaagagcagtata

SEQ ID NO: 17120 - DNA, 281 bp, Sorghum bicolor
  Clone ID: LIB3476-006-Q6-K1-H1
acatgtatagccggtgcacggtgctgcagcggaacagatggtctggccgtacaccaacaagctgagaggacatgtgatgcatggcactaactgacaaccgaggcggtgcgctcactgactgaacgagcagagtgacttgccacggctgcaccaagtgatccataatccttgtgggcgaaccatatcaagcacgtggatcaaacaatggtcgcaacactcacgttagcccatcaagtaaagcgagtcggaccactggatatatatgcacctgaggatacatg

SEQ ID NO: 17121 - DNA, 450 bp, Sorghum bicolor
  Clone ID: LIB3476-006-Q6-K1-H4
gttaatttggcgggtcttcctgcattggttgtgccttgtggatttgttgaaggtggacctgcagggctcccagttggacttcagctgatcggatctccattctgtgaggggaatttgctgagagtaggccacatctttgagcagactcttcagaatctcagctttgttccaccgttgttggcagagagctagtcaacataccgttgttggcagagagctagtttcaacataggcatctcagccgctcgacaagcaattacctgaggcccttctgtgcatcgacttcattcccatgcggaagaggttggtactacgcgtgtagaaaatagaatctttgcccgtggagttgctgataaatgtgagagagcaacggcacccatgcgatgtacgccagcaatcagcacattgcatacagcacagcattgtacacaccgacagaatgattgatga

SEQ ID NO: 17122 - DNA, 312 bp, Sorghum bicolor
  Clone ID: LIB3476-006-Q6-K1-H7
cttttcttttccttctcctacgcaaccagatcaaaccctagatcagatctcatccccccaccttcgtcatcccatgcggggaggttattatggattcttcgtcttcatctacgttcacccagtcgcaaagccagccggatttttattacctctataagctgcttcttatcggccactcggacttctgtaagagcattcttcttcttctctttacctacgactctttctaggatctctaccccaccataggtgtcgtcttcaaggtcaagatggttaacacctgttgcataaatcttatgcttgccatctggg

SEQ ID NO: 17123 - DNA, 374 bp, Sorghum bicolor
  Clone ID: LIB3476-006-Q6-K1-H9
aaaaatctggaacagaagttacggatgagacagcaatatatgatagctcaagttgctcagatatatcctgtgaggcctttggatgaacaatcttcagatcacaagcctggatttacctccaacataaccaaaacaagaaatgctgaaccagtgttgccaaatggctcccaaaacagacctttggttatattgggtctacaattatcaaagctttctgtgaaaaagactggctacttcagtgacaagacagaggttcagaaatcttcgactgttctgggatatgctgctcatgcagtctccctcattgcatcgtatctcaatgttcctcttcgatatcctttgcgctttggaggttcacggtcatatgttcttga

SEQ ID NO: 17124 - DNA, 319 bp, Sorghum bicolor
  Clone ID: LIB3476-007-P1-K1-A1
caatggctacaacctcgccgacatcatcgcacaacatgtgggattcgggaagagcccacctgcctacctctccctgacgccattgtcaaggcagcgcgacctgcttcgaggtcgagtcggcaccaactacgcctctggcggctccggcatcctcgacgtcacggggaacgggacgatcacactgcgtgaacaggtagcgttgttcgccaagaccaaggcgaggatcctccgggccggcctggtgagccgcgagaggctggacggtctgctgggccggtcactgttcgtcatcagcaccggcggcaacgacttcggtgcc

SEQ ID NO: 17125 - DNA, 385 bp, Sorghum bicolor
  Clone ID: LIB3476-007-P1-K1-A4
tgctgttttgtctactgttatagcattgattatttgctgtctggctgcatggttgctgatactcagattcaggggtccgagtgacacggctcaaggatttccacgtactgtacttccaaaattttctaggtcatctggcacaggtcacacacttttagttggtgctggtcgctatagttcaccttcaggtccatcaggttcactgggctcaagcatcgcaacatatgcagggcaggcaaaaacattcaaatttgctgagattgacaaggccacaaatggctttgatgattcaaaagtacttggagaaggtggcttcggatgtgtctaccagggcacacttgaagatggaactactgttgcagtgaaggttctgaagagatatgat

SEQ ID NO: 17126 - DNA, 420 bp, Sorghum bicolor
  Clone ID: LIB3476-007-P1-K1-A5
gtttgtttggtgccctcaggtgtcatggcatcggcatgattgtgggggcattgggagtttccaaggagcaactgagggatgcactcttggaaggtaatgcacatggtttgggagtggaagccttgcggatgctcactcagatggtgctcagcaacgaagaagagcttaacctcaaatatttcaaggacgattccctgaccagactttgcccagtcgatgcttttttgaaggcaatgctggatgttccgtttgcgttcaagcgagtggatgccatgctttacattgccagtttctatttggagatcaatcaactgagaatgtcttatgctattcttgagggggcttgccaggagatgagaaacagcaggctgttccacaaagtccttgaggcagttgtgaatttcggcaatttcatgaaca

SEQ ID NO: 17127 - DNA, 364 bp, Sorghum bicolor
  Clone ID: LIB3476-007-P1-K1-A6
gtaaccagcaatcgagtcgtcgatccacccagcgacctggaggggacgacgagagctggatcgatcgatgaagctcgtgtggtgccccgacacgggctccaaggcctacatcgacggcgtccgtgcaatcgcaaacgtcgactccgccgacgcctcgcccgagctcgccgagctcctcgccgccatggccggcggctggaacgcccggctcatcgtcgacgctccggactccgcctcatccacgtctaccaccaccagcctcgcgctcgccgcctgcgtgcgacgcacgggcggacgctacgccctgctcgacgttgatgacgacgcgcctgcgccttcaactgaagacgaggccaccaccaac

SEQ ID NO: 17128 - DNA, 255 bp, Sorghum bicolor
  Clone ID: LIB3476-007-P1-K1-A7
caaccaccacggccacggcaccaccctccctaaatcccgacccccaaaaccccccgtacgcgcccgccgcgccgcaatggcgcaccgccaccgcgccccgctgctccccatcctcctcctcatcctcctgctcgccacctcggccttcgcggcaacggcgcagcgtcgactcgcagcgacctgcgacaccgcggtcagcgcggggcccatcggggctggcgagcgcgcggtgctgcggctgggtctcagcgcgct

SEQ ID NO: 17129 - DNA, 455 bp, Sorghum bicolor
  Clone ID: LIB3476-007-P1-K1-B1
actagttctagatcgcgacggccgccctttttttttttttttaatgcgaatcatgtcttgttgctccagtgaaacttgtttacaatgtatttgagtccacaattgacgcgatttcatttctcattgatatcagaaatctttgcttcatgtatgtcagtgtcgtactgtcgtgccagcagcatcaatcaatcaccaatccaccaaactttcatggggaaacctgtttccgattgatttgattgatagataggtacatggatggatcacaagatggatggatggaaccatgtgcgtacttctatctatctttgcatgggttttgacatggacatttaaactagcagtcggatagagtatttacattacacattggctcagttcagcatgtaatggatatgttcatacatttgtcgtgacaaaccaacctcttaaacacattctttgttccgcttgtt

SEQ ID NO: 17130 - DNA, 414 bp, Sorghum bicolor
  unsure (1)..(414): unsure at all n locations
  Clone ID: LIB3476-007-P1-K1-B2
gcggatgaaatctccagaaggaaacaaagcgcaatagaggaaatcagaaaggtattcttttctcctgtgacacctgtgaacgtgtcagaatggagaactggccatcagagatgccccccagaacttcaagaggaggtacttgaggcactccatccaccatcccagatcacatcactttgcatcagaaactatgatggtcagagatacccacgttggttgtcaggggaacaggacactcgagatttgaacagcacagatatttcccacttgcaatatcttatgttctgggattgcaatggttcaagtattccccccaagattggtaagtttttcgttcatatctttaggctcacagttacaggctgcagttggacctctttgccagataactnggaccatcttgaatcactaaag

SEQ ID NO: 17131 - DNA, 284 bp, Sorghum bicolor
  Clone ID: LIB3476-007-P1-K1-B4
acacagtccacagagcactaccacttcactcagcaacagatgagacatcacgatccaccagcatcaatggatgcacttgccatcagagcgtcgcggtgcaaactttcccttttggtattacgagctttccctatctcagttctttcggatgctacatcagatctaccgtaaaatctacttcgttagtgtaaccatacctgttatccagtattttttcttaattttgtaaacaatttccatatatttttttcgcatagttctccaatattttcttttaaactttt

SEQ ID NO: 17132 - DNA, 190 bp, Sorghum bicolor
  Clone ID: LIB3476-007-P1-K1-B9
cccgcctatcgttcgtccacaccacaatcatgctggccgacctcacgcgcagaggagttggagggcacggccattgggatggagaacgatccacttgactatcgctatatatcaagtcccttttcatattcaaatagtttgaactcaattactacagcttcttttggaaagcgtactggttactttataa

SEQ ID NO: 17133 - DNA, 229 bp, Sorghum bicolor
  Clone ID: LIB3476-007-P1-K1-C10
ctgagcaaatgctcacatgcaggctttaatacatgctgcacaagacagactgctaactattcgtgaaagcgctcggttgcatggttgtgctgacagtttcaggtttcgtggaacagtcaaagacagataccgccagacaggaaatgccaggtctgtacctgtcggtcgtgcgctgggtgttgctctggccatggcctatctgaacaagactggagatgaccatctgatg

SEQ ID NO: 17134 - DNA, 339 bp, Sorghum bicolor
  Clone ID: LIB3476-007-P1-K1-D2
cactcatggctttctctttgcctgaccagtgaggacctctcctcccatgcttcactcgccgccccgtcgtcatccacacacacacacctcaaccggccaccatcggcgacggcaatgtccgtacgcttcttgctccgttccgcggcattcctggccatcttggcggcagcgacgccgacgccgtccgccgacgtgcctcagccggttccggagcccgaggtgaagccgagcgacacggacgcgctcaccatcttccggcacggcgcggacgcgcacggcatcctgtcgtccaactggagcacgggcgacgcgtgcacgggccactggcttcgggtgggc

SEQ ID NO: 17135 - DNA, 445 bp, Sorghum bicolor
  Clone ID: LIB3476-007-P1-K1-D7
aacgacacagcctctgcttaccggactccgacggtagtcttgtccggtctccggtgagcggccagcgaacacaccactgcgaatcggatcctgcgacatggggagagggaagagaccagtgctactgacaccaagatccctacacggatgcacatgaagacagagatgtgtatacttatggagggggtcaacgcattctagagggaccagcatacgttacatgataaagctcatcgagatctatagcacaagcccaccatcggatacaaagatgaaactgcggagtacaagaacatcagcttcactgactgagatgtctgcggtcatgacaagagcaagccgttgcggaggcatgtacttacagaatacacagggtatcatcttacatgtggacatgaacgataatgaccgtgtcagtgaatcaacggatgagctacaccggatg

SEQ ID NO: 17136 - DNA, 263 bp, Sorghum bicolor
  Clone ID: LIB3476-007-P1-K1-E11
tggagaacggcgacgaaaccctcgcctcccccaccgccgccgagaaggccgcgctcaacggcggcgtcgcggaggaggagcaagtggcgccatcacccaccccgcatagtcctacgccgccgtcgccgccgagaaccccgctccaaacggcggcgtcgcgaatgaggaggaggaggaggaggaggaggaagagggggtcgccggcgcccacaccgacgtcaggttctacgctgccgtcgccgtccgcgctgagatcgaggacc

SEQ ID NO: 17137 - DNA, 392 bp, Sorghum bicolor
  Clone ID: LIB3476-007-P1-K1-E4
ctcttccgtcgccgaggtagcggtggccgcttctgcggcggcggctgcgatggcgtcagctttgccgcaggagaaagagcagcagcaggcgcggcggccgatgcacgcgggggtcggcggcgctggcgccaatggccgccaccacgcgtacagccgcaaggacaagtctctcggcctcctctgctccaacttcgtggttctctacaaccgcgacgacgtggagtccatcgggctggacgaagcggccaaatgcctcggcgtggagaggcgccggatctacgacattgtcaacgtgctcgagagcgtccggattcttgtgaggaaagccaagaatcgctacacctggataggtttcggcggagtcccaatggccttgcgagaactcaaggaaa

SEQ ID NO: 17138 - DNA, 244 bp, Sorghum bicolor
  Clone ID: LIB3476-007-P1-K1-E7
gcttgtgagctttgctgaattccaccagataggtatggaagagaaccaacacttacaagactagagcctaacagagatggcgtatgggtggaggcacaatgcttaataaataatggttctggtataccctgatggaagactgaaaacttgcccttgagcttgttgaaaatggctgaagatgttgaaggaagctatatgcttgatggtgagaaaaataagctgagaaccacaattaagcttaaaa

SEQ ID NO: 17139 - DNA, 472 bp, Sorghum bicolor
  Clone ID: LIB3476-007-P1-K1-F4
cccacgcgtccgtgaaagctgtacatgcacctcttctatggttagtggtggaatggcctgaacagtcctatgaaacagcagaaatggtgaggtcgtctggggttatgtacaggcatcttgtatgtagaaagaataccacgagtgtccggaagattgctgtctgtcaaaggaataatgcaatctatcatatcaaaaggcatcaccttgatggtattaatgcatttgctgacgaagagcggtcatactcagctgatgtatttgaagaaatgcagaagatcaggcgctttggctcatggcctgtagcaatccatgttggaacaaagtatagggcagttttggaaggtcctatttgcaaaggtaaccgagtcatgggatggcacacagtccagacggctcaaaagaagagtttgactcgtcgattcccaattggtttctctgcatttgctttcaacagtacaaatgtatgggaccc

SEQ ID NO: 17140 - DNA, 324 bp, Sorghum bicolor
  unsure (1)..(324): unsure at all n locations
  Clone ID: LIB3476-007-P1-K1-F5
gcagcgctggcaccggcggcggtgctggcatgggcaccggcggngcaggcgctggcaccggcggtggcatgggcgctgggacaggcgcaggcgcaggcacaggcctgcaccggacagcacgcatgggcaccggacggactgacggactgcaccgcaccggacggccggatacaccgggctagcacgcgcgacgcgtacgccgaggggagacatcaaagcgcagcgcggctgtgagtgtgcgctgctgcacgcgcgcgcgacttctcgtgagggcgcggaggcatggtgcgcgactacgtgggacctcgagtctcgctctgtgtt

SEQ ID NO: 17141 - DNA, 290 bp, Sorghum bicolor
  unsure (1)..(290): unsure at all n locations
  Clone ID: LIB3476-007-P1-K1-H12
cccacgcgtccgagaatcttgccgtttttatgataaatttaattgatgagcttcatattgaggttttantnnataatgctcggagaggctacaacatggaaagaatttgccctggaagcgtcttgctgtagagattacactgatcttgggaagatgctcctcaaatttcaaaatatgattcttcctgactacataagttgtgaatggctacaaaatttttttgagatgtggaaccaaaagtgtatgaatgcacatgatgctgagacttttgaaatgctttgtgaggaact

SEQ ID NO: 17142 - DNA, 307 bp, Sorghum bicolor
  Clone ID: LIB3476-007-P1-K1-H6
attcaaccaagtcggcatatatcagacccaattttagctcatttgttactgagttaaatttggatgaaagttgaaacacggaacttcagatgaagtgcaaaacttcatgtggttgctctttcagtgaagtcttcacagcagacaatctgcttgccaggggatgaatggcaatcatggcatgcaaactcaacttggtacttaactgcctgtttgtaacagatttggtatgcagtggcaacttggtcaggtatagattctcttgagccacaaaatgcttcacaaaatttgagaaactggtgacacaagc

SEQ ID NO: 17143 - DNA, 320 bp, Sorghum bicolor
  unsure (1)..(320): unsure at all n locations
  Clone ID: LIB3476-007-P1-K1-H7
cggacgcgtgggctagttctagatcgcgacggccgccctttnttttttttttttttttttttttttttncctctcacaagtcacagcgcacttcattttgttgcaacaaccaatcgtcaatcacaacgaattcttttgcacagtgactacaatacaggtaaccaaaatcaacaagaaaaagcaaaaaaaaaagagagctacaaacaggctaatccgtggcgtccactaggaaaacaaaggcatctcctcatctccagcacactgcagcagccacagctctggctactctgaactcaactcacaggcatcatacatgaact

SEQ ID NO: 17144 - DNA, 437 bp, Sorghum bicolor
  Clone ID: LIB3476-008-P1-K1-A11
caacaactttcttgaaggatgatttagattatttgattcagtgcctgcagcagccatttgaggaggcacagaaagttggtgcgttgtgcttgctttgagcaagtggaaaagtttgccagccaattccctgaccttgctttcattgatctgttggataaattccgtgagacttgtcgcatcgataagacatacttcatgtgccagcaggacagtatcaagaaggttgctaatatgcttgagagggtgcaggggctatccctcaaggatcggttcacatttttggtttggttcaattaatattagggattccaaagccctttccatcttctgagatttgcaactaactattgccaaagccgtcgtgttagcatcgcaatgggagtgccaaggggttctgcaagaaatgactctgagcttctggaccttgagacaaaaca

SEQ ID NO: 17145 - DNA, 328 bp, Sorghum bicolor
  Clone ID: LIB3476-008-P1-K1-A5
gatcgtttgattattggcgagcttcattccattccatcagttcctttggcggaggatgtcgtgctgcggaggcaactgcgggtgcgggtccggctgcaagtgcggcagcggctgcggagggtgcaagatgtacccggacatggctgagcagcaggtgaccaccaccgtcaagactctcgtcatgggtgtcgcaccatcgtccaaggggcacgccgagggcgggttcgaggcggcggccggcgcccgagctgaaaacgaagggtgcaagtgcggccccaactgcagcttgaacccctgcacctgcaagtgagctgtataataaccccct

SEQ ID NO: 17146 - DNA, 291 bp, Sorghum bicolor
  Clone ID: LIB3476-008-P1-K1-A9
gcgaggctctctgattcgttagtgcattgcgtgaggaggtcggagtctgaggcagccgaaaactcatggtctcgagtttgctcggagcggaggcgatcactagacgaagggaggaaaaggcttgctctccgccaagaccactgacgcctattcctccgagaaggataactcgaacaacaccctcatgtcacgctcctccatcacccgccttcagttccctgctccacgtatccaccatgaggtcaagcatatgactcaggctaatggacaattttgctccacttcaaatgt

SEQ ID NO: 17147 - DNA, 174 bp, Sorghum bicolor
  unsure (1)..(174): unsure at all n locations
  Clone ID: LIB3476-008-P1-K1-B10
cccacgcgtccggagacggcctccttcctctcggtggcgctggccctggcggccctcgtccccgtctcgctgctcctcctgaaccggctcctctacggcaagctngccccggggccgnagnggcggnccgtggtggacaacctgttcgacgtgcggacggtgcggagccggtgc

SEQ ID NO: 17148 - DNA, 379 bp, Sorghum bicolor
  unsure (1)..(379): unsure at all n locations
  Clone ID: LIB3476-008-P1-K1-C2
ggaagccttgatatcaccaaacttctggatgaactagagataccatctcgttctcagaatagcatatcgtcttcagttttgcttgtgaagaagcttctgcagtttgataaaagttctaggccagcatactatggtacctggagaaagaagagttctacagttagtgcaaggcaaccctttcagagggatgaggaactcaattacgatgtccagagtgatgaagaatgggaagaggacgatcctgatgatcctggtgaaagattgtcttgatttgaggaagatgatgagaaaactatgaatgaacatgattccataattgatgcagaaagaggagctgagaacaagtttgtagtgcccaatgactatctttcanatgatg

SEQ ID NO: 17149 - DNA, 252 bp, Sorghum bicolor
  Clone ID: LIB3476-008-P1-K1-C4
ccagcatggtgacagtggtgattttgaagatcagcacgaggattcccctgatgatgccaaagaagaggaagaatatgaaagcattgagagaaaatcttagagaaagtgactttcctgctgattctgacagtgagaacccaagagtgagtcatgaatttggaaattcagatgacccacggtcagaaaatggtgatgctgattttccaagtgaatccgcaattggtggtactaagttcactgcttttacaggaa

SEQ ID NO: 17150 - DNA, 348 bp, Sorghum bicolor
  Clone ID: LIB3476-008-P1-K1-D8
cttaccttttcttttactttttctgaccagataataagcttctccgaaagaaacaaattgacctgcaaaataagaaaaagaagtcgagtcagaagaaaatcactggatttcagattcaagaatcagtgttgttgatggccttaatctagttcacaagtacaaaggtttccgaaacactaacagccagatttcagcctgtttagctgcaaatgggaggtatgtgatctcagcaagtgaggattcccatgtgtacatatggagaaacgatgataaccttggacaaggcagaagcaaggggaatgctactgtcaccaattcctatgaacatttccactgccaggatgtgac

SEQ ID NO: 17151 - DNA, 391 bp, Sorghum bicolor
  Clone ID: LIB3476-008-P1-K1-E1
ggcaaaaccaccttgctacactttgttgtccaagaaatcgtccggtctgaagacgcaaaatccgagaaagccgtaggagatgaagccagaaatatcgtgaaagacgaaatgttccgtaagcaaggattgaaagttgtatctgggctgagcaatgagctcgggaatgtcaagaaagcagccagcatggatttcgatgtgctgcacagctatgtatccaagcttcaggccggtcttggcaagatcaagtcggtcctcctgctcgagaagcagtgcacccaaggccagaatttcttcgcgaggatgcgtgattttctcaaggaagctgagatagagatcaaacaagtcaggtgcgatgaggagagggctcttgggagagtgaagagatcactga

SEQ ID NO: 17152 - DNA, 407 bp, Sorghum bicolor
  Clone ID: LIB3476-008-P1-K1-E12
cccacgcgtccggtcctgctctcgagggtctatgcatccgcgcagcggtggaatgatgtgggcatgatccggcggttgatgagcgaagagggtttcaagaaggagcccggtttcagctccattgaaatggatggattggtgcaccagtttgttgcgggtgacacttcgcatcctcagtcagaagagatatacgagaagctggatgagattcagcagaggctcacgtctgctggatacacgccggacttgtcagaggcgcctatggtcgctgacattgaccgcaccatgggcgccaccctgcgcttgcacagcgaaaggctagccatatcctttggcctactcaatgcgacacccggggcacccatccggattctgaagaaccttagagtgtgcaaagactgccacac

SEQ ID NO: 17153 - DNA, 109 bp, Sorghum bicolor
  Clone ID: LIB3476-008-P1-K1-E4
cactagtatttgctagctaaagctaaaaatgttgacagtgaataaaacctagagtgaacttatgtttgttatcaaaggagttcctgttaagatattatggatgaaacta

SEQ ID NO: 17154 - DNA, 349 bp, Sorghum bicolor
  Clone ID: LIB3476-008-P1-K1-E9
ctgggtttgatgcagcattgggtgatcctctcggtgggtgctgcattacaccaaatggatatgcactgctactaacaaagttgttaggatttgctcaaggaaggatagtgatggcccttgaaggaggttataaccttaggtccatagcaaattcagtttgtgcttgtgcaaaagttctcttgggagacaaattcacattcaacgctccagagatgcagccatttgaatctacatggagtgttatacaagcggtacgtaatgaattgaagacatgctggcctgttctgagtagcaagctgccagaaaatgtatcattgaggattaggccttcaccaagcgaggtcaacgc

SEQ ID NO: 17155 - DNA, 462 bp, Sorghum bicolor
  Clone ID: LIB3476-008-P1-K1-F10
gatttctttgccctttttctcgacccaacaatgaattattcttctggaatcttcaagcttgggtgtcggctgtgatggtaggtggaggatgagagcttagaagcagcccagctacgtaaagttagagttctgatcgacaaggctaatgtggagcaaggacatcatgttctagagattggtagtggctggggcactttagcaatggaggtggtgaaacgaacaaactgtaaatacacgggcatcacgttgtctgagaagcaacttaagtatgcccagagaaaagtgaaagaagctggattagaggatcacataactttcctgctgtgtgactaccgtcaaataccaatgggccataaatacgatagaattataagttgcgagatgattgaacatgttggccatgaatacatggacgacttttttagctgctgcgagcagcatttgaaagaacacggtctattt

SEQ ID NO: 17156 - DNA, 272 bp, Sorghum bicolor
  unsure (1)..(272): unsure at all n locations
  Clone ID: LIB3476-008-P1-K1-F11
gccagcaccacgacttccgtgctcgtcgccttcctcgggctagggttcggcgcgagatctgattccgggcgccggagagcgagatggaggtgagggagatggcgatggctgcggcggctgcggcggcgtcggtgggcggnggaggaggaggaggaggagggttctagctgccgccgcccaatcccaacctgccctacagggaggactgctggagcgacagctagacggcggcgctcgtcgccgactgtggcagccgctacgtctagctcaac

SEQ ID NO: 17157 - DNA, 384 bp, Sorghum bicolor
  Clone ID: LIB3476-008-P1-K1-F3
cccagccaattgataaccataacgattcggtagatcaaactcaactgtcccattcttcaagccctaccaagagtacagatgaaacttcatgagaagacgaagaagataatgataaagagaacatggacccaagcactcagaataatggtgtacatactcgtgaacacctccaacgagccattggaggagactcatgtccaggtgatgccatcataaatgattttctagatgatgaagctgaggaagaggatgatagtgacaatgacatgatgagatttaaggacaatgaagaagatgatggaagtgatgaaaacgaggtattcaatgatctaatagcagctggctatgaggaaaaagaagcagataatgagaagcgtaatgaac

SEQ ID NO: 17158 - DNA, 360 bp, Sorghum bicolor
  unsure (1)..(360): unsure at all n locations
  Clone ID: LIB3476-008-P1-K1-G4
ggattcctggtttgcataagatacaataataagttctgtcagtattactgatgtatgggagcccattgaggaaggccttgtaccgttgagtactgagtttcacagcactggttttttggttgatatattgttggatcattcatttgctttttattgatttattatgtcgtatgattgcagattggagatgactcgtcatgtntcaatgatatcnaattccttgtcacctaagggagctaacaagaattctcccggtatcaagctcctctgcatttagatcttaagccacanagataccagcaacctcagcaatatcaacagcaccagccaagacaaaatccaattcaaacagattcatat

SEQ ID NO: 17159 - DNA, 184 bp, Sorghum bicolor
  unsure (1)..(184): unsure at all n locations
  Clone ID: LIB3476-008-P1-K1-H10
ctctgcattgttgggtcaacgatgatcattctacatgccccccaggagaggactcctagttccgtggaacagatttggaacctggcaacacagccttccttcctttgctatgctgccattgcagtnggggtgtccctgttcctcatgctatactgtgctccacgctatggacagacaaacataa

SEQ ID NO: 17160 - DNA, 466 bp, Sorghum bicolor
  unsure (1)..(466): unsure at all n locations
  Clone ID: LIB3476-008-P1-K1-H6
gtccgaaccgcaaccgccgtcaccgccttccctcttccaaatcctccttctgcgctcgcagtcctgctgccactttccccccattgctgtggggccatcatccccccgcggccctctgctctgctctctcctgccattccacctgctgcccgctgctgtgcgtcgctcgctcaccaccaccagtcgccggcaccccgtgcggcgctcgctgccatcccgcggaggaggaggagcacgcgtgtccgagccttccgttccgcgtcgcatggactcgtgctgtcgccagccgcctacaaccgggtgcctgcctaaccggccgatttccttcctagcgtagctccattccactgcacanatagcgcgccactttcccaattccncgtcgcgtgcccgccgccttccgatcctggccactctgttcagcctgtggcgtccggcagggcggaggtgatcggtgatggagtgg

SEQ ID NO: 17161 - DNA, 206 bp, Sorghum bicolor
  Clone ID: LIB3476-009-P1-K1-A12
ccaacgcgccgcttcttccatgaaggacccgttccagagcggccgttaaagaccatcactctccgacgcaatactcggggctctcctgggatgaatcctgctcctcgggcacaacttactaccccgatgactactacggctgcactcctcatcacttgaagctatgctcatcaactacaccgtaggcatcaagtattcgtcgcacc

SEQ ID NO: 17162 - DNA, 157 bp, Sorghum bicolor
  Clone ID: LIB3476-009-P1-K1-B10
cgcctatctccgtgactcaaaagctatctcccattccacaccgacgacctctgtccaccctttcaacaacaccatgagggactacatcgcgatccacattagccaacccggtatccatgtccgaaacgcgtcactaacagctgtactgcctggagca

SEQ ID NO: 17163 - DNA, 256 bp, Sorghum bicolor
  unsure (1)..(256): unsure at all n locations
  Clone ID: LIB3476-009-P1-K1-B11
gctagatgctgaagctagccagaaagagaaacttgaagaagaaatagatgttttgaggagtcagttattgcanatgagtatggaagcgtgatgagacaaggaggagtcttgataaaggagatgggccaggaaaaatatttcctggtttagattcgttggtgtctcagactcgaggttcgcaacccagagagcagagcaatggaccaaagcaaccaattgccaaactctttgaacaagttgggttaaaaaagatatt

SEQ ID NO: 17164 - DNA, 170 bp, Sorghum bicolor
  Clone ID: LIB3476-009-P1-K1-B12
actatatactcaatctctacaaaaatagacactacctcatgaactatatgtcttgagcagtcagtcatcaaccatgagtgtgctaggtaattacacatcaaccagtcttgctcaacgaatataccacaagcaaaatatatcatgaatctaatacagacccatctcactac

SEQ ID NO: 17165 - DNA, 364 bp, Sorghum bicolor
  unsure (1)..(364): unsure at all n locations
  Clone ID: LIB3476-009-P1-K1-C10
gcgcggactcgtgggttcatcttcagcaaaataataggcgaagggggttatggacgtgtttatcgtggtgtaattgaagatggtgtttaggttgctgtcaaattgctcacaaggaaacatcacaacagagatcgcgagttcattgcagaggttgagatgctaagtcggttacatcaccgcaatcttgtcaagctgattggtatatgcattgaacggagcacgaggtgcttggtatttgagcttgttccaaacggaagtgttgaatctcatctacatggttcagataaaatatatggcccgattgattttgacactagaatgaaaatagccctcngcgcatcaaggggactagcctatctgcatg

SEQ ID NO: 17166 - DNA, 380 bp, Sorghum bicolor
  Clone ID: LIB3476-009-P1-K1-C12
gtgccgcctcctgtttccacgagctggggttttagttttagcggcgcaaagagggggaagagagccagcgagagacgcagactgaaaggaggagatgagccggagcctatggatcccggtgaagctgctccatgaggcagcgggtcatgtggtgacggtggagctcaagaccggcgaagtgtaccggggggccatggtcgagtgcgaggataactggaattgccagctcgaaaacatcaccttcaccgccaaggatgggaaggtgtcgcagctggagcacgtcttcatcagaggaagcagagtgagatttatgattatacctgatatgcttaagaacgctcctatgttcaagcgcttggaagcgaggattaagggcaaag

SEQ ID NO: 17167 - DNA, 405 bp, Sorghum bicolor
  Clone ID: LIB3476-009-P1-K1-C4
gtggtttcctgcagaatgcagttggtcaagacctagtccatcttggcgttgcaagaacagccagtggtggctcttcggctgtcgctggtggtgttagcactggacaccagcgcagcaaaatggatcttgatccagcatccagcagcgtggataatttcaaaacaccagaactgacaaaagaaaatggtctccaggaggatgagaaaggggagagtagtatgtatgatgagaggcaacctaagagaaggaagcggacccttatgaataatgagcaaatagatgaattagagaaggctctagtagatgagcctgagatgcacaagaaacgctgttctaattgcagagtttggtcaaagaaagtaagtctgcagggcttcaagatcacagcatcacaacttaaaaact

SEQ ID NO: 17168 - DNA, 235 bp, Sorghum bicolor
  Clone ID: LIB3476-009-P1-K1-C6
gtgcggaacttcatctcacactcacacatctttctagtataaatggagatatagccgcggacatctttgtactaaaaatagtccacgagaaccatatccgataaaatccactaagtcgagccaccaacactttcacaactcccacttccatgtgcttctatcaacataacaatctaactctaatcttctatctaaacaataatataccgtttcatacaatccatattatccctac

SEQ ID NO: 17169 - DNA, 445 bp, Sorghum bicolor
  Clone ID: LIB3476-009-P1-K1-C7
gcgaactcccatcctactatctatattcttccacacattacattttccattcctaatgattcttacaccacatcttaagggactaatttagcttccttatatctaatcttttatttcaaacataatcatatgacctttctacactatatttataccctcataacgaactttcctacttatcattaacatttcatcatcaacctaacatatctttacactatcattcgaattgaatcagacagaacctttcaaccttatatatttcttaaaacacatattcaacaactatacatattcttaataaaatattctcttactcactatttacaatactttataacacctcctaaaaattcaatcctgtccataattcacctctatatttactatgtgacgaactatttaatacacagtattttaataacatatcttattttatagatat

SEQ ID NO: 17170 - DNA, 395 bp, Sorghum bicolor
  Clone ID: LIB3476-009-P1-K1-C8
gcgggcatttggaatggtggtggtggtgctggacaaaagaatctctttgtagcatcctttttctttgatagggctgctgaggctggatgtgtgaacgccaatgcagctgttgctaaagttaaaccctcggacttcagacaagctgccgagcgtgcttgttcgttgagcgtcaagaatgccgaggctaccttccctggtgttccaaaggataacattccatatatctgcatggaccttgtttatcaatacacgttacttgttgatggattcggcgttgatccaaaccatgagatgaccttggtaaagaaggtcccttacagtgatgcatatgttgaagctgcatggccactttggagtgccaatcaggtggcatcttcatcataggaaggaaacac

SEQ ID NO: 17171 - DNA, 362 bp, Sorghum bicolor
  Clone ID: LIB3476-009-P1-K1-D9
gcgcgactgaagtactacgtactagcgtccacgcctctggcctgctgcactccatctccatcccacctcatgaatcccagcgagccatcgcattaattcccataagcactgtactgtgcctgcgcctaccgacgagcattgctgctgcctcggccagtcggccggcatggcggcagcgccggtggaggtgggcgcgcagggcacggtgggctcgctggtgctccgggaggtcgagtacttccggcggatggaggtcgccggcggccacggcaagaagagcagcagcaaggtcgttggagccagcggcggcagcggcagcggcagcccgtggagcgacagcggcaagaagccgaagccgacga

SEQ ID NO: 17172 - DNA, 370 bp, Sorghum bicolor
  unsure (1)..(370): unsure at all n locations
  Clone ID: LIB3476-009-P1-K1-E1
aaagatctttggtttgatctatgtgattatatagttgcaactgtagtatttacaagttttagatatttatttgactgacacagtgtaggcattaagtgaactgctgtatttttaataaaaaaataatgttatctcattttgatataatcagagaacgcacacctgcacttgcttaatccagttacatctattttagtactcaatactcgttcacaaagaagcaggtgttgtgtattagtctgttcccgtaacaaatccaactacacatccctgttcaaagcagcagcagtaacttctccagcaagtggaagcactatagcaggaagcaacacgtcaaagtcaagcaccagctcangcaaaggcagggggc

SEQ ID NO: 17173 - DNA, 406 bp, Sorghum bicolor
  Clone ID: LIB3476-009-P1-K1-E4
gcgggcaagaaagcgcgccgccaaccccttggcgatggtgcacatgggcttcctgtccctgtacacgtccagccatgccggctccaagttgagcaagactagcgccagggatcaggtcttcgaggaggtgaggaggctggtggagctctacaaggacgaggagctcagcatcaccatcaccggacacagcctcggcgccgccatctccatcctcaacgccgtcgacatcgtcagcaacggcgtgaacgtgcccgccggaggcggcggctcggcggcgtgcccggtgacggcccttgtgttcgcgtgccccgacgtcggcgaccgcttcttcagggccgccttccattccttccgggacctcaaggctcttcacgtcaagaacagcccgggacgcgtgcccatgtac

SEQ ID NO: 17174 - DNA, 465 bp, Sorghum bicolor
  unsure (1)..(465): unsure at all n locations
  Clone ID: LIB3476-009-P1-K1-E7
gcgagcttatataactagtccaaggcatcccatgcaatataaacctcatctctttcaatcctcatggctnttcccaattcgagcccacagcatactattttataattgacttccncacctttttaattcatngtcacctcactgtttttgttctcctcatcagacattattatcacatatctaccttcggtcatctaggagagcctttatactaccattttcctctactccttatacccaataaatttcatttttccttattattattaacatctcatacagtaaacttatcctaaacatcttgactatcactactattaattttctttaaactactattccatcttacaaatcttattaatatctacctcctatctcaataatacctgtaactctacaatattcttcatatcttaaccttactacttatttttcaatacatatttaatttattttcttcttcta

SEQ ID NO: 17175 - DNA, 307 bp, Sorghum bicolor
  unsure (1)..(307): unsure at all n locations
  Clone ID: LIB3476-009-P1-K1-F2
naagaatatgtgaagcatacaaatacaattcctaaataaaactgcattactgactaaaatctggaaacatgataattaaatacacaatgggggaacttgagataacacaagcttcctctttcataatacaacatatccatggactttgaaagtttgaaccctggacagcagatatacgaaaaactcatttctgacatgtatcttatcacagattgtacaaataattttactgaagttgccacatgacacttctctatttggacatattgctccatctaatctacatcagccatttatatccattaca

SEQ ID NO: 17176 - DNA, 151 bp, Sorghum bicolor
  Clone ID: LIB3476-009-P1-K1-F4
cccacgcgtccggccttgtatgccaactgttgccagagcaacccttggaagtttgctgatcctatcacacataatctcgttgacatgagtatcatcggacagtcctatggtatttcagaacacttctcacagatactgaatcatgtcatct

SEQ ID NO: 17177 - DNA, 438 bp, Sorghum bicolor
  unsure (1)..(438): unsure at all n locations
  Clone ID: LIB3476-009-P1-K1-F5
ctgaaaggcttcgagggaaaccatccatttcataattacactgcacgtgccaagtacaggaaggttcttgcgggaaggcacccgagggccaaaggagcaagcttgacgttgaagtccatgtcctctgaaatgggtatggcagaaagctcttctttagaaagcacttcttcagatgatgatgaggacttgaatatttcatcaatcgactctggtgcatcagaaaacatttttgtgaatgatatcctgaaattttctgagagtcgagtgcagattcaagctaggtggctgcatgaacctgatgaaagtgatagattaaatgcttcacatttcagagatatcattacctgttcatgtggagagtgcaaacttcatcangaattcaatttgtggattgcccatatggtggtatcttcatgctccaccaatccggaaaatggt

SEQ ID NO: 17178 - DNA, 397 bp, Sorghum bicolor
  Clone ID: LIB3476-009-P1-K1-F7
ccgatccaaccgccgccgcccgtgcccgctcctcgacgccatcgacctcctcgacggcccttccccgcccttcttcggcaagtcccgggcccgatccacatccgtgtcctcgtcgccgccgccgccggcggtttctccgccgtctcccccttcccctcccgcatctccgcccaggaagaggcggcgggacgatgccggggatgaggaaggtgtgagcgacgtggtgggggctctgagggccatcggggagggtttcctgcgggcagaggagaggaggatggaggccgcccgggagactcagaggatgcggatggagatggcgcttcggcaccttgatgcacagaggaggctcatggacgcgcttgtcggccgcatcgtcgatgccttggactgaatg

SEQ ID NO: 17179 - DNA, 396 bp, Sorghum bicolor
  unsure (1)..(396): unsure at all n locations
  Clone ID: LIB3476-009-P1-K1-G1
ggtggacgccgcctacttcgccatggcgtacctcaacgttaccaacgttccggtgatggtgacggagaccgggtggccgcacaagggcgacccgtgcgcggagcccgacgccacctccgacaacgccgacacctacaacagcaacctcatccggcacgtgatgaacagcaccggcacgcccaagcaccccggggtggccgtgccgacctacatctacgagctgtacgacgaggacacccggcctggctccacgtcggagaagtactggggcctcttcgacatgaacggcgtnccggcctacaccctgcacctgacgggctccgggtcctgctggccaacgacacgacgaaccagacctactggtggcgcgcgacggcgcggaccccaagatgctgc

SEQ ID NO: 17180 - DNA, 384 bp, Sorghum bicolor
  Clone ID: LIB3476-009-P1-K1-G2
attcaagacattttctgtattcaagtcctgctcagcctcttggaccagaagaccttacatggaggatgattgctggtaaggtggtggagatcaaggggcagattcggcgttctcaacgtttggtcagagagtcaaggagcgtatgtacatgtgaatgcagagttgggaacaccacgaggatgctttgaccaatattttcatttgtcttgagacttttgtagcataggcattttttgttaccaatggggcgagcttcgagcttggcaaaatttgccaagttatttgtgaatgcaagtatgcaaccgtagtcatgtacccaatgtatcagttgagctgcaaagagttgtgatactgtattctgagaaatcttaacatggcagagat

SEQ ID NO: 17181 - DNA, 452 bp, Sorghum bicolor
  unsure (1)..(452): unsure at all n locations
  Clone ID: LIB3476-009-P1-K1-G4
gcgagacaaacccgcgcctgctctccgcctctctcccgagtcccgacctgctctttcgccccccgccccacttcctgccaaaaccctaacggctcnacctcgaggatggcgtcnccgccgccgccnccccctcccgccgcagcctctgccccacccgccgcggcgtccggatcgccgccgccggcgcaagtggtgggcaacgccttcgtgcatcagtactacaacatcctgcaccagtcgccggagctcgtctaccgcttctaccaggaggccagccgcctcgggcgccccgccggcaccggcgccgacggcatggacacggtcaccaccatggacgcgattaacgagaagatcgtctcaatgggcatcgaccgggcggagatcaaggcggtggacgcacaggaatctctcntgtggcgcgtcactgtgctcgtcatgggccaccttacggg

SEQ ID NO: 17182 - DNA, 422 bp, Sorghum bicolor
  unsure (1)..(422): unsure at all n locations
  Clone ID: LIB3476-009-P1-K1-G9
gcgtgtgcacttttaaatttccacgtaacatatttttgttattcaacgtgtatgaggcacagagtatgaaacttggatatatctattatggagtagcacatacatattgcctactanctaatggatagttcattggcacttgcttagttatgaattatttctctcaaaaagccaactaccttgctacttcccttctgaaattctatggttggtgcctactgaaaaatgtttttagtgctggatgtcttcactggcagatgggattgtcaaagcttgttcctaatattgatgttgcctccttgcccccattctcgatgccattcctcagaatgcattgtgctgctattatgaaatgctttatgtgtgcttactatcatcctttgctatcaatactcccttgatctgtctttaatggcgtttta

SEQ ID NO: 17183 - DNA, 454 bp, Sorghum bicolor
  Clone ID: LIB3476-009-P1-K1-H9
gtgatagacgcagacgctcacaaacacgagcgcacactcacccctatgaacgcacgcatgcacaccctacctctatgggcacctccgaggaaccaagttggaccagcaaatctcgagattgacgaagtcaccacaggcgcctcactatcgacggacatgtcgcctaccactgaaagcatagcggcgttaaatcctggaataaatccagaaaaatgcgagcacctgtgtcaagtcggagacttgaacccaggtgggcaggtttcaccacaaggaacccaaccagctgatctaaattctattaatggcgaaacaatttgcttttgggcagaccactggttgagtggcaggacagttgctgaaattgctcccaacctgatcaagttgatcccaaaagagggtgtcaagaatcggactgttgctcagaccctggaaacagctgggtggccgacataat

SEQ ID NO: 17184 - DNA, 443 bp, Sorghum bicolor
  unsure (1)..(443): unsure at all n locations
  Clone ID: LIB3476-010-P1-K1-A11
gattcatcttggttgagatcttgctcaatgtttagagtaaattgtgaatgcacaatgactttagagtaaaatgtgaatgcacaatattcagagaaataaacaatgcagtgtccttcgtaggttcattttggtgttttattaggttttaaatttaaacttccaggttgctaaattttctcattggtaacataaggaaaatggtgtactagttcaagatttgttgtatcaaattttctcatagctgtcatctcttttctattattaagtactgcatcaatttttctacagtcagtcattgttatctggtatattttgatcacgagataggagcctgcacatatatacttggtgatttagtactaaagctcattgcaaatttattatcaaaacattntctgtgaaaaatgcacatactctatttcttcacatctggagaagtgact

SEQ ID NO: 17185 - DNA, 512 bp, Sorghum bicolor
  Clone ID: LIB3476-010-P1-K1-A2
cccacgcgtccgcccacgcgtccgcccacgcgtccgcccacgcgtccgccttctttgaaggggtctctacgttgcacctctaggatgcataaaagggatcacctgccggaaggatggtgtacgatactattgcaatttttgcttgtacttcttcggattgtattgttgttatttgggagatgacaattcagcccaccgccacttgtaagattttcttccttgtggattgacattattactattaggagccaaaatttttgcggtgctggtttcactattcaaactcaaattatttttattttatgattttgacggttcttggaaatatggactgcatttgtacctaactttgctcatctcaggagagaaccactcggatatggaaaatgacttcacaagctgcttcttctggcttgctctattagccaatgaaaatgtttgatctcaacactattggaccatatacttcatattttaaagtgtgtttacccttgccatgaaaatgttctata

SEQ ID NO: 17186 - DNA, 138 bp, Sorghum bicolor
  Clone ID: LIB3476-010-P1-K1-A3
gatcgcgccttgtaccggcactttaagcgcgcttgtggcgctgtttactcgcagggttcccgatacatttgctagcgccttagcacccgctcatttcgctttcttccctttcttttttgccactttcgccggtttttc

SEQ ID NO: 17187 - DNA, 407 bp, Sorghum bicolor
  Clone ID: LIB3476-010-P1-K1-A8
agctgctggaagggaagtgcatgtggtttctagggatggccggctgctggatcctagcatacgttcgctgcaactgatacgcgaccgttgcaatgcattcgataccgaggcatggtatatgctgccacctgtgctcaggatggtggtggagggtgccgaaaaaacagacctaactgaggtttcaattgctataggcgctttagcacatcagatggaagcaggagagcacgaggtcaggcatggtgatagattaacatctctagagagatttatggatgcatcgtacacaacacatcctgtctgactgctcgacacattatgataccagatatcatgacaaccagcatagactttcaagggaagaaagcgaggctcatggcagtgggcaccatgacctccaggggtaa

SEQ ID NO: 17188 - DNA, 535 bp, Sorghum bicolor
  unsure (1)..(535): unsure at all n locations
  Clone ID: LIB3476-010-P1-K1-B4
gtgacattcagctcgagtggctatatacttacatctgagattgacggaacgattcaaatgaaaagttacctcactggtaatccagaaatccgtcttgctctcaatgaggatttgagcattggaagaactggatcttcatatgattacagaagttcttctggaggtggaacagtcattcttgatgattgcaacttccatgagtcagtacatctggatagttttgacattgacagaactttgactctgataccacctgacggagaatttcctgtaatgaactaccggatgacccaagaatttaagccgccgttccgtgtaaccgctctaattgaagaagctggaccatcgagggctgaagttctactgaaaataagagcagacttctccgcaaatgccactgctaacacaatcacagtacaaatgccagtgccatcatacacaatgagagcaagttntgagttggaagctgaagcagttggacagacaaccgatttcaaggaaggatccaggagactcgagtggaatctcaagaaga

SEQ ID NO: 17189 - DNA, 470 bp, Sorghum bicolor
  unsure (1)..(470): unsure at all n locations
  Clone ID: LIB3476-010-P1-K1-B7
atcttaggaagcattgctctgaattccggcatatttactgcaatccagtgaaaaaggtatttcacccaattcatgatcagtctttctatttaactcaggagcataagagaaagctcaaggaagaatatggaattgaaccctggacgtttgaacagaagcttggtgaagctgttttcattcctgctggatgtcctcaccaagtgagaaatttgaagtcctgcatcaaagttgcgcttgattttgtttccccagaaaatgttggtgagtgtgttaagttgactggggagtttagacgacttccatctttccacaaagctaaagaagacaaactagagattaagaagatggctcttcatgccctgaacgaagctgtaaacttcntggatccttgttcctcagaagggttgaagaattggggtggtgagaacagctgtggagatgaatctgcagatgagaagccgatgcctaaa

SEQ ID NO: 17190 - DNA, 295 bp, Sorghum bicolor
  Clone ID: LIB3476-010-P1-K1-C1
gcttgttgtggagatctatgaagcatatctcaaccggcaagtcaacactgctgctgggaaggacacagattgtagcagccggaagtgataattatgaacataacttgtgcagtagtagtattctaactatgtgtttgtgcattcatcatattctcatgctgtttagatgcaaactgtttttttttggatggtaatcaattagatgatgttgcttgaaacagggttgaccagctgttgaaaattaaacgggatataatggcatcttcatgtccgaccatgtgcccaattggtttat

SEQ ID NO: 17191 - DNA, 523 bp, Sorghum bicolor
  unsure (1)..(523): unsure at all n locations
  Clone ID: LIB3476-010-P1-K1-D3
cccacgcgtccgcaatcatgtctgggaagttaactgctgagcagttgacaaaattcacactatatgctgaatggctaattttgtccacatggtggattggagacaactggtcctccctgatgcagtctgtcggagcaagtgaaaaagtttttcgtttgatggatctccttcctagcaagcagcttagctctgaaggcctcaagttagagaagttgaaagggaaaattcagtatgctgatgtatcattttcatatccatcaagacctacggtaccaattttgggaggattgaatctgacactgaatccaaatgaagtagttgcaattgttggtcttagtggaagtggcaagagtactataatcaatttactacttagactatacgaacctacaaatgggcaaatactaattgatgggtcccactcactgagcttgatatcaagatggtcaaggaaaagaaatggttcgtcggacaggaaccacgcttatttccgaatggatatagctctaatattanaatatgg

SEQ ID NO: 17192 - DNA, 432 bp, Sorghum bicolor
  Clone ID: LIB3476-010-P1-K1-E1
cccacgcgtccgatcacatcccaggattctcgtatataactctactactccataacgcttattactatctcacatttatcctgtagacatttctagtaatccttagatctcacatttacctttctcatctgacagtcttttaccaacagaaaacaacagaaggatgaaggctatcgatagggagaccaagacgatcctaaggggaataatagagaagagacatgaggccatgaagaacggtgaacccaccaccaccagagatgacttgctcggcatgctattagagtcaaatatgaattacacagattcagacggaaaatccagccgtgggattaccctagaagaagtgatcgaagaatgcaagctgttctactttgcaggaacagagacttaccgtgtcctgctgacatggacaatagagtcttaagcatg

SEQ ID NO: 17193 - DNA, 423 bp, Sorghum bicolor
  Clone ID: LIB3476-010-P1-K1-E12
aaaatttcagtcatggcaagaataaaaacacttagcccattttagtactttcatcttgctgaaaatactctttctgttgcccacctttatctgctatagccctgcaattgcctaatacatctgcattttttagtgttttcatcattgtcaatagatttcggttggaaccattgtatttttacatggtcatgattctactgctttaatacttttatcttggtggaattactctctctgcttcacaccttggtggtgcaacgtttttctgccaacctgcagggttcaagttgttcaactcctttttggaggatattgcttggttggagagtgtcaagagggagctccaggacgtagttagatgctaattgaccttttgctattggtattgtactattgcttcctaattccttttaaaaaatgatg

SEQ ID NO: 17194 - DNA, 369 bp, Sorghum bicolor
  unsure (1)..(369): unsure at all n locations
  Clone ID: LIB3476-010-P1-K1-E5
ggcctcgctgggtcttcacctccgctccgggtctctacgaccgcggcggcgcggccagcaggagcagcggcagcagagccacggcgcatcgtcgcggcggaggctggagcttacccagccggagcccctgggctacaccgcctttggactggctctcacccgccccagaccgcagccgttgtgccacgtcgtggcggcgcgcagccgcctccgcccagccaactcgtgagcccggccgacagcgtgaaattaatgagggctagcttcattgaaatgnggggagcgatgtgagagaaaaaactagcgttcaggtaaaaacattgataattgctgcggagcatgagatgatggcaaacgaacagcacgaca

SEQ ID NO: 17195 - DNA, 445 bp, Sorghum bicolor
  Clone ID: LIB3476-010-P1-K1-F11
ccgcgtccgcgacggcacggcgttcgccgcgttcccggcctcctcatcgaccgccgcggctgcgctcgccgtcgacgtgcatcccccaccgcaggcaccgtgcatccctgacgatttcctggacgaggacatcccagtggtcatggagcccgacgagatagtcccggtgattgaggaagaccccgtcgtcccgatggacatttccggcgaggtggaagccgaaggcaatgcggcccagggaggtaaggccatcaaggatcgcatcgatctcgagtcggcgcagaccaagaaggcttcgcccaaagacctgaaggagatcgccgggagcttctgggtcgccgcctccgtgttcagcaagaagtggcagaagtggcggcgcaagcagaagctcaagaaggaggctgccgtgagcaaggccgcggcagcggcaatgccccctccggag

SEQ ID NO: 17196 - DNA, 441 bp, Sorghum bicolor
  Clone ID: LIB3476-010-P1-K1-F7
gttcccaatctcgtgtccgcctctcctctttccctcgctcggtcgctcccttccttccctctcatggccgccgccgccgcgcgcttcggcgacccggcggagtccacgcgcctgcgcatcggcgacgagatcacgtggtccgagatcaacggcgtgtacgaccgcgacgactcgctcaaggagaacaccaaccccaagtccctcctcaagaaccaccaccccggcgccggcccccacgccaacaacaacggcacctcgcagcggttctcgggcaacctcaagccgacggcggcgcccatcatcggcctctcggggaagctcggccaggggcgcgggggcggggccggcatgggcatgggcatggccacccgcccgccatgttccccaagaataaggccaagacgggcggcgggcgcgcgttcagagccgcgtcccggagcc

SEQ ID NO: 17197 - DNA, 475 bp, Sorghum bicolor
  Clone ID: LIB3476-010-P1-K1-G1
atacatattgctcttgatgcataatatctttttcgaaaggaaacagagctgatggggcttcttccaggagtattttctcaacaatttccaattgcactgaggttattggcgatgcattgttgggaaacatcatatttatgatcattttactcctgggagtgcgatttattctcaaattatctttcgatgttataaggtatagggatgttctgttcgctgtcatcatttcaagctacttcaagctgttccttttcacaatgatggtttgggagtttccatcatctgttatattcattgttgaaatgtttgttctctcatcaaatgttgtagccctgagagttgtttcgcagtttccaaaagcccacttgtttccggtctgcttagtagcgcatgcagcaaaatacttaacccagcgatggatccttggaacgccatgaaccctgaactcgtccagaactccagatcattctggagc

SEQ ID NO: 17198 - DNA, 554 bp, Sorghum bicolor
  unsure (1)..(554): unsure at all n locations
  Clone ID: LIB3476-010-P1-K1-H1
gcagaaatcgggatggttttgaataatgtgagactagttgcaaaagctagagagcaagggaatgatctctttaaagctgccaagttttcagatgcatccatggcctatggtgaagggcttaagtatgatccctcaaattcagtgctccattgcaatcgagctgcttgctggtcaaagttagaaaagtgggaaaaagctgttgacgactgcaatgaggcactaagaatacagccaaactatacaaaggctctcttaaggcgagctgcgtcctatgctaagcttgagcgttgggtggactgcgtgcgggactatgaggtgcttcggaaggagcttcccagtgacaaggaggttgctgaggcattgttccatgcacaaattgccttgaaggcgactcgtgggggaggtgtatcaaatatgaagtttggaggagaggtagagatagtttccaatgtagagcaactccgtgctgncattaagttcacctggggtatctgtgtctacttcatgtcggcaatgaatcagcaatgcacacaaattacaccatcagtcaacac

SEQ ID NO: 17199 - DNA, 405 bp, Sorghum bicolor
  Clone ID: LIB3476-010-P1-K1-H7
cccacgcgtccggacaaactctaccatagtggggtggttattggcatccatgtcaccttcagtcagtaaaatggtggaaggtatgcacactgcagcacaaatatggagaaccttaagtaacatgtattccaggcgaggtaacgtgatggtgatgatggagattcagaataaggctgacgcagtgaaacaagcggggcaatcagtggagcaatatgctagtgagttacagtacttgtggggagagctagactactatgctccacttcgtatgagggatccacaggatacattggatgtccagaagtggatagaggacaggagagtgactcattttctgaagaatttagacccagagtttgaaagaaggagggctgctttttgccatcaagatagtcttcctaccat

SEQ ID NO: 17200 - DNA, 370 bp, Sorghum bicolor
  unsure (1)..(370): unsure at all n locations
  Clone ID: LIB3476-011-P1-K1-A1
ctccaatctctttcgctcaaggagctctacaacggccagtgcttctcctatttgatcacccagtcgcccaacctcaaaaccctcaagattatcagatgctcgggtgactgggacatcgtgctccaggacgtcccgagggattccctcctagctgagctccaccttgagaagctgcaggtcangcgaccgggtgtagccgccttaattgggctcgaggtactctaccttgccaaggcacctgaggtcactgatgttggattagccgagcttgctgccaagtcgccatgcctccgcaagctgcatgttgatggatggaaagcaaacccaggatggtgaccggggcttgctgtgttgcaacagaatgtgccag

SEQ ID NO: 17201 - DNA, 239 bp, Sorghum bicolor
  unsure (1)..(239): unsure at all n locations
  Clone ID: LIB3476-011-P1-K1-A4
gatttgttgagcccagttgagaaggttggcatcctgaacagtgctacttgcaaagacaatactggaagaggccaagctcgntagaccccaagacaccaaagaatctgtggtcttaaatgttgatcaggctacactgggaaatataagtggtaggattaggaaagaagtacttcagtcttgtgtaaagaaatcttggagaatagaagctcagagttactgagtatctgcagacaggtctg

SEQ ID NO: 17202 - DNA, 415 bp, Sorghum bicolor
  unsure (1)..(415): unsure at all n locations
  Clone ID: LIB3476-011-P1-K1-A5
cccacgcgtccgacgcggtggtggccggccggcagcagcaggagcagcggtggtggccgtcgtcgcgatcagggccggccacccggacttgcaccacttcagggggcaaggcgtgtaccgagggcggtgcggcagcaggttcaaccacgccgtcgccgtggttgggtacggggaggacgcggccaccggggagaagtactggatcgtcaagaactcgtgggggaccaagtggcgcgacggcggctacatcaagttgaagaggcaacaagtccccgccgccgccggcagcccagcagcagcggcagcagggggctactgcggccctgccgtcagagtcagaccacctttcgtcccaaccatgaccatgtgatatgcagatgcgcatggttccaaaacantgcatgatgcatatgca

SEQ ID NO: 17203 - DNA, 488 bp, Sorghum bicolor
  unsure (1)..(488): unsure at all n locations
  Clone ID: LIB3476-011-P1-K1-B1
cacagcttgagctagagatcaaagaaatcaaagggaagcatggcagcaggtttgcaagtgtttggccagccggcatctaccgatgttgccagggttctgacatgcctgtttgagaagaaattggaatttgagcttgtccgcatcgatacatttaagacacatcacaagcttcctgagttcattaggctgcgggatccgaatggccaagtgaccttcaagcatggcgacaaaactcttgttgattcaagggatatatgccggtatgtttgtaaccaatttccaaatgacggaaacaagaccctntatggatctggtgctctagaacgggcatcaataggacagtggcttcaggcagaagctcaaaactttggccctcccagttctgcacttgtcttcagctggcattttattctcatctagtcatctgggcattctcaggacccctgctgtatgctgaaatgggataactgaagcagccctgtgtatga

SEQ ID NO: 17204 - DNA, 493 bp, Sorghum bicolor
  unsure (1)..(493): unsure at all n locations
  Clone ID: LIB3476-011-P1-K1-B11
ggtggctgggctcgagctgctgaattcgatctgtgcggtgcacaggccagcgagaagcatgattgttagcattggtgcggtgccgcagctggtggaattgttgccggagctagcaacggagtgtgtcgagccagccttggacatcttagatgccctgtctgcggttccagaggggagggtggcgcttaaggattgtccacggacgatacccaatgctgtccgcttgctgatgagagtttcggaggcatgcacgcgacgggcgctgtcgatgctgtggacggtgtgtcggatggctcctgaagagtgtgctcctgctgccgtggaaggggggtggccgcgaagctgcttcttgtcattcaaagtggttgtgcaccggagctgaagcagaaagcatctgagctgctcaagctgtgccgncctaactacactgacaccctcttcatcttcaagtgcaaactcacaaggacaattcaatgaggagatgcaaatgatg

SEQ ID NO: 17205 - DNA, 428 bp, Sorghum bicolor
  Clone ID: LIB3476-011-P1-K1-B12
ccccaaccctcctgctccatacgtcggaggttccctccaagccctggacaacgccttcaaatgggcagagaagtacaagctgggtgtcatcattgacttgcacgctgctcccggatcacagaacccctgggagcacagctcctccagagacggcacgcaggaatggggaacaacagatgccaacattgcgcagacggtgcaagtcatcgatttcctcgcatccaggtacgcgacgagctcgagcctgtttgccgtggagctgatgaacgagccgctggcgcctggagcgacactggacagcctcaccaagtactaccgcgacggctacgacgccgtccggaagcactcgccgacggccctacgtggtcatgtccaaaccgccctgcgtcggggaactccacggagcttctccagttcgccagcgggct

SEQ ID NO: 17206 - DNA, 385 bp, Sorghum bicolor
  Clone ID: LIB3476-011-P1-K1-B2
cggacgcgtgggcgagcacgcgatcgcgtacacggcgccttcgcagcagcaggtgtacggggccaaggccaccatcaacgtgtgggatccggccatcgaggaatccaacggcttcagcctctcccagctctggatcctctccggctccttcaacggctccgacctcaacagcatcgaagcaggatggcaggtcagccctgagctgtacggggacagcaggccgaggctcttcacgtactggacaagcgacgcgtacgaggctactggttgctacaacgcgctgtgcccggggttcgtgcagacgagctcccgcatcgccatcgggcgcgtcgatctcgccggtgtcgtcggccggcggcgcgcgtacgacatgacgctgctatct

SEQ ID NO: 17207 - DNA, 311 bp, Sorghum bicolor
  unsure (1)..(311): unsure at all n locations
  Clone ID: LIB3476-011-P1-K1-B3
gtcaccaccctctctcaaattaaggcatttttaagccatcgatcaccagccaaccagcactcactcactagctccatccaactcgtacacgacctctccatccatcctctcgtccttccaacaactagcagcattagcagctcatcttcatcgaccgtccaaagcatcacggcggcagagatgaggcgctgcggcatcatcatctcctccccgctcgcggctgctgccgtgatcctcctcctcgtcgccggctgcttccactgcgccgccgcggctcgcctnctgccttcttcagtcccagttccagctat

SEQ ID NO: 17208 - DNA, 408 bp, Sorghum bicolor
  Clone ID: LIB3476-011-P1-K1-B6
tatgtatccaaattacacatcctatgatccagtcttgactggaaaatgccatgtaaatttttctgcactctcttatgtcatggagaagacagcatatgattgctccattcctttagcaccactagttgctgatgttatatgttgcccccaagttaatagcttgatgaatattttccaagctgcatatggcagtggaaacaataccctagttctcaaccaggcttcagcaaatgcttgtttctctgacattgtgaacatccttgcaagcaaaggggcaaacaccaacatccctgagttatgtactctgaggccatcaaatcttactgatgcttcttggcctgtgaaggatgttagctcctttgagaaaatagtcaacaccagtaaacttctaaatgcatgcagcagtgt

SEQ ID NO: 17209 - DNA, 456 bp, Sorghum bicolor
  Clone ID: LIB3476-011-P1-K1-B8
cggacgcgtgggctagcttgctagatttcggaaaaaaaaaaacgaaagtgtccccaactcgaaccgccgagaagcccgcccgccgccgccgagagatggctgccgagtacgacgagcgctaccagggcaacggcgacacagccacggccgagggcggccacgcgcaggccgagtacgccgccccagccgctgccgtggcgcctgccgccgggggttcgccgcccgccgacagtaagcccgctgggttctcagaccacgccgacggccgctcgtcccagccccagcacgagacacaatcacatgacagtggttcctccaaatctcgagaaagggaccgcgaacgtgataagagcaaggacagggagcgtgatagggaccgtggccgagaaaaggagagggaccgggataagggacgtgaaagaggtgacagggacagaagagcgtgtcgccaccaca

SEQ ID NO: 17210 - DNA, 425 bp, Sorghum bicolor
  Clone ID: LIB3476-011-P1-K1-C8
cggggaaagggagaaattctgtctggtacccctacctgtctcagctacccagctactacactatcttggctacctttgacgattttgaagtcgaagctcttcaagtataactcggttgatgatgccatttgggttgcacagaaggctaaaagtgccataaaatcagactgggaagatgtgacaccactcatgaaagaattggaatttaaacctaagcttttgatgtttaaatcctggctctgggcatttgcaacggtatcttctcgcacattgcatattgcatgggatgaagctggttgcttatgccctgtgggtgatttgttcaattatgctgctcctgatgatgatactgcattggaggcagaggatgcagctgaactaacgaattaccagcaggaaaaatgagatgatcaattcaatctgag

SEQ ID NO: 17211 - DNA, 355 bp, Sorghum bicolor
  Clone ID: LIB3476-011-P1-K1-D12
agaaaagctgagcacacacgcatgccgaaacataagagcacatccaagatgcgggagcccaaggtgcgacggcagaacatgctaccgtggagccggcggccaagaccagcacgaccacctgatccgggatatgcgagacgacgaggacggtactgactggcagcgcgtaccgcacgcattacaccgtgccatgcgccgagtactgccaaggctggaagagctccgcttacacaaccaggcttcgcctacggacgcacgcacgcgagcaccaacgatgacgttgtctactatacgcataacgtggacccgaccgccgccggtgaccacatcctacccaaatgcgacgacaggaccg

SEQ ID NO: 17212 - DNA, 470 bp, Sorghum bicolor
  Clone ID: LIB3476-011-P1-K1-D8
atatagttgtatgtcaacttcgggtcgtttttcgattatgatagcttttattggaaaaaaggcaaaaacttcatttattttcttttctgtggggaaaaatggttttgttggttacccttgcatatggctgctttgttgtagatttaattaaacctttttggtgacagaacaaggtatcagtaacacctatgaatctgtgctctagctgtagcttaattttgttaacacttttttttctaatcactggaaaatatatgaaatatatccgactcattttcagtttctgtagaaaagagaacatggcattgaatgttctgtaccaccattaatgctgtttgttatttgtaatgccacatgaataatcatgaatgctcactgtacacattcctacctgccacgataggtagaggcatatgctttcagctgcagagcacagacgaaatggcacaattgcagcgtacgtgacagat

SEQ ID NO: 17213 - DNA, 446 bp, Sorghum bicolor
  unsure (1)..(446): unsure at all n locations
  Clone ID: LIB3476-011-P1-K1-D9
gttagctaagtctactctcaagattgaagaggaatttaagcagctgatgagtacatacagcaaacctattgagccagatcgcctgtttgactgtctacccaagtctctgcggccaacaaaaggtgaccacgaggatggaggcagcaattctgatcatccatccaaaggcttggagactgctgtatacaggaccccaacactaattcctcccagaatattgcctctcatgaatgacatagctcagcagttggttcaggctggaaatcagcaaacttgctacaaaatctacagagattcccgtgcttcagctctagaagtgagccttcggaagttaggagtggaaaaacttaccaaagatgatgtacaaaaaatgcaatgggaggctttggaggctaaaattggaaactggatacactntatgcgaattgggtcaaattactactagc

SEQ ID NO: 17214 - DNA, 370 bp, Sorghum bicolor
  Clone ID: LIB3476-011-P1-K1-E3
ctttgctttccatcttcgtgactgtactcagctcagtggtgatagggtgctgctaatacatgtaacagatagattttgtagctacaatgcagagtttttattactatgtttctattgccaatcccgtagtctatttaatagcacatactactaccaagaacttcacctagaatggaattgctgctttttttgggtattctctccatatctacatttctcgggaactttcatgctatttctcctttttacattattacaatccagaggttacattattcttttgtttgttcccaggtatccgaatagacaactatttctccatttctatttctgcttttcatgttcacatgtgtccaccatggcttctgac

SEQ ID NO: 17215 - DNA, 397 bp, Sorghum bicolor
  Clone ID: LIB3476-011-P1-K1-E5
cagcagccgcacaacttgctccaccgttgggggcgctccctttgtgccgccgccaccttcctccactgctcgggccaaatcgagagctctcggctgggggccacgcgagctccggcaggatccgtcgccggcggcatccttgctagtcgcgcttctcctcgggtcccacctctgccgcgaacactgcccctgctgcgcctgccgtacccgcccagtctcgtccgtcgccattgctgttgatgctgcggcggtggatctcgcacagtcgcacatggggtaaggaggtagtagagccggatctcgcacacaggcggaggacacacagacggatctggcttccctcttggtaatctcgtgtccttcctcgggtctgtagttatgtcagccacttatttat

SEQ ID NO: 17216 - DNA, 363 bp, Sorghum bicolor
  Clone ID: LIB3476-011-P1-K1-E8
ctagattcaaccaaccagtagttagcgagcagcagcagcagcagcagcaacaggcatggaagcagaagtttatgggctcacaatcgatgtcttttgggggcttggtttcgcttaactcacccactagcaaagatggttctgctgacaacaaaattggccgtgatgtgcagaaccagtccctttttagccctcaagttgactcttcctccctgctgtacaatatggtacctaatttgacctcaaatgttgcggataataatatatcagtgattccttctggatcaacatatctgcagagtccaatgtatgggtgtctggatgactcttctggtttattgcaaaatacaggaaagaatgatccgg

SEQ ID NO: 17217 - DNA, 309 bp, Sorghum bicolor
  Clone ID: LIB3476-011-P1-K1-F10
ctcagcgccgcagcctatgagcgcggtcggcgcctgcgatagacgcccacaggacatgcaaggcggaacagactgagaaggctctattgacacccaactaaggtctgctcagctcaaccaagtctatggagggtgagaagcctggcatgggaggcaacctgctctgggcgagcactggtcgcgggatcatgactgccaacgaagccatggtagggtcctacagcgtcaagatatgactatacactgcaaccgtttctatcaaatgcagaatcctagctgagacgggccacagtgctaagatgaacagaa

SEQ ID NO: 17218 - DNA, 434 bp, Sorghum bicolor
  Clone ID: LIB3476-011-P1-K1-F12
cttagaaatgctgttagtaaaacatacaatcggatcagtgacctccgaaaggaaattcaatcactcaagaaaggtcttctagttgctaaagaggcaagtgcaaaagccataaaggagctggaggaggccaaatcggtgcttgagattgtagaggggcaacctgcaatagctgaaagaccaggtaggataaggcgactcgaatcacatgtcaaaaatgcagaggacaaggaaagaactattgaagaatctttagaagtgaagggagctctgcttgctcgggctcttgaagaaagcaaggacttgcttaagttactatttaagagctttgttgacgttctcacttgacgtttgccgcctgtctctgttgatggaaaaattcctaatctacgcacttgagatcaagatgtaaatttttgaccttcaagatcctgaag

SEQ ID NO: 17219 - DNA, 247 bp, Sorghum bicolor
  Clone ID: LIB3476-011-P1-K1-G3
ctttattctgcccttgaatggtcattcaatgatgtcttctacactttctctcggttgtatcatattacaaacaatcaatacttttcaagttagtgtgaaatgcaatgtcagttattcagttaacctagcaaagatagaaataactaccagcagtgttgatggtactgtccaggcaggcattcacataggtagataggtgatgctctattctattctgaattatatctagctcttacgaaccgaacct

SEQ ID NO: 17220 - DNA, 407 bp, Sorghum bicolor
  Clone ID: LIB3476-011-P1-K1-G9
gctcgttgacctcagcggcaacggcttcaacggctcgctcccgtcggacttcggcggggcacggctgcgcctgctcaatgtctcgtcgaataagctcgctggcgcggtgccgaccgagctggccgcgctcgtccccgcgaacgcgacggtggacctgtcgcggaacaacttcaccggcgcgatcccacaggccggcccgttcgccgcgcagccggcggcggcgtacgagggcaacccgaacctgtgcgggccgccgctcaagcaggcgtgctccatcccgtcgtcgctgtccaaccctcccaacgccaccgactcgccgccggcgttcgcggccatccccaaagaaccccgtcgtgccccgccgggaaccccgggtcagccgccgagcgagcaggataagcttcgtc

SEQ ID NO: 17221 - DNA, 400 bp, Sorghum bicolor
  unsure (1)..(400): unsure at all n locations
  Clone ID: LIB3476-012-P1-K1-A1
cggtttttacanaagcgccgaggcgctggcggcggaggttttacaggtggtacaagaacaataccctccccgcaacacgacatgcaaagtcagttagtcagtagcattggtacaccgagtctaaaaaccagaaagttccccatcttcgagcaacttgagattgtgacagcttaacatcgactactaaggccttgttcagttcgcaaaaacttgcgaaaaagggcactgtagcactttcgtttttatttgacaaacattgtccaattatagagtaactaggctcaaaagattcatctcgcggttatagataaactgtgcaaaatagttttgttttcatgtatatttaatgcntcatgcatgtgccgcaagattcgatgtgacggggaatcttgaaaaattt

SEQ ID NO: 17222 - DNA, 383 bp, Sorghum bicolor
  Clone ID: LIB3476-012-P1-K1-B12
gcgtgtacatctgtaacgcgcactactggacgacgcaggtcatccgcacaaaaacgtactgatctcactctccattcgaggccgggggtgggtaggtacacttggacggatgcccctggccgtacaacctcatcgacagctacgcccaaaaggtcccgcgagacaaatagacatcattggtaaaataaatccggtactcgagaaatgagatgtacatttctttgctgtctgtgcaccatagccatctattggtgtggtaacgcactcaccgaactttgtacatactactgcgtggaaacttaccggattccatctcatcacattgaatacaccgatcgcagatcatccttaccaactccggctaccatactctcactccataa

SEQ ID NO: 17223 - DNA, 455 bp, Sorghum bicolor
  unsure (1)..(455): unsure at all n locations
  Clone ID: LIB3476-012-P1-K1-B2
gggagcgacgcggggagcgcggcggcgaggtggtgatgctggccgcagcagcgagggagaaggaggaggaggcgcgggagcagctgcgtcaggcggtggcggagaaggcggcggcggacgaggcccgcgcgcaggcgaagcggcacgcggagctggccgagcaggagctggcgagcgccaagcggatgcggcggcaggcgcaggtggagctgagccgcgcccacgcgctccgggagcacgccgtgcgccaggtgaacgcgacgctcctncagatcacctgcctcggctgccgccacaagttccgcgcgcgggcgccgcagctgatgatggacgccgccgtggcgggcccncgggtggcctgcagctacatgtcctccgtcgtgacagcagagggcggcgacgccgaggtcgtcgacgacgagccgccgcccctcgacggcgcggacgccatgcta

SEQ ID NO: 17224 - DNA, 465 bp, Sorghum bicolor
  Clone ID: LIB3476-012-P1-K1-B8
catgggctcactgaaattgctgagaggattgctgctgaattaggcgagaatgttccttgtctgcctgaaggaaaatcacactcgctactgattccccctgcacctctcacagcctgcggtgattggccattgctgagggtaatgcgtggtattttcgaaggtggactggatgctactggaagggcagagcttgaggaagatgatgaagcttctggtgctgactggggtgatgaagacttggatattgttgatgcaagtgaagtggtggcaaatggtggtgattattttgatgcggaggagggtgaaccaaatgaggaggatggtgaggaaggtggctgggacttggaagatctggaacttccacctgatacagagactccaaaatctgctggcaatgctcgctctgctgtatttgtcgctccaacagcaggcatccctgtcagccaaatctggacacaaaaatct

SEQ ID NO: 17225 - DNA, 461 bp, Sorghum bicolor
  Clone ID: LIB3476-012-P1-K1-C6
caacaaacggctcctaaatacagacaggcttggcagacctgaaagcttatcagtggaagcgtcaccgactgttgggagtgattctgcatctgacattggtgatactgagcaatcaaggaagcaaaccgcgcagcattcgccttcttcagcagccaagccaggtcatgaggcggtcgggagcatcagccacagggctcctcaaagaaggcaatcgattgccaaggagggccaagatgggtcctcgtcatcatcctctcattcgaagtggaatcttgcgcagaaacaatattcaaatagcccattgataagagggcttcatggatccagcagactagaggaattcggtggaagcataccaccagcagcgtcaacggcattagtaaaactgacaaaccggctcaacttcctgaaagaacggagggcgctgctggcaagcgagatgcaaaagcttgaattgggtc

SEQ ID NO: 17226 - DNA, 409 bp, Sorghum bicolor
  Clone ID: LIB3476-012-P1-K1-D2
attcttggtgtcaagttgcatcttttacctttgaatatacactttggagatttgggattgactactgatccgatgggcagttgtagtctgcttgatgctttccagtctgatcaagcttctgtatctaactcagagaaaagcttggccccatttgcttgtgaagatttgttggttacttgtaacttcggccatgaaaaggagaaaggtattaaaatcattaacctggaattcaaatgtgggtatgctattgccaacattgatgaaaggatgtttcacaagaagcacatgattccagaatataacactgtctctttgaacactggagattctatcagagataattcagcaatcaaacaaacatcaaaaagcaaatccattctaccgctttaaagaaacaaattctcgtatt

SEQ ID NO: 17227 - DNA, 376 bp, Sorghum bicolor
  unsure (1)..(376): unsure at all n locations
  Clone ID: LIB3476-012-P1-K1-D4
tgcaaatgcaacaaagaatgaatgcaaagaaaattacatttaggagcatcctagttatcttactgattacccaagtgactcctgctttccttactttcagcacccagttattgtgaaaaaagacacatcattgtaaataagaggaaataagcacccaaatttgagttgaagaggacttgaactaaggttcttggagtgtacacctatacctnccaccaactgacctcctaccatttagtctgaaagaattggattatttccactaatttccagttctcttttgtatctgcaactatttagggcattatagtcttttgtgctgactaccttccctgtttcttttaactataaactgggttgtgattttgcatgcatg

SEQ ID NO: 17228 - DNA, 378 bp, Sorghum bicolor
  unsure (1)..(378): unsure at all n locations
  Clone ID: LIB3476-012-P1-K1-E4
ggagtcttaccatcgcgcgctgtgataggatcaccagtctggacttcgtgcgtgtgcctaccctgcgttccttccgctactatggctgcccctccaacttgcccttctccattccacgcgatgccgtgctttctgatctttatattcagctatactcatatgatccagtaccgatgaaagagtggaatatcgataagttgaggaaatctctcccggaggaattatccagcctcggtgttctcaccatctgttacaaagccctcacgggtgcatctgtcttgccagccgatggagccagtgcccagttgaccaatttcaacttacacagtttgaaagagctacaccntacgcatgttagaaatgaaagctgtcaaccta

SEQ ID NO: 17229 - DNA, 483 bp, Sorghum bicolor
  unsure (1)..(483): unsure at all n locations
  Clone ID: LIB3476-012-P1-K1-E8
ccacttcttggccagctgagcaattctcttggtgctgatcatggttacttgtttctttcttggctggaaactggagaagtggagagctctgaattgagattgtgatggtgtgctgaggccacttgacctgaatatatagtgcagtcgaactcagagtggaatggtgagtgcgatgttgcaagacgcgtctgcgagtacgatttggatgagactctgatgggggccgactgtgtgggctgaatgctcgtggtgtgctttcggtgcttggactgcacagaatccgtgctggcgcaccatgccgagcgngtgtctcgngaagtggcacgagggccccatgtttgttggggctaacgtggagcatgagggccagatttgttcagctgctgctgctgggccatcagatcattaccagatcagcttggatttaaagtttcaacaaaacgaagacaggggagcatggactgcatgcatgnctttgtcaga

SEQ ID NO: 17230 - DNA, 492 bp, Sorghum bicolor
  Clone ID: LIB3476-012-P1-K1-F11
ccactatttcctcccccgccccctctctcccctctcttccccgcagcggcagtcgacggcaaaaccctagatctctctccctcttaaaccctcaacaagtgcggaaggatgtcggagccgtccaaggtaatccacatccgcaacgtcgggcacgagattgccgagtctgatctccttcagctgctgcagccgttcggcgtggtctccaagatcgtcatgttgcgtgccaagaaccaagctcttctccagatggaagacatacatgcttccgtgagtgcgctgcaatattacacttctgttcaacctagcataaggggaaggaatgtatacatgcagttctcatctcaccaagagcttaccacagaccagagctctcatggaaggaattctgatcaggagtctgaacccaaccgaatcctcttagttactatccaccacatgatctatcctataacggtggaggttctacatcaagtattcaaagcttatgga

SEQ ID NO: 17231 - DNA, 518 bp, Sorghum bicolor
  unsure (1)..(518): unsure at all n locations
  Clone ID: LIB3476-012-P1-K1-F12
gttccttattatcgcgccagcatcaatcttctgtgcattcgttgcgaagggattgatggataggttctcttatgccctgggattgccggttatgattgcagcagttctattcacagcatatgatctgagtcttctgcttctaacttctgggagagatccggggatcatacctcgcaatgcacatcctccagaacctgaaggttttgatggcaatgcagaggttggggctaaccagactccacctgtgcgtttgccccgagtgaaggatgttgttgtcaatgggatcactgtgaagacaaaatactgtgacacttgcatgttgtacaggcctcctcgctgctctcattgctctatctgcaacaactgtgtggagcgttttgaccatcactgtccatgggttggacaatgcataggacttaggaattacaggttcttctatatgtttgtattctcaacaactcttgctctgcctgatgtctttgggttctgctgggtgctcattgntaagatcagaaatg

SEQ ID NO: 17232 - DNA, 369 bp, Sorghum bicolor
  unsure (1)..(369): unsure at all n locations
  Clone ID: LIB3476-012-P1-K1-F2
aatactcagtttcttgttgaatattttgcactggaccttctcatggacaatgaaggcatctgccaaggtgtaattgcgctaaacatggaggatggtacccttcatcgttttcgtgctgcaaatacaattctagccactggaggttatggtagagcctacttttcagcaacttcagctcacacatgtactggtgatggcaacgctatggttgcacgtgccggattaccccttcaggatcttgagtttgtgcagttccatcctacaggcatttatggtgctggatgcctgataacagaaggttcccgaggtgaaggtggtattcttcggaacaatgaaggtgagaganttatggaacgatatgctccaact

SEQ ID NO: 17233 - DNA, 240 bp, Sorghum bicolor
  Clone ID: LIB3476-012-P1-K1-F9
gtactgcacgcatagaatccacattcgagcaaacatggtactggtgaggagcgcatatgacagtaacgtgtgcatcgaccagggagaggctgacaccaactctgctgctcaggtgaatatgcccaccatgtgtttattctatctaccgtgctgaaattgggcttatgctgatctgctgcgagacgaaaacagtgttcatatattgtaaagtactgatgacaaacaggcccaattggtctt

SEQ ID NO: 17234 - DNA, 319 bp, Sorghum bicolor
  Clone ID: LIB3476-012-P1-K1-G1
gttcctgcaggtgtaccgcaagaagtcgacgggcgggttcagctcggtgccctacgtggtggcgctcttcagctcggtgctgtggatcttctacgcgctggtgaagaccaactcgaggccgctgctgaccatcaacgccttcggctgcggcgtggaggcggcctacatcgtcttctacctggcgtacgcgcccccgaaggcgaggctcaggacgctggcctacttcttcctgctcgacgtggcggcgttcgcgctcgtcgtcgtcgtcaccctcttcgtcgtccgcgagccccaccgcgtcaagttcctcggcagcgtc

SEQ ID NO: 17235 - DNA, 518 bp, Sorghum bicolor
  unsure (1)..(518): unsure at all n locations
  Clone ID: LIB3476-012-P1-K1-G11
cccacgcgtccggactcatcgaccgcgcccgccggcaggctccccccgtcgccatgggtctcctctcaaacagtgcatgcgcggttattttctcccccttcttttgtgagaactttttttcccttgtgttgttgggataggattgggaaggagagcctcaaggtgggagatcacatctactcctggagggccgcgtgggtctacgcgcatcacggaatatatatgggtgatgataaggtgatccattttacaagaggaagtggccaggaggttggaacaggaactgtcgttgatattcttcttgtgagttctgccccaaaacgaagcaacacgccttgcccggtatgcaccaacgaaaccagtgataccagcacagagacaaacggcgtggtatcctcttgcctcagctgcttcctagctgggggtgctcttttaccgtttgagtatgcagtcaacccagcgctcttncttgccaaagcgcgaagagggaacgtgcactctgcgtgctctgatcctga

SEQ ID NO: 17236 - DNA, 383 bp, Sorghum bicolor
  Clone ID: LIB3476-012-P1-K1-H2
cttgtcatgtcaaagcaagctgaagctgccagtctgctgtacaaatcaaacctcaactctggtagtgtgctggagtatgctcttgcattcacaagtgctgccctggatagacactacagcaaatggagcgcaactccaaaaacagggtttatcgacattactacttcaaaggacttctatcgcatttttagcggtcttcagtatagttacttagaggatagcattaacaatccttcaaagaaacaggaaatgctgggtgattctgtagcatgggctggctgtacgatcatgtacttactgggacagcagcagcacttcgagctttttgatttctcctatcaatttcttaacgtggcagaagtagaaagtgcacagtttcacac

SEQ ID NO: 17237 - DNA, 280 bp, Sorghum bicolor
  Clone ID: LIB3476-012-P1-K1-H7
ggctgcatcacgttatagtatgcactgctccaatcagcatagctaaatctcgactaatgttaccacacaaccaaccactcctgggtgtggtggctcgtcgtgcaagtggagcccatctaccgacttcacctttacatgagccttacctgcaggtgagctcaccttactctcaggatcacagcgcttgtcgttattgagggcggactcatgtggttcatagcagagcacagagacgactgcacgtgctccttaactcgcggatgcacctgccgactatact

SEQ ID NO: 17238 - DNA, 174 bp, Sorghum bicolor
  Clone ID: LIB3476-013-P1-K1-A10
ccctaacctctgcgccagacttaagactaccatcttgccgatagcggcatcagtcggcgagatggtgctgtacctgctgcatgagtgatgctacgagtaccgtctattacacgcgtacggaatccatgagaaccgccagagcgtatcagccggacgctactgacagctggacct

SEQ ID NO: 17239 - DNA, 413 bp, Sorghum bicolor
  unsure (1)..(413): unsure at all n locations
  Clone ID: LIB3476-013-P1-K1-A12
gctgctgcgcctttgttcccatgcgccgancangntgctcctctcacttgctcacgccatcaagaatcttcccccccccccctcttcctcctcgctcctcctgcctggcctctctctcccctctcctccctcctgtgagtgagtgagctgtagccgagcggctagcggagcgagtaatggcatggggagcttgcactgctgcgctcctgctgctgctcctcctcgccgccgccgccgccaccgcagcagcaggtggtaatggcggcggcgtgcattgccttcaccttgaggaggacgggagccggcaccggcaccagcaccacctcagcaagagagccttgcggcaggggaggcagaggcacccgcaccacctgaggtcaagagcccggggtggcgccacggtgctcgagctc

SEQ ID NO: 17240 - DNA, 444 bp, Sorghum bicolor
  unsure (1)..(444): unsure at all n locations
  Clone ID: LIB3476-013-P1-K1-B11
cgcccatgccaagttgcttgttgagagtggcgtnnacttctgatattggaataattactccttactctgcacaggtaacctgcctgaagatgatgagaaacaaagatgctaaattgaaagatttagagatatcgacagttgatgggtttcagggccgggagaaagaagccatcatcatttcaatggtccggtctaactcaaagaaagaggtggggttcttgagtgatcacaggcggatgaacgtggcggtgacacgcgccaggaggcagtgctgtctggtgtgtgacgtggagaccgtgagcaacgacaggttcctgaaacgcttggtcgaatacttcgaggagaacggggagtacttgagtgcttcagaataccagagcagctgactggcgtcaatcaaattaaatccaactactctagtggttcgtgcaactgatgcttttt

SEQ ID NO: 17241 - DNA, 468 bp, Sorghum bicolor
  unsure (1)..(468): unsure at all n locations
  Clone ID: LIB3476-013-P1-K1-B3
agctcgataggtgcgctggcgaataccatcgatcccccnncttcggccgacgacgaggacgaggaggaggaggagcgctacgtgctcgtcggcatgcagaccagcggcggcgacaagatcaggttagtcgccgtagccgaccagcgctacgtggctatcaccggctntgccaaggggttcagctactgccccaactggttcttccgagagggcaagcgccaccgcctcgtcgtcacggcggcgttggccaacgacgggggcagcagccacgcagaggtcgtcgcctccaacctgcttcgtgggctgaagactaattaacggcggcagcggaaaggcttagtgagttattagtgatctgctcatgctattagctaaggcggcagtgccagactgccagtctcactgatctcccgcgagaataacaagctaatgacgggtaattagctagcagtagtatggattaattat

SEQ ID NO: 17242 - DNA, 418 bp, Sorghum bicolor
  Clone ID: LIB3476-013-P1-K1-B6
gcgctctcgactctcccgcgccagacgtcccttcgctggccccatcatggtacgccctcaccgggaagacgaggaggccgcctcaccgctcatagccgcgccggcgggcggcggtcggagccacgccgccgacgcgcacgtgctctcggcagccttcctcttcgtcttctccgcctacagcgccgcccagaacctccagagctccgtcaacaccgagggcgacctgggcaccgtctcgatggggattctgtacacctccttcacgctcttttccgtggtcgcgtcgcccgtggtcacccgtataggccccaagcgcgcgctcatcgtcggcaccagcggatacgtgctcttcattctcgccaacctcgtcccgacatggtacacaatggtgccagcttcactctatcttggttttact

SEQ ID NO: 17243 - DNA, 515 bp, Sorghum bicolor
  unsure (1)..(515): unsure at all n locations
  Clone ID: LIB3476-013-P1-K1-D12
ccaagtttgatggccacgaggcccctgagcagcttctccgcgtcccagatctccgggcaccgccgtctggttcctcccggccgccgccctcctcctcctcgtgctcctccgctggtcgcccatgggctcctaccctcccgtctcccctcgcggctccggctcggtcccggcccagcgcgccgagctttactcgaagatggcgcgtgacctcgacgagcgcggcgcggcgttcctcaagggcggcgagacgncgcagtcgctcacgctctcggacctcttcgacaccgcagctgacggtgccgtcgtgcccaggctcaaggccgccgacccgccagtgcgcgcgaatgtgctctatatggaccccaagttcgctgctgtgatctcgaaggctgtcaaggacgtatntcttccttattttgatcaagctatctggttccaaaatacgagcatgtaccacttcagcatgtttcacgcctcccatcacttggagcccattgtagcaaccgaggatgaga

SEQ ID NO: 17244 - DNA, 420 bp, Sorghum bicolor
  unsure (1)..(420): unsure at all n locations
  Clone ID: LIB3476-013-P1-K1-E8
caacgtgctgctatatgatcagagccnnngnntattccgtcggattcatctgttgccttggtgccaccggaaaatgtgggcactggtgatttctacccagagtctcaggtggcggcaacctatgcggtgttgcttgctgtggccttgatgctgcaattgttacccataggtggcagtgaaacgcagaactagatggctagttcacagcctgttgccatggtctttggcatggccggccgggcaacctattttctactagagttgctccatccttgtgttcccgcgctccatccattgggtatatcttatatttttttccgtgtcacatgaatgctatattatttgtagctcaacaaatacaattttctcccctttctgatgtatgaagttttccggagtgaatggtatcatcccctttct

SEQ ID NO: 17245 - DNA, 466 bp, Sorghum bicolor
  unsure (1)..(466): unsure at all n locations
  Clone ID: LIB3476-013-P1-K1-F11
ctgacgtcagcgtggagaacatggatcatgcttctagctcgtccttggaagtgaaatctgacgtcaggatggaaaacatggatcaagctcctagctcgttgaaatctgacaccagcatggagaacatggatcatgctcccagctggtgtagcttgggagaaaacggttattttgatgctgaccctgagtggttgatacacgcggaaagtgccatgcagcagtatgaggaacaaagcaggggatcacagtcacaagcaacttcccaagtgtttgatctgtatagcggggtcacgtcagctgtctagaagaggtacgtgtttattcgacgtggaaggaagagaaagatgctaactactctcagttccaaatntaacgatttacaatttgaatgatgagagtagttaatagatggctgtgagcgtgagagacccccccctccctctatagacaatgtttttnttttcta

SEQ ID NO: 17246 - DNA, 408 bp, Sorghum bicolor
  unsure (1)..(408): unsure at all n locations
  Clone ID: LIB3476-013-P1-K1-F3
cccacgcgtccgccacgcgncgaataagctcccnnncccaataagaataaaggtataagtttggtaatgcttactacatgcagtgtctattgattgtattgttttggtccatacacataccaatctgattatttctgattattgctatcctagtgcagctttgagttcatttgcgctggttaatttaagactgcaagttttttccttctatacattatacgaaaattggtttcagttaaaaggcttgtgacctgtgatcatacattagtaattttgagatgacatatacatgagttttcataccttgcttgactgccaatgattagtttttcgagatgacatacatgagtttgcatactttgcttgaccgccatagccctaataagctattttctgtctatgttctgc

SEQ ID NO: 17247 - DNA, 221 bp, Sorghum bicolor
  unsure (1)..(221): unsure at all n locations
  Clone ID: LIB3476-013-P1-K1-F8
tcggcatctcgctgaccccgccanannnnaatactcgcccgtgcgggcctggatcgcctactcgccgcgccgaaatgcgaccgcatctcctccgcttcctcttgctcctcctcctcgccgccgcctgcctcccgccgccggccgcgtgccggcacacccccacgcccccgccggcgccgcggcagcagcagcacaacgacagtggcaccaacgtgcccacc

SEQ ID NO: 17248 - DNA, 399 bp, Sorghum bicolor
  unsure (1)..(399): unsure at all n locations
  Clone ID: LIB3476-013-P1-K1-G1
gaagcttatcgagcagctggagcggaggcgtgcgcngnggnatccgccctggtgctcaccaaagtccctcgtgaagcccactgtccttgcaagctctctgggacccttggcaactcgaactcaagagtcacagcacgcgcgtgctcgcctcacttcacttggcccggctgtctccacgccacgctccccacatnccctttcccctcctctccactctccagtaggtagagtggcaagaaggatggtggcgacgatggcgagctcgctgctgctccggccgcgcgcggtcctgccacaccatccttctagttctagctccagccgccggccattgccagccccgcgtgtacagctgcaaccgatcatccagcagaaaccgggcctcgcggcgagaagcga

SEQ ID NO: 17249 - DNA, 124 bp, Sorghum bicolor
  Clone ID: LIB3476-013-P1-K1-G9
catgccttgaggctggtggcaccgttccagccccgacagcatccttgctcgctccattgatgagtcattcggcagcatttctttctccaaagtatctgttggggaccattctatgccgttcaac

SEQ ID NO: 17250 - DNA, 472 bp, Sorghum bicolor
  Clone ID: LIB3476-013-P1-K1-H12
gtgctgctatctattggcatggtatgtacaacttgatattccctgcctaattggaaagggtgggctgataattagtgactctctgaatcataactcaattgtcaatggcgcgagaggatctggtgcaactgttagggttttccagcataactcccctgctcatttggaagaagtcctgagagagcagatagctggtggtcaaccacggacgcacagaccatggaagaagatcattgtcattgttgagggtatctatagcatggaaggggagctgtgtaaactccctgagattatagctgtctgcaagaaatacaaggcttacacatatctggatgaagcccatagcattggtgcttgtgggcaatctggccgcggtggttgtgaactccttggggttgacccaactgatgtagatataatgatgggtactttcaccaagtcttttggatcatgtggtggatatattggcgca

SEQ ID NO: 17251 - DNA, 288 bp, Sorghum bicolor
  unsure (1)..(288): unsure at all n locations
  Clone ID: LIB3476-013-P1-K1-H4
ctgtatcgtgtgcgtgtgaatattcatttgttcgagctttcagacnngaccgtacagacaagctacgctcgctcgatggtgaagacaggttgtagagaggtagaggaggctcggacagacatgtgaatggtgaatctcttttgcagagccgaggtggctttccatctccttcgctcgccccaatgctccatgctgcctaattgcctactagtagtacacagctagagcttgctgcatgactagtgtcctnctactcctctctcctgtcatgttaggctcacacggcag

SEQ ID NO: 17252 - DNA, 184 bp, Sorghum bicolor
  unsure (1)..(184): unsure at all n locations
  Clone ID: LIB3476-013-P1-K1-H5
cccacgcgtccgcgcctcccctccccgcctgaccttgacacgngacggacctgcggctggcacgtcggcagccccctccgcctctgcttccgcttccatctacgcctacttcctccctatctctgcctctccccacgcgacggcgcaaccaactggataggacgaggcaccaaccggcgaacgg

SEQ ID NO: 17253 - DNA, 173 bp, Sorghum bicolor
  Clone ID: LIB3476-013-P1-K1-H6
atataaatgagaattttgttgtactggcataatgaattgcttttgatattaatgtttctagaatcacaaatatcacaaacatctttaataacatttgtaatgattgtttgtcatttagaataattttggtcatattggaaatgacatttgtggttgaaagagaaaacttatga

SEQ ID NO: 17254 - DNA, 423 bp, Sorghum bicolor
  unsure (1)..(423): unsure at all n locations
  Clone ID: LIB3476-014-P1-K1-A11
gcaacctacgtgcccagtatgtcttgaacgacttgaccaagatcctggaggtattctcacaacaatctgcaaccattctttccactgttcttgcatatcaaaatggacagactcctcatgcccggtctgcagatattgtcagcagcaaccagagaaatccatgtgttctatttgcggaactttggagaatctttggatatgtctaatctgtggccatgttggctgtggaaggtacaaaggtggacatgctattgaacactggaaggaaacacaacattgctattcacttgagttagagacacagaaagtttgggactatgctggggacaactatgtccatcggcttattcagtcaaaaacagatggaaagctagttgagtacaattgccatgntgatcacacagcagaagagcccgtgttcac

SEQ ID NO: 17255 - DNA, 339 bp, Sorghum bicolor
  Clone ID: LIB3476-014-P1-K1-A2
gcggcgctattgtatatcgtgcatcgcctctcctcgcctgccttccttgcttggccgcctgctgcagaggcaactgcagttgcggctcgggctgcatattccgcagcggctgcggagggtgcaagatgtacccgtacatggctaaccagcaagtgaccaccaccgccaagactctcgtcatgggtgtcgcaccatcatccaaggagcacgccgagggccctacttaggcggcggcccccgccggagctgtgaacgaagggggcaagaacggccccaactgcagctgcaacccctgcacctgcaagggagctggataataacaccgtgcactgcactgca

SEQ ID NO: 17256 - DNA, 254 bp, Sorghum bicolor
  Clone ID: LIB3476-014-P1-K1-B3
cccacgcgtccgatctagcaagcccgatccgtttatgagagcgctgcgacctataccaaatgcataggatatatgaccagcgactacgcgcgtgacagactcatctcagctttgcgagagattagacgcaccaccttacatggtataggatctgtgagtcgatagctgacatgtaggtgggcaaggctctaacgagagactgggcccctaatcagacacagaggcagaggatggctagacggagatggtagcac

SEQ ID NO: 17257 - DNA, 363 bp, Sorghum bicolor
  Clone ID: LIB3476-014-P1-K1-B4
gctttgaacactttgaatcaatattgaattagcaatcttagctatatctattaggccttgtttagttcccaaaatattttacaaaatttttcagatttcccatcacatctaatcttgcggcacatgtatgaagcactaaatatagataaactaattacacagtctacctgtaatttgcgagacgaatcttttaagcctagttagtccatgatcggacaatatttgtcaaatacaaacaaaaatgctactattcgtattttgcaaaaaaatttggaactaaacaagaccttagtgtactggattgagtgaggaaaaaaaatttaacatgtattatttagcccccctcttggtccatttctggat

SEQ ID NO: 17258 - DNA, 297 bp, Sorghum bicolor
  Clone ID: LIB3476-014-P1-K1-B9
agttacacatcatcacgaggggccgtagcatcctcggcgaatctcagccatggcggagcactctatagctccagtcacccaggcgcgctgcccagcgcaccctcctcgcctccggccgccgcaaccggccgccgctgccggagtcgacgccaactccttcagctgcagatatcaccgccgcctccttggccccctcctccgcgcgccgatggccgccgtggacccgccgccgcgcggggaggccgcgcccgtgctgaagcggagcaccagcatcgaccggatccccgaggacgcgcg

SEQ ID NO: 17259 - DNA, 332 bp, Sorghum bicolor
  Clone ID: LIB3476-014-P1-K1-C3
ctcactggttcacatcactgtcatacacactcgaagactcactcgacatagcacgcggaaggccacaccaaaggcccaagcacaagagcgagcgcgacagccagccatgcagcgagccatgacgcaaacgacgacgcacgaggcgacagaggaggtgacaaacgacgtcaccaccgccgccaacacgaaggcgaaccggcaggcgaaacacccgacgaaacaaccggcggaggtcaaggccggcgtcaagaccaagcccaacaccaaggctgcccccgtgggtgctcccgtgttccctgccgccttagtagccgccgtagcagcagatgccg

SEQ ID NO: 17260 - DNA, 374 bp, Sorghum bicolor
  Clone ID: LIB3476-014-P1-K1-C9
attaacgctcctcggctgtcgtctcgtctcccctcgaaacagcaaaaacccaccaccctctcctctcgcagcgccggcggaaacctggcatcaaggcaaagctaaatagtctttgtattcaattgaggaagaactgtgcccatcctgatcttttggaagctgcatttggaacaacaagcttgtatccacctgttaataagcttttagagcaatgtggcaaatttcagcttctggacaggctactaacttccctacttgcacgcaagcacaaggttctaatattctcacaatggacaaaagttttggacattcttgagtattacctagattcaaaaagccttcgggtttgcagaattgatggcagtgttaatttg

SEQ ID NO: 17261 - DNA, 416 bp, Sorghum bicolor
  Clone ID: LIB3476-014-P1-K1-D5
gcatatatgcatgatgggagatcctggtgttgcaaagagtcaacttctgaagcatattatcaatgttgcaccaagaggagtgtacaccactggacgtgggagcagtggtgttggtcttactgctgctgtccagaaagatccagtaacaaatgagtttgtccttgagggtggggcactggtgctggcagatatgggcatttgtgctatagatgagtttgataagatggaagagtcagacaggaccgcaattcatgaggtaatggagcagcaaacagttagcattgccaaggctggcatcaccacctctctcaatgcgagaaccgcaattctggctgctgcaaatccagcatggggaaggtacgatatgaggaggaccccagcagaaaatataaatctacctccagcacttttgtctc

SEQ ID NO: 17262 - DNA, 473 bp, Sorghum bicolor
  Clone ID: LIB3476-014-P1-K1-E1
aggtgctcaatggtcttctcattagaagtgatagagcagaagctgcatcaattccagtaggaataattcctgcagggtctgacaactcacttgtctggactgttttgggagttagagatcctatttctgcatcattattaattgttaaggggtcttcacagctctagacatcttggctgttgagtggattcaatctgggcaaatacattttggctcaactgtttcatactatggttttcttagtgatgtcctggaactttctgagaaatatcagaagaaatttggtcctcttcgatattttgtggctggaatactgaaatttttgtgtttgcctagctacttctatgaactagaatatcttcctgtgtcaaaggagatggctgtgaatggaaaaggtacagatcaagacaagacccacttgtccaatgtctatactgatgtaatgcacagtagatcaaagagagaaggaatac

SEQ ID NO: 17263 - DNA, 326 bp, Sorghum bicolor
  Clone ID: LIB3476-014-P1-K1-E12
gagaagtaaaatcattgcatgttgcggaggaagcttctcaagcttttgctccaacatccagggctattcttggtgctctctctaatgtcggttcatcaagatccagctccgcactgtcaaattcagaaaggcagcaatggtggcataaaccatgtggacctctcctgctttctactgctagcaagcaaaagatggtcacagcttatgatatacgtgatggcgatgttgtgatgaaatgggaagttagcaatccagtaatgggaatggaatactccagcccactacaatggcgtagcaggggaaaagtagtaattgctgggagtgaa

SEQ ID NO: 17264 - DNA, 528 bp, Sorghum bicolor
  Clone ID: LIB3476-014-P1-K1-F1
ggcgcctcggggatgagcagcagagcaggggaagagattggaggagcagggaggtcgccgcgctcccttctattctcgcgcgcctcggtttcgtggccgcgcgcgcgcctggccgcgcgggaaattctcccgctctccgatttggcgcgctcgcgctcgcgcccgcctatgcgccgcccagcgccgactccacgccgcctagcgccgcccagcgcctggaagcgcgactatggccatagtcgaggcgacgggcttcgcctagcgcctaatcgtgcctaatcgccgcctagtcgacgcctagccgaaccttgcaagggagaggtcaaagaccaatccttacccccaccagaatgttacaaagggagggtcgagagatcaatcccaaaaccccacgcagcaccaaaacctacacaataataaacatgataaagttgttaaataggtccgacaaaaatgaatataatggaatcttttcattgtagctgtcaagcattgtcagacaatttctaggacattatcgatttggga

SEQ ID NO: 17265 - DNA, 168 bp, Sorghum bicolor
  Clone ID: LIB3476-014-P1-K1-F5
caagcaaatccactagtgtgcttacttgttttagctgcccggttttcccacgagcatccatccttttgcttggtgattcctacggaggagtacatatatctattgtatgtattatatactttttgagtagtagtaacaatatacggagtacgtcctgaaatttggctt

SEQ ID NO: 17266 - DNA, 457 bp, Sorghum bicolor
  Clone ID: LIB3476-014-P1-K1-G12
ggccagcgcgcaaagccctgatgggcgcgcccccttccgccgcgcgctcgcgtggcggcccgaggcgcgcgctccgaagatccgctgccgctctcttcctcgccaccctcatcgcgctgcccttcgcggtgctataccgcgccgccgtctggcgctcgctgggggcttcctgggggtgggagtgggactcgctgccctcctcgttcgccgcatccaaggaggagggcgccgaagccgacgatctgtgaagatctcaaacttgagcgaatcctaaagaaggcttctatgcgagacaatacagttatcttgactacacttaatgctgcatgggcctctcccgggtctgtgatagaccttttcaccggtagcttccgttctggtgttagaacaaatttgctgctgaaacaccttgtagttgtagcatttgattggaaaggtacgagcaatgtgcaaaata

SEQ ID NO: 17267 - DNA, 344 bp, Sorghum bicolor
  unsure (1)..(344): unsure at all n locations
  Clone ID: LIB3476-014-P1-K1-G7
cactacttgtgcatgaaatgccaaaagtagctcaactggcgcaataggcgacgcagcacccatggctactctcctccacgggcttcgccggcaaggccgtgaacgtgccgtccancatcttcacccaggcccgcgtgacgatgcgcaagacggcggcgaaggccaagccggcggccgactgccgcagtccgtggtactgcctaaagcgtttgatctacatgtgactgttgtctgcggaaagcacctgatgaatgtcaactggcgccgcggggacctacgtgcctaccacggggtgtatgtcgaccgatcccgagacgctgccacagaacccgacgatgggaggg

SEQ ID NO: 17268 - DNA, 344 bp, Sorghum bicolor
  Clone ID: LIB3476-014-P1-K1-G9
ccctctatttcgcagtttatctctcaggttgtccttccggttctctttctctttacgtcactgtctacggcacagtccagcccgagtcagacacaaaggcaccgacgagcgtgcaggaggtcatgcacgaggcgtgccgtgagccggggcatcagccggagcatcagttggaggatgtgtacctgcgcgtagacatggggtacaccaaggcgtacgtgaaggaggcgacacaggaggtcacagctgccgagaacgttgaggaaggcgacccgtgacggcactcctcgtcgcggtacacgtagttgtgctcctacaactgctactacaactactacacaagctac

SEQ ID NO: 17269 - DNA, 436 bp, Sorghum bicolor
  Clone ID: LIB3476-015-P1-K1-A6
gaaatctgtggatgacttatgtattaattaagacaaaacgtccatctgcagtagaaacacaaataacaagaaagggcatctagagaacaacgatgcaagcaagcattgtactcgaactctgttaactaaggcctatggcttgctgctattcacaatgttagacgatgacaacgacggctctgccatgatcagttagatacagtacaactggccggacggaggggcgacggccggcgatctcacttgtcggagatcggcgggccaccgtagtggacgctgtgcatcttgagctctgtcggcatgtcgatctccttcagccatgctagacggccttggccatgctccacgtccaagccgttgaggtcatcaaccggtgtcatctacgcccgtcgaaatgggtgtgtatggtatatcgggtagtacgtgcagtccctgt

SEQ ID NO: 17270 - DNA, 424 bp, Sorghum bicolor
  Clone ID: LIB3476-015-P1-K1-A7
agtgcagacacgcgtgatcatacgcatggactgcttaccttaccatactgggcgatgctgtacatactggcatctggggacaactgatcgaaaaggttgtcaaggaagccattgcatctgttgatggatataatgctgatagacgagaggctgttaggaaggcagcacaaagtctaaacctgaaaacggaggctgccatggcgatctttagtaaagcagtacggaagttattcttgagctacattcagagagcaaaagaagctgggaaccgcattgaaactgcaaaagagctgaagaagttaatttccttcaacatagttgttgttagcgagcttttagctgacattaaaagagagatatctccagttgctgaaactgaagcatcaagtgcagcatcagaatcttggggagaggatgatgacat

SEQ ID NO: 17271 - DNA, 490 bp, Sorghum bicolor
  unsure (1)..(490): unsure at all n locations
  Clone ID: LIB3476-015-P1-K1-A9
agccacctcgcaccccctcgctgtctcgcaccacccgcgcggagcggcggaggggaaggagggaatcggtgggggggacggcgagcggcggcgggagatcccggggggctccgatcgagcgtaagcgggcgggagcagagcgcgcagggagggcaagagtagagtggttcgatggtaagggacacggcatactacgacgtgttggaagtgagcccgacggccaccgaggccgagatcaagaaggcgtactacgtcaaggcgaggcaggtccatccggacaagaaccccaatgatccgttcgcggcggcgaggttccaggaattgggggaggcataccaagtgcttagtgatcccacacagcgtgaagcttatgactcatatgggagatctggtatttcaagggaagcgatnattgtcctgcagcaatttttgcaatgctgttcggagcgagctttttgaggacacattggcagctgcgatggatcatggt

SEQ ID NO: 17272 - DNA, 398 bp, Sorghum bicolor
  Clone ID: LIB3476-015-P1-K1-C1
agggcttaccaaacaacgcaagccatgggttcggagaatacaaccaacaaagactgaactaaagaagcctcaggattatactggacccaagctggaaagtctcttattccatgaatttttgagagctagatttacacccagttatgtgctaggtgcagcttccaattgttggctggcgcttatggatcggctcttgacaggcggcgttccaaagagtgaacggcaagcgataaagaagaagatgcttgatttggttgacatttactatttggctttggatgctccaaaggaagggaacaagatcactgttcctggagagctgaaggtcaagaaatacccacacttcatggaacgcgatgaaaagaaatcttacacatcgacgtctgtgctgggcaaaa

SEQ ID NO: 17273 - DNA, 445 bp, Sorghum bicolor
  Clone ID: LIB3476-015-P1-K1-C10
aagccccccacactggctggcggctggctggcgactggcggctggccgctgcactgagcagtaaccaccacagtcctcctcctgccgtccagccacgccgagcgtctcgcctctcaaagattcgattccttcctccggtcctcccacatggccggcgaactgcgccaccgccgcgtaccgtcgtcggacggggacggggacggggacgaggacgagggcgtcgtcgcctcctctcaaagactccattccgcctcttcctccgccgccgatggcaacggtaagggaaaggccggcacttcgtccggcggcggcgagggggcggagccgcggagggagaaacgggacgcgcctggggtggctgagtggggccgcggctggatggccgcgtgggggagttctttcagcgcatgcgcagcacctcgcacccgtcagctgccccgtcgac

SEQ ID NO: 17274 - DNA, 451 bp, Sorghum bicolor
  Clone ID: LIB3476-015-P1-K1-C6
accacgcgtgcgatcttctgagatcctctatggcaatggtttcgatgcgctgtttgttaggtggtcaaaccggtctggcgccacaactatcaatgggcagaccgaggtagctatagacatcgatggctttccaccccatacattcagtccaagtgctttaggatctttgcttgagcgccactgcagcatacaagcttatagattcagcatgactaggggcctatgccgcgtcgatgcatacacactcagcaagtactctatcccaaagtccggtgaaatcggcttacaatatacaggcccacacggggtgaccaatgtggcgttgactgtcacaatgacaacgtacaactattccgaggctccggcatttgtagagaatgaattccatgccgatccagttactcttggctcagctgattctgacgcatactttgacacatatgagcctggc

SEQ ID NO: 17275 - DNA, 434 bp, Sorghum bicolor
  Clone ID: LIB3476-015-P1-K1-D6
atgcaacctcatgggtgggcagaaaaagggaaatccaagggcaatctccaaaattgtaaaagaacggactggtgaaattgacaagaagaggtcacttattacacctgtactgcgaatagtcacctcttttacatcacttgtggactcggctgattttcttgaggtgaagaacaagattgtacgagagatagtggacttcacaaagcagcatcagtcggtttttaatagcattttaagggagaacatgactggagctaatttgctcacattggagcagcttaaccaatgggtttctattctcagcaaggtttgggcgtatgaggaaaatgaggaatgcagctatattcaagatctattttccttgatgcattctctttttagccctcgattttgggtctctaaattttatgcaatcaccaaacattattgagaat

SEQ ID NO: 17276 - DNA, 502 bp, Sorghum bicolor
  Clone ID: LIB3476-015-P1-K1-E11
ggaagaaaggcacttaagtggggtctggccaatggatgatcctgcgcagtttatccgtgcagggaccagtccaaatcagagacatggtcgtttcgatctcctggagaatcttcagagatcgtcatcgtttgatcaccatgaacatcttgaccgcagcttatccttacatgaacgtttgcataggggaggtcaaggtattcactccctagagcggtctggttctttgcctggtggtggtcctggaccaaacccagatgtcataaatgccctagcacgccatcatggacttggtcagttggaaacacatggtgatatataccctttaggccaaatgcctatgcttccttcaggggttcatcctcagcaacataggcttcaggaacagcttcctggttctcacataggaaggcttgaaaggcactggtcggatgccaatggacagttgcaaaacagtctaatggaatcttcacgcatcaaccagttgcagattgaagcggagaag

SEQ ID NO: 17277 - DNA, 404 bp, Sorghum bicolor
  Clone ID: LIB3476-015-P1-K1-E5
gcaggctgtaaatgaagagcatcagcaggaaaaatgtgatcaagaaaaagaaatatatcttctaagatcacaaatatctgaacaaggacttgtgaactatcaccaattagaagaaattcacagaataaatcttttgttggatgaatcaattcagacatttctgcagaaggaggttctggaacagaactatgtttctttacaaaaggcaatgggagaagagattcatcggctggagtcacaattagaccagtcaaaggtacattttgctcatttattgagtcagattcaggacaaggaacagtctattgcaaagctgaaaaatgaagagttcaatgttttgtcaagactgatgtcagaagttctgaaggcaaatggtattcacgtgaacttcgaatggatcaata

SEQ ID NO: 17278 - DNA, 369 bp, Sorghum bicolor
  Clone ID: LIB3476-015-P1-K1-E9
gcacgcgcacgggcctgagagctctgactgaacccttcctcctctcctgcggcggcgccggcaagtcggcagcaaccaaccggagcgggagcgggagcggcgatgaagaagatcttcggcgccaagaaagacaagggaccctcccccttcattcaagacgccaccgagcgaattaacaagcggggcgagacggtggacgagaagatcaagaagctggacgaggagctggccaggtacaaggagcagatccgcaagacccgccccggcccgtcccaggaagccatcaaggcgcgcgccatccgactcctcaagcacaagcgcatgtacgaggagcagcgcaacatgtgtacaaccaaacctacaatctcg

SEQ ID NO: 17279 - DNA, 344 bp, Sorghum bicolor
  Clone ID: LIB3476-015-P1-K1-F10
agggccaccacaccagtgcggatcaaattgatccaggccgagtctctcgaggtcattgagggtctcatgctatctgagcagagggtttcgttcccgggtggccagcttttcaaggtgcacaccctgaaggcgaccctgaaaatgcaagtgttgcagcagtggaaacacttgttcgacgtggtagcacatctacctgtccttaggagcttggaattgacaagagacgacgacttctgcgctgatgaggaggtggagctgcccatgccggcctgcttcggggactccctccggcacctgcgtctgaacggctacagagccagcggtgcataagtggctctggtgac

SEQ ID NO: 17280 - DNA, 432 bp, Sorghum bicolor
  unsure (1)..(432): unsure at all n locations
  Clone ID: LIB3476-015-P1-K1-F11
cgatttgatatcacctctggctccttgttcttatgtggtgcttctcgccttgctcnagatttcttcttctctagaagacctgatgtagagacattctgtgatatttgtcctgatgtgactgtttcccttcaacaacagatagttgggcccttcagttttcgtgttgaatcctctgttgcctttgaccccagaagccaggaccattttgttcgagtggatgatcccatctttgcaattgattgggctctcaaggtcctgggttcagcaaaggccacagcatggtattcacccaagcatcaagaggccatggtggagctccggttctacgaaacctgaagctgtttatcatgaatgattgaacgttgtagaaaataatgcctggacttcattatcgttatgatcgctgatttcactaggatcagatctatggat

SEQ ID NO: 17281 - DNA, 127 bp, Sorghum bicolor
  Clone ID: LIB3476-015-P1-K1-G11
accagatacataactaccgtaacagcgcatacccttgctcctattccggttcttctcgggctcccgaccgtggcagagcgaaagagagggcgacagcggacgttgaggacatgtggttcgtctgcgg

SEQ ID NO: 17282 - DNA, 288 bp, Sorghum bicolor
  Clone ID: LIB3476-015-P1-K1-G5
cagaggcgtgagctgacgcctggagaccatcatggctgctgacaggacggtcaagaccatgatcgtcggctagctccttgctctgagggcgactctcgacgcgcggctgacggccaccacgctcacacttcacaacctgagcccgaaccgtgcgtggccgctgttgaccctgaacactgggttactggtcatctacgagaacacggcccgacttgacggtggcagtcgcaggctcgtctccttgcgcttaccagacagcttctgtgccggccgcttgatggctctcac

SEQ ID NO: 17283 - DNA, 410 bp, Sorghum bicolor
  Clone ID: LIB3476-015-P1-K1-G8
cagaatcgaaactttttttcaagcaagcaacaagctggcgaccctctgcagctagcgatcttatgatatctgtatcatctgaactgtctctacgaaatccaagtctgggtgctcgagttcctcaactgcccgttcaggtattaacactcgaagctactaatatgacatcagaaaaccttacgttaactgtcattactcctgaagcatctggttcttcttcagttgtatccttaaactcagatccagccaccccaaatggttctttcgatggtgttaatcagtcagaaaaaagatctggattgggaaaacatggaatcggctttcaaagattgaattctgtcctagctggatctccacaagaaggtgacaatggaggaaatagaatgagtaatgcttcagactgtactcat

SEQ ID NO: 17284 - DNA, 453 bp, Sorghum bicolor
  Clone ID: LIB3476-015-P1-K1-H1
ccgccatggtcttcttcccagcacggcgttgagttccacccatcattgcttctcgccatcttggtccaaacattcttggtgattgctccaggcttgcatcccccatctggctctgtggtgaaagagcgatacaggaacagaggcaaagcaacagaggagttggttttgctggcgacaatggtggaagcagtggggaccttcgagagcagaggccccggcgttgcggggatgagcagcacgctggaggaggtgcagatgcaggagactctcgccttctctgaaaccatcaaggatctcaagacactgaggtcgcagctgtactccgcggcacagtactttgaacttgcctacatgcaggaagacaaaaaacaggcgatgacaaagaacctcaaggagtatgccgtgaaagcccttgtgaacacggttgaccacctggggtccatatctttcaag

SEQ ID NO: 17285 - DNA, 452 bp, Sorghum bicolor
  unsure (1)..(452): unsure at all n locations
  Clone ID: LIB3476-015-P1-K1-H7
cctgctccatcccagctcagccctctgctctgcttctcctccgtgctccggcgcctagcagcctgctcctgcccccgccgccgccgccgacgccgtgcagggacagccggagcaggagcagcgccgcccgcctttaccgtcactcaccatggccgacaaggagaactccgccgccgctgctgttgccgccgccccgccgcgcctcacccgcgccgcagccaagcgcgccgccgccgtcacggccgtggccgtcgccgccaagcgcaagcgcgtcgcgctcacccagctgcccacgcaccccaacgccgtgcacgacgactactacgacgacggcgacgacgacgacaagcccgtcaggaagcagcagcacctcctcgtccccgcctctgacgaggaggaggcggaggatccgcagctctgcaagccctacgcctncgacatctactcctacc

SEQ ID NO: 17286 - DNA, 443 bp, Sorghum bicolor
  Clone ID: LIB3476-017-P1-K1-A1
aaagctaggagcagtactattccacgaagacctgattcgtctttaaaatcatctgttcagggttccaccccggtgaggcgtatgaagcttgttgatagtccttccaccaacccaaaaatcatggaacgtaattttggacagagagacatttcatcagcatctcgtgcagcgagagctaataattctgcaactactaagaaaagcaatcttacagaatcagctttagtgaaagatatttacactacatctcaggctgttcctgcacctgttgttgtgcccagagacattttagaggacaaaacagtaagcaatgttcgtagagggactggagacacagctgcagccccagatgattttcggaccccttttcacaaaagaaaaccctcacttagtggcagtgctgcggatagtgatagctcatcagtatacactgaacctgatgt

SEQ ID NO: 17287 - DNA, 452 bp, Sorghum bicolor
  unsure (1)..(452): unsure at all n locations
  Clone ID: LIB3476-017-P1-K1-A9
cccactgcgtccgaaagctgcatggacagtggagtggtcgatgttaacatatccgtgaactaagtgatgcatagagtgaacgatagcatgaagcctcccatgacggaacgctcgcagtcatctatacagatccatatgcacatccataggtgctacacatggtatatgtgatatcatatgtgcgacagctattttgggaggcacagcttatggcacaacttatgacatgaatgtatatgagaagatagatggatgaagagccttatagtgttaacgatgcggtacaggctgcngtgcatactgaagttcattaagatgtgcatgcggctaccgatgcaaattcctatcgtatgtatatgcattatcatatctaagatcggacattgacgccgacaatggcctgaactatctgctgaacttgatacagctgttataaaattcgttacatagct

SEQ ID NO: 17288 - DNA, 427 bp, Sorghum bicolor
  Clone ID: LIB3476-017-P1-K1-B11
tgttgctggaaaggcactgcgggtagattcaagggtctttaacagcaaacatgggactgttttggatagtgggaccacatatgcctatttgccagagcaagctttcgtggcttttaaagatgctgtgacaagtaaagtgcattctctcaagaaaattcgtggccctgatccaaattataaggatatctgctttgcaggtgctggaaggaacgtctcaaagctacatgaggtatttccagatgttgacatggtatttggaaatggacagaagctgtctcttacacctgaaaattatttattccggcactccaaagttgatggggcttattgcttgggtgtattccaaaatggtaaagatccaacaacactattaggaggcatcattggtcgtaatacacttgtgacctatgaccgtcacaatgaaaag

SEQ ID NO: 17289 - DNA, 249 bp, Sorghum bicolor
  Clone ID: LIB3476-017-P1-K1-B6
cgctggacactctatagagtcgagaaagagaaagaggaagtgaagtgggataaggagagggggtgctcgtatgatcgttcgtcagtggcaatgtgcgttgaggaacggtggaggtggagcctttacaggcgctgacgtactggtggctgatggcactgcatatctgttggtcgcttgctggtgcgccatatagtgcggcgacgtaggatagactaaatggtgcaatgaccgcatggactgctactgata

SEQ ID NO: 17290 - DNA, 406 bp, Sorghum bicolor
  Clone ID: LIB3476-017-P1-K1-C12
gaccgatgtggaagcgcacagtctggagatgcgtagtatccatatataactcaaaaaagacttcacacgttttttaggggccagagcaatgctcagtgattgttaatgatgcaaatattgatgcaccactgccaaacgctgtacctgtagtcacaggtgaccacagcaatgaaactgttatagcaacggtaacatccactatgaacaccaaatctgagcttgtcagccccactacaagcaaacatgaccactgcaagtgtgaacaacatgtatcaaggacaagccagcataatgatgaagctgctgtgacgccttcagagcaccactagttgataatatgcctaactcaactgaaggaaaatgacctgaaccatacgctgatacagccgttaaagctactccagct

SEQ ID NO: 17291 - DNA, 452 bp, Sorghum bicolor
  Clone ID: LIB3476-017-P1-K1-C2
tgaccattttgagcagactgatacaatatacagatatccagggattcatcttcgaggccctccaccactcagccttttctgtgcatttaaagattatcctgttggtgtcacaaaaggccgtcattggtttggtagtttgtatcaactctatgatgaatctgaaatcagtttgaacaatgcccagaccattgattggtcagaacattgtcactgcaaggcaacagacttgctgcaatttattgatattaaaatcgctggctatcgccacacccagcctggacatgccaaaatctttggcttctttgcagcccgggataagattgaacctttacgcaactatgtctacagacgtggggttgacaattatgaagctgtttctgtgaaccaaaagacgggtatggcgcgcttgtcattgactagccctgctcgaggtatatgcattacaagccatg

SEQ ID NO: 17292 - DNA, 476 bp, Sorghum bicolor
  Clone ID: LIB3476-017-P1-K1-C7
atcctcttcgcacgcaacgacggcggcggcatcttccacagcgctgagatcccctttggcaaggcggcatcacggcggcacacactcgagtaacctcacaagaagcgggaggacggggaaggttcacaccaagctcggcagcttcaccatctctcgcaaagccaggacctctctggcattggtgacgatatctctttctgatgtctctacacgcttcctggccaggctttgtgcagcagcctgcaggctgggacgcgccgtgcatgctgctcctctccttcatatccacatggaagagaattggtggataaaacaatattggagaagtgcttgaccaaggaacatcatttcaccaaggcgatttctttgcttatttgctgatcgcggcatggtggatagacaatgttagctgtttgaattagtgtagttttaaattgattcatcgtcaatttggaaagtttttatataaacatatt

SEQ ID NO: 17293 - DNA, 458 bp, Sorghum bicolor
  Clone ID: LIB3476-017-P1-K1-D3
gtattatcttacagctacatttattcactcatgaattgcctaactccttgccttctttggatttgaccaccttattttttattgaccaagatgattgtagtttatcactgaattgctttgccacataatggttctgtcaaattgtcaaataacaacacaaattgtcaaagctagtcagaacattgttttattcatagtgattttcatttagttctatattgcttctactcttttattcagaatttttttgctaataatattcaaaaaatgcttgtgatattcttgagctgcctatacttgagtatgttataatcatacattgtggtatcatcaggttgtcatccatttgtggtcatcgaaagctaaagagttagctcttagctatgataaacaatgttgttcaggatcaatagacaatgatttattctcttaattatgtttaaatagaatttagcata

SEQ ID NO: 17294 - DNA, 473 bp, Sorghum bicolor
  unsure (1)..(473): unsure at all n locations
  Clone ID: LIB3476-017-P1-K1-E1
ggagagatggttcgtggaggccagcccggtgcccatccctttgcccttcggcaagctggaggacatggtccggcggcccgtctatccgccggtgcgggagtgtttcttccacttctcagcggagagcgtgaggaagctcaaggcaaaggcgaacgccgagatgcatggggctgggcgacggccacggcgacggccggcgtgtcgtctcgtcgctgcagtccttgctcgcgcacctgtggcgagcgtcgtgtcgggctcgggagctcgcgccggaccgggagaccacgtacatgctcctcgtcgggtgccgggcacgcgtgaaggggatcccacangagtacatgggcaacgccgtcacggtcgccgtcgccaggtcgacggccggcgacgtggtgagcaagggactgggccgggcggcgtggctcctgaaccgcgccgtggcggcgttcgacgaggccagcgtgagagacgac

SEQ ID NO: 17295 - DNA, 510 bp, Sorghum bicolor
  Clone ID: LIB3476-017-P1-K1-F11
cccagaagaatcctgaccaatcttcaactcaagaaaccactccagatgacgaccattggtctgatcctgttgaatctagctttgatgatgatgttggaatgcctcacccagctgatatagaggatcctgttggagattattctgatgatgaggatccatggaaacctttgaatccacatgaacctggcaacctaaagattcggccttaccgaagagtgaaaggttctccacgggtggttattggcactttgaaaaagaaaactgtcatatttttatttcctatggcaaagatggatggcgtcatcatacctgaacatgctaaatcttttgaagcacagcagtctcagcaggaggaacattatggttcccaatcaccccctcgttttgaaaagtttttgagatcatttgaatttggagaagaaaatcccaatgtgtttggcgatttgaaagatgacgatggatcaaatactggccttaattttgataatgatgatccagacatgccaaatg

SEQ ID NO: 17296 - DNA, 444 bp, Sorghum bicolor
  Clone ID: LIB3476-017-P1-K1-F12
aagggaagctgcatgctagcactgacacgcaggactcggaccatgtagaggatcaacactcaattattccagtatttaacgaacacaaaacattagcaaagctgttaaaaggcacattgtgggacatctgctcacgtgctcaatggtgcacgcgatcacagaggtacatcgtacatggttattggcttcagacatcaactgccactggccggttgtgcatggaggagccaaatctgcagtgtggtgagcacttgaaggaattctgtactgggaaaagcaataaagattactgtatgtgaggggatgatcattatacaatcaatgagaactggagattagtaactgctgattactgacagatagagttgcgaataatggcttacttttgtaaagatcctacattggttgaacttctaagtaaacctgatgatgatgtttgtacca

SEQ ID NO: 17297 - DNA, 313 bp, Sorghum bicolor
  Clone ID: LIB3476-017-P1-K1-F2
ccgactgagagcaagcgggggatacgactatacgagaggcgacttccactgccgtcgcacagtcgccgtcggaggccgcgcgcgccgccatcttgccacgcttgcgcgtctcgctgtcttacacgcagctcgtcggaagcactagggttgccttgcgttctgggattcgcttttactcagacaaagtcctcaaatacagacgattaactaccaacagcgcgatgaaatcatatagactatcagtgctgagtgacactgaggtttgtggtgtcaacggtagtcacctgatctattaggaagccatatttggcac

SEQ ID NO: 17298 - DNA, 323 bp, Sorghum bicolor
  Clone ID: LIB3476-017-P1-K1-H3
catcatcgtacacacaaccgccgccgcgcctcccgttcgggcccggtcccttcccctcccctccctcgtcgcggaagaacggaaatggcgtcgtcgacggcctcgctggcccccgcggcagcgctgctgctggagcggctgggcctgcgcgtggcgcccaccgacgccgcagacgaccaggcgccgccgatgcccgcgctgccgctcccgggcctcctcccgctgcgctgcgccgtgcagcactacgagtggggccgacgcggcgccgactccctcgtcgcccggctcgccggcgaggcctcggcgtccgacggacgcggaga

SEQ ID NO: 17299 - DNA, 445 bp, Sorghum bicolor
  Clone ID: LIB3476-017-P1-K1-H7
gaaccagatgcaatcggtggtgcaatccgcgatggcggccaccaacacgacgacgacgactggagtcatgccaccaggtgcgaggccccagctgagctcaaacggttcaagtggccgcggatcacgcgaggccgaggacccggccaccaaggcgcaattgaaggccatggcggcaaaggctctgtggatgcttgcgcggcgccatgtgggagtctgcaagagcataacagagtctcgcgcgctcctctgcttcgccaggctcctccagagcggcgacggcggcgcgggaacggacctgcagttgcactccgcgatggcgatcatggagatcacccgtgtcggcgaacacaacctggcgcttgggcagttcgcgttcaagcccagcgccacggcagccaaagccgtcgtggagcaacttcttccgattggacgcaagggggacgac

SEQ ID NO: 17300 - DNA, 272 bp, Sorghum bicolor
  Clone ID: LIB3476-018-P1-K1-A1
agcctatacaaactaggagaggtcgctgtggagaatgggcaaattgcttcacattctactgtcgagcttttggatatgatgctcgtttgattctggatttcactgatcacgtgtggacagaatgtttttcaaacttgtacgggaggtggatgcacctagatccatgcgaaggagtctacgacaatcccctactgtatgagaaagggtggaacaagaagttagattatgttattgcgatctctaaaagatggagtacgtgacgtaacaaaacg

SEQ ID NO: 17301 - DNA, 511 bp, Sorghum bicolor
  unsure (1)..(511): unsure at all n locations
  Clone ID: LIB3476-018-P1-K1-A5
aaggaacaatattgtgatgcatttctaacagcacactttgaggtccctggagaaatgttctctttggcaatggaagcaaagcggagagcaatgggagttgttggatccactcagaacatcttggatttcattaaggaccatctgatgagagctctggacagaaatgtagatgaccatcttcagtttgtgttaggaacagaatcagggatgatcacttcaattgttgctgctgttcaggagttatttgatttgtattcttctcaagagagagcaaacattgaagtagaaatgtgtttccggtttcctcggatgcgatttctaagacatcgaatgttctcatcatgttggttcttcaatggctactaatttagataatcttactattgttcctggtgtgagttctggcgaaggctgctccattcatggtggttgtgcctcgtgtccctacatgaagatgaataccctgnggtcgctacttaaatattgccatcagcttcctgataaaaacaac

SEQ ID NO: 17302 - DNA, 369 bp, Sorghum bicolor
  Clone ID: LIB3476-018-P1-K1-A7
ctcagaagtttggcccaaattagacatgacagcatttgaaactgctgtctttctttctcgaatacgatggagagctgaagatcatttcgttaagcagggaaaagaaccaagtaggcaagtacaaccccaacaccacacactaaaacagcatttgaaactaccatctgaagctgagctattggaaaatgatactatatggtcctaacatgagagatcctatgaggaaatgtaggcaggcttcaaacttggaccacagatcttaagggagtgaagatatgatttcttagtacccagagacgttattatttggggacaaggataaacttggacccatatcactagaggctaggaaataatattatttagttg

SEQ ID NO: 17303 - DNA, 279 bp, Sorghum bicolor
  Clone ID: LIB3476-018-P1-K1-A8
ggaccagatcggcacctactactacttcccctcgctggccttccacaaggccgccggcgggttcggcggcatccgcgtgctcagccgcccgcagatccccgtcccgttcccgccgcccgccgccgactacaccgtcctcatcggcgactggtacaaggccaaccacaccgatctgaggtacgtccttgacagcggcaaggcgatcgggttccctgacgggctgctcatcaacggccggagcttgaatggctacaccttcaccgtgcagcccggccggac

SEQ ID NO: 17304 - DNA, 431 bp, Sorghum bicolor
  unsure (1)..(431): unsure at all n locations
  Clone ID: LIB3476-018-P1-K1-B10
gaaagagggtagctgttgtggtgggagggagcgtggctggactagcgtgcgctcatgccgtggctggcgcgggatgggagctggttgtgctggagaaggcggcggcgccggcagccgggagcggcacgggcgccggactgggcctcgacgcgcagtctatggagatcctctcacgctggatcccggggtggggaatcgacgcggccacgctgccgctcgccgtcgatctgagcaacggacagcgagacgaaggcggcgcggacgctggcgagggacgaggacttcatttccgcgcggcgcactggggcgacctgcaccggcggctgcacaggagctgccgcccgcggtgaccgtgctgtggggccaccagttcctgtcgttcgaggcgccggacgacacgccgcgnggtcgtcgcgacggcnccgcgtgct

SEQ ID NO: 17305 - DNA, 397 bp, Sorghum bicolor
  unsure (1)..(397): unsure at all n locations
  Clone ID: LIB3476-018-P1-K1-C3
cccacgcgtccgctttgtaggtcatgatgaggttgttcagtccacgtaaaacaacattattatttgtaattcgtgacaaatcaaagacacctcttgaaaatcttgaacctattctaagggaagacattcataagatatgggatactgttcctaaaccccatgcccataaagaaactccactcagtgaatttttcaatgtagaagttgtggctttatccagttatgaggaaaaagaagagttattcaaggagcaggtttccaatttaagagatagatttcagcattccatgctcctggtggacttgctggagatcggcgcgggttgtcccacttcaggtttttcttttagttcacagcagttttggaaggcattaaggagaacaaagnacctgatcta

SEQ ID NO: 17306 - DNA, 465 bp, Sorghum bicolor
  unsure (1)..(465): unsure at all n locations
  Clone ID: LIB3476-018-P1-K1-C7
cgtttggtcagagtggaatggaaagtatcgcgataccgtgcgtcagttcatcaaaggcacagatggatttgctggtgcttttgctgaatgcctatgcggaagtccacagttataccaggcaggggggaggaagccttggcacagtgtcaactttgtatgtgcacacgatggatttacactggctgatttggtcacatacaataacaagtacaacttgtcaaatggtgagaacaacagagatggggaaaatcataatcttagctggaattgtggggaggaaggaaatttgcaagtttgtcagtccgaagattaaggaagaggcaaatggcaatntctttgtttgtcttatggtttctcagggagttccaatggtctacatgggtgatgaatatggtcacacaaagggagggaacaacaatacatactgccatgaccattatgtcaattatttccgttgggataaga

SEQ ID NO: 17307 - DNA, 530 bp, Sorghum bicolor
  Clone ID: LIB3476-018-P1-K1-D12
gctaaatgtgatccctattgataccaacctgaagcctaactcgtcacagccacatgagaccacacctccaatcaagaggctgctgcatgcttggcatgatatccttgagaagctccctgttgatgcaacgaaaagggccatacacacatttgcggaagtggtgcacacaatcctagttcaccaggatgaagaactgaagttgaggatgaaaatttaagagactaggagggactttgagaagaagagaaggcagttcgatgattgggcacagaaaaattgggacagaggacaagtattcctgatggcgacaatcccgcaccccgtgctgatccgctgctgaaaggaaagccgtggtggataagttggagaatgcactgaaggacctggaagatagttataagacccaatgcaaggtagtaagggataaatccctcaatcttctccggtcaaacctgccggagctgttccgcgttgtgtcggaattctccctccagtctgcgggttatttcaagggcttatggtcgatcgcg

SEQ ID NO: 17308 - DNA, 480 bp, Sorghum bicolor
  Clone ID: LIB3476-018-P1-K1-D5
atacctgataatcttagtaaggtattagtgttttgcgacaatctagcacaaagttcatctccggaaggccgcagtagttctccatggaaaccccttattaagagatatggaaacgccaatcgtccaacggtccggctgaacatccctaccgttgtcagtggcaacactgcaatgtactcgacacaaatataccaaaaggattgcaatggtgtcattccaaagcttgcttccagaaagatagatgcagcgaatctggaatccatgcttcaagggaaaaaggtggatgcgttctttcactggaaatatatggctaccagcaaaatgctggtattcgatggttgctaagaggctagacgttcacttctgaagggaccatgccaagttctatcctcctatcactataaaacaggctcttgtccccactttagccaccttagcctctatcaatagtagcaagtcgtgtgttagtgtgtacaacat

SEQ ID NO: 17309 - DNA, 511 bp, Sorghum bicolor
  unsure (1)..(511): unsure at all n locations
  Clone ID: LIB3476-018-P1-K1-D9
gtccctgngggcattgccaaagacgccactgctgttcttgatgaagcaatctgttacttgcagtatctgaagctgaaggtcaagacgctgggagccgtctccctctagctcctggacaattgtgatttagttctcaaagccgcttgcttctgctgttctacatatacgaagtatcacattggtaataaggtgaagatgccaaagatagctcaggttggtgcttcaggacgcgccagaggtgaataacggaagaagaaaaggttcaatgctgctttcttggctcccttgtacccacatggctctaatgatatttgtgggcaaatgatggcacgcagcattgcagtagtacttcatctgaagcaaaggcgtgcgagttttccttccaatgtggttgtggcggagcaccacggagcgacgctgcgctcctggccacctatgctgctctccagtaagctagcctaccaccatccttgtgtctgagagctccagatcttctcataccagcagctta

SEQ ID NO: 17310 - DNA, 467 bp, Sorghum bicolor
  Clone ID: LIB3476-018-P1-K1-E8
cccacgcgtccggttcctgccatctgttactaaactcaagactccagaggcaattcatagatattctgagccatgtgatgctagggcttcttccagcctaaactcttcaccaacatattcgactgaaacatcagtaagcaaggaagcaaagaaacacctgtctaacagatggaagaagacccatcagtgtcagcatcaagaaactgatagtgacagcttcagcacgcttggggatatgctttctctctctgatcagaatgcatcaaaggttgctacccataaaagacatccaggacatgtccaaaggcaggagtgcagagtgatagatgcaaagctcatgtggcatcagcagcaatgatggttggagagacacagctactagtgaattgacaaggtccaagtctcttacatcatgcttcatccgcggagttcacaagtcaaacaacaggaaaagaactggcagtgta

SEQ ID NO: 17311 - DNA, 516 bp, Sorghum bicolor
  unsure (1)..(516): unsure at all n locations
  Clone ID: LIB3476-018-P1-K1-F12
gctaatgacccatacataaggaatgcatagttcattaaaaagttatggttagaattctcgtaaatattattagtaaaaattcttgtaaatattgttagtattgtcgtaaacacaattctcataaatacttcaatatattcattgtacagaatatagaacaaattatatagaaaccgatttcattttatggtaactgtgtttcgttaaccaaattagtatcaaaatttattatcataaattacatagatcaatcttccaaaaacaatgtttccttatggtaactttctctggtaaccaaattgctgagtgaaagatcaccagctcgctactacagtaatacttctattcataggccaaaattattgtaaaccttgttcaaattaaaagatgcaaaaggcgaaccatgatttacctgnatgtggtgcaaaacaatngatggtttttggcatcgatattcaccctgaagttgctgacatgacaatncggaatgtgcttttctctctcagtcatgctcta

SEQ ID NO: 17312 - DNA, 445 bp, Sorghum bicolor
  Clone ID: LIB3476-018-P1-K1-F8
cacatttcgcctccctttccctctctcccccaattcaaaatcaaccactccccttcccttccccatcctcctccctactagggtttgcctttgcggcgtcgccctcatccatcgaccagcagcaacagcagccgacgatcgatccgtgttgggcggcgatggagatcaacatcgtggacaagtacgagaagctcgagaaggtcggtgaggggacgtacgggaaggtgtacaaggcgcaggacaaggcgacggggcagctggtggcgctgaagaagacccggctcagatggacgaggaagggatcccgcccaccgcgctccgcgagatcccctcctcaacctcctctcccactccatctacgtcgtccgactcctcgccgtcgagcagggccgcaagaacggcaagcccgtcctctacctcgtcttcgagttcctcgacaccgatc

SEQ ID NO: 17313 - DNA, 411 bp, Sorghum bicolor
  Clone ID: LIB3476-018-P1-K1-F9
tgcttgtgttattccaggttatgttgtggaggggacccttgcgaagaccattatcaacgagcctagagaagtgacgctagctaatgggctcactgctcctcttcatatgtcagtccactatatctctttttcagctcatgccgatttccctcagacaagcaactttttggatgaacttcggccaccaaatattattcttgtacatggtgaagcaaacgaaatgtcaaggcttaaacagaaacttaaaactcagtttgatggtacaaatattgtatctcccaagattgccaatcagtagagatgtatttcacttgtgagaaaatggcaagactattggcaggctggcagaaaaagtaccagaaggtggagagtcttccggtggcttacttgtcaagaagggattcacgtatc

SEQ ID NO: 17314 - DNA, 547 bp, Sorghum bicolor
  unsure (1)..(547): unsure at all n locations
  Clone ID: LIB3476-018-P1-K1-G10
caacttcaacgtataggagttcttggttctggtgatacaataagcaaacatccaacctttgatacaaactaaaaattttgtgggccaatcatggagatgcaataagcattcagtactctggaactcctgctctgaagggagattttgttcggtatgggaagcgaactacacaaggaattctgaacgatttgaggaatgcgcttgcaagatactacttgaataactttgttgatgggactaagcaggatgccatggatcttcttcaaggacattatataacgtccgttagtcgaacatggcagtgccaagcaaagcaggacttctggagagttatgcgtcttccgccttgcttttgcattggttatgggagcgctaatgttcatgatgatgtcactaaggcaagcacggaatgatgttcgccatttgttgctgtcacttatgtgggctggtctttgtattgccatcacacattttgttagagccaatggccgcacgttcactaaccggcctaggtttcaccagtcacgccatngatggacgatgcaag

SEQ ID NO: 17315 - DNA, 435 bp, Sorghum bicolor
  Clone ID: LIB3476-018-P1-K1-G2
gctcctgctcacgcacagtggcgccatctcctacgccgtcgtcgtcagcgccgagatcgtcaccgtcgggtggtacagcggcaaggaccagggcaagctgctcctcaactgctacttccgcacgggctgctccgccgcgctcctcaccagcagcgggacggcggcgccggtcaagtaccggctcgcgagcctgacgcgcacgaaccagatcgccaacgaccggagctaccgctcggggtaccgcgaggaggacgacgagggcatcaccggcttcaccctcggccagggcggggccgcatggtgagcgagctgctgcgcgcgcacctcgtgacgtcagcctgtccatcctcccatggcgccagaagctgcgctacgtgctggcgctgctcctgtcgtcccgccggcgcctaacaggcgacaacaacaacaacaagc

SEQ ID NO: 17316 - DNA, 469 bp, Sorghum bicolor
  Clone ID: LIB3476-018-P1-K1-G4
catcctcggcttctctccaagtcctcgatccatcctccggctgccccctccccgcggcgaaaccctagcccgtcacctcgccgcccgtcgccgcaggcttatggcgcctatgtgaccggaccagcagcccgccccatctctcccttggcccccgcgtctgatgttcctctcccgcatcgtacttcgcgacctggactcaatcgactccccggcctccatggcgtcctcgaagaaggttgtgacccgtgacgagtgggagcggaagctccgcgacgtcaagatccgcaaggaggacatgaccgcctcgtcatgaacttcctcgtcaccgagggcttcgtcgacccgccgacaagttccgcatcgagtccggcacccagccggagaatgacctagcgaccataacggatcgaatggaggtagagagcagacagtcgggtatgtcaggagcgacgagaaataacgatctacc

SEQ ID NO: 17317 - DNA, 438 bp, Sorghum bicolor
  Clone ID: LIB3476-018-P1-K1-G6
atccctctccctgtcggatctgtgcttgttctgaatggcaatggtgctgatgtagcaaagcattgtgttccagcagtccctaccaaaaggttacactcatctgtcatattgtttttcaaaattcattgaactatttggtattaaaaaatcgaatgcgctactttctgaaacacaggatatccattacattcagaaaaatggatccagcaaagcgtccattcgattttaaagatgacccagaactgcttaaccttgcccctctagggacagctgtacaagaaactggcatatatcagatgaggcaagggcaagctacctgacgcccaaataacaaatctgagcaaatatccagaggcaagaggtctaaaggaagaacaactcctgggaaatatggaagcggcattcttggagagcagcctcctgggcatgcacaagccc

SEQ ID NO: 17318 - DNA, 445 bp, Sorghum bicolor
  unsure (1)..(445): unsure at all n locations
  Clone ID: LIB3476-018-P1-K1-G8
cgctcgccctgctgcttctgttctcagcttgctacaccggcccctcctccgccgcggactgcgaccccgcggaccgcgccgcgctgctgcgggtgaaggcgcagctcggcgacccggccgggctctcctcgtggctgccgtccaccaactgctgcgcgtgggaccccgccgtgttctgcgacgcggcgggccgcgtcacggggctggcgctctactccctccccgacgtctcggcgcgcgtcccgccggcgctcggcgacctcgccgcgctcctcctccaggtcactccgtgcctggcctggcgggccccgtcccggcctccttcgcaacctcacgcgcctnctggacctcgacatcaacggcacctccatctcgggccctgtcccgggctgcctcctcgccgggcgccgcaacctgaggacgctcgtcatcgccaacagcaagc

SEQ ID NO: 17319 - DNA, 546 bp, Sorghum bicolor
  unsure (1)..(546): unsure at all n locations
  Clone ID: LIB3476-018-P1-K1-H1
cccacgcgtccgctcgtagcatgtcaatgtgtgttgagtttgtgaacttttggtttgtggttttgtctattggtgtttttaattctctggatagaaaattgcagactaagcccatataaattgcaacaaactaaaggtataattttagtacaaaatatatgcaataacaattttttgctgggtaagttgtttttcattaaattctgttgattttctgaatccacaacacacttaatagtacatatgcataatggcaagttttatgacatgctccagtagtacacacctatcaattttgagttgtagtagggtggctgtgaattttgtggcgtggcgtgtattggtgttggggtgtgtgtgcgtgtgagtgtgtgtttgcgctctctctctctttccctctagaaactctttatcagtatgtgattgcagcatttaatcttctctatccaacctaatagtagatatgcttaatggcatgattcatgacacgctctagtagttcacgcctacaccacttngagtggctgtacatatgttcaagctact

SEQ ID NO: 17320 - DNA, 414 bp, Sorghum bicolor
  unsure (1)..(414): unsure at all n locations
  Clone ID: LIB3476-019-P1-K1-A11
gggaaggtgttgcaaggccgaagaaagagtttgcaaaggaggccaagaaatttgcaaacatccgtcatccaaatgtggttggtttgcgtgggtactactggggtccaaccccacatgagaagttgatcttgtcagattatgttgcgccaggaagtctcgcgagcttcttatacgatcgaccaggaaggagaggtcctccactgacctgggcacagcgactgaagattgcagttgatgtcgcacgtggcctgaactacctccattttgaccgtgcaatgccccacggaaacctcaaggccaccaacatcctgctggacggccttgacctcaacgcccgcgtcgtcgactactgcctgcaccgnctgatgacacaggctggagtcgtggagcaaatcctggacctgggtgtgcttg

SEQ ID NO: 17321 - DNA, 112 bp, Sorghum bicolor
  Clone ID: LIB3476-019-P1-K1-A5
aaagaaataaaatctaaatctaacgcccctaaatgatgactgatatctgctcctgcagcgcacacaaatttcctcagcagatccaagagctgcaaatgctaacgactacacg

SEQ ID NO: 17322 - DNA, 381 bp, Sorghum bicolor
  Clone ID: LIB3476-019-P1-K1-A6
ccgcctcaaggcgctcagtttgatccaggaggaggaggaagggaacgggggagccgtgccgccatggtgaaggacagcgagtactacgacgtcctggagatcagcactgacgcctccgtggcccagatcaagaaggcctattacctcaaggccaagctggtgcacccggacaagaatccgggcaaccctgatgccgcgcgcaagtttcaggaactaggcgaggcctatcaggtcctgagtgatccggtgaaaaaggagtcttacgataagtatggaaaggaaggacttccccaagataatatgattgatccaaccgctgtctttggaatgcttttcgggagcgattatttcgaagattatgttggccaacttgcgctagca

SEQ ID NO: 17323 - DNA, 400 bp, Sorghum bicolor
  unsure (1)..(400): unsure at all n locations
  Clone ID: LIB3476-019-P1-K1-A8
ggagatctggcaacggtatcaagatacagagcacatgaaggatgctcttatctctttatgagatgaaaggaaggcaaggatgactgtggaatctttacgggactttatggagatctgaataggttaaagttggaggacaaacaccttagcgactaggtgtccagtccaggacataaataagaggcttcaagaatataacacaagcttgcggcaatacaatatatagctatctccaagcagatgcaacaaaggatgctgaaacaataacaaagctgcaaaaggtgaagaatactatcgagtgaatgaatggtccgaaggatcatgctaattcactaaaaatacaactagacattgcanagtggggagggggtctgtggcagcaaaagctgcttgccaactg

SEQ ID NO: 17324 - DNA, 443 bp, Sorghum bicolor
  Clone ID: LIB3476-019-P1-K1-B6
cacccaagaagaagaacgcgcggggagcggccacgtttccagagaagaagacgaacaccaccctcgatcgtcgaacagactccgaggtgcttcgatcttttgatggcgacgctccccgtcaagccgctggacggcgccgacggctacctgcggtggaaagagtcgatgctcctgcgcctccacagcgtcggcgtcgcccacgtcctctccgacgaccctcctgctccggccgaggcggctggtgcggcggcggcggcggcggcggcggccaagaagtgggcgcgcgacgacgcggtgtgccgcggccacatcctctacgcgctctccgaccgcatcttcccggactacgtgcggcacggcaccggcagggcggtgtggcaggccgtggcgcgcaccttacacgtcgacaagcccagacgttcgtactcgaggcagtacgagcg

SEQ ID NO: 17325 - DNA, 426 bp, Sorghum bicolor
  Clone ID: LIB3476-019-P1-K1-C12
gtccgccctttttttttttttttttttaatcaaaggacaaaggattgcgagtttggcagtaaagttttacagggtatgtacaacaaacgaagcatttgcatcttagctgttatgtgcttaatgtgtacctgaagcaagggagaaaagaaatatgctactactttacaaaaatgtccattcagaccatcatcctagcacttctaccataatgttattatcttgtttgagagctatcaaacctacattggaattggaacaaaagaatcttcaaatgttgctcttcaaatgagcaagtgtgttgtgcttctcaagaatttatgggctacgcaaaggcccgttttgcacgtctccaggtgaagtggactgataaatgtatttcttgcagcatcgacctaggatttgttccggtatgcttttcccgattca

SEQ ID NO: 17326 - DNA, 508 bp, Sorghum bicolor
  unsure (1)..(508): unsure at all n locations
  Clone ID: LIB3476-019-P1-K1-D2
ccatagtttaatggcttctgattcaaagtttggaacaaacaagctaaagcatccttgttttcgaccagcacaaaaatgcaattcctgttgcgtggattataacccccaattttgcacatggtgaaatacataaatggatgggtgctctttatgatcgagctcataccaaagatcctacttggcaattgggtggctttattattgatgatcccttggcagacgttcgcacaataagggaagtcttccattgccctgtgctgatcagtttatggcgtatccggcatgcttggcataaaaatttggttaacaaatgttcagacattgagaagcgttcagcgatggccaaacgtcttggagatgcaatatctagtatatgcagaggaaatggggatgttgaattattttgaggttttctgcaagattttgtcgattgtgctgggtttctagattactttgaagctagatggcttccaagacttggcagntcatgtacctttctactatcata

SEQ ID NO: 17327 - DNA, 520 bp, Sorghum bicolor
  Clone ID: LIB3476-019-P1-K1-D7
ctgttactggttttagcacagccagttcttttggacctcttcatcgtggttcatggtgcactccaccaagattgttcctggaagaccagttcgatgccattcctccagaggtcggcatttcacagaattcaggcagtaagaaaatcaaggaagaggaaggagcaaggagaaaaaatggagcagtgaaaatcagtccatggacattggcacggctaaatgcagaggaagtttcaaaggcagctgcggaggcaaggaagaaatccaaaatcctgaaaccaattgcaaaacatggcatctcagacaatggcagtaaaccagaccataagctcagctaccagagacgactagatagaagaggtttccctgctgagctttctcttgacccacttgcaactctatctgcaagcggcactgaaagcaactacagcgacacagcaacagaaatttgtggagtttagccccattacagctcgaagcaagaagtgctttccagcctagtactgcagcattcacaaagaat

SEQ ID NO: 17328 - DNA, 522 bp, Sorghum bicolor
  Clone ID: LIB3476-019-P1-K1-E1
cccgatccttcgcaccatgcctccgccagtccgccgtcacgaagcatcctacaatgaagctccatgaaaatctagatctacttcttcctccaacccctccctctccctctcctcacaagaactcccaataacggcagctatcgaccacactttgattgcgtcgggtcacctgcgctccccatcgcactgccggtgtgctcagccaacatatgggcgacgaatctcatacttaaaaccctagccagtttagctaaacataatcggtgctaatggagatcccagaaattaatgaagaaatatactggcagtatgcagtcatctcgaggccaaaaaaggttttcagaacagaacctaaacaggtggccaaagaaattgtaaatgcaataagaagtcagctaggattgtacatcatcgcctctgacataacatatagacgacctaatttcatcatctatctcaacaattctcatctacaaagacaagtagtggccgcatcacctatacgtacaaggaattttcaga

SEQ ID NO: 17329 - DNA, 404 bp, Sorghum bicolor
  Clone ID: LIB3476-019-P1-K1-E10
ggactgtgtcgaggcgctctatgaaaacctcggtggccaagcatctgttacagcaatagggcacatttcacatagccagaagggaacttatacaacttacctgatgtttgtttcacatgcaactatggatgccaagaaccctgcagcaaaccttgtaatgcacacatattagaggattatgagcatggacgattgttttcattgtatgaacaaattgaccacaaggtagatttcattgagcaagagcttcagcattctgaacaaccaatagttttggttggtcattcaattggtgcatacataggccctgaagtcttcaaaagatttcagaataagataattttttttgtaggactatatccatttttaaagatgaacacgaattctgtaacacaatcagcaat

SEQ ID NO: 17330 - DNA, 373 bp, Sorghum bicolor
  Clone ID: LIB3476-019-P1-K1-E12
cggacgcgtgggctcgacttcgctcaaaactggatttggccaatcgctcaagaacacaagatcccgtgcgccatgttcctcatcttcacagcaggcttcttggccttcgccggctcgaagcagcagaacgaggcgcagccacgcacgacgacggaggacttcatggtccagccgccgtggataccgttcccgaccaccatgtccttccgccgccacgaggcggagtggatcgccgccgcgtaccggcccaacgcctccggcgtgtccgacgtggaccgcttctggcaggtgcatcacccgagctgccgcctcatcgtcatccgcagctgccccgaggcggaagccgcgtctgttccccgctcctaacaagaca

SEQ ID NO: 17331 - DNA, 446 bp, Sorghum bicolor
  Clone ID: LIB3476-019-P1-K1-E9
gctgatggtatatctagccaactttctgttggacaaatttcttatgatagtggctatggaagtgcacaggcaaggacaactcctaccggtctggcagaccctttaagtggaagccctggagggactggtcttcattctggatttgatccatcaagaggcaatgcatatgatggttctcatgttgccaatttcagttcttcaaaaactgggacccatgatggatcaaggggtgccactggctttgactctctgaagggttctgggtatgatgcttcaaaggcacatctaattggacaggcatcagctacagcggctcatgggggccttgctggttactacgggtccaatcaggcaacatcggctccatatgcatggggacaatctgcatcgacctatggatctgtacaagtgccaccatcttacgcatcagggtcaaacacattcta

SEQ ID NO: 17332 - DNA, 531 bp, Sorghum bicolor
  Clone ID: LIB3476-019-P1-K1-F1
gaaacaatgaccgaattcctggaatgttcatgctaaaagttggtgcattcatacccttactctgttttgtagatactacaagatttttaaagctttgactggtttccaattcagtaggtgaagtttctaatttttaattatgcttttccttcagtgtaactgtaatatcatatcgatgactgcaggttgtctgataagtttagttagatatgctagctggagctgtagtatatttctacaattaacactcctgtgatataggacagcatggcaacactatccttccaccaggttccataagcagatggatgagcatccacaacggtcggcgctgttattacgtctatggagtatggtatgtggtagtggttatgtcaagcgagcctcagctggataactcatgctcgcattttcctttggctggttggacttttgacagcaactaacaaaattttatgcaggatgtctcttttgtcatcaacgattgacagaatgaagtgtttgtgtattctggtgtagtgttacctgagt

SEQ ID NO: 17333 - DNA, 463 bp, Sorghum bicolor
  unsure (1)..(463): unsure at all n locations
  Clone ID: LIB3476-019-P1-K1-F7
cactgacttcatcatcagacagacttcctactgctgatggtatcagcacaaatcatatgaaggaagcagattcacaaacacctgtgaagctgaagctacagttatttccaataaatgaagctactcggaaggcattggagaaggatgaccataatcctcatctagagctcacattaagctctaggaagaaaatatcatctgtgctagaacatctaaaccgaaaatggggtaactcaaacatcgcatctggagagcttattctttttccatattgtgctaatcaagaggatttggctacatatcagaggtggacaacaagagatgctgttgcagtagctgatgtgtttctttctgtgaataagcccttctgttttccgtttaaaggaatggntgttttcccttgttgagcttggagccaggagtagtgaaatatctttaacccattttgaggattgcatgatac

SEQ ID NO: 17334 - DNA, 387 bp, Sorghum bicolor
  Clone ID: LIB3476-019-P1-K1-F8
ctctacttattggctattacagtggtcttgcttcattgttgttgcctcgctcttagatcatattatgcagcgaaattcaccgcgtctttttctatcggacctcacggttggtccagtgagaagtgcagtttgtgtgcgtgttatgcgaaggtggattcatgatggaaacgaacccggcggtgctgtccgctatatagcttttgttttggccgatgaaaagggagaatccatatatgctcaagttttgccttctcaagtccaaaaacttggtgatcttcttcagatgggtagcacatatattgttgcgaaatttaatgtcagagcatcaaaaacaagctacatacctttcgagaaaaaacttatgattgaattcacaggattcactac

SEQ ID NO: 17335 - DNA, 561 bp, Sorghum bicolor
  Clone ID: LIB3476-019-P1-K1-G1
ccctgccccaaaaccctagccgccgttcctatcaaagcgcacgagctcacaggtcgacggcggcggcggcagcgaggaggacgaaactgcagtcgtgcgatgggtagcgacacagaggccgagcaaaagagggcgccggtggccctggcacccatcgcgaagccgctcgccggcaagaagctctgcaagcgaaccctcaagctcgtccgccgagcctctgaggccaaatgcttgaagcgaggagtcaaggaggtcgttaagagtattcggcggggaaacaagggactgtgtgtgattgctggcaacatttctccaatcgatgtaataactcatgttccgatactctgtgaagaagccaatattccttatgtatatgttccttcaaaagaggatcttgcaactgctggcaccaccaaaaggcctacctgttgcgtgctggtgctgacgaagccagccaaaggggagctcgaggggcaggtcatggagaaactcaagacggactacgaccaagtcatgtctgaagtcgctgaggtcacgtcggcgatgtctaagcacccacgg

SEQ ID NO: 17336 - DNA, 525 bp, Sorghum bicolor
  Clone ID: LIB3476-019-P1-K1-G4
cggacgcgtgggcggacgcgtgggtgaggatgaaattgaagcagctcgaatggcagcgatcaacaaggaaattaagcgtgtgttgactgaagtccttttgaaggttactgatgatctttttgatgagatcgcaacaaaagttctgaatgaagatgactcagctgaatccaatgaacccgctggtgtttttggctcaaaggagcctggtcttggaggatcaagaaccaagacctcggctaaagttgttctccctgctaagtcaaccaatagcactgatcataaagatagtactgggttaagctcccctaaaggtgctcttctcggcctggctagttatgattcagatgatgacgatgacgatgacaacgatgctgaggctgatggcaaggataagataccaatatcaaatttatcttctaacgctaatgctggtgctgtaaatactgaagttttaggtgataaaagcactcttggtaaaaaaaatgggaatagtaatgaacagaattcttcacttgaagtgctcca

SEQ ID NO: 17337 - DNA, 442 bp, Sorghum bicolor
  Clone ID: LIB3476-019-P1-K1-G6
cacacacgctcaccctgcacgccgccgccgcccgcgtgccgccgccgccgcaccccgtccgccaccgccgtcgaccaaatccgccgcagtcagcctacaccgcacccacccccggccctggctcgcccctccccagccccgtgcgccgccgccgcctcgctgcatcctgcacggtcgctgcaggagtcctctctctctccagagggaggaggagggacccgaagagcagaggaaacaccaagcagcagggcgcgacgcgacagggggtagggagcccaggaggtctcgcaagtcccgaggcgttcgtcggagttccccagccgcaattcgtcccgagtaggacctgtcggaggggactcggagcaccttggcacggcgccacctcgccactgcaccgtctcgcagcacacgtggcctggtgcccatccgcagcacggccacc

SEQ ID NO: 17338 - DNA, 510 bp, Sorghum bicolor
  Clone ID: LIB3476-019-P1-K1-H1
atagagaaaataattttcagtctttactctatgaaaggaacaatttaattacaaaaacaaaactataactaatacatgtaagttaaaaaaggtacagatgtagtaagaaaagaaacacaaaccacatcagttttgattttctaacaggaaacacatgtttctcgagatacttggaataatggatgaaggcatttaccgttccagaaatttttcacatcatgtggttaaggtgccaataagtcactgatctaagaacacaatttagactgtagtcagtatgcaatccattgatggccctgaatgaagttctcctttgaaaagtgtttaacatgctgttctggtgtctgactgctccactcaacccttgctgtgttgtttgcaccaggacctcgactgtcaaattctccataatagagtgtcctgagagcaaaatcacctcgccatggaagccatccctccggcctgacaactgtccccaaataacagctgacatacaacgtcctggcatac

SEQ ID NO: 17339 - DNA, 393 bp, Sorghum bicolor
  Clone ID: LIB3476-020-P1-K1-A1
cgttcccactccgccgccgccgccggctaaaaccccaattccgtcttcttcctccttcccaaatcccaacctcccctcccagcctatatatccgcgccgcctccccaagtgctatagatctataccctcgtcttcttttctattctaatcgtgcaacaacagctcgtctccagcagatcgattcgatcccctcctctcctcttccgcgccgtgttctgaggatggcgtccttcaaggtggccgacgcgtctgagtacctggcgatcacgggctggggcatctaagacgtgaagctagccaagaaggcgtgggtgttcgtcggccagcagtgcaagaagttcgacatcacccccgtcaactacgaattcgaggtgcacgccatgagctcggaga

SEQ ID NO: 17340 - DNA, 278 bp, Sorghum bicolor
  unsure (1)..(278): unsure at all n locations
  Clone ID: LIB3476-020-P1-K1-A11
gtttatgatgacagtgctgccacctgtactgtcttatgagcatacagcggcatggagaccatagagtttgtatagtaacagcatcataatgttctaggaaaatgcaactcaggactnatgttataggatgatgtgcgaatagggtactccagaatggtcgatcgatgatcctcgagcttgataggatgtgacgcaacggataagggtggcgaggatgagcaacttgtaatgtgaatattatagaatgaatatgtcgaggatgtgactggaaactttac

SEQ ID NO: 17341 - DNA, 441 bp, Sorghum bicolor
  Clone ID: LIB3476-020-P1-K1-A12
ggcacgcgcgcggacagctcccgccatgggccgcgcaatggacgccgcacccgacgctgctcctggatctgctttttgatttctttcctgacttgttccgcgctgctccgaggcatctgccgcaacagctgcacactcaacagtccactgcaaggcctgtgtccagacgtccctgtggatgtccatctaccgatgcagctatcgctgtggggacatggcggcccacagtgtagggcaccgtcgcgagcacccgcgcctgcgcgctcggcttggccacggtgcggtccacggtgtgctccgccgttgtctgcaccttccgcttctccagcgtcttctggagcaagtgctgcgggaagataccctattacatgcgctgttccctgggatagtggccaataggattgtgcgacatatttgtagttatatgcctcacgacatggt

SEQ ID NO: 17342 - DNA, 519 bp, Sorghum bicolor
  Clone ID: LIB3476-020-P1-K1-B6
cccacgcgtccgcccacgcgtccgggagaggatgcgggtactgtatgacagaaaacgtgaggagctgaaaatgttagatgagaaaggtgcagaagctcataagcttgaggccactgaactttacatcaggaagctatcaactaagattagcatagctatccaggttgtaaacactatttcagaaaagattagtaagttgagggatgaagagttgtggccacaaacatgtgagctgattcaagggttgatgaagatgtggagcgttatgctagaatgtcatcagatacaattgcatgccatatcccaagctaaaaacatagactccatgatagacactgcaaagtttggtgagaaacatatggacttgatcaagcagttagagcttcagctattggattggattgcttggtttgttgcatgggttagctgctaaaagagtatgttaaaactttaaatcagtggctgagaaatgggttatctacgttcctgaggaaactgaggatggggacgcctcttttc

SEQ ID NO: 17343 - DNA, 527 bp, Sorghum bicolor
  Clone ID: LIB3476-020-P1-K1-C4
ttctcgcccccctgccgttcggccccccttggtccctccaatgccgccacccatggcgctgctgccgctctcctccaccgccgcgtccgccgcactcccgcacttccgcccctgcccgcccgccgcgctgcttctgcgcctaccctccgcccgcgcccgcgcggtctccaccggctacgcggcgtccttctacggcggctcgcgaatgtccgcggccggcggcgcggacgaggaggaggtcggcgacgagtcggggttcggcccggggctcggtctcggcggcggcgggccttcggatgtcggccgcggaggccgcgctggcgctagaggagcgcgagatgccgccctgccctcccggcctgcgccagtacgagaccatggtcgtcctccgccccgacatgtccgaggaggagcgcctcgccttgatgcagcgctacgaggagctgctggtcgccggcggcgccatgtacggtgaggcttcaacccgggtgtcatcccgctggcatacagcatcaggaagaggaaca

SEQ ID NO: 17344 - DNA, 523 bp, Sorghum bicolor
  unsure (1)..(523): unsure at all n locations
  Clone ID: LIB3476-020-P1-K1-C5
aggaattcttgtgcaggatctaatgagtggtgtgtcccgtgagcttgataattggcacaaatctagcaaggaagaagaagcaacaaaaaaggatcctgaaactgaacttgatgaaattttgtctcatggtacccaggatcccaaagctatttttctagataagttagacgttttgcttgcagagcacaaaatggaggaggcggttcttgctttggaagctgaagagaagaaatatttggttgcagatgaatctggtaaagaatcaaatgcagagaatacagcctttaaggcagcactgattaaaaggaaagcaattcttgaagatcagcttgttaggtattgtggacagccatctttatctatgaccgaactaaggaagtgtttgtctggtttaattaagataggcaaaagttctttagcccatctatgtacttctgaaagcttatggttcacaactgcagaaaaatggtgaggcatttcttnctaactgttcaatctacacgcagacttactctgcaacttt

SEQ ID NO: 17345 - DNA, 573 bp, Sorghum bicolor
  Clone ID: LIB3476-020-P1-K1-C6
aatgcacgttgatatcaactcgtgctggatccctgggtatcaaccttcatgctgcaaatcgcgtggttcttctggatggatcatggaatccaacacatgatttgcaagccatttatcgggtttggaggtatggccagaccaaacctgtatatgcctaccgcctaatggcacatcgaacaatggaagagaaaatatataagcgccaggtgacaaaagaaggccttgcagcaagggtggtggatagacagcaagtttcaagaaccatttccaaagaagagatgctgcatctttttgaatttggtgaagaggaattaatggaacagaatgagaatggttctaccataattgagaagccatccacttctgacactattaaaacctctgagcctgtacctgtcgacagtctcatgctgagcctactcatggagcaaactcggtggatttcaggttaccatgaacatgaagctctcctccaagaaaatgaagaagaaaggcttacaaaggaggagaaagatatggctttgtcagaagtggagtcattgaggaaagctgcacttgattccgagagaaaat

SEQ ID NO: 17346 - DNA, 541 bp, Sorghum bicolor
  unsure (1)..(541): unsure at all n locations
  Clone ID: LIB3476-020-P1-K1-C7
attccgtcccccctgcccagatccaattctccctcctcctctcaacccctcagatccctgtcgctattggccgtggctgcggttttgaaggcgcagttgagggtgagcatcgactgttgctgctgggttcggcaccggcgaggtcgacacaccaaggtcggccgtcctacctgccaccaagcccaccaccgtgtcttctgccaacactactggcagatctagtatgcgttcggctcaggtcacggccaggagctcctctttaactgcagcaagatgcctctcgatggatgtcgcctcctagcggtctgcaacccggcctcctacacgtgatgttgtgtgtgtgcaaatgccaggcgttttccatcaaagcgctctgctccagctacactcatgatcgctcacaaaggctcgaacgagtagaaagagagctccttcatggctctaaagttgaatattttgttgttcctccagtgatggagctgatggccatgaagttcaagttctgaatgagaagggattgngggctgatggtcaagtgaga

SEQ ID NO: 17347 - DNA, 521 bp, Sorghum bicolor
  Clone ID: LIB3476-020-P1-K1-C8
ctggccttgcgttcccacatttggagctgatcaattcaatgataccgatggggaagagaaggagcagaaggagatctactacaactggtactacgtttctgtcaatggtggtttcctcttcgcgagcacagtccttgtttgggttcaggacaattatggctggggattgggttttgggattcctactgtattttcagcagttggagttgctggatttcttgcctgcatgaagctgtacaggtatcagaaaccaggtggaagcgcgctaactaggatatgccaggtcgtggtggcggccactcgcaaggtcaacgtagatctgccaacagacagctctcttctgtatgaaatgccagggaaggagtcagtaattgtggggagtaggaagctaatgcacactgatggattaaggtttttggaccgatgtttcaccatcacaaccgcggaagagaagtttcttgacacacctaatccatggaaagcttgtacggtgacgcaagtggaggagctcaagatttggc

SEQ ID NO: 17348 - DNA, 484 bp, Sorghum bicolor
  Clone ID: LIB3476-020-P1-K1-D10
acagccgacgccgccgtcgccgccctacggcccagatcttcgtcggtctcttctccggcaacgagcacccgaagatggtggtcctgcaaccagatcggttcctgagcgatctgacgagcatgtacgagcggagcacggagaagggatccgtgtgggtcaccatgaagcgatcgactctgaagagcaaggcacagttgcagaagatggagaagaaggggcaggaggttgagcacaggtgcctcgtccgcgcctctgatggcaagaagagcatctctacctcggtctctctaaaggagtacgcaaagttccaagcttcatacgcaacagtccttaaggcccatatgcatgctctgaagaaaagggagaggaaagacaagaagaaggctgcagatgctgagaaggcagttgagaccgcacccaataagcagcagaagaaagcatcttcaaagaaatcttcggggtccaagtcataagacgctcgcag

SEQ ID NO: 17349 - DNA, 416 bp, Sorghum bicolor
  Clone ID: LIB3476-020-P1-K1-D11
gtggccaagatcttagaggtaaaagcagctatgcatgcccaatacgacttatgggagaaagaacaggaaaagcttcggctctccaaacaaggaggtgacaacaatggcggcgactttagtggcaacaaaagggagagtaaaacagtttatacatatgagactatcaataaacctacaggacgttacagaggatggatggacttgataccatatgaaccggaccttgagtttgggacagaatttgagctgaagcacataaactggcaagttgagaagtccactctggagcttgctcgatgtgtggttggccttgaatgttttacaggagacacagagattttctcttgctctggcacaataggtgagtatgaggatgatactgcttatgtagttacatctgcaagtttgataacatg

SEQ ID NO: 17350 - DNA, 531 bp, Sorghum bicolor
  unsure (1)..(531): unsure at all n locations
  Clone ID: LIB3476-020-P1-K1-E1
cttctttatcctcagctgaaaatagtgaaaaatttggaaataccaagtatggaactgttcttttcacggatattaatttgataagtgggatggagcaaaccagctttttgttccaacaagcttcagcggttgggttctctcactctcgaatcctccgtacagttgttcagcatgcttgctcgcgattcccttctcttgttccatgcaataacgcttggaccgctttgtccagaaaactacaaccatcgaaacaaataggagcaatccacaaaggtacatcaagacagaangtttttgtgatcttcggaggggacacttcagagcggcaagtatcacttatgagtggtaccaatgtctggcttaatctccaaggttttgatgatcttgacgtgacaccatgtttgctcgctcctgcaaatggatatttctcatcccatgatcaagttttcagtgacacttcaagagaagtctggacgttgccatattcattagtgttacgacataccactgtagaagttcatgctgcatgtg

SEQ ID NO: 17351 - DNA, 236 bp, Sorghum bicolor
  Clone ID: LIB3476-020-P1-K1-E2
cccacgcgtccgcggacgcgtgggcgaagtcagagcgcaccatgaagaagccatccacgctcctccggtccttctcctcgcgccgatccacgcggctcgcgctcgctccctcgccggcggtggctccatggccgccggtccgatcgtcctacgaccgctggctcgcctcagagctcgaccagctccgagccgatctggtcgaccctgcaccagcgcgatggtcggcgacgctagct

SEQ ID NO: 17352 - DNA, 461 bp, Sorghum bicolor
  unsure (1)..(461): unsure at all n locations
  Clone ID: LIB3476-020-P1-K1-E6
tgctttcacagtaaatggacacgtgaggactttaactctgaaatgctataactggcagcttattttggattttgttttaccttctgtaattttcaaacttgatattgttgttctaggatttgcgttgttagtgtgctattcagttcactccaaattctataaggtgcttagcataatggcccaatataaacaaataatcctatttcattctgctaaaattacaccttgttttatactatcttcatgccatttaattgcatgtcctttatcctatattttctactgctataaatatagttggtaaagcagaacaactaaggtagttgtttgtagtgcatccatacacatagttcttggtctctgttattatgctcttggcaagaactcaaataccngaagttgattcaaatttctttaagaattaattcagtctcactacagttaccatgttctggagatgt

SEQ ID NO: 17353 - DNA, 409 bp, Sorghum bicolor
  Clone ID: LIB3476-020-P1-K1-F1
agcgagcctacctgcaaacatatacatgcatgaagctagaatacttaatgtatgagctagcaaatggcacaacacatgaatatcccgacatgatgctcataggcaaggaatatgcatgagacgttcgacgaagtcactacacaatgatagcacgcctgactgatccactagctgtcgctatgtatagcacgtaacaagacgcaaagtgtgtgtttcaggtactcaaaaacagatgcacgctgaggccagatagaatgtcaaggaggtcagtggtgctaagcatgtgatgtttaaagcgtatgtggctaatgcactacgactgacgagagatgatgtagagcatggtgaagggtataatggaccagccgatgccaattacactgaaggaccggctggtaccactggtgat

SEQ ID NO: 17354 - DNA, 405 bp, Sorghum bicolor
  Clone ID: LIB3476-020-P1-K1-F4
ctctgtgctgtgatccaagcggcgggcgggcgggcggctgcacgccaggtgttcgacgaaggaccccgaccggtgcaagccagccatgagggacttcccttcctgcttcggcgagagcggcgtccagatcgcggacgcgtcgtcgtcgtcgtccagcgccggcaagggcgcggcgcagaacctggtgacctgcctctaccagacgcagttctcgggccggccctgcgtgatctcgctcacgtggagcaagagcctcatggggcagggcctcagcatcggcgtcgacgacctgtccggccactgcctctgcaaggcggacatcaagccgtggctcttctccaagaagaaggggtccaagagcccctacgtcgaggacggcaagatcgacatcttctgggacctgtc

SEQ ID NO: 17355 - DNA, 386 bp, Sorghum bicolor
  unsure (1)..(386): unsure at all n locations
  Clone ID: LIB3476-020-P1-K1-F6
ctctcactccccgcgcccaattcggagctccaaccgtccaattcgctcgcctgcctacctgcgatctctccatggcgactgcagcaaccaccaggaggccgagcggcccagtcctctcggccgcgcactaccgctccgcttcgtgcacgcgcgtgtcgctccccggcgccggcgcccgcgcgcgggcaccgnccaggcagtccgtcagcgtctcgtcgtcgtcgtcgtcgaggagccggcggacctgcatgtgctcgccgaccaaccacacgggctcgttccgctgcagccggcacaaggagcgcgtcaagccggcgtcggcgggctcccacggcgtccacgggcacggacacggcaagccgagcttcccggctttccctggcggg

SEQ ID NO: 17356 - DNA, 400 bp, Sorghum bicolor
  Clone ID: LIB3476-020-P1-K1-G12
cgcgggctggccaagaaggcgcgggagctggccgtgctctgcgacgccgacgtcgcgctgctcatcttctccgacaagggcacgctccaccacttcgccgcgtacgccagcatggacagaatccttgatcgatatgaaaggtacttgctatgtgaagatagggatgtgacggaagattaccctgaagaatcggaggggaacatgagctatgaccacgtcaagatgaggtccaaacttgaagctctacagaagagccaaaggaatctcatgggggagcaacttgagtccctgacattcagagagttacagcagcttgagcaccagatagacagcgctctgaggaacatcagatcgaggaaggaccacatcttgctgaactcgatcgaggagctccaaaaca

SEQ ID NO: 17357 - DNA, 480 bp, Sorghum bicolor
  Clone ID: LIB3476-020-P1-K1-G3
caacattgcagctccaatctctatctctatccacgtggcaccatggcaccaagaatgtactgcgacaacgcctcagtccacattctgtacacttgaatctacaagatcgtcgccgtgcacaaggtcaaagaaacaagatgccagcataccagtaccccaatctcacaataattgaagaaggacaacttcaacgggacgaaagagatgtgtttcaggctgcggtcatcttcgaagtgccaccttcggcgatgcatattataggacacgaagaaatcaacaacgcaatacatcaacaacttcgggtcgacataaatgtacaagacatatcaaagtttggctctaattacttcataaagactaactgtcaacagacaactgccccgatgctacagcacacctttctcaaagttggctcacacacactaacacttgaaccatggaacccatattacaacgccatcatattttcttgtgagacac

SEQ ID NO: 17358 - DNA, 402 bp, Sorghum bicolor
  Clone ID: LIB3476-020-P1-K1-G4
gacctcgctgatggatgtatctaagaagtatggaactgattaccggatcttacatgccatcaccactgtttattcttggtatggccaatggggattcaaactcaacacagggagcttcggaatcacatcaaaagaatacttaaaagctgtagacaacctttcctcaactccattatcacacttgttccctcacttccgatatcctaggaaccagctacaagataccatttaattctaccaatctctgtcaaagcaccctctcaccacaattcgtgaactgttcctctatgtgctgtggcttgccactagcaagggtataaatatgcactatggatcaatgcataaggagcattcacatacccatatgcaagagacatggcctgatgaggaaataaaacgtgc

SEQ ID NO: 17359 - DNA, 398 bp, Sorghum bicolor
  Clone ID: LIB3476-020-P1-K1-G7
acagaccgagccaatctcatatgtctatcacaatggataagcattccataccctttacactggggtgcaccaacattcagagcagaccatgcattcggtatgatggctgcggcgatggatcatataatagagaccacgggagcattcaaagctgctgcacgatcggctagtgcgacaccaccaccagcatatgttctgagccgaggcatagggtggcagggcattggcaccctactagatggcctgtttggcactgggactggttctactgtttctgttgagaacgttggtctccgtgggtcaacaagggttggtagcagaagagtgatacaaatctctgctggtttcatgatcttgttctccattctaggaaaatttggagcgctttttgcctcaat

SEQ ID NO: 17360 - DNA, 464 bp, Sorghum bicolor
  Clone ID: LIB3476-020-P1-K1-G8
tgttagcacaaaactttctatgtgtataatatgtgtttttatgaaccaaagctcacatgcatgtttgtatgcttactatgaggtcttcctcatagaagtctgtcagatttaattgaatgtatgactatatgtataattttccatttggatcaatgccaaattctttgattgaaatattatcgcttttatttaagccatgactgcttagaatccacgttgtcaggctttcacaaaacttaaacatggtagttaagtgattgcctttgtgtttaatatgaatcaactatagtctgaataatatactattgtacttttagtcattttggttgtgattcattgatttcgagcttcttgatctaattttttggcatccagggttcaagatgtattcttgccaacaatataaagtgtgaagctaaaatataggggatgggaaagacactctgagaacggttgctaaagca

SEQ ID NO: 17361 - DNA, 250 bp, Sorghum bicolor
  Clone ID: LIB3476-020-P1-K1-G9
cctcggtcgagttcttccacctagctggcacctactagctagctagcgccgcgccatgagtcccatcatcacgatgctgctcatctatcggcgtgggcatcggtgccgacatgatctggtagggcataaggggagagcccacagggtgacgtcgagactgtgaacggacaaagctgacagaccgtggggcccggccgcgcgcgactggcggtctgcgagcgggtgtgtgtgcgtgggcgggcccctgtac

SEQ ID NO: 17362 - DNA, 419 bp, Sorghum bicolor
  unsure (1)..(419): unsure at all n locations
  Clone ID: LIB3476-020-P1-K1-H1
gccattggagctgccatctcgccgacctccgtttacaacggccggcagttcgacatcagcctgctcatatggaaggacccacaccgggggaactggtggctgcagctggggtcaggtccgctggtggggtactggccgtcgctgctgttcacgcacctgggcgggcacgccaacatggtgcagttcggcggcgaggtggtgaactcgcgcccgtcggggtcgcacacgccgacgcagatggggagcggccacttcccccgcgagggcttcaaccgcgccgcctactttcgcaacgtgcagggtgtggacggcgacaacagcctngtncccgccgccgcgctccgcctcgtcgccgaccaccccggatgctacgacatccagggcgcgtacaaccgcgcctggggcaactacttttacta

SEQ ID NO: 17363 - DNA, 384 bp, Sorghum bicolor
  Clone ID: LIB3476-020-P1-K1-H7
caggttacacctgatagccaacaagtgaagactacaagaacatgtgcgtctgagactaatcagaagcgcaagcgtagctcctttaggtcccccctgtcgtgtgtaagtgagatgtcgaagaaggatattattgaggcaaacagaaaatctaagtctacaaaaacttcccaggtcacacctgataggcgagaagtgaagactacaagaacacgtgcatctgagagactgagactaatcagaagcgcaagcatagctccttcaagtctcccctgtcgtgtgtaagtaagatgtcgaagaaggatattaataaggcaaacagaaaatctgagtctacaagaacttcctaggtcacacctgaggtggacactgtctggttgcttgggt

SEQ ID NO: 17364 - DNA, 139 bp, Sorghum bicolor
  Clone ID: LIB3476-021-P1-K1-A7
cggacgcgtgggcggcggcagcgcatcaacgcccacctcgccacgctccgcaccctcctccctgcggcgtcacggatggacaaggcggctctgctcggggaggtcgtgcggcacgtgcgggagctgtcgggcgaggcgg

SEQ ID NO: 17365 - DNA, 491 bp, Sorghum bicolor
  Clone ID: LIB3476-021-P1-K1-A8
acagagaccattttgtcaacattgccagaagaagggctttagaagcaaacaaattagcagcagcacagagtgaatcaaatgagaaacaaactaatggtttagcacatgttggttctgagatgatggatgacaagttaacagctatgcagagagagtcaaacaagatgcaaaataatgatccagcacttttcagtactgaaactctacactctggaaaatgtgatgtgaattctgattcaaagggaggtttttttgctgaccagtttgagaatatggcaaattatcgagcacattatgaatggactggtcctgagatatggaaacagactaaagggaacctgcatgcctttgttgcagcagctggtactggcggtacaattgccggagtctcacgatatcttaaggaaaagaacaggagcatcaaatgctttttaatggacccttctggatctggtctgttcaataaggttaccagaggggtgatgtacaca

SEQ ID NO: 17366 - DNA, 453 bp, Sorghum bicolor
  Clone ID: LIB3476-021-P1-K1-C10
aaagaaggtgaagaagaaatcatgtctgaaagaaagcatacagagcttcctgatgataatgcaccatctaagcaggaaagagaaccaaagcaaggtgggactaggaaaccaagtcagttggtggatacttcaaccaaagctacttctgagcaggttgctgcaaaattggaggaaagcgaaatggaaaaagaattatgtgcggaggcagaggatccttcagagttcatcactcatcgagccaaagattttgtgtcgagcatgaaggacattgaagcccggtttatgcgtgcagctgaagcaggaaatgaggtttccagaatgcttgaaaccaagaagatcagacttgacatatgtgctaaaatgccaggttcttcaggcaagctacctactgcccgatttgtgtcagcacttcgagtgtgctgcaatcgggatgttattctcaaccaggaaact

SEQ ID NO: 17367 - DNA, 457 bp, Sorghum bicolor
  unsure (1)..(457): unsure at all n locations
  Clone ID: LIB3476-021-P1-K1-C4
gttgatcccaaacccgctagcacccaggacaccaccgccgactccagcgaccgcgacgatgacggcggcggcggcggcggtggaaacgcgcgttcatggcccgcgacggagcgcgtctcctcgtacctatggagccagaactcggtccacgccctctgcgagaagttcggcgtcaacacgaaggcgttcaccccgattcccgccggcgaccgacgcgcgtgctcgcctccacccggtggctccatctgcttgtacgcggacgcgctggaggccgggatgcgcgtcccgttcgaccccttcttctgcgaggtgctctcgcactttggcgtcgccccgagccagctgtcgcccaactgctggcgcatcttggccgccttnctggcgctcttccggcgccgccggcgtgcaaggcggccgcgggtcccgtgttcctgcacttcttcgcgcttggcgtgct

SEQ ID NO: 17368 - DNA, 412 bp, Sorghum bicolor
  unsure (1)..(412): unsure at all n locations
  Clone ID: LIB3476-021-P1-K1-D5
ggtgagcacaccgggtgtaggggccatggatttatggatagctctccatccggatcctgactcaaaaccacaaatatatgatgctatcctcaatgggatggaggtgttcaagttacagcttatcaatggtagccttgcagggctcaatcctatcccaagtgttgccccggccaatgatgggacaactaagaagaagtcaactgttgggcctatcgtcggtggagtggttggaggtttggtggttcttgcacttgggtattgctgcttgtctatgatctgcaagcgtangaggaatgctgggaaggatgcatgcctgagtgatggacattctggttggctacccctgtgttcttatggcaaatcacacactttcagtttggccaagttacacactactggtagctatgcttca

SEQ ID NO: 17369 - DNA, 433 bp, Sorghum bicolor
  Clone ID: LIB3476-021-P1-K1-D9
cgcaggctgtgaccgtcgccaccaccgagtggcgcgcctgttgcaccatcgagcccgtcctggaggacggggagcccgtgtccaaccagaactccatgatcgagcacgaacccgagagcgactgcgacacatagttcatcgtggtgaccggcgacgaagatcttctggagaacacacaagattcatatgctcaatgctcatgtcattttctttcaaatgaggcaggcacttgcgacatacttggagaacaacagagccgttatcaccgcgttcgggttcacgctggaccggtcgcacctgcataccatcttcatgctcgagtggacgctgtttctgtggttgctcggtaagaccatcgtcttatagtgtaaaagaaaaaccattgtcaatgtagacggagaggtgtgtgcctgtgtacaacgtccgcatctcc

SEQ ID NO: 17370 - DNA, 246 bp, Sorghum bicolor
  Clone ID: LIB3476-021-P1-K1-E12
cctcgccttgcctcgccgccagcgcaactccagcccggcccgggatctctctcatcacatccccccctctctctccgctcccccgcctcggggcctgcctcggatgctcccggcctcgcacccgctgctctacgcctgcgtcttccgcgacacccacctcgtcgccgagctcccccactcccactcccagaccaccgtcgtcgaccccgtagtcgctcccgacgtccccgtcctcgttcctgacta

SEQ ID NO: 17371 - DNA, 475 bp, Sorghum bicolor
  unsure (1)..(475): unsure at all n locations
  Clone ID: LIB3476-021-P1-K1-G3
agcaactccctgacgatgtaattgtgcactgtagtgaaaaaaatgcatcaatgttgactttagatggagttgacgtcatgggggaacgcttagcaaatgaggtgcttgatgtaattagtcgaaggccagaactcactaaaatttctttccttgcacactccgtcggaggattagcagcaagatatgcaattgcaaaactttgcagacatccagacagcgcatctgatggaaatactaaagggaccatctgcggtttggaagcaataaactttattactgtagcaacgcctcaccttggttcacgagggaacaagcaggtcccactcctatttggatctgttgcaatggaaaaggttgcttgccgcgttgttcattggatatttaggagaactggtagacatctctttctaactgatgatgatgaagggcagcctncacttgtgcagcggatggttgaagatcatgacgatctcta

SEQ ID NO: 17372 - DNA, 503 bp, Sorghum bicolor
  Clone ID: LIB3476-021-P1-K1-G8
gtgcgctggactaggtctgccagccactagccgcggtagatctgccgctgcccctcccatcccgtacgctggcttaaacactcctgatttagccaccgccccttccgttgcgatggatctgccctacccgccgggcaagtggcggtggaggtcaacgatggtggtgggatcttgatttcggcatgaagtaatgggatggggatttggattggggcactaagaaactggtttggctgatgggggatttggattggggcactaagaaactggtttggcttgatgggatcttggtattggggaactcaattttgatggtatgatgttcaatccgccatggattagggatcgtgtgtgtatggtggtaagggagggcgttgcttttgaataccgcatcatcatgtgattttatttgcgatggtgtatggggagggcgttgcttttgaacagtacatctttatgtgattttatttggtacctggttagtacttcagattatttttcac

SEQ ID NO: 17373 - DNA, 157 bp, Sorghum bicolor
  Clone ID: LIB3476-021-P1-K1-H1
gcacccgataccctacctcacttcagcacgtcccgatttgacggcgcgtcgcttcgacccggctagtgttacacccggacagatccgacggtcgttcgctgctgcagcgggcgctggactggcttggcgtcaattcggactgagggagggagggagg

SEQ ID NO: 17374 - DNA, 549 bp, Sorghum bicolor
  Clone ID: LIB3476-021-P1-K1-H7
cccacgcgttcgcccacgcgtccgcccacgcgtccgcccacgcgttcgcccacgcgtccgcccacgcgtccgggggtttggtatttggatgtgtgttcactgcatccctgggttacacagcagctgttaacttgattgagctttcaatgcagtatactccccgtgttgtttattactaccaggagctgattgttactgcggctgcctctgttcttctgtacatcacagcttcatactaccgataaacacacaccgtgagcaattattgcctggcttagacgactgtgagatgttaggacatgcctggagtttcagttggacaccgacttgcggactggcggcggtgccttgtgcgtcaagggatagccgagaatccacagattttgtagcatactttcaccagcatctgtcagttttgaggcagagagttcttagtgcaggatcttatgtgaccagtttacggttcagtagcaaacgcagatggctgatgagaaacatttcacgtgaatatttcaacagcagtgttgtgtatgaatttgttttattaga

SEQ ID NO: 17375 - DNA, 259 bp, Sorghum bicolor
  Clone ID: LIB3476-022-P1-K1-A9
atctaccatatcatgaaatcgctagacatagtttacaaggctatgaatttctggccattcacctgtgaggtactaggcatgatctgctactcactgcgaccagtttatggaaataacataattgtgaccatgcctcaactctccaagttgctaagacaagtgatgattataatgtctctgtagactataaaaactatgaatggattactacaaatggtaacctattgggttggggtcatgacaagtcgttagctctgag

SEQ ID NO: 17376 - DNA, 499 bp, Sorghum bicolor
  unsure (1)..(499): unsure at all n locations
  Clone ID: LIB3476-022-P1-K1-B11
gcttatgggactggcgccgctgcctctgtccctgcccctgcaggacatgacacaagactttggactgagcagggcgaagagtttggcggtgatgaggaaactggaatggaaactgaagatgaaaccgaagaggaaggaaatgatcatgaggagggcgatgatgatgatgatgatgacgacgacgatgaggtggacatcgagtgattcatttgtttgcttctttcttcaggtaatgctgaaggggaagagaaaagcttatcatgtatttcgtagtatcattacgtcgtcgttgtgattctgcacacgtagaactttatgcttgtgggtgtgcttgaggacttgttttaagattcctataagacttattttgttttagtgtgcaaccatgtaacgcaatggttgatgctcttaatctcattgtgtgctgtaagatggtcttatgagacatggaagaagaggccacccgtttgcatgcatgggaaaatgcangtcatgccac

SEQ ID NO: 17377 - DNA, 497 bp, Sorghum bicolor
  Clone ID: LIB3476-022-P1-K1-B4
cagcaatgtcttctagatccagtgcgtgtcagaacaccagtagagcaccttgtaaattagctgctcaagcttctcataaatatcttaaagttgtgaagggttcagatgccaaaccccatggaatttacgttaataaaggatcaagtgcttctcttgttgcttctagaaacagtactgcaactgggaagtcgcctgcaaagatcttggtggtgcccagttcatctcaagctagtgcaaaaacttccaggactgctcaggttacatcgaaaagaacagcagtacctaccagtgtaaacaatgtgtcacagaataaaaggaagcacacactcgtggcattggatgaaaaatccccaaagagagaatatgtgcgcagatctgcaccttcaagtgcaagaagcagctccgagaatctccctcgtgctgcaaaggcacctaagatttcaaatgtgacaaatccgggtccaagactgaagtgtgcagaattcaagtcatcaagt

SEQ ID NO: 17378 - DNA, 405 bp, Sorghum bicolor
  unsure (1)..(405): unsure at all n locations
  Clone ID: LIB3476-022-P1-K1-C11
ctatctcgcagttcgtccctccggctccccttcgccttctctctctctctacgccacgggcccgcgcgcatcgcagccagagccaggcacgacggcgccgtcgcgcatgcaggaggtgtccgtcgagcccggccgtcggccggcgcagcagccgcaccatcagttcgcgggcgtcgacctccgccgacccaaggggtacgccacggcgccggtgcaggaggcgacaccggcggtcaaggttgccgagggcggcgagggaggggacccgtgcccgcggtgcgcgtcgcgggacaccaagttctgctactacaacaactacaacacctnccagccacgccacttctgcaagggctgccgccgctactggaccaagggcggcacgctgcgcaacgtccccgtcggagg

SEQ ID NO: 17379 - DNA, 457 bp, Sorghum bicolor
  Clone ID: LIB3476-022-P1-K1-C12
gagccagtgaaccctatatcagaactgaccctgaggtttgtgaagaatgtattggagaaagagagagctgtgcattggtggagaaacttaattatcagaatgaagacatccatgtttattttgtccgtgggaaagaagcaccaaagtctattaaagaagcatgtagtaaagctgctgttgtagcagatcgtcggacttcaaagcgttcccggagagcaagctctggaaattcaattagtttgaaagtctctggttctacatccatctatcagttgaaactcatgatatgggaatctttagggattgttaaggagaaccagaaacttcacaaaggctctgatgaaattgaagatgaccttgctactcttgctgataagggtgtttttcctggggatattctttgggtcagagactctgaaatctatgagaatcgtgacatagcagatgaaatttcaga

SEQ ID NO: 17380 - DNA, 445 bp, Sorghum bicolor
  Clone ID: LIB3476-022-P1-K1-D1
cagaaaatacagaggttgtcttggcagaatgcacaaaaaattttggcccttggctggtcacacatgctatggaacttctgacagctgataatgactatgcggatgttatgttgcatgaagagagacctaacttaggtggtataagcatagaggaactgcaccggctagtctatgctcaagttttgtgttctcattctttaacttggcagattgcgcctacttatctgtcctcatgtctaaaccaaggcctaggactcttggagattctacttctcaagcaacccatacaagataattgcctagtactcaagactttggaaatttgccgattgtacgaactggagaatgttagtacaatcatcatgaagattgctggcatttatcattggaagcatggacgaaaaggaactggtgtatactggttccagcaagctcatgataaaat

SEQ ID NO: 17381 - DNA, 122 bp, Sorghum bicolor
  Clone ID: LIB3476-022-P1-K1-D3
aaacaaatgaagttgaatgcatcaaggaccaacacaatttgaatcctagaaaagaatgcagggggccggtccgttagtgagcgtgttctcaagcgtcactttactgcgggcttgcggacagg

SEQ ID NO: 17382 - DNA, 369 bp, Sorghum bicolor
  Clone ID: LIB3476-022-P1-K1-E10
ctggaactggaacaaggcaagcaggaccatcgccatcccacttgcgttcttgccttgccttctgcccgcgagattcctcagccgccccgcccttataagccacggcaaccgcgagccccggacgcaaccgcagcagggcgttgggacttgggtgagtgagtgagtgagactgggggagcagcagcagcagtgccgcactgaactccccttcttttccttgtggttcggcgccgcgcggcggagaggcacagcacagcagcaagcaatgccgcgccggcagagggcgcgcagcagcgaggagctcaaggcggaggacttcgtcgactcggtcctcaacttcggcggcggcggcgtgggcgacgaggatga

SEQ ID NO: 17383 - DNA, 556 bp, Sorghum bicolor
  unsure (1)..(556): unsure at all n locations
  Clone ID: LIB3476-022-P1-K1-E8
tggagagaagttcatgaccgaatgcaatattcactaattaataggacatgaaatgcaccaaacactcatgtttgggcatttgaaccacagatttcatgggttttgcttaaatgatgaggttgtcgtgaaaataaacagaattgctcctggcctgcagtttctatgatgactcaaacacaccccagttgaggcagtgctcaaataccaaaaggagaaggttgaaatgctttctgcacaaactgacaaaagtagccataacaatgtccgaagttatgattttttttaccaagacgtaatatagattatttcacactgttcattacggtttgatgattttttccatatgcagcttggcactgcaaaaatgcagttacttgctgctcattgttggtataaaatctttggtgctattctttttgctcactgtgcaagagcaatactgagggagnccaatgttgagtgcggcacagcatgtacagtacaggaaccagcttatgatgcttgtatttattagcagcaaggcttgcatttggtactggtagatgttgatagccca

SEQ ID NO: 17384 - DNA, 436 bp, Sorghum bicolor
  unsure (1)..(436): unsure at all n locations
  Clone ID: LIB3476-022-P1-K1-F2
aggcgctgcacgaccccaagcatctcttcacccagcagttcgtcgccaacggtcgcggcctcgtcgccgctgacggcatccttgtcaacacgttcgacgccttcgagccggacgccattacggccctgcgtcaaggctccgtcgtctccgacttcccgcctgtgttcgccgtggggctgctgcaaccggtgaggtttgaggtggcggagaagccggcgcactacatgaggtggctcagcgcgcagccggcgcggtccgtggtgtacgtcagcttcggcagccgcaaggccatatcgacggaccagctccgggagctcgccgccgggctcgaggccagcggccagcggttccctgtgggtgggaagagcaccgtcgtggacagagacgacgccgncgacctcgccgacctgcttggggacggttcctggagcggtgc

SEQ ID NO: 17385 - DNA, 432 bp, Sorghum bicolor
  unsure (1)..(432): unsure at all n locations
  Clone ID: LIB3476-022-P1-K1-F5
ggttttgcgatggagatattgttgactttacaggtcatggttgaaaacatggaacctgagaaggttatactttacccacagctcttttggggctgtgttgcactgatgcataccgactttgtacacatttactgccaggtgcttgagttgttctgtagggtaattgatcgattgacattccgtgaccgaacaacagaaaatgtgttactctcaagcatgccacgtgatgagtttgacatcaatgggtatgcaagtgacctccacaggctggagtctagaactacttcggagagattgttatctgtgactgataccgngaaggtccctgcttttgaaggggtgcagccgctggtgctgaaagggctcatgtccactgntagccatggatctgcaatngaggtgctatctaggatcacgatacctacgtgtgac

SEQ ID NO: 17386 - DNA, 280 bp, Sorghum bicolor
  unsure (1)..(280): unsure at all n locations
  Clone ID: LIB3476-022-P1-K1-G6
cggaaacccccttttttattcctcatccactcgccgcacgacgaagaggagagcggctcccgttccccaccacctactcggcgtctcggcccggagcagcaggttctcgaagcgagccgcgaaacattctcgcgccaattgtgggggccatgggcgccaacggccacccgccgccggcgagcaccgccgcacagaacgggtcccactccggcggcggcngaggaagaagaagggtgaaggggagggagagcctaacccctagcaacgggcgggcacgggc

SEQ ID NO: 17387 - DNA, 393 bp, Sorghum bicolor
  Clone ID: LIB3476-022-P1-K1-H11
cgtcaacacaactgcaactttacgatctaacttgtcaaaatgttgctcatctgtgtcaagaatctggtgtgaatacttgttcaataagcactggattagacaaccatgggacattaaatattcagcagcaatcagccaaccagacaagctccatggttgagcatatgcctgagaatggactccagtcagatccagttaccaatgggtgtagacaattgcttatgtctagtaatcgcacctctccacctgttcgagttaccaagcagcaaattgccacctctccacctgtccaagttatcgagcagcaaaatgcctctaattcatccttattaactccacatgaaagacaacaatatggtccccagacttgtcaaactgttgctcatcaggatc

SEQ ID NO: 17388 - DNA, 107 bp, Sorghum bicolor
  Clone ID: LIB3476-022-P1-K1-H6
ggtccttcagagatgggcacgatcatccatgcgcaagacacgcggacaagcccaaggcggcggagtccggcagtcactggtacgggcccgaccgcgtcaagtacctc

SEQ ID NO: 17389 - DNA, 331 bp, Sorghum bicolor
  Clone ID: LIB3476-023-P1-K1-A11
gggtgggctaccgccgccgccgccgccgctgccgcccgacgccaggtgccgaggccttttctgtctcgtcaccgtcgaggcggagacgatcactcactaggttttaggtccgcagggcgcacgccgtagctgcactgcccgagcgggtgcggtgaccctgtgcagcggcagtggcagaagtggctgtcgcaggccagcatcttggctcccggtggccgcgtgggtcagcagcagtctgcaggccgcacgcacaccgcagccaggctgccaagcaggcggctctgtgttgcctgtttgggtgatttgccttctgtccttgcagttgccgatt

SEQ ID NO: 17390 - DNA, 505 bp, Sorghum bicolor
  Clone ID: LIB3476-023-P1-K1-B2
caggatcaaacatgaagagcaacatagaagctgtttggatggggaactctcctcctttgctaaggctcgcaattgtggatttggcactaccaaaaactcctaatgataactctctgtcattgtttcctgacccccttgttccagagagattttattgtgcgcatggtggggggcttgacatggtcacactgcacttcctacctttttcataccccgaaatgtcttcgacaccaccctctgtgcatcctgtcctcactacaggcaacagcgaaacaagttctccttttctttctggatttgttatcatagctgatgcatatggtcatgtacagttagttggcatcacatgcttgggtgagtgctttgtggtggagatgaagggttggaaggaaccgacacctcttcagctagacatagaaagcaaaagcaccaaggatgtggagccttctgcaactggaatgatcagcaaagagcttattgtggtccagacccacccatacttcca

SEQ ID NO: 17391 - DNA, 518 bp, Sorghum bicolor
  Clone ID: LIB3476-023-P1-K1-C4
atttgagggtacaaagtaattttactcaaatgactacaatgatgatttagagtaaattttttgaaagactctttgagatgctcttagttaacaagataagcttagtttgaaatttatctatttgtgttttatatgagatggaatgtgctacaaagcatgcagtatgtgctatcggcctctgaaacctagcatctgatcaaggtgcctcgatgtctgctactgtggctctggcataataaggcatgttggtgagtacactgtgcacaaatctctatgaaaagggttcaatttcatggttgcccttggagcttgtggctctagaaacactacaagaactgcacgttcaatggtggtggggcaccatgggtttaggttgttctgtgagagttgatcgatgaggctaatctctggcatctaacatacacgatggggctcagcccctcaatactctttggttgggatagatcacaatgcttgtttgagtttggtcatcgatctttttcagttctgttgcacat

SEQ ID NO: 17392 - DNA, 523 bp, Sorghum bicolor
  Clone ID: LIB3476-023-P1-K1-C8
ccaaaataaaccagctgaacagattcatcactacacagaggtggttcttggaatcctagttagtataagataattaaccatatacttagaaaatctctcaaaattaaaatgggatatttgatgaattagatgttcacgagcataacttcaatataacctctatttgcaagattggatatgaacatatacttgctctctgctaaacctgtggcttgccgtcaaatggggttaacatttgacatttgatatatcaaaatattatatagcgttgactgcccagtccatgaaccaaatctgcacggaactagccccctgtcaacctccacaatcaaagagtattatcttgtttgcttggatactgacttgtaggcaaccaggtggagacacatcgatccatggagattctttgggggcatgcctcttccttccaaagttactagtaaaagattactcactggagaagcaaacattggtgatcttgcctgcgtgtgaagcttgctcagcaggcaccagacaagatact

SEQ ID NO: 17393 - DNA, 522 bp, Sorghum bicolor
  Clone ID: LIB3476-023-P1-K1-D10
gtgcaagacaatcaagttctactcatgatgataaagataatagtgacagttcagctgaaggtttcaggaacaagagacagaagtatgctgctcaaagcgcttcggatatacttggaagtgaagatgcaactcaaggttcaaagcatactgaaataaaagctatggtcagggatatactgttcaaggacattattgacaaggagcatgatgctgaaatggcttacgtggatgaagtgattaatggcatttgtaatgctactgacagtgtgattggtagtggtgatgcttctaccaaaggcggacgaggcctcaagccgagtggtagtggagtggagggtgagtcaagcaatgcccctgggaacaacactgatgacacaggggcaacttagtgcacgccggaataggcaaatcaggatcatgcaaaccctcgctctgattgctccatcaggatcaccattcggcaggaattgagttgttgcagccatgcaccaaaaagtctaattcacttatgagaaccataag

SEQ ID NO: 17394 - DNA, 446 bp, Sorghum bicolor
  unsure (1)..(446): unsure at all n locations
  Clone ID: LIB3476-023-P1-K1-D3
gtgtttctgataaatctagtggtgcaagaagattgcaagatgccatggtctcaggatatgtgcttcaaagggctcctgggagagatgcaggcattcctgactggtactctctgtctaaaactgaaactgaaactggtgctggtccgacctcaaaaaatgttgctacaaaggaaagtgcagcatcatccagatgtattgaagactttgagatactccatggngaccttcaaggattaacagatacgatagaatttttgaagagcttatctgaacttagtggaaatgatttgaagagctccaagaagcaacgcctagagagaactgcagcatctgttcttnttgactgggagacggaaatatatgtagcaaggggcacctggacgtttggccgtcatgggtggcatngctgattattcaggaagtctcgttttgcagatgccccttcg

SEQ ID NO: 17395 - DNA, 193 bp, Sorghum bicolor
  Clone ID: LIB3476-023-P1-K1-D8
tcacgcttgcatgcggggctcttctcttctagtatagtgacacttaaatccaattcattgcccctctttttacatcgtacgtgaccgccaaaaccctatctacccccaacttaatcacctcgctgcacttgctaaatccctcagctggccaaatttaaaacagtcccgtaccaatcccctttcccaacatgtg

SEQ ID NO: 17396 - DNA, 460 bp, Sorghum bicolor
  Clone ID: LIB3476-023-P1-K1-E10
gccccggggaccgggaccccctcgtcgacaccgtcgcaccccaccaccccctcctcgggaacgccgtcgtcctcgcattgctcgccgccgccttctcagggcgggagccccggcaccggcaccggcgggcaccatccgggcggcggcaagctgccgttcccaccggtgtacggcgtgtcgtacgcgtcgccgccgccgccggggaagccgtactactaaaccaccttgaccgcgctcgcccgcgctgcctcgccgtcgccggagtataatacttttcacccgccagtataatacttctccatgcatccatgtagtattttttttcttggattcttttttttttgtttctttgatgatgcgtatttgatcaaattgaatcaaagagttgctaaaaatataatatattttttttattttttttaatttcattttattttattttaatttttttttttttttt

SEQ ID NO: 17397 - DNA, 385 bp, Sorghum bicolor
  Clone ID: LIB3476-023-P1-K1-E4
ctcgtgcgcgctctacggctgcgagagccgctgcatcatcgttgcgccaccaccttgtaacctcctgcctaccgctattgtcaagctcgtcgccgtgtatggcgacgtctgaccggctcttgcgtgctgcttactccacctgccgcgcccacagcgccgtcgctacggccatatgcgggatccagccacctcacgtcgaaggcgaagatctacaccgacatcaacatactgcgccccaaggagtcctgggactaccaggcgctcaccatgcactgccgtgagcaggctggctatcatgttgtcctgacagttagcactgcataatataccgagctctctgacggcatccatgttaacgataatgagacatgcatgacatagatcc

SEQ ID NO: 17398 - DNA, 298 bp, Sorghum bicolor
  Clone ID: LIB3476-023-P1-K1-E5
atcccgctctcgctctcgctctcgccgccaccacccgcacaccccacacgcgcgctccgcggcccagtgcccagcgcggacagcgaccaatggcgagggcgcgcgcgcgggggcgtctcctcctcctggcgttcctcgccgtcgcagcggcggcccgacacgacgcgcccgcgccccgggcgtcgtcgtccatctccgcggcgcccgagtactcgcgccttccgaaccggtaccacggtcgccacgcctccggtcccgcgcttccgtcggttctgtttgagctgtttccggacatata

SEQ ID NO: 17399 - DNA, 352 bp, Sorghum bicolor
  Clone ID: LIB3476-023-P1-K1-F3
gacccacgcgtccggaagaagccagctaaggacaagaaggctgagaaaggcgaggctgcggcgaaacccagcaaggacgaggctagcaaggaggccgaggtggtcaccgagtccaaggagacgaagaagggctcctctgagccggcgaagcaagacgccgccgaggaggcgggcgcggaggagccagcggcggttgtggcggtggcggcaagaaaggcaagaagaataagaagaacaagcccaaggacggcggcgagggggaggaggcccaggccccggccgcccctgccacggcgccggcgcccgataagaaaccgcctcagcagcctgtcgtcggtgccagcgccgtcgc

SEQ ID NO: 17400 - DNA, 523 bp, Sorghum bicolor
  Clone ID: LIB3476-023-P1-K1-F5
caccgacgcccacctctacgatgaccccgacgacgcctccatccccgagctcctcgactcccgcttcgatgctgacaaggtcgacgccctcaagcgcctccttgccctcatcgcccagggcgtcgacgtcgcacacctcttcccgcaggttgtcaagaatgtggcgtcgcagtcgctcgaggtcaagaagctcgtctacctctacctccttcactacgccgacaagcgccaaaacgaagcccttctttctattaacattttccagaaggatttatcagatataaacccattggtgagggcttgggccctgcgcactatggctggcattagactacatgttgttgctccgcttgtgttggttgctatcaagaaatgtgccagggatccatctgcatatgtaaggaaatgtgccgcctatgcgctttgcaagctgtgtgacttgcttccagatgaaagcacagctttggaggagatcgtggacatcttgttcaacgacaattcccctggagtagtcggagctgcc

SEQ ID NO: 17401 - DNA, 520 bp, Sorghum bicolor
  unsure (1)..(520): unsure at all n locations
  Clone ID: LIB3476-023-P1-K1-F6
aacccctattgggtctgaaggaagttgtgcctttattgaatcaatgttcatagggcccattgagaaaacctcaagtcctgacgaaatatccaaatgcagcagtagcatgatagagatcgaacataatgtcaatgaaaaaggaactcctgttcaatttgaaacccaaatggatcaagtggagccagtgaggagcagtgtacgcagcaaaagtcgcaacattgttgtacgtgccaatgaatcagaacattgtttctccaaacaggaaggtagaatgcctagtaacactgaggtcccagagcctttgttgcctatgaaggacaaaattctggagctggattatcattctccaccagagatcaactcgcaactatgcattcctgataccactcagaaatggcttggcctatccaagtcgctttccagtgcagttattagacagagaaggcatcattgggatgttgtaatgctgaaggaccccatgaagagattatggcctattatntaccatgacaacccaata

SEQ ID NO: 17402 - DNA, 311 bp, Sorghum bicolor
  Clone ID: LIB3476-023-P1-K1-G4
cgaaaagatccctcctccctcccaaaggcgagtccgttagccaagaatcccggcaacaatgacctccctttcctccgccgtggcactggcgtcctcgtgccgggcatgcccggcggagggcagccggagggcgcggatggtggtgacgcgcgcggcggcgtccagcccgaagctgccgaacgggctgcggctgcagatgtcggtggtgggaggcgtgtccgcgttcggcgcggctgcggaggccctggcgaagggcgtagttgagacactgctgatttagcggcagatgtacaattgctagccttgtggcg

SEQ ID NO: 17403 - DNA, 393 bp, Sorghum bicolor
  Clone ID: LIB3476-023-P1-K1-G5
gcaaaaggccttcttgattagaaagggcaggtgactcccatactgctatctatagtaagtaaagactcatctatgctagatggactggaagatgcaagcaccgagatggatgaagctaatgctagattgcatgagactattatttcaagtgcaaaaacaaagaacgcagaagggccagtggaattttcatggatggatgatggtgcaggattgactgcaaatgcttacgaatttctgtctaagatggataagttgactaaagaagcgacttcacaagtcaagctacttgctgaaggtgaagatgaaagacttgcattgacgagcacatgttcaaaatatgaccaagcataagctcttgggaagacaactattgacgtgactcgtattgctgtc

SEQ ID NO: 17404 - DNA, 470 bp, Sorghum bicolor
  Clone ID: LIB3476-023-P1-K1-H11
atgcatatactgtcgaaagataccagcaccacgctgtgaagaacaccactcactcgcaggcagatgcatcacacacacatgtcacagacacactgacacactcgatttcaacggaggcgagctcatggcggtgatgttccgcatccgcgctggttctgctgataatggtaggaactacaacgatcttgttgaagcgatcgctgaacaccaaggaagacactgaggagaaagaaaatgagacagcctgcactgcacggtgattcagcaaagaaattcacagccacataggccacgactgaggaaactatggcgaaagaggacgctcctgcacttgatgataagaacgatgcttaaaagtgaaggcgtctttagtcctaaaccacggtcaaatgagtgtgcttccattcatttcgtcgtcaaggttcatgttcctcttacaatttacattgcgctttctctgggattaatgc

SEQ ID NO: 17405 - DNA, 409 bp, Sorghum bicolor
  Clone ID: LIB3476-024-P1-K1-A11
gccccttccctatgctcacacatccaacaccatgaaccccaccttgccatctatctccttccaatctccttgtttcaagatccaaccagatcctcagcggagccactggcctcctcggcaacagagcacaaggaaaccagggctgtctctaaagcttatacgcgcaacactaggaccagacgccaatggcggactccacaatgctgaccgcagaggtgccaccttaccatcttcgcccctgtcagatgtagttcaggagttttactcctccctcaatgaaaagaacagcaaacgactcgataagttgatggcccctgattgcatcgtcgaggatactgcttattataagccactggatgccaagtgtacccgtatctacttcaaacgattgatggaatccatgggaaag

SEQ ID NO: 17406 - DNA, 463 bp, Sorghum bicolor
  Clone ID: LIB3476-024-P1-K1-B10
cggacgcgtgggctgcagtaaagccatctgcacccccagaacataatgataatgttaatgaagaggaagatgagtttgcccagctagctcaaaggaaaaacaaatccgtagtaagtagtgacgatgcatcgtccagcactggggcggaccttgcccttgtacccattgatcaagcagtttcagaatcgtcatcttctggtgcaagcaatgcactggttcttcttgatcctgctcccagtactagcactgaaccaaaagagctggacatgatcgaccttctaagcctcaccttgtgcagccctactcctgaaacttcaacagattcttcagcacaggatcaaaatggaccccagcaacctgcagttacacataatcaaaatgggccccatgaacctacagttacaaatgggcaacgatatccttctagtgtgccacagtatccttcaaactaccagccttacgc

SEQ ID NO: 17407 - DNA, 547 bp, Sorghum bicolor
  Clone ID: LIB3476-024-P1-K1-B12
cacaatattagtgtgtagaataggtgtcaatcttcaagagttcagcttgcaatggataattgagttgcattttttattcatcatgagtttattattgaataagtcacaaagttatgcttaaattagttggtcggcatgctcccccatatattttttgttcattcaaaaagcaaaccgattacatgcctgtctggtttactcttcttgtcaagtagaattgtgtttatggtttggtttcgttgtcatgccagttctaccatctactgtaaacgtagttaggtgattgggtggtgtctagtctagcaggtgaatgcctaggtagtctatatggataagcagaatattgaatttataattggattttcaacaagttagcatccaatcagcatgaagataacgaagaattccatgagctaatttggcatacgtggcataattaaatttaagccaaagagtgtgaaactcatttgtgtattttcccaatcaagcatgaacatttcaagccaacaatcaattgttggtgctaaaagtttattgtccacttcgt

SEQ ID NO: 17408 - DNA, 483 bp, Sorghum bicolor
  Clone ID: LIB3476-024-P1-K1-C10
ctgatgtaattttgccagaactactcaaaatcgagacactcattttcaagggaaggcaggttgaaagagaaacactgactgctgctgaacaaattccaggcagtgagattcaacaacatatatggaataattataagaaagagatgaaatatcaatggtttatttccaatggatcaggagaagatcagtcttttgaaccactggcaaccaagtgctctcgctcatacaaagtacgctttgaggatatcggccgttgcctgaaatgcgagtgctttgtcattgatatatttggacgatctagtgaattggtatctgctgtgactgctcctattttgccaggaaggcctaaaattgaaaagctggagattgaaggaagaggttccacactaacctatatgctgttcagggtacgtatagcggaggcaaagaagggcagagtaaaataccaatggctaaagcgatggtcggaagccctgtcttatc

SEQ ID NO: 17409 - DNA, 545 bp, Sorghum bicolor
  unsure (1)..(545): unsure at all n locations
  Clone ID: LIB3476-024-P1-K1-E1
cccccccgtcccccgtgtcccgtgccgcccaagccataagctgccagccgcctggatctgatcatctatctgattggattggctcttgtcaccggggggcgaagggaaccaaggtccaacgaggaagaaccagcaccagctagcaggcgttgttcgtccaagaacaccatcagcaagagatgctgcagctgctcatggcgctggccttctcggcggcgccgctgacgctgtacgtgccgccggtgcgcagcctcagcctcttcgtcgaggccatggaggccgtctgccgcgactgcgcgccctactcccacggcgccgtcctccgcttccgcctcggactctcccgcatcctcgccggcctcgcgcgcgccctccgctaggcggccggcgggcccccatcgccgcctccgggttcctccgatcctcctgcccatacatacacacgcacacgcacgtatggtgacctttctggttcttgctccattctntctctgtcctttccactacctagccaacaggtggtttctagcgcagcnacagcagtc

SEQ ID NO: 17410 - DNA, 471 bp, Sorghum bicolor
  Clone ID: LIB3476-024-P1-K1-E12
cgcacacggtactcgtcctcctcctcgcagagcttgcaccagcacgccaccttagcttgctgtgctcgcactcgcacagttgcgagcgcattgcatttgctcagcacgcagctaggcggccgggaagcatagctggcagatggcgagcagcgccggcgggtacggcgtgaagcagcaggcggaggccgccgcaactgccgcgaggaagcgggtgatggtggtggtggatgagacctcgggctccaagcacgccatgatgtgggcgctcacccacgtcgccaacaagggggacttcctcacgctgctccacgtcctgccgcactccggcagcggccggggcgaggaggcctcctccctcgccaactcgctcggcacgctctgcaaggcctccaagccagagggtggaggtgaagcccttgtgatccaagggcccaagctgggcaccgtgctcagccaggtgaagaagctgga

SEQ ID NO: 17411 - DNA, 510 bp, Sorghum bicolor
  unsure (1)..(510): unsure at all n locations
  Clone ID: LIB3476-024-P1-K1-E6
gngaaaacatatattcaaagataaaagtttaccaaagtgtatcaaatacagattttcatttatactgcacttttgttctgactttgcatgcttttaagcttgtgtcttggaacttcctggacacagcaacctttttcagaactatgaaaggtaagcatacacaggatttgtacatacgcagagattcgcatactgtcccagttgacacgttctctttcctgaacagtttccttgacaaagctgcagtcgttttgtggaatgaacatgatggttctcgcaatccatggagactttgcacagtcacacaagttgaagagcttaaaatattactgaggatgtttccaatctgggcaacaggaattgtgttcttcaccgtatgtgctcaaaactcatcgatgttcatagaacaagggatggccctcgataaccaaattggtctttcaagatccagcagcaactctgtcatccctagtgttatcagtaatggtgttcgggttccaattatgagag

SEQ ID NO: 17412 - DNA, 429 bp, Sorghum bicolor
  Clone ID: LIB3476-024-P1-K1-E8
gcgatttaccagattccagctccacgagcactctctctggctagatgccacactccattcttgcgagcggtgctactaaccaggcggacgtcctctactgaaaccacgactgagaatgaactaatcactgcaaatgctacagcatctgacatgtggattggtgttgcctaccacgcacgtgagtaacaacccgactgtgactcattgctcaacgatggcaaaagcattagtgccaatgtgaatgcgaagcaccaaatatatgggaggatctaaaagaagcatccaatactactacaactagtcgttgtggggactcgattgtcggcgatgatacaggataccttcgatttgaagattctaaggcagttgaaatggccccaatgacttctgtacttgctgatcaatgtagcttgattattaacgaccaca

SEQ ID NO: 17413 - DNA, 472 bp, Sorghum bicolor
  Clone ID: LIB3476-024-P1-K1-F4
ctgaaagaggcgtgcaaggatacaaaaaatttgtagaagatatggaagagcttaccaggaccaaggttttagaagtgaaagggctatcgacgaaacaacatctagggccagcaatgctgcatctcctcaagaaatttactgggttaacaaagtttaagattgacctcctcccagtgaacacctggatgagtcattctaatcgattttctcattatttgattctggtcctaattgccaaataaataattacggaaactctatatgtcagttggctgaaatcactaaatactttagttgacgagaacattttgaccccatcagcaaggttaggaatcaagtttgcacttttatcatgtggcttacacgccattttaattttattgttatctttttatcttcactttttggtgccacaaggtctggttatgactcgtaaactggtagtagatgtagacaatacaactggtagtgc

SEQ ID NO: 17414 - DNA, 394 bp, Sorghum bicolor
  unsure (1)..(394): unsure at all n locations
  Clone ID: LIB3476-024-P1-K1-F7
atcgaagttcaagtcattccgcgaatcgtagctcaaaatctgagttcctccaaatctccctttgtacagtgcactctgaatttatattctgaagttttcatcgaatctacaatttttcctgctcctgtccaggaaaagctgcaattcccatcagtgcatggaggactgcgaggcaagggccgcaagtggaagctgtggcggacctcctccggcgaccagggctccatctggcgcggctccagaggcggcagccagcgctcggcggcgtcggaggcctcggacgacgcgtcctcggtggccgcccccgccgacccgttcacgngcccgccccgccgtcgccaccgtcacccgcgccccggcgcgggacttctatgccgtccgccaggagtgggcc

SEQ ID NO: 17415 - DNA, 517 bp, Sorghum bicolor
  unsure (1)..(517): unsure at all n locations
  Clone ID: LIB3476-024-P1-K1-G1
gcttccaaatctcccaagtcaccaagattatcaaggagttgaggcctttacgcacttccttggggacagcagcagaagatctcttccaccatcctgagaaacgagtcacagaaggctgtggtgccaactgcgatagccccaaatgttgaaaaaccagggaccaaacttggcgagcaaaaacgcagcccactatcaagtgattaattgtctcatcctcctgatcacataatggacatttctccggatggggtaggttcgtctttgctaagcgatcagctgtccaaacccggttgtgtagtccattcctttggctcattacaatacaatgttagaattagaattattagttcttgatgaaatgaggagaaacttctgaccctctttgccaatctgtagttttattacatgttaaacttgtctactgcacatattgcctctatgtgtactcatactttgagcaattttctaagtgcatccacanattcttctaatacatttcacaatatcttcaaatgct

SEQ ID NO: 17416 - DNA, 517 bp, Sorghum bicolor
  unsure (1)..(517): unsure at all n locations
  Clone ID: LIB3476-024-P1-K1-G11
gtttctgaaggatttgctgggaaagttgttagtgatgaagtgaagcaactggcccagggggtccagaacaagttacgtgacctgattggctctgagaaatttgttgaagtctacaagagcgttcggatgggcctgaaacagaagcgggacggtagaaagcaggcacagaagattgttgcagccgtggacccagaacggcatgccaagcgaaagcagcgtatcgcatccaagcaccgggaacacaagaggcggaagataatggctatgaagattggcaggtggatgaggtagttctgtattaggctctgcggaatttggtggcaatgggatcatctaatntgtaaggttttgtactggctaattttcgtgccaaaagtggtggcataaaattaagttaatggttaagtagatagaaaaatttgttttatacgctgtgtcactaacttttgacaggccgacctaattttgtgtgatgatgagtggcggatcatattgtaagtaaatgttagaggcattc

SEQ ID NO: 17417 - DNA, 407 bp, Sorghum bicolor
  Clone ID: LIB3476-024-P1-K1-G12
aatatttcagattatggtattatttgctgcttggtgcttaactctgatcttttttatattttcgtagattgttgagaattcccgtctaagtaaaggaatggactactttactgctttgcttatatctatgtgatgaaaagttttgaaaaataatgtcagtacaccctgcctatgagcatgtctcactttcactaacatatttaatatttgaccatttgaaatctctaatcattctgaggagctcaggcgttccggcggtcgcgagcgggcagccacatggcctgcatccatgagtggcgctcaggcgtctcaggttgcaagcggcgagcctatgcagccgagcggccatggtcatgtccttggtggccgaacgcgccacactgtgtgtatcgccaccgtcaggttgc

SEQ ID NO: 17418 - DNA, 534 bp, Sorghum bicolor
  unsure (1)..(534): unsure at all n locations
  Clone ID: LIB3476-024-P1-K1-H1
caaatggttcaagcacagcctttgagtcagggagtcaaccatcgccatccagcttagtcgatgtgaagcaggattcttctcttaatattggaaatgatttctccttgttccattcagagatgaaatgtacggggcacggcaagtgtgtttgtgaagaagcaaattcttccgaagagtctcagaggcacctatctgataccgaggagcacattccatccttgaaaagtgttgtgggcgggatgcctcagcagcctctagttgaaagcagagaagctgactcatcatctgaacctgctgacacaggtgatgaaggatttcagtcatccctatcgggcagcacagaaggcagtttgtcctcaacacctgcagactcagatgctggcaatgaggaagcaagttcattatcagaggatactgaaccagatgatgtgtaccatccagctgacatttctccagaagataaacatttcatgatgtngcttggttggaaagaagatgaaatagtgcaagtggcacccttggatttcgatgaga

SEQ ID NO: 17419 - DNA, 349 bp, Sorghum bicolor
  Clone ID: LIB3476-025-P1-K1-B1
ggaaggcgcatattcgagatggtgccgctgttgtacaatacctttcttggctggataatcagatgcaggagaactatggagcttctggttacttcagtgagataaaagggtcacagaaaaaggaaaatttagcaaccaaacttactgaggtgtctgtgagtgacaaacttgaggcttccgtgcaacacaagagaactttaaaggtttgagttttcctacaatttcatctgtgggaccaaatgcagcaattattcactataaacctgaagcaagcacatgttcagaaatggatgctgataaaatatatctttgtgactctggggcacagtacttggatggtacaacagac

SEQ ID NO: 17420 - DNA, 312 bp, Sorghum bicolor
  Clone ID: LIB3476-025-P1-K1-B6
gactagttctagatcgcagattgaagtgatcattcttcacccgaattttgcaaagattttaacgtgtccttgttcgcaggacgtgatcacgtcgcggagcagctacctgaggcgtctgctgtcggagtccggcgacgtcgcgatcgcgctgccggcgggcctcacgttcgacgcgttcgcgcaggccatcgcgacctgctacggctccggcgaagcgacggcggcgctgtccccggcgagcctcgcggcggcgtgggcggcggcgggctggctggagctggagccgggcgccgggccgaggggggaccccta

SEQ ID NO: 17421 - DNA, 317 bp, Sorghum bicolor
  Clone ID: LIB3476-025-P1-K1-B9
cgtactaaagggagaaagggggccaacaagttaaagaacccgggcggtcctttttagggatccaaatttatactcctcttgtggggaactaaaaattcttttattggggcaccttaaacaaattcagtggggggaaatttacaaggttccgacttggaaaaccctggggaaacacaaatttatcggcagggagcaaatttccctttaggcccgcggcctaaaagctaaaaggcacgcgcccattttcttttcaaaaaggtacgcaccctttatgggtaaattaacccccccttgttcggttgttaaagcccgggggg

SEQ ID NO: 17422 - DNA, 411 bp, Sorghum bicolor
  Clone ID: LIB3476-025-P1-K1-D1
gccacgcgtccggtatattgctactggcagcttctcggctctgttgcatggtattaagggcgtatgtgagaagaccccattagattggaacaccatgatgaagattatacttggtacagcacgcggtatagagcacattcattcagaaggtggctccaagttcgcacatggtaatatcaagtcaaccaatgtcctgctggatcaagaacgcaacccttatgtctcagactatgggctgagctctttgatgagccttgcaatcaacacttcccgagttggcactggttaccgggctcaagagacctatgaatcaaggaagttcactcacatgtctgacgtgtacagctctggcgttctcctcatggagatgctgacaggcaaagcccgccttcagtcacagggtcaggatga

SEQ ID NO: 17423 - DNA, 305 bp, Sorghum bicolor
  Clone ID: LIB3476-025-P1-K1-D10
gaaagatttgctaagtgccaaattgttcttttacatgcttcttatccattttctaaggaagcatcctatcttgcatctgtttactcccaggtctaccttgattttggcttggcaattccaaaacttagtgttcacggaatgacatcgtccctgaaagagcttctggagcttgctcccataaagaaggtcatgttcagtacagatggatatgcttttccagagacatattatctaggtgcaaaaagggcacgggatgttgtttatcgtgtcctatctgctgcatgtgaagatggagaccttagcat

SEQ ID NO: 17424 - DNA, 304 bp, Sorghum bicolor
  Clone ID: LIB3476-025-P1-K1-D3
aaatagaaaaaaaaataatataatcgaacataaattaaacataaataaaataaataaaatactacaatgaaacagataaaaaaacattgaaggggacaacaatcaaaaaaaaaggggggggtcccctttaaaggatcaaagtttacacacccttgcttgcaaggtcaaagcttttttatagggccaccaaaattaaattcattgcccggctttttaaaactacttgattggaaaaaccctgccgttcccaaattaaattgctttctataaaatcccctttaacaaaagttgcttaataccaaaa

SEQ ID NO: 17425 - DNA, 419 bp, Sorghum bicolor
  Clone ID: LIB3476-025-P1-K1-D5
atgggactttcgggagtgtatggcgtgctataaataaacagaatggtgaagttgttgctgttaagaaaatgaagaaaaagtattattcttttgaggaatgtatgagtttgcgtgaagtaaagtctttgcgtcgcatgaatcatcctaacattgtgaagctcaaagaggttgtcagggaaaatgatatattatacttcataatggaatacatggagtgtaacctctaccaacttatgaaagatagggtcaagcctttctcggagtctgaagtccgcaactggtgctttcagatttttcaggctcttgcttacatgcaccagaggggctactttcatcgtgacctcaaacctgagaatctgttggttagcaaagatgtcataaagctagcagactttggtcttgcaagggaagtctcatca

SEQ ID NO: 17426 - DNA, 333 bp, Sorghum bicolor
  Clone ID: LIB3476-025-P1-K1-D9
gacaagatgtccgtattgtatgccacttcaacttgcctaagtcaatggaatccttctatcaggagtcaggtcgagctggtcgtgatcaacgaccttcaagaagtgttttgtattacggattagatgaccggaggagaatggaattcattttgagaaaccccaaaattaacaaagcacaaccgtcttcctcttcaaatgagctttctgagaaggctctagctgacttcagtcagattgttgactactgtgaaagttctagctgccggcgaaaaaagatcattgagaagcttggagagaaagtacaaccaactttatgccaacgctcatgtgatg

SEQ ID NO: 17427 - DNA, 443 bp, Sorghum bicolor
  unsure (1)..(443): unsure at all n locations
  Clone ID: LIB3476-025-P1-K1-E3
aactcaccagcctgtccccaacaatgcacaccagcatccattctcccccatcagcaggcggctcttcttctcccccaaacccaaatgagtgctgagttttgcgctgctgctggtggtggcggtgcggctgtggccatggagttcggagtcgtcggggatgtgatggggctgcagcaaggcatcgccgtcacagcgccatcgcccagggacagcagcgacctgtgtctcctcaagcgagcagccctcacccaggcagcggcggcggctgctgccccctacccctcccccttcctcgacgaacagaagatgctcaggttctccaaggcggctcacacattgccctcaggcttggattttggaggcccaagcgagcaggctntcctgctgtccaggaccaagaggccatttactccctcgcagtggatggagctggagcaccaggc

SEQ ID NO: 17428 - DNA, 397 bp, Sorghum bicolor
  Clone ID: LIB3476-025-P1-K1-E8
atcttgcccaagtccatggatgaagcacagtcgaaatcggcattccagatgcaagttttcaagatgccaccagacctgaaccggactaagctgttcccccctgccaatttcaagattgccggtgcatcatcgctgaacccggactacacctgtggccagccggtgcctgtcagcccaactgcgttccctgacccaagcgggcttgactcgacgacacttgctgtggcaacatggcaggtggtgtgcaacattaccacaacgaagggggccaagcccaagtgctgtgtgaccttctcggcgtactacaacgactcggtgatcccctgcaacacctgcgcctgtgggtgccctgcaaacaggcgaggtccaacgtgcagcacgactgcacaatccatgc

SEQ ID NO: 17429 - DNA, 307 bp, Sorghum bicolor
  unsure (1)..(307): unsure at all n locations
  Clone ID: LIB3476-025-P1-K1-F5
ggcaggccatggagactctggcggcggctcgccgtgccaagagaaggaagccggaggcgcgcaagagccccgaacaggagggtggagcaatcatctcgccgctggtaccagcgacgagtgcgcctgaatccaatcctccgggtccgggagccggaggagatgaatcccacatccaagatccaccgcctggagccgtcggaggggaagaagacggngtcgaccgaatcagcctcctccccaacgccatctctggcgctcagcccctctcaacctcgacggccgtgacgttcgcaccatcgatgtcgtc

SEQ ID NO: 17430 - DNA, 225 bp, Sorghum bicolor
  Clone ID: LIB3476-025-P1-K1-G1
agtcctgcttgcttgcgcggctgcagacgagagaggcgtaggagagggatcatggcggcccccgacgtgaaggcgaataccatcaaaatcatggatcaccgaaatgatcaggaagcacagaacaactccattatcccccgactcacctagaccggagatcctggcattaccggacctcttgatctcgtcgagggttaccgaagtgcctacatagacatccctaac

SEQ ID NO: 17431 - DNA, 363 bp, Sorghum bicolor
  unsure (1)..(363): unsure at all n locations
  Clone ID: LIB3476-025-P1-K1-G9
ccaaggccaacaccttctggaactgtcaccactccagtgtctaggagatcggacagccagtggaggtttgatactccgacatcagaagcatccatgtccatgagaaggcgcaagttcagcacactttcttcaatctcgtactggatgacacagatcaggctggctgaggctgcttctaagcactcagtttctctgggcttctttaagcttgctcttgaatcagaatgtgagcctttggaccggatgagggaagaactcaagtcctatgtagcccggcatggcctagcgacagagttggaggacccagttaaggacattcttcaggtttatgatatngctgaggattttgagaagctgaagatc

SEQ ID NO: 17432 - DNA, 395 bp, Sorghum bicolor
  unsure (1)..(395): unsure at all n locations
  Clone ID: LIB3476-025-P1-K1-H9
gcgcacgctcgggcgctcctccaccgcccgcgagtcgcgacgccgccgccgccacaccatccggccgccctcgccctggcatccgtgcgccgccgcgacagcgacgtgcctccacatcgctgtctctcggtctctcttgtgcttgcgacgtcaacgcgggggtcacgctcgggcgctcctccaccgccgctgtcttagtcctcgtccgccatcttgttcctctgcgccgtcgccatcttcaccttcaccgccattgtcgtccgtctcaaggaccacgagctgcagaccacggtcaaggccctggttggagccttcgagtccgtcatctncaagattgcaacaacaacactaaagctaaatgtgccatctaacaagcacatgggagtctacatcac

SEQ ID NO: 17433 - DNA, 360 bp, Sorghum bicolor
  Clone ID: LIB3476-027-P1-K1-A11
agcagctgttgttggtcatagcaaaggaggagatgtagtgattctatatgcttctatttacaatgatgtcagcaaaattgttaatttatcaggccgatttgatttaaaacaaggcattgaagaacgaataggggaagggtctatcgatagaataaataaagaaggctaccttgatgtcaaggacaaatctgaacatgtcaactacagggtaaccaaagaaagtttgacggaacggcttaatactgatatgcatgctgcaagtgtttccataagtaaggaatgcaggttcttaactgtccatggttcagctgacaagaccatacctgtagaagatgcccatgagtttgcgaagcatatacc

SEQ ID NO: 17434 - DNA, 315 bp, Sorghum bicolor
  Clone ID: LIB3476-027-P1-K1-B12
gcatgatttaccagatgacacagaggaactattttggggttcacctatcagagtgcaaaatgagatattaccccccaaaagtcttccagaggaatatgacgctggcaaagctgaatcacagttcagttctctatcatctgatcctcatagcatggcaagccagcgtgcatggaaacaacctactcagggtcccaggcctaagtcactgctggaaatccaagctgaggaacaattgcgtgcacagaaaggattagctactgaaactgctaagccagcaacttcagtcccttcaattccttggaatggcatgacaat

SEQ ID NO: 17435 - DNA, 520 bp, Sorghum bicolor
  Clone ID: LIB3476-027-P1-K1-B7
cccacgcgtccggtaggattagtaccttgtgttgtcctacttctggggcttttcttcattccagagtctccaaggtggctggccaacatagggaaagagagagaattccatgcttcattacaggagtttaggggggaagattctgacatttctgaagaggctactgagatcaaaggactatatagaatcaattcgccgattgcctaaggccaggtttcaagatttatttcagagaaaaaatatgtatgcagtcacggtgggtgttggcctgatgatttttcagcaactgggaggaataaacgccttaggtttctatacaagctatattttttcctctgcagattccaatcacattagttggggcccttctgatggataggagtggaagaagagcccttcttttggtatgaacactctaaatctgagttgtacagaaaagaaaagcagtgttgtatgtgtctagtgtctttggttttcaggtctcttcatctggaacatttcttgggtgctttctgactgg

SEQ ID NO: 17436 - DNA, 459 bp, Sorghum bicolor
  Clone ID: LIB3476-027-P1-K1-B8
acaagatccaaaattaatgcttcattccacgaggacaaatccccaggttttgtgatatttttagtgtgtggagctgataccaatatgccatcgattccatctcagcactagcaaaggtgattcatctcttctcatgagctttgttcatttgtagaagtacaagtgcagatactagttaatttctgccagctccagagtctagacctgatacaagtatgtcaatgactccatctcagcactaggcaaggtgattgatctactctcatgccttatggttactagcttgttacctgctaagagtgtacactatcttgcagttgttaaagaaaaaaaaaatgatttgtttgcattcatgagaacgcactgctactttgattaatatatgatatatgattagcttactggtctctgatttgcatggcaacacctcagagctatttataactgatctactatata

SEQ ID NO: 17437 - DNA, 485 bp, Sorghum bicolor
  Clone ID: LIB3476-027-P1-K1-C8
ggatgatttgccagtcaacggcatggaactttcactcagcaggtcaacccctctcagtcaggaaatattggcactaccaacaccagaggactaccttaacagggtcttaccacatgatgaggtgaaagtaccagtaggtcctgctggtttgtttcgtttgccaacagattcgtttcccagaaatgagatggcctcaagggacggctatggttcaaggttcagtttgacctcgatgagtccatcctacgtatggtcaagctaccatgctgatcatattatgccagctctgtccttttctgactatggttctgggttgtcactggatccatactatgatcctccaagttccatgttgctatccatgcccgctgctggtgggcgtagcgtccctgtgtcagatttcagaataggggatggttccttcctccgagagttccacggcctggcaactattagggtgatgccttctggagacacaactacac

SEQ ID NO: 17438 - DNA, 413 bp, Sorghum bicolor
  Clone ID: LIB3476-027-P1-K1-C9
cttatttgtgtagatatttggatagcagacagttgtctaccaaatataatctgtgcatccaaaaaatcaaagtggtatggtgaatttggcaacaaattatttatttctgattcagtttctcttgtataaaggtgtcaattactaatgctatagtttacatgtgcactgatctattctgtaagtagatactcctaggtccgtaatatgtgagcattgcattgcctgcactcctattctagatgttctgaattaatgaagcctggaactaatgcggaaattttcagtgttactactgtctgcttcagttctaggttctagatgtacatcataatattttcgcttagtaatgagccacttcaaacttggatcaaccaaaaaacagtgaaagggggcaataccctaaatgtgtttat

SEQ ID NO: 17439 - DNA, 512 bp, Sorghum bicolor
  unsure (1)..(512): unsure at all n locations
  Clone ID: LIB3476-027-P1-K1-D1
caaaagaggtttcgaagaagctaatgtcggaaaaaaatcttcttgaccaaaaagttcaaaggcttgaaagaatgaaaagtgaagagaaaagcacaatggagaaggtttatgcggatgaatgccgtaacctgaaatctcagattgctgagttggagcagaaattgaaagttgcgacacaatcgttaaatgttgctgaatcaaatcttgctgtaagaaatgctgaggttgatagcttgcaaagtagtttgaaagaacttgatgagctaagagagttcaaagcggatgtcgatagaaagaaccaacaaactgctgagattcttaaaaggcaaggagcgcaattggtggaacttgagaatctttataagcaagaacaggttctgcgaaagcgttattataatacaattgaagatatgaaaggaaaaaataagagtnttttgtcgcttgcgtcctctaagcgacaagggacgttcttttgaagagaaaaatatagtttgcagtcccgatgaatttac

SEQ ID NO: 17440 - DNA, 418 bp, Sorghum bicolor
  Clone ID: LIB3476-027-P1-K1-D7
attgcggcaaccatgcaactatgaaactgcaggaccaggaaggaacgatccaacctatgatcatacagacacgtgctctgatatgagcatttcattgtcagagagtgattttcagagaaaagatcatgctttgtcaatgccagagcatggaggcaccaactctgaagcctcggatgctgttggaagtgcatcggcagagaaaccaactgttgatgctgattacgatgaggtaacgtcagcttctggtccgaatcattttccgggggttgcatcaagggcaggcagagttcaatattggatgatggaagactcaccactcctggaagacggagagctgagcgatgcaccaccagtggacaggcctgcagctgtcacgcatcatcaaccgaaggaacacacgccagcagcagcaacaccc

SEQ ID NO: 17441 - DNA, 327 bp, Sorghum bicolor
  Clone ID: LIB3476-027-P1-K1-E10
tgctcacgtgcgagcttacctagctggcttctacacggactcgtacaccaatgacagtacgactaacactagtgttattacgagaagtcctaccacatgacgtgcacgaaaaagcagaggtaacaccagaaatggtgacgggagggcattaccgaggccaatggtaaacctgaagggagacatgatgtattgctaatattgacgctgagagcgagcatatgtggaagtaaacataagactttagagaatactttcgagtacctgaactagttcggtgattgtggcgcagatggatgcacaattgtatgtaacaatgaaagctataaa

SEQ ID NO: 17442 - DNA, 441 bp, Sorghum bicolor
  Clone ID: LIB3476-027-P1-K1-E11
gtctatgcttaatcacttgcgattctatttgccggagatgtacccaaagctacaccgcattcttttcctggatgatgatgttgtggtacaaagggatcttactggactctggaagattgacatggatgggaaggtgaatggcgcagttaaaacatgctatggatcttttcatcgatatgcacagtatatgaatttgtcacaccctcttatcaaagcagagcttaatcctaatgcctgtggttgggcatacggaatgaatttctttgatcttgattcttggaggagggagaagtgttctgaacagatccattattggcagaatcagaacgagaaccggacattatggaagctaggaacgctacccccaggcttaatcactttctactccaccacaaaacctcttgagatatcttagcatgttcttggacttggatacaatcc

SEQ ID NO: 17443 - DNA, 281 bp, Sorghum bicolor
  unsure (1)..(281): unsure at all n locations
  Clone ID: LIB3476-027-P1-K1-F1
gactagttctaatcgcgagcggccgccctatcttttttgtttatatgcgctggatagcctatgctgttaatgggcttattatgtggacgatgagatgtctgtaggtgctgcangggcacacaaagctttaaacttttttgggacaccttctcctaggcttagcttggggcattacacttgcaaggaagcatggttttttggaccgggggggaaccatttaaagggtgctggtttccggctggctggtgaaaaaaacaacccaacaatttgttgattgtgac

SEQ ID NO: 17444 - DNA, 459 bp, Sorghum bicolor
  unsure (1)..(459): unsure at all n locations
  Clone ID: LIB3476-027-P1-K1-F11
gccaagcttgtggaagcagcagcaagaggtggngttagaatcaaaagaaggccacaccgaggggacaacttcaccctgatgcaggcatttgtgaaggctgatttttggcttatttggctatcacttttgcttgggtcgggatcagggctgacagtgatggacaacctgggtcagatgagccaggctattggttacaaaaacgcacatatctttgtgtcactgatgagcatatggaacttccttggtcgtgttggaggtggctacttctctgagatcattgtcagggagcataaatacccaaggcacatagcattgacagtttgtcagatcgtgatggctgttgggcatgtactatttgctatggcttggcctggaactatgtacattgcgagctngctggttggacttggatatggagctcactgggctattgtgccagctgctgtctctgagcttttt

SEQ ID NO: 17445 - DNA, 209 bp, Sorghum bicolor
  unsure (1)..(209): unsure at all n locations
  Clone ID: LIB3476-027-P1-K1-F2
gcgcgtgctactatgagcaaccttccatctattatgtagagaagcaactggtgctcctgacagcactactgcagcatgaagtggcgatgctatgaaatccggatccgangaacgaacatcaacctatattgctcatcgactcacaacctcaatgccgtgtgatcagatcattgattaggagaatgggaaggttttccaagaaggaccac

SEQ ID NO: 17446 - DNA, 376 bp, Sorghum bicolor
  unsure (1)..(376): unsure at all n locations
  Clone ID: LIB3476-027-P1-K1-F7
ctcagatgcgctgttctcccctcctgaagcaaagcacaaacaaggttaaactgaggcataacgcagaaagcaaggatttcctttgggtttttgtcatggatcaggatgttggtgctcttcatggagataaccatgcgttccacattgagttacgtagatctctagtacaactggtttcctctcaaccaggcgaagggcaatctttttctgcccctgccattcctattgtgtcagtgaatggctcttgctatatgatagcacttagcaaggtgttccgtcagcccaacaggcaacatagagtcatttttcctgatggaactacagtgatgcttagagtagaagatataaggatgncaggatctctggcagcattttc

SEQ ID NO: 17447 - DNA, 456 bp, Sorghum bicolor
  unsure (1)..(456): unsure at all n locations
  Clone ID: LIB3476-027-P1-K1-F9
cattcgtccatctcttcggcgttacacctccttgcgacaacgcgaagcgcctcgccgaccggcgaccgccgttccccaccaaacggtcgaacaacaaccctcgccacccttgcaactgcgccatgccttcctcttccttctccacctgccactcctcgtcctgcgtccaaatcgttgatcccaaccccgcgagcgcgagcgccccggacaccaccgccgactccagcgaccgcgacgatgacggcggcggtggtgaaaacgggcgctcgtggtccgcgacggagcgcgtcccctcgtacctatggaaccagaactcggtccacgtcctctgcaagaagttcggcgtcaacaccaaggcgttcaccccgatcctcgccggcgaccgacgcgcgtgctcgcctncacccgcgggctccgtctgcgtgtacgcggacgcgctggaggccgggatgcgtg

SEQ ID NO: 17448 - DNA, 336 bp, Sorghum bicolor
  Clone ID: LIB3476-027-P1-K1-G12
cccacgcgtccgaccacgcgttcgcagaggaggaaaaaaaaacaccaagggaaaaaaaatatcacctcctcttcctgcgttcgtgcccctgctcgatccccgacgaagaattcgcccccgaatccatcgatctgctctcccccagtccgccgatccgtggatcgatccgtgcgcgggctcggtccgccccggggttacgatctggtcctcgcctcgccggaggaggagatgaacggcgccggtggcagtcaccaccagcagcagcagcagaggctccggcagcagcagcagcagcaggcgcttctgatgcagcaagcgctgcagcagcagcagcag

SEQ ID NO: 17449 - DNA, 243 bp, Sorghum bicolor
  Clone ID: LIB3476-027-P1-K1-G2
ccgacgcgtacggatctgtttatggtgatacctgacaacatataactgttattcatgatgacacgaaatttgaacgcgagctgtgtgctatatgaactatgtctcgagacttaggcgatcagctcattactagtgagattattgcgatgcattgagtacatcgcaagagtcgtgcaacagaagcgacaggcataagagacatactcgattctgatgtatacggttcacaagagaataggatga

SEQ ID NO: 17450 - DNA, 395 bp, Sorghum bicolor
  Clone ID: LIB3476-027-P1-K1-H7
cggacgcgtgggccgcaacccagcatcaacttgctccccaagaagaatcgagcgcaagaccttctcgcgcggccatccatggcgaagcgtctgatcccgtcgctgaaccgggtgctggtggagaagctgctgcagcccaagaagagcgttggcggcatcctcctcccggagaccaccaagcagctgaacgctgctaaagtcattgctgttggccctggtgatcgtgatagggatggtaagctgatccctgtatctctgaatgaaggcgacactgttctgcttccggagtatggtggaacagaagtgaagcttgctgaaaaagagtaccttcttttcagagagcacgacatactgggaaagcttgaggagtagctctggatcgtcaaaatgtcaac

SEQ ID NO: 17451 - DNA, 490 bp, Sorghum bicolor
  unsure (1)..(490): unsure at all n locations
  Clone ID: LIB3476-027-P1-K1-H9
ctcaaagcgagctgtgggaatggagttcgaactatctcaacaacagagatcactctttctttatacagaaaatgcccttgtccgcgagtcaacacagcttcattctacttttgtgaagttgaaagaattgagagagaactgcaagacaaatcttgagacgatcagcaagtcttcaatgagaaaatgagtgctgcatgttgcgctgctgaactgttagttttcctgagacttagtatgatcagctggcttggtttgaagcaagatgtgcattgagatttttcctcaacttaggaattatgatgcttaccatcagtttggcactttggctgtagtgattactcctatcataaagcattgntctagtatgttttttttttttggataaagattctagtatgtttgtaggtgatgtaaaaataaccatggtaaggtaggaactgtaagacatcggcatcttgaccttgtcctttgagtgaggtttctttataag

SEQ ID NO: 17452 - DNA, 426 bp, Sorghum bicolor
  Clone ID: LIB3476-028-P1-K1-A8
atttatttggtcacaattgcttattcatgttaccatctcttagagcatgactagttatacaaccactgctggctggatgtacatttacagccctagctggttgtaaacttacatatcacttctcttctctctcctacatctcaagcataaagtctacttacaaccctttattagagcctattgggttacaagggataattgttagccaggtaaaattattcccagcccatccaagcaggacagatgactaatatgtgggctaatttttagccaagccttcaactagttattacccaactagttggccaactgtagctaatttatgctaattttccagctaataactagccaagcccttatacttgttcttatttttctgacttgtgattagcagtgtcaaactatctaccacaagtatcatgtcac

SEQ ID NO: 17453 - DNA, 506 bp, Sorghum bicolor
  Clone ID: LIB3476-028-P1-K1-B2
agcaagtgagagtcctcacctcacctcaccccaccccaccccaccccgccgccgccaaggccgtcgacgccctcttcggctcgcgcctcgcccgcgacgacctcgtcctcgcggggctcgagtccgagaaggccgtcagcggcttccacgccgacaacatcgcccccgccatcctcggcggcttcgtcctcgtccgcagctacgaccccttccacctcgtcccgctctgctccccgcccgcgctccgcctccacttcgtcctcgtcacccccgacttcgaggctcccacgagcaagatgcgcgccgcgctgcccaaacaggtcgacgtccaccagcacgtgcgcaactccagccaggcagcggcgctcgtggcggcggtgctgcaaggggatgcgggcctcatcggctccgcgatgtcgtccgacagcatcgtcgagcccaccagggcacccctcatacctggcatggcggccgtcaaggcggcggccctgcaagctggagcgctg

SEQ ID NO: 17454 - DNA, 405 bp, Sorghum bicolor
  Clone ID: LIB3476-028-P1-K1-B4
gcacaacgtccagcatgttaatatgagccatatgccacatatgatgagcattgggggaccctattctagttatgttgttgctacagtcggacctggtggattgcctcaatcaacttatggtattgatatggtctatccaaatgccactgttaatccagcaagtgagagaagagatgttccgcctgaagtttatcacaaggaagcttacatgaagtcgtagctctccaacacagtcagttgccgcagcagattggaaaccatgctcaatgggataagactgcaatgacatgcctgcaccaagactaagggagaagcaaggacatagccaaggatccatcaacaactttgtgactgaagggcaactgatttcagtgagtgtcttcaaacagaatacaaggtgcttta

SEQ ID NO: 17455 - DNA, 506 bp, Sorghum bicolor
  Clone ID: LIB3476-028-P1-K1-B6
cccacgcgtccgaaaaaaaaaaaaaaaaaaaaaaaaaaaaggggcggccgctcgcgatctagaacgacaacacccgcatctcctggacgccgtccccaacctttccgtcacgcgccgccgccgcccgtcactgtgctcgcgatcccgccggcggctccagaggacttgtcgcgtgctcggccatggcatcgccaccgccggccctcgagatcctagttcgcgagcccgacggctgcacggtgtggtctggcccgccatacccgccgggcaccaccactccgccgcagagactcccaaagacggcgtgcagcgccacctctttctccaccgacggtgcccgcctcctggcgactgtggcatcggcctcggccaccgtctacgactgccgcacactcgccgttgcaagtgcttcgagctcccgggtctcctcgccgccgcgctgtcgcccacgggggcgatctgcagaccttccagaagtatcctcgccgcaggagaagaatgtcacg

SEQ ID NO: 17456 - DNA, 448 bp, Sorghum bicolor
  Clone ID: LIB3476-028-P1-K1-C10
gtccccgtccccgcgtcgccgcttcccccctcccttcccttccctccgtcctcggcgaatcgaagccgctagcccccgacatccatggctgccgcgttaacccgcctccgatccgccgtcgagcggctcgggccctcccgcgcccgcgtccgcgccttctccgcagccgctgctgaggccgaggcggccagcgactctagggctttcaccgcagccgcggtggccgccggctcggggctggggatctggctgctgtcctcgaacccgcagccgctcgcggactccggcctggcggaggatgccgccaccgcaggcggcggaggcaatagcggcttccccgcagcttttcggcgtgtcggagccaccggggagcgggaggccagattcctcttcggagattcatatcgccgaagggtgtcttcaagtatgagaaaaggattaggacgcg

SEQ ID NO: 17457 - DNA, 488 bp, Sorghum bicolor
  Clone ID: LIB3476-028-P1-K1-C5
cccacgcgtccgcccatctcccactctgagctgcaccctatctcccggtcctagcactctagcagtgagggaggagagcatggtggccatggttggcagcgcatcgagtagagtggccggcctccttagcgatggtggcgtgaagggtcggcggctcggctagggcggcgcgagggttcaccattccaagcctcgtccacaccatctatgatgacaggatgatgcttgtagcgctgacggctccctcagtgatggttttgcaggttctggaagacggatccggctgtggtgaggtggcaccggcgagcacagcccagatccacacgagagaaggccggacctgcgctaggaagtttccaactcggctccttcatccttaaggccatcaccatcaatggctctggcaagatccatggcgcattcatggctttgagggcccagtgttgcaggttgcgggcgtgtggatgctgccccagtggacgtgaaga

SEQ ID NO: 17458 - DNA, 491 bp, Sorghum bicolor
  Clone ID: LIB3476-028-P1-K1-D8
atctattgtattatcacatcaccatggaacaacgtccatgtgttgccctggtcaactagggactcagtgccttgatagatggtgtctcagttgccaatcaccatagcagcagcacatcacaggaaagaattgattgaactgcaattctgcattagtcaaaggtgtgtttcatattctgatggagcaaagagtcaaatttagaaaagtagaggtagcaagcctaatgatgttgtgacattgctatattatatcaggtgcgtttcatgttctgaactgcattgcgtgctttcctttgtgtttttttggtaattgtgatttgctttgattattataaagttagtcaatccagtaaacgagtcctattaatggctttgtgatggaccaatacaagttggtaacaaaccttagaatatactcagcacaccagcaaggactcaacaactgattactaaaccaatgatgctttgacattggtcacttagatatttgtc

SEQ ID NO: 17459 - DNA, 496 bp, Sorghum bicolor
  Clone ID: LIB3476-028-P1-K1-E1
ctttgctgttgtcgaagtcggtggcttccatgatgttaatgttggaactttccatcgtaagctgaaatctgtgccccatggtgaggcatgtgtagttggacgtgatgtctctggtgacctaacggccaagagtgtggaattgggtggtgatttaagggtacataaggatgataaagatcttgacagtaaaacctcaaaggcttgggaaggtgcaacgattttttcttttgatggggagttgttggcatgaacctttttttggttacggaaagagcagttttcctaccatggggcacaattttgaagtgtctggagcgttactggacattctgggaaaaggagagaggtcttgcacggtcaacaagtttggttcacgggtttggagcacctgtagatggtaaatctaacagccacccagaaggatacagggattgtctcaaccaggaacacttagatatagatgactcggttaccctaagttaccatcaaccatgtt

SEQ ID NO: 17460 - DNA, 458 bp, Sorghum bicolor
  Clone ID: LIB3476-028-P1-K1-E6
cggacgcgtgggttcacctgctacctcttgaatttgagataccatcgcacaccatgtaaacataaccatgctagttctgtttaatgatagtaatcttgatgcattatgggtttttgattctgcattattgtctttaactggacatacaaaattgtttacacaattcttgtttgatgactactagtgatcagtctctgttttcacttgcaggttggtccaattgctgcctattataaactgccacttaatcgtgtcctagtggcatttgatgatatggacttgccatgtggagttctccgcttacagccaaaaggaggctttggacggcacaatgggttgaagagtgttatataccactttcgtaagaatcgagaattttgccgattaaggattggaattggacggccacctggccaagatggtcctaaagcctttgtctttcaaagttcaataggact

SEQ ID NO: 17461 - DNA, 289 bp, Sorghum bicolor
  unsure (1)..(289): unsure at all n locations
  Clone ID: LIB3476-028-P1-K1-F1
cccacgcgtccgggaagctaggggccaagatggagctaggagggtcaaggaccatcatgctagcgccggcgctgcccatctaggagagcgtggctcgccgcaacgtcaatggatgggcgacctaacggccaagactgacctatcggccactcttctaaacgcccctaagcttcatgtactttttctcagggaaacctccatctctctcgatccttcaaccttgatggttctctgaacgttgatgtgaacgagtntaccttttttttggttactcgtttgagcaggtttc

SEQ ID NO: 17462 - DNA, 503 bp, Sorghum bicolor
  Clone ID: LIB3476-028-P1-K1-F11
gaacaagcaaaattctggaagcagcatccatcactagtaaagatggaactgctgattcaggcgcatctcacgtgtgagtcattttctttgaccccagcacttcttaaagattacagacatatgcttgaacttgcacctcgtcttctggaagaacttgttaagattgcagttctaccaaggaatccccatggttttggatggctccggcctgcaattggtgttattgagctttctcaaaatattgtccaggctgtaccactaagtgcacgaaaagctagtggaggtaactcggaaggaatagcacctttcttgcagcttccgcatttcacagaagcaactgtgaaaaagattgctcgtaagaaaatccgtgccttccaagaactttgtgacatgtctgtggaggatcgtgctgcattgctcacacaagttgctgggctttctgaagaacaagccccgcgatgtggagcttgtcctggagatgattccttctaatgaagtagaca

SEQ ID NO: 17463 - DNA, 180 bp, Sorghum bicolor
  Clone ID: LIB3476-028-P1-K1-F2
tacatgtacaatagttcattgtgctgttttgtatgtatattggtatcagctctcaagtgtaatgctaacagggcaagaattgttggacggacttgccctttcatagcggtacagacatcgatagattcatttctatttctaattcaataaactagcactatgccgagtctattttatgcc

SEQ ID NO: 17464 - DNA, 187 bp, Sorghum bicolor
  unsure (1)..(187): unsure at all n locations
  Clone ID: LIB3476-028-P1-K1-F6
aaggtgtctggatctaatgggatttcggctgagagatagatcaaagtgaaataaggatctatgaaatcaaaagcaaagcttaagggngctttctcttttattggactaaacaatgacaccttcaaagtaaatgtaagcttcatcatgtttaagatctcgactccaaaagtataattgaggactgtct

SEQ ID NO: 17465 - DNA, 226 bp, Sorghum bicolor
  Clone ID: LIB3476-028-P1-K1-F9
ccgcggacgcgtgggcggacgctgggcggatcgtaatttagtcagttccagacgccatccgccagtgctcggcgagcggttgcttaataatatactcactctatatggctatcaataaaggcggctcgacaatctaatatctgaatcaaatcctcaggcgatgctagagcttgatgcggcgtcagcagcagcagtatcaatagcacggcattgactaggactacaa

SEQ ID NO: 17466 - DNA, 429 bp, Sorghum bicolor
  Clone ID: LIB3476-028-P1-K1-G11
cggacgcgtgggcgacgaggagatggcgtcggcgctgtcctccctgcgctacggcgacagcctctcggtggtgggcatctccgccgcgacggccgtgctctgcgaggccatctcctggctcctcatctaccgcaccgccacctacaactccctccgcgcctccatcgagcgccactcccgcaagctcgacgccatgaagtccggctccagctcctcctcctcctcctccggcgccggcgcctcctccgcgcagcccgcctcgtcgcgggctaagaagatggaccgcgtcgagaccagcctcaaggacgccgcgcgggagctctcgctcgccaagctcaagtcgggcgccgcgtcgccgggtgctcttcgcgtcttcggcctgctaactccctcttcgaggccgaccgtcgcaagctgccttcgcgccca

SEQ ID NO: 17467 - DNA, 468 bp, Sorghum bicolor
  Clone ID: LIB3476-028-P1-K1-G2
ccgagatgcttttccggtgccaggcctgccagaggacatctgaactgtttggatgggttagggatgtctttcagcaatgtgcacctggttgggatagggatgccttgctgcgcgagctcgactatgtttgcaagatattccgtctaagtgaggactcaaaggggaggaaattattcagaaaatgtgctgaactagttgaaagattgaggagtggttctgctgaatcaacgactcctagaattctgctacaagcactgcaagagctggatattgatacctccaagagctttgagaacgaagagccagggcgcctgatcactccccaagaggcctgcaaccggatcgccgaggtggtccaagaagccgtcagaaagatggagattgtagcagaggagaaactgcgactgtacaaatgcgcccacccttgcggggaagcctgcgaacgtgagctggaggagaaggcgcggg

SEQ ID NO: 17468 - DNA, 503 bp, Sorghum bicolor
  Clone ID: LIB3476-028-P1-K1-G9
gccaaaaaagatgtgatgaagcaaggatgaatgctctgtcagaagaaattgacctactcaatgccaagattgacaagctatccagtgagagaaacgagctcttcgaaaagaatgagcagaaagataaggagttagctggaattagtgaaaaggacatgcaattgcaagacaaaactgctgagattacttcactaaataaagagcttgtatccctcaaggaccaagtgaagatgcatttggacgaactacacaatttaaaacgtttgaagaacgagaaggaggagacaattggaaagctgcaaatagatattgggtcactgaaactccagtgcgacaacttgaagactttgctgtccaagaaggagtctgagaaagacaaccttgcttctcaggtgctgaaactgagaagatcccttgaaacccgggaaggggcaaaggcaaatggtcaaaattcagatgcgaaggacaatcagcacactaataataagcgcaccaaacacaat

SEQ ID NO: 17469 - DNA, 311 bp, Sorghum bicolor
  Clone ID: LIB3476-028-P1-K1-H6
gcaagactaaagaacacattcgtgattctcacgataggtttctaccatgcatagagtattagtattctaggatcggatgaggttgtagagaagggcgtggactactgattagtatgtcaaatgatttgataattagatttgtgttgtgttagagcaattctacctatcaatgttccagggaaggtttcatggtgaattgtacatgcccctgaaacaattttgattgcttaaactctagaatgcttgtgttttcttatacgctggagtgtcgtgggatataaatttgcactgtcggttcagattaaagaaaa

SEQ ID NO: 17470 - DNA, 421 bp, Sorghum bicolor
  Clone ID: LIB3476-029-P1-K1-C11
aaaaaaaaaaaaaaaaaaaaaaaaaaaaaaaaaaaaaaaaaaaaaaaaaaaaaaaaaaaaaaggagaaaaataaaaaaaaggcgccgacgttttaaggggcccaaagtttaaacttcaacagttcttctggtggtataaccttttattttgttggctcgcgccgttcttttacatgggcaggggttttaaaaccttctggccttggacaactcttggggtttcgcagcttaacccgtttgcggcagctgccctttttgcgaggtggcctcattccggacgttgtccccactggtttggcctttcttaatggtgggtggcccgcgtggtgtaggggttctttccttgtggggggcgttaatcctccccgttttggggctttccctcttgggggccttttccctgcccctggtcttggtttcc

SEQ ID NO: 17471 - DNA, 587 bp, Sorghum bicolor
  Clone ID: LIB3476-029-P1-K1-D11
cagatcgtgcacaggtaccattttgcttcccacttgaagagaatgtctgttatcgtccgtatccaggagaaattttacgctttcattaagggtgcaccggagaccatccaagagagattagttgatttacctgctgcatatgtggagacatataagaaatacacacgacaaggttctcgggtcttggctcttgcatacaaattgcttcctgagatgcctgttagtgaggctagaagtttggaacgggatcaagtagagagcgacctaacatttgctggttttgcagtcttcaactgtcctataaggagcgactctggtgctgtcttaaaagaactgggacaatcttcccatgacttggtcatgatcaccggagaccaagcattgactgcctgccatgttgctagccaagtacatatatcttccaaacctgttttgatcttgacacggataaagactggcggttttgagtgggtttcgccagatgaaactgatagagctccgtacagtgctgtggaggttgcagtgttatcagaatctcatgacctttgtattaatggggactggtttgaaatgctacaaagtactga

SEQ ID NO: 17472 - DNA, 566 bp, Sorghum bicolor
  Clone ID: LIB3476-029-P1-K1-D6
tccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcgccccttttaagggtcccaactttccttcccctgctttccaccatattattttttttttggggcccccaaatttaatttccttgcccgtgttttaaaacccccttacttggaaaacccttggttttcccaattttattccttttgaaaaatttccctttttccccggttggtttattacaaaaagggcccccccaattcccctttccaaaaatttgcccaccttaattggaaattggacccccccttttatgggccttttaaccccgggggttttggggtttccccccagggggccctttccttttgcgaggcccttagcccccgttctttagattttttcccttttttttctccccattttggcggtttttcccggaaaagttttaattggggggttccttttggg

SEQ ID NO: 17473 - DNA, 648 bp, Sorghum bicolor
  Clone ID: LIB3476-029-P1-K1-E11
cccacgcgtccgcccacgcgtccgcccacgcgtccgcggacgcgtgggttttgaagtacaaatcatttggaacttttaacattcagagaggtctgtcacaactcaattttccaagttggcattcaaaattgatgatttgacgaaatactgattcctagggcaagaaattttgggataagattacatggcatctacctgaatacagcacaccaaaatggctcactagtcactacagtatctaatgacaagatccacgataaattgcgggcatctcatccaaaaggcaacctgattacaatgctttacatcactacaaatagaatgggcagcaatgtggctactaggtgaatcaaccagcatgattgggattttgaagcaaaactgtccgggcttgcaggcccggaggccgttccacctttgctgccactggcgccagtgcttccagcgaaaatgcatgaaccatggcttggatcagttgatgttacatttgcggtgccattgaagttgcatgtaccaccactagactgtgttctgtggtaataatcgttgaaagcataagaagaaacagctacaatatcatctgatgcatagcatggttgcccaggttgaattgcactgcagtttgcagaaccagggccacatgcccaa

SEQ ID NO: 17474 - DNA, 463 bp, Sorghum bicolor
  Clone ID: LIB3476-029-P1-K1-F8
cggacgcgtgggccggccctcgaaaaagctcaagaattcgaggactcttcctcctcttgctgcttcccctcctccacgatgcccatgccaagatccttccccaaatcctagcacatgcgcagcaatttgttttttgccccaaaaggaaggatttcatttcattccattccatggtttggatttgccatcaaccaaaggcaaagcttcttcctgtgatcttcttgtacctcggcgagctgtgtggctgattagttgatccaggctgtatatctgtctgggtctctgggataataatgagcggtggcaattcttcgtggctgatgccgccgtcgccgccggcgcccgcggcgtcggcgctcgacaacgtggagaccaagataagccccagcatcgtcctcatcgtggcgatcctggcgatcgtcttcttcgtctgcggcctgctgcacctgctggtgcgccacct

SEQ ID NO: 17475 - DNA, 405 bp, Sorghum bicolor
  Clone ID: LIB3476-029-P1-K1-H12
cccatgtcggtcccagccaccctcgcgccggcggcgccgccaaaggcgtcgccgacagccagaagctcggcacgacgggcgccggcggctgacgcagcgtccgtggccgcctcttccgtcgccggctcggccgcgttgctgacactgacgccggccgcgcccgccgcggccttgtgagggaggacgtctccggctcgcttatcaaggtggtggacacggtggacgacgtcatcgtcgtcggcggcaaggccgctgagcaggtggcggccgagctcaaggcgctagacgaggccgtccagccggcgtttcctgatctgaagagcgccagggacgaggccctcaagctggaggagcgcgttgtgtacagcgcctacaagcaggtcacggaggcactccagggcgccg

SEQ ID NO: 17476 - DNA, 516 bp, Sorghum bicolor
  unsure (1)..(516): unsure at all n locations
  Clone ID: LIB3476-030-P1-K1-A4
ggtggatccggtcatggtgtccaccagtggtgatactctttcaggaccatctactctcgctacatatagggatgaactattttctgtggctgatatagtcactcctaacgtgaaagaagcatctaagttacttggggatgtatcattgcatacaatttctgacatgcgcaatgcagctgaatccatttacaaacttggtccaaaatatgtgcttgtgaaaggcggggatatgccagattcatcagatgcaattgatgtattatttgatggtaaggagttcactgagcttcgtggtccgcgtataaagacccgtaacacacatggaaccggttgcacattagcttcatgtattgctgctgaattagcaaaaggtgcaacaatgctgcatgctgttcaggttgctaagaaatttgtggaatctgctctttatcacagcaaagatcttggatgganatggcctcangccctttgacacctnttgagctattctcgtttacagatggacatggaagtcat

SEQ ID NO: 17477 - DNA, 436 bp, Sorghum bicolor
  Clone ID: LIB3476-030-P1-K1-A5
taaagaaggcgcgattctcagtgttgtaaattgttcatcagacagctttagcccaactgttcttttcagcactgaacattgtggcatccataaatgggatacaagaaccaactcagaatcttggtcatttaaatcctctccggaggagggctatatatcagcacttgttgtgggccagtgcggaaattggttcatctcaggttcttcaagaggcgtccttacattgtgggacaataggtttttactgcctgttaactcatggaactattcaacagtaagccctatagagaaattatgcttgcttatacctccaccaagttcaatatcttctgctggaaggccattagtttttgttgccgccggatgcaacgaagtttctctgtggaatgctgagaaatgaagttgccaccagatgtttagaacagcgagcactgac

SEQ ID NO: 17478 - DNA, 384 bp, Sorghum bicolor
  Clone ID: LIB3476-030-P1-K1-B2
cgctcccccaaatgccgcctcctcatcactaatcaccattgccccgcgcccacctcccactcgctctctactgcctctcgccgtcgccacggttcgcgatgggctgcttccttggctgcttcgggggggccaaggagcgccgccgccgccgcaagcggtcgccgtcacagtcccccaacggccgcgcccgggccgtgccgcgggtttcgccgaagaaggttgatctggatggggaggccgcctccgccgccgcgccgctcttagcgacgctcctcgagctgagaacctcaacctcacccgctggaaggaatccaagccccgcgctgccgccgcgcccaagtcctcggacaaggagaacgtcactgtggggcaggagaaccggat

SEQ ID NO: 17479 - DNA, 441 bp, Sorghum bicolor
  Clone ID: LIB3476-030-P1-K1-B7
atcgatcgttggattattggcgagcttcattccattccatcagttcctttggcggaggatgtcgtgctgcggaggcaactgcgggtgcagctccggctgcaagtgcggcagcggctgctgagggtgcatgatgtacccggacatggctgagcagcaagtgaccaccaccgtcaagactctcgtcatgggtgtcgcaccatcgtccaaggcgcacgccgagggcggcttcgaggcgacggacagcgccagagctgagaacgaagggtgcaagtgcggccccaactgcagctgcaacccctgcacctgcaagtgagctgtataataaccccctgcactgcactagaacccggaggaaggacggactctcctagctagcatagcagtgtcgtcactgcactgggtgtgtgttgagtatgcagtcagtgagtccatggaacatat

SEQ ID NO: 17480 - DNA, 499 bp, Sorghum bicolor
  unsure (1)..(499): unsure at all n locations
  Clone ID: LIB3476-030-P1-K1-C11
gttcgaggtgatatagtgcattttctggggctctatgacttcaaaagcaagacacatcaagatgcgtgctgccctgagggtatgtgcagagctgcagtgtttgcgctgcatgtaaaggaagagctggcctcatggcctgagcagagcacccggcagaggacctggctcacggttcctgaagctgcatcaagatgccggtaccagtggatgcaagaggccttgctcacaggcttctccgactggcacgacaagtggagcagaggcggcggcggcacaaactgtgacccggcctaactgctgaacccatctgcagtcgtccattttttttcatctcctcttcccctaggctccaaccttgcataatgcaataacagtgtacttctcttgatatgctgngttgtcattgaccctngatgtcaaaatgtcaagatggttatctagttatagtgggacgaggtatatctcatcaagatgagaattctcacaaccttttaagtgt

SEQ ID NO: 17481 - DNA, 426 bp, Sorghum bicolor
  Clone ID: LIB3476-030-P1-K1-C5
gtggaaacaacatgggagacagccattggcaagataacatctatactggaggaacagttctctcgcatgcgtacagccagccacttccttctcataaaagattatgtcactcttctaggcgcagctgtgaacaagtacggttatcgaatcacacagttgattgaagttcttgagaaaactagggacaaataccaccagttgcttcttcttgaatgtcggaagcaggtagacgacatccttactaatgactcatatgagcagatggttataaagaaggaatatgagtataacatgaatgtgacagcatttcatctggaacatgatgatgcaatccctggatttcccatatgtgacatcattctcctcttctgttccagatgtttgtcgcattgtccggtccttcatcgaggattctgttagctactt

SEQ ID NO: 17482 - DNA, 371 bp, Sorghum bicolor
  Clone ID: LIB3476-030-P1-K1-C6
ccgcttcttctcggcgtacatggactcccttgaggagagcttcccgaaggcgagcaacgagaggctggcgctggagagggcggcggggcgtgccattgtggacctggtgtcctgcccggcgtcggagtccgtcgagaggcgggagacgggggcgtcgtgggcgcggcgcatgcggtcagccggcttctcccccgtggcgttcagcgacgacgtggccgacgacatgcggtcgttgctgcgccggtatcgggagggatggaccttgcgagagccaggtgcagacgacggcgtggcggcccgggtgttcctggcatggaaggagcagcccggtggtgtggacgagtgcgtggaggccatgatcgatcttcatg

SEQ ID NO: 17483 - DNA, 452 bp, Sorghum bicolor
  unsure (1)..(452): unsure at all n locations
  Clone ID: LIB3476-030-P1-K1-D10
gccagcctttgctttgcttccagctagcagccggccagccagcagagactagctcttctcacacctgctgtgcgttgcgtgtgctcgcctttagcgaccggcccctttcactttgagtagcgagcgacaatgcagtacgcggcggcggagcaggcgtggtacatgccggcggcgacgacgatggcggagagcgcggtggcgcgcgtggagcggctggcgtcggagagcgcggtggtggtgttcagcgtgagcagctgctgcatgtgccacgccgtgaagcggctcttctgcggcatgggcgtgcacccgacggtgcacgagctggacctggacccgcggngccgcgagctggagcgcgccctcgcccgccttctcggctacgggcccgccggcgcgcccgtcgtccccgtcgtcttcatcggcgggaagctgtcggcgccatgacaggtcat

SEQ ID NO: 17484 - DNA, 481 bp, Sorghum bicolor
  Clone ID: LIB3476-030-P1-K1-D3
attctcacttgctttaatttcgagactacctgtttctcccatgattggccctacatgttcttgcatttcttgattggttcggtttctttggttgtgatgataggagcaagaagacggggtggagtcaagaactggtacaaacgaatcgtgttgtctgcagaatggattcagcatttgaggctgctgttgtactcgcacgtacatgatgcctctagacctgcgcaatctgcagatctcatcaccacagctacaaagattactgccctactctgaaggaggatatccaatactagatgtcaggacttcttgcagcagttctaggagctgctgcaggaggctttgcactactagctgttgtcatagtcgtaatagtgctttgcctatggcatcacaaaagaacttcagactcttcaaaaagtagttaataggtcaagctctaccagagtcacaggaagcagaagtttacttggaggactgattt

SEQ ID NO: 17485 - DNA, 450 bp, Sorghum bicolor
  unsure (1)..(450): unsure at all n locations
  Clone ID: LIB3476-030-P1-K1-E11
gaagcgggtgctggcgcgccgtaccgcggcaccgcgcgccggcgagggcaaggacttcctgccgttggaaggaggccctgggaagaagctgcggaaggtgcaggagcctgaagagcctgagaacaccgccacagtcgtctacatagggcatatcccccatggcttctacgaggacgagatgcaagggttctttaagcagtttggggatataaagaggcttaggattgcccggaaccgcaagacaggaaagtccaagcattatggattcattgagtttgagagccctgttgtggcaaagattgtagctgatgagatgaataactatctcttgtttgagcacaccttgcaagtttcacttgttccgccggagaaagttcatcctaaattatggaaaggngtgcgacggggatttatacctattgatcgagttgcaattgaacggaagagaca

SEQ ID NO: 17486 - DNA, 532 bp, Sorghum bicolor
  Clone ID: LIB3476-030-P1-K1-E7
cccacgcgtccgcttctttgtttaatgcagtaatacgcagctctcctgcatatttgagaaagtttatccttctttgtctcttgtggaaagagttattcacaacagtacatgtgaagatgtctccttttcaaatttgacttcaccgtagcacgggctggtttggatggctatgacaggttaccacaccacatatgatgatatgaagcatgccacacttattaaaggccatatttgtttaatttccataagtttctgagctaaagaaagttatagcttatattcagttcgctgcggggggacggaccaatgacatgcaaaaacttgtttggttcattgaatccaaaagatcaggctgagtagagcatttgtttggttggtttgcactgacttttgctgtattgaactgctgtattaaactgaaataaaagacaactaccaagatttttttattttgcttgaatcgattgtatgatactattttttaccatattaaagcttaatttacttcgaaatataagactaaatcgattgt

SEQ ID NO: 17487 - DNA, 394 bp, Sorghum bicolor
  Clone ID: LIB3476-030-P1-K1-E8
atttcactcaggaattgaagttcatggtgttgaatatgcattcggagcacatgacttccccaccagtggggtctttgaggtagaacctcgccaatgccctggttttaggttcagaaaatcaatatttcttggtacaacatgcttggatccaatccaagttaggcagttcatggagcttcagtcagtaaactacaatggagatacttaccatcttatcacaaagaactgtaaccacttctgcaaggatatgtgctacaagttgaccggtaacaaaattcccaaatgggtgaatcggctcgccagaataggtgccatttgcaactgccttctcccagagtcgcttaagatctctccagttggccatgatccaaatagtcaatctgaagactcggag

SEQ ID NO: 17488 - DNA, 397 bp, Sorghum bicolor
  Clone ID: LIB3476-030-P1-K1-F11
tcctgtattatccaacagcttgctcttgcatataacttcagctttacatattgtctgtgctgcaaacaaatatattttgttatccataaccttttctctctagctcccagcctaaaatagttttcttgcaggtgtacttttggagtcttccaagttgtgctgggaaccaggtcttgtagacttattcctctcaaatcttcttttctggcatatactacgatgaattggtggtatataagttgctgatcttaattaataactaacaataagatatggtatcaagaagcaatatctttgttctatgattttctgatgcggagtagtaagacatgtctaaagtaagcaggccagaagtcagaagagccttttgtttttggataatgtttctacatttgct

SEQ ID NO: 17489 - DNA, 288 bp, Sorghum bicolor
  Clone ID: LIB3476-030-P1-K1-F5
gcggaagtgcaaccacactagctaggtcgcaatcgccggcaaccagggcagccgccagaagctccggccggtccgccaggcgctgctgttggtactctgcagcgtcgtgacgcgcatcctcacgatgcgcgagccgcacatcaaggtagactgccactgccacacgcccaaggcgcgcaagccgacgcacttggacgcgtccaagaccaaggagtccgacgcatcgccgtcgccgtacctgaagcctaagaacgacaagccatccagaggctacgagcaccaggcgcc

SEQ ID NO: 17490 - DNA, 439 bp, Sorghum bicolor
  unsure (1)..(439): unsure at all n locations
  Clone ID: LIB3476-030-P1-K1-G1
cggacgcgtgggctagaagatgcgccgcgccctctccccttcctcctcctcctcctcctcttcaacaagtctcgccacccgcccccttgtcccagcaactccgccgccgccgccgccgccgccgccgccgccgtcgtaaagccctctccggctctcccccgtccgccgccgccgccgccactggtgggccaggccgccccagagaagaggccagaggagacgccggggacgtcgggccgcggggttcgagatggtgctgtgggagctcacggccatcaccgcctacttcctcgggctcaggcgcacctaccgnctcgcgctccgcatncagcgccgnctcatcccgcccaaccaccccaggatccgggacttcgtctacaggcgtacacgggatatcttcaatggtgcagtgtcagtgcacaagaacattcagcagaga

SEQ ID NO: 17491 - DNA, 304 bp, Sorghum bicolor
  Clone ID: LIB3476-030-P1-K1-G6
tagatgcagcggaaggtgcggctatagccccccccatgcgcgtggcaccggaagccttctgcgctcctgctcctggatctccggtcttcctccttcaccaacatgtttcgcgcttctacgaggcagcatctgcaacagcacgcacattgcactgtcagcggagaggcctagtgccggtcgtacgattccatctacatataccgatgtggacatcgcggtggggacatggatgtcctttgtgtacagcaccgtcgcaagctatcgcatttattcgactactgtagctactgcttggtactggatg

SEQ ID NO: 17492 - DNA, 422 bp, Sorghum bicolor
  Clone ID: LIB3476-030-P1-K1-G9
cactgaagcagcttcgattcctgtaccgaaactaaagaatgtgcataggcttcgaacagaacactatgtgtatgagcttccagatgcacatccacttttacaacagctaggacttgaccaacgggaacctgatgatcctaccccgtacttattggccatatggacaccagatggaataaaggaaataaccaagacaccaaaaccatgctgtgaccctcaaatggaaggcgatttatgcaataatgaaatgtgcaacaattgtactgtagagaaagaaaaccaatctagatatgttagaggcacaattctggttccttgtcgaacagctatgaggggtagtttcccacttaatggcacttactttcaagtcaatgaggtatttgctgaccacagatctagccacaacccaatccatgtgcaaa

SEQ ID NO: 17493 - DNA, 484 bp, Sorghum bicolor
  Clone ID: LIB3476-030-P1-K1-H11
acccacgcgtccgcccacgcgtccgatctgatttcttcatcgagctggttggcaacattgcaaagctaaatcatccaaacctctcagagctagatggctactgctcggagcatggacagtgcttgctggcatatgaattctacaagaatggatctctttatgacctccttcacctgtcagatgggtacagcaaaccattatcttggaataatcgtgtaaagattgctctaagatcagcgagggcattagagtatctacatgaaacttgttcgccgcctatcatccacaagaacttcaaatcatctaacatactgttggatgatgatcttaacccccatatttcagattgcgggtttgcagacctaattcccaaccaggaactccaggaatcagatgacaacttgggatatagagctccttgggtgaccatgtcttggcagtattctcaaaagaacgagtttaccggtttggtgtgcatgcttga

SEQ ID NO: 17494 - DNA, 239 bp, Sorghum bicolor
  Clone ID: LIB3476-031-P1-K1-A11
cccacccaaccccgtctcctccctcgctcgcctcgcctcgcctcgcctcgcgcggcgtgttgcctttttccgtgtgatctgttctcgcctcacgcttctcccccctcgctcgctctctcctcagcacccagacgagcgcgcgcggcgaccctggtcctggtccggcaggtctcccgtcccctcggactccctccgtgagcggagcctatctgtgcgggggcttgcgcggggcgtgacat

SEQ ID NO: 17495 - DNA, 440 bp, Sorghum bicolor
  unsure (1)..(440): unsure at all n locations
  Clone ID: LIB3476-031-P1-K1-B1
gcatttacgacgaagatcgagcttttagtttgcttgttcacaaactgttgttcttgcatgcaccatggatgacgacctgaaacatctgagggtcagcttctctggggtgaggcaggaagatcgtggccgccgcggcggcgagacaatcccaacaccatcttttcagcaaaggacgagttcacgcagagggtcactgagcaatgcagaggagtacgacgcggcgtatgcagccacggtggcagcagtggcatacgccattgccgcgcgagaggaggagaggctgttagcgtctcaagagagtccgtcgccgtatgctgccgcggacaagctttcgcgtggaaatggnaacaagcagcagcgtactgctgctgctgctgattccatggatgagcttgcttcgacgaccaccgccgagtccagcaagtcaccacgtacaccca

SEQ ID NO: 17496 - DNA, 466 bp, Sorghum bicolor
  Clone ID: LIB3476-031-P1-K1-B12
cttgaagtaatcgactgaacaatcatgtgtttgttacttttctttgtcctatattttttcccctttggattatgaaatcctcaatgaccgattataagttggaaggtggtaaaattaagatatactggcctagttgccattgcattgtaccatttaatttagttacatgctgttgtatcagctactacctccattccttaaagaggtgcatagccagaatgacattctttaagggatgaagttaatagttgcaacaaacccttttcttctttggctccaaaaggatcctttttggtacatgccaataggaaacaaagtgtgtttgaaaagcctgctgagtttttctaaatggcgtatgatccaatgagatgggttcattggttttgttagagtaaagatcaaggtcgcttggttaggggccaagcaagccttatctctaattagccctaaactaatgggctataca

SEQ ID NO: 17497 - DNA, 262 bp, Sorghum bicolor
  Clone ID: LIB3476-031-P1-K1-B2
acgaaacaacacagccttcttggccatcgagctgctcaatgagccgttggcaccgggagcaaatctgtctgtactgatgaaatactaccaggacggctacaatgcagtgcgtcggtacacgccagcatcctatgtgatcatgtctaacaggttaaacatagcaaaccagacagagatccttcagtttgtgggcagcttcgatggcgccgtcctcgacgtacattactacaactggttcgacaagaagttcgacaacctcact

SEQ ID NO: 17498 - DNA, 289 bp, Sorghum bicolor
  unsure (1)..(289): unsure at all n locations
  Clone ID: LIB3476-031-P1-K1-B4
aaaaataaaaaatttaaaataaatcaaaatatttnttttttgnggaaaaaaaaaggctggccgaattaaatagtccggacttatccacccagtgcttccaacttttaacttgtttatttggatctcggggcgccctttttaagggccccaatttaacatccccttgcttgcgaagacaaagtttttttttagggtcaccaaatttcaatccactgccccctttttaaaaccgtcgtaactggaaaaaccctggccttacccaatttaatagctttggagcaaatcccct

SEQ ID NO: 17499 - DNA, 275 bp, Sorghum bicolor
  Clone ID: LIB3476-031-P1-K1-B5
cgaacacgcaaatccctagcttattaagagctctcgctgtcgttagctactgcctactgctggtagcgagagaaatcagcacaagggtttgctgaggaggaatcgtcgatttggagaggaaagcagcctgctgcgtgggcgtgactgatcgatcgagagagatcagaccaccatgggccgcgggaaggtggtgctgcagcggatcgagaacaagatcagccggcaggtgaccttcgccaagcgccggaacggcctgctcaagaaggcctacgagc

SEQ ID NO: 17500 - DNA, 401 bp, Sorghum bicolor
  Clone ID: LIB3476-031-P1-K1-B7
atcatgatgctgcccaccggagcaaagcgaatgggcgacgtagagctggccatccgcttctccacgtgcgggtcgatgctggacatgctgcacgcgtacggccgaccggcgctcccggcgatgcaccaccagcggcccatcccggcggtgaaccgcgaggcgctgcggctggcggcggcgcgcatcaccgcggcgcacctggcgcggtcggcggagccgccgctgcggcgggaggtggcgacgtggatgctggacgccgcggagccgcgcgggttcagcatgcgcaagctgcgcgccaactggaaccgcgccgttgccgcgctctcctgggtcgccgacgcggcgcgctgggtgaggacacccggtcgtggcggaacccgacggcgaccgcgatggcgcac

SEQ ID NO: 17501 - DNA, 238 bp, Sorghum bicolor
  Clone ID: LIB3476-031-P1-K1-B9
ggagatggagttaccgagccgaagcaacatgaacgacctgttcgagtaccagcagtaccaggacgccacgcgcaggagggcgagtcagacaaaggagaactcggactgatgctcctatgtgcggctggtcagataaatatattgctgcggctataaatattgcgtctaggggaaataaactaggggtgagtataagctaaaggcggctgtcgtggaaccagatgatgatccggtgtgt

SEQ ID NO: 17502 - DNA, 287 bp, Sorghum bicolor
  unsure (1)..(287): unsure at all n locations
  Clone ID: LIB3476-031-P1-K1-C1
gactctgtgacctagataccggagggtggaggctttgtctaaaccctcggccaccgtatgcaccatcggtcacctttagcctcacccggggagcacaatctgtgcatggagaccgcagattcggacgactgcaaattgcncacacgacgtctacaagcttttttgacactacgactagctctactttcgcgatactgtacgatgctgagccgtatgatgcgccgaaggcacactacgcaactgtggtggaatcctacactgctattaccgaggaggcgagggctgta

SEQ ID NO: 17503 - DNA, 165 bp, Sorghum bicolor
  Clone ID: LIB3476-031-P1-K1-C2
ccacgctggcgtgcgtcattaccatggccttactcatcgacggaggctactacgagcaggacattcctgcgttcgtagcgcggcttaagtggctcaactacagctcatactgttaccgactactggtcgatatccaggtacgcaacggcggtcattactacgact

SEQ ID NO: 17504 - DNA, 449 bp, Sorghum bicolor
  unsure (1)..(449): unsure at all n locations
  Clone ID: LIB3476-031-P1-K1-C8
gaacctcatccgacaataagttcacttctattgctcttagcaacttccttgctggagctgctgccggatgtactaccctggtcctcatatatccactcgacattgctcacactcgtcttgcagctgatattggacgtacagacacncgccagttcagaggcattccccacttcatccaaaccggggtccagaaaaaccggattagaggcatttacaggggattaccaacatcacttcatgggatgggcggtcaccggggcctggactttggcggcttcgacactggcaaagatgtcctggtgcctctggagacccccctgtggcagcgcttggttgcaacgcaagccgtgactttcatggcagggcttatatcgtacccactggacacggtgcggcgaaggatgatgatgcagtcgggggatggagggcagatgtacagancacactcg

SEQ ID NO: 17505 - DNA, 449 bp, Sorghum bicolor
  Clone ID: LIB3476-031-P1-K1-D1
gaccccgtgacctcggagccggagggtggaggctttgcctaaaccctcgtccaccgtcttcgtcgccggccccctttagcctcacccggtcaccccaatccggccatggtgaccgcggatccggacgggagcggaggcgcgccggacgtctccgagcttttctgccactacaactccctctactttcgcgattccctcggctcctgcgccgtctcatgggccgaggacccactacccaattctgatgtaagcatatgcgactattaccctggaggcggtggctgtataatacttctttcgaaatccttatgcggatctcataatggatctgatctgaagaatgctttgcttcatgagatgattcatggcctatattgcatcaaatacaacaacagtaaccatagtgatcatggtgcaaaatttcagaaactggtgaatacgatcaaatt

SEQ ID NO: 17506 - DNA, 497 bp, Sorghum bicolor
  Clone ID: LIB3476-031-P1-K1-E10
gcagaatgctagactgataagggacccctgagatctttaaaccctctttttcaccatcgcatgaattacttctcatctccttttaccgtttcatgaatcaccatcttttacagattggcagcgttgcatcatggagctttcagggcaggttaggcagcagcgtaggttagcaagagttcatggacgccccgtggctgtgatgattctatctacgagggagagggaccccatgattccaacaaaagcttcgttggttggacgttggacgcaaacttgtcgaaggaatttgcgggtctcgatcgacagctcatcaaatcatcattcggcacaggggcaaaagacgctggaatctgttatcgtgatctcatccagggggcacttgattattgtccatcgaaacgacgaaaccagagaagcaggtaacggagccctcgttttgacaggaaacgttctacctggatttcttgggtcaatttttggtgcacaacttttttttt

SEQ ID NO: 17507 - DNA, 275 bp, Sorghum bicolor
  Clone ID: LIB3476-031-P1-K1-E4
cagccgccgttctctcctctcccctgccaggcagagcgccgctccctcatcctctcgccgcgtcgctccatcgtcctctcgctgaacgcgctcctcgccgcaccgcgctgcccagccccttcgatcctcaccacgcccgtggcccctgggtctgtctctcgcacgcgcggatcgagcaagggtgtggctcctttgacggcgcggccccctggtaccttcgatggagcatggtccctccgcccgcactgcagcagcgcggggcctgagcctggatc

SEQ ID NO: 17508 - DNA, 412 bp, Sorghum bicolor
  Clone ID: LIB3476-031-P1-K1-F11
cgcaggtttagcgtttgcgatccagtcaacttaggaggccgaccaagtgattttgatgggaatctgcgctgccctggatcacctgatgaggataacatagatatggaagtgagcgatggtgcacaaatttcaccattccctcatagctacagtgcatctgcagcttctgaacaaaatgatgatcaatcaaacagctctaggtattgcttggttgccagcaaacaaatggttggcatatttctcacagtgtgggtacgcaatgaaataagagatgatgtcagaaacttgaaagtttcttgtgtgggcagaggattgatgggttatcttggaaataagggttcaatttcaataagcatgtctctgcaccagacaagcttctgcttcatatgttgccatttgacatctggggaaa

SEQ ID NO: 17509 - DNA, 436 bp, Sorghum bicolor
  Clone ID: LIB3476-031-P1-K1-F12
agacaacctggacggacgattaatcgcgattggacgacgactaatcggacgaccagtttcctggtcgttctggccaagtcggaggccctggtcgagtacctccaaccgtccaggacgattagtcgcgattaatcgtgattaatcggacgtcttgaaaacactgctttgggttacaacacttctatttttttcttacatttaaatatctctttcttttgcatgataggatgcaaacatggataaatataacagttgtagaaccctattctttaaacggatggatatagtttgtcaagtatgacccaagatttgtaaatgttgttgagccgtgtacctatcatggccagtagtacttgcctacaacaattgtttcccagattattttgatgtcaatgtcaaggtatcgttatagttgtaacatctaatttttcaattt

SEQ ID NO: 17510 - DNA, 461 bp, Sorghum bicolor
  unsure (1)..(461): unsure at all n locations
  Clone ID: LIB3476-031-P1-K1-F5
ctcccgttctggaggagcatgtcctcgacatggcgacggcccctcaccctcatcctcatacctcggcaatcaagcgaaggaagagccagacgaagaaggtggtgtgcatccctgcgccggtggcagcgccgccaccggnggtgggcgggcggccgagcacgagcggcgaggtggtgccgtcggacctgtgggcgtggaggaagtacgggcagaagccgatcaaggggtcgccgtacccgagggggtactaccgctgcagcagctccaaaggctgctccgcccgcaagcaggtggagcgcagccgcaccgacccttccatgctcgtcatcacctacacctncgaccacaaccacccatggccgacgcagcgcaacgcgctcgctggctcgaccaggccgccttctcctctcgtggcggccagagtcataccatcccaccataccatacttcgggttgcgtcc

SEQ ID NO: 17511 - DNA, 313 bp, Sorghum bicolor
  Clone ID: LIB3476-031-P1-K1-G11
gccgccaggaaccttagataatctcgtcttggcagggccggcggcaggccgtgccgccacgagactcctcgccgaaaccgccgggtcgggtcgcgcgcgtcaaggagagaccgagagatcgcgttcgcgcgcggtgggatcggagagatttcgttctagaaaatcgagctcccctgaggatggagcgcggcagttcctggcggcggctcaccgtggtcgtcggcatccttgtgtgcgcggacgtcttcttgccgcccgccgccgagctcaacataggtattcagtctgtcggcgacagcgcgagcaagcagta

SEQ ID NO: 17512 - DNA, 174 bp, Sorghum bicolor
  Clone ID: LIB3476-031-P1-K1-G2
ataagctgcagcatgcttgcctcaagagactgacgatgctgagcctgcccgctcgcagcagcccaccatcatttgatcggtgcctggatcgactagaaggctgctgctggagactatggccaagagcacgggcgagttctcagcagatctgcgctctgttgtccttaagcaagc

SEQ ID NO: 17513 - DNA, 430 bp, Sorghum bicolor
  Clone ID: LIB3476-031-P1-K1-G6
accagtcattagcaaagaacactgaacaccaggccagcagcaaaattaaacacacacaaataattccttgacagcagcaatggcgagaacgaacaacaagaaggtgacgacgatgctcctggtcaccacagtcgccgtgctgggcctcctgctagccgtggcctcgtcggcggcgtgtggctgtggccggcgtcgcgtgcacctgcagctgtacatgcacgacgtgatcggcgggccgaaccggacggcgatccggctcatctggggcgtaggcctgccgcacgagtccatgccgaatcgcaccttcggcgacacggtgggatcgacgacctcgtcacggacggcccgggcattcgtcgcgtcggcgacggcgacggcgacggcgacaccaaggcccatcggccgggcgcagggcacctacatgctgagc

SEQ ID NO: 17514 - DNA, 324 bp, Sorghum bicolor
  unsure (1)..(324): unsure at all n locations
  Clone ID: LIB3476-031-P1-K1-H12
cccgcgcgtacggttgaaaacttacatagtaggagtgatgcataattcaaggcatgctaaaggcttggaaaataggactgctattgcaaatggaacctcaatggatgcctatagagataaaggtcctaatgaagatcacagtgcttctgcagttgacaatggaatatctgtgaagttatatgttcagcaaatggagattattgaggacaaaactggctcacttttaccaganttgaaacactcttctagnttgtgaagatatgtggtgaccttgaccgagtcaaagtcacttaaaaaggatatggttgaaatcaatgatgcaac

SEQ ID NO: 17515 - DNA, 208 bp, Sorghum bicolor
  unsure (1)..(208): unsure at all n locations
  Clone ID: LIB3476-032-P1-K1-A10
ccgtccgnnggagaaactncaggggcngnngtgtcttattcgagaaaagaccanntctagggaccaggnnaccgcccaaacatttttatttgatnngtgcagggtttggggcctgtagaaagtaatnnaatgtaatggtagcnctnggtaatattaattctcgctgcattanntgtaaaaaggatnngagagaaatnngtggtagtcc

SEQ ID NO: 17516 - DNA, 314 bp, Sorghum bicolor
  Clone ID: LIB3476-032-P1-K1-A12
ctcacgcgtccgatctagcaatccaagaaaccaacacagcgacaagcaaagctgcgatcctagattcgccagcagcagcggcgagcgtgagcgagagatggacgcgaggatgttcggtctcgagacccagctgatggtagggcattagcaccttctggacttgcccgacaggtacaaatgaagcagactgcgggatctgtttaggcgctcacgcttgcagggcggatacgcgcgacttactggttttacacaggagccgagctgctatacacaaacacccaatgcattgatgctttcttgaaagcactgtggta

SEQ ID NO: 17517 - DNA, 150 bp, Sorghum bicolor
  Clone ID: LIB3476-032-P1-K1-A5
atcgcagcacctgcaacacaggatcagtgctgaccattgctttgcagctctcatatgagaattacctacgggaaagcgacgcaggagtggccaggcaatatgtcaggactgtggttgcatcggtgcagagggtggccatggcaatagctc

SEQ ID NO: 17518 - DNA, 176 bp, Sorghum bicolor
  Clone ID: LIB3476-032-P1-K1-B1
ggcgagcgagggaaccagacgagatccattcagatctgttgctgttgatcatcgacttggaccccggataggaaccttagctagcaaaggcggaggcggctagagagtagcagtcatggcagcgggtctcacgctcgaagatgtactcgtactatggctgagcagcaggcgacgca

SEQ ID NO: 17519 - DNA, 316 bp, Sorghum bicolor
  Clone ID: LIB3476-032-P1-K1-B10
gccgagaaagaccaggcgcaggatctcaacctgaagaccatcaccggacagaccctgtcccacatgatattgatctgcaagagcggggctgtttagtactaatgtactgaagcctacaatattatctcctttcatatgttaatagataacaaagatgtggtcattcatttaatgttaaataaaaataatgcggcccgcccatttagaggatcccttcttacttacgcttgcattctacattttatctctattatactgttacctaaatacaatatactgctcgccgtcttacaacgtcttcactgtgaaaaccctt

SEQ ID NO: 17520 - DNA, 405 bp, Sorghum bicolor
  Clone ID: LIB3476-032-P1-K1-B11
gggaggtctattctcagttttgcaagatgtagagcatgcagcagtcactgttcttgacagatggaagatcacaataaaggacaaccaagggaaacttatggcaccaccaaaatttatgaacaactactttggggttggctgtgatgcaaaggttgccttagatatacacaatctgagggaagagaaccctgaatggttttatagccagtttatgaacaaggtgctgtatgcaagagagggagcaaagaacattatggataacacatttgattgttttccttgggatgtcaagctcgagatagatggatccaaaattgatattcctcaggattctgaaggtatccttgtcgccaatatcaagagctacatgggaggggtcgacctttggaaagaacgaggatgatg

SEQ ID NO: 17521 - DNA, 445 bp, Sorghum bicolor
  Clone ID: LIB3476-032-P1-K1-D1
atcgacgactactgtcaagtccttctccattgcatccctccaacaatataccaatagtttcagtgaggaaaatatcataagagacagcaggtttggtaaggtatatctggcaaagcttcctgatggagagctactggaaattttgaagatcgacacttctaactcaaaagtgccagttgatgcctttcttgagctagttgtgaggatttcagaactgaggcatcctaacatacttggtcttgttggatactgtgcggagtttgagcagcgattacttgtctatgagtactgtagcaagctgaccctacatgatgaacttcgtcatgtagatgactcaagcaagccattatcatggaatgctcgcctccaagttgctgcggaggcagcaaaagcattacaacatcttcatgacagttgccaaccaccagttgtacatcaaaatttt

SEQ ID NO: 17522 - DNA, 450 bp, Sorghum bicolor
  Clone ID: LIB3476-032-P1-K1-D2
gcgagggacgactactgtcaagtccttctccatttcatccctccaacaatataccaatagtctcagtgaggaaaatatcataagagacagcggggtttttaatgcatatctggcacaagctccttatggatagctactttaaatttagaagatcgacactcctaactcaaaattgccattcgatgcctttcttgcgctagttgtgaggatttcagaactgttgcatgctaacatacttggtcttgtagtatactcgtcttagtctgagcagctattactcttctattagtactgcatcatgctttactctacatgatttacttcgccatgtttatttttcaaccaatacatcttccatccattcctctctctttaatctgctgtggaggcaccaaaatcattacaacatcttcatgacagttgccaacctccagttttacatcaaatttt

SEQ ID NO: 17523 - DNA, 504 bp, Sorghum bicolor
  unsure (1)..(504): unsure at all n locations
  Clone ID: LIB3476-032-P1-K1-D3
cccacgcgtccgaaatgaacaaatcatttccttttgcaaaaataatactgcattggcactgatagtagcaaagagataggatgcagtgtcatatctagaatcaaatttggtaggtgcgttctgcaaaattacaggatatcttttggttttaggttcaacagggagagaaacacactatatatcgcattaagttaatccatgttgtaatcaacaatataagcttgattatgtaagtttatatatctcctttgggtgaattttcaatctattttacgcgtttggttgttaatttgcatcgcctacaatgccaccgtagcgttagcacgggcaatatactagttagcttagtaattttttactagatctaatacaataacatatattgaagtcaaattcatatgtatgcgtatataataaactgaatatcatatagtaataatatgtatataatgaattatntttaagaaaaactcatagcaacacgccggaaattcacctagttct

SEQ ID NO: 17524 - DNA, 372 bp, Sorghum bicolor
  Clone ID: LIB3476-032-P1-K1-D7
atcctattcctatctatccctcactcgttactcctccttccctacatccatcgatccttaattaggtagctgctagctccaccacccaaccaatctgcaaacagctagcaaattaaacctgatcgatggatcatcatcatcagagggtgagtgggtgacagtgacgacgacacaaatgccctgcggctagctaaccggtatttacaagatttcagctcagcaccttgcattctgcgtagagatcagggccaggctgctacctagctcatcatcagcttctcctctgatccatccatagtcggtctccacgacatccacactctctgatctcttgttctaagctagaggccagagcacgcgcccacgccagat

SEQ ID NO: 17525 - DNA, 428 bp, Sorghum bicolor
  Clone ID: LIB3476-032-P1-K1-E12
gctacgctgtacggctcgttacaacgacactgacaccgacacggtcacagctagcgagctcgtaactacgcacttatatacagacacctaaccaaccaccgaagggacaagtgacgattgaggacgagatggacgacgagtcggacgattacgtgttcaaggacctgatcatggtggacagcatggtggacaggaccaacctgatgagcaacctcgtgcggaacgactccaggctcgagttcaaggtcaacatcaaggtcaacatccagacgcagagcctgaacctcagcatgaacatggtcaaggccgagatctaggacaccatctggcacaagcgcttccaggagcgcatctgcgcatactaacgcggatactaacgggggctcttcggctaccacatcttctaacacttcaccttacactacatc

SEQ ID NO: 17526 - DNA, 130 bp, Sorghum bicolor
  Clone ID: LIB3476-032-P1-K1-E3
gcagtccaggcccttcagggctctggcaacgtctgcttgacctgtgaccgaatcctccaggagccattccacttttgctgcctttcctgcaaggtggaccatgtgatgatgcagggcgggggggacctgt

SEQ ID NO: 17527 - DNA, 462 bp, Sorghum bicolor
  Clone ID: LIB3476-032-P1-K1-E5
agctcttcttccgcaacggcaaggccacacgctcctgtccgcggctgttcgcagcgcaaaccctaacggagccaacggaggcgcgcgagcggaagcatccatggacggtcgcaagagggggaaggccgacggcgccaaaggggcctccgccagcaggaagcggtcgcgagaatcggagtcatttcaaagtggcgtaggaagcaaatcgaagccatgcaccaattttttcagtacttctggttgtccctttggtgagggctgccattttctccattacttccccggtggctaccaggcagtttcaaaaatgaccaatctgggtggcacaacaattgcatctcctggaagaatgacgatggacgggccacctacacccaccgtgaagactcgcttgtgcaacaagtacaacactgcagagggatgccaaatggggtgacaaatgccactttgcacatggtgaaa

SEQ ID NO: 17528 - DNA, 475 bp, Sorghum bicolor
  Clone ID: LIB3476-032-P1-K1-E8
cctcacgcacggtcttcccctccccctctcccacacgaacgacctgcggactcctctcatctctcccgacggacgaaccctagggcagggtgccaagcaaggtggcgtgcagagtgctcttcagccgttgcagcagcggccatggcggcccatcgcgtggcggcgtggattcactaaggcgcaacgagtcttcatcttcgccaactccacaggcggtggtgcgacgggagcatcatcgtcctgccgaatctaatccctatcgaagcccatggtgacttgaggggtgagggcgctgtgctgagacattctgattggaattgccacaaatcagatagtagttggctgacgacaaaagctatggtagtggtgaggccaacagcagggggcaacaagtacatctgctacatctcgatggccaggcccgtgcgggaggagtgcgactgccacatggagactgcagagcaaattaggagag

SEQ ID NO: 17529 - DNA, 339 bp, Sorghum bicolor
  Clone ID: LIB3476-032-P1-K1-F1
cccacacgtacggagggagatgaacatggaccttactgagaacatcttggataatctgcaggtcgaccacatggacaaatacgggaaccactgacacgatctctactgggacgacgcatcttgggcacacgctcaagcttacgaatcataccatggagactcatcttatagactcaacctgcatgatgatgacatggaccctggtgtcgcacgttccagattatgatgacgtgcgtcttgtccagaagagctatgacaacaggactaccacacacgagatcgaaacttacgaaggaggcgatgaaaggagttgctgacaacatcgacgaggatctggaa

SEQ ID NO: 17530 - DNA, 261 bp, Sorghum bicolor
  Clone ID: LIB3476-032-P1-K1-F10
gcgagctactccataaatcaacattatttacaagttacctaccaaccaacatcaacacataaaacaataacttctataactggaggggatatattttatttgtcacgaggcttaaatctttttacattaatattttactaacataaccaatcatctaatacacaaagaacttcttaacatctttaatatcatttttttcaataatattccattctttttattaaaattatataatacatcagctatatttaaaacttttat

SEQ ID NO: 17531 - DNA, 329 bp, Sorghum bicolor
  Clone ID: LIB3476-032-P1-K1-G11
gggaagggtggacgggctcctgcgccgtggcgggcgggcggatgtacatcgtggcggagtacggggagtggcggcttaagcggtacgacgagggccgggacgagtggcggatggtggcaggcagcggggtgccacccgaggtgcgccggccccacgtcgtcgccggcgaggtcggggaggtcgcaggcgggaggcggaggatttacgtcgtcggcgccgggctcgacgtcgccgtgggcactgtctctgccgccgccgccgccaccgcggcacccggcgtcgaggaggaagtggtggaagtgggaagtgttctagggcccttgctagtt

SEQ ID NO: 17532 - DNA, 498 bp, Sorghum bicolor
  unsure (1)..(498): unsure at all n locations
  Clone ID: LIB3476-032-P1-K1-G6
gtgcaaaaccacgctgacgaagctgacccagcaatggcgaccctcggcctgttcccctcttcagtcgccgcatccaccgccaccattcgcgcccccgcccccaccgggccgaccagcgccagcacccgccaacccccgcacgcccgccgcctcccggtcctcggacgccgcgcgccggcgatggacgccctccgcgtgtcggnggccgccgagcccctcctcttccccgccgccaccgccgccggngggcaccccaggctccgcgtgcggacccacgtgcagggcgggggcgcgccgggcgtggcgccccggcggagggggacgccgccttctcgtgggcacccgtcatcctcccgtaagatattttctcggattgtagcgtttggggggtcgtctggaacgcacgcgcgctgggtgttgaattaggatgcgtttctagtccgattcaaccctccacactgtctgatttgatgtactatagtgtggaatcgatgcact

SEQ ID NO: 17533 - DNA, 416 bp, Sorghum bicolor
  Clone ID: LIB3476-032-P1-K1-H3
ttccaatcccccgtctgctttgcgacgctctcacaggaactcgctcgacccccaaacccctcttgccctagcgctccgcgccatgcggccaccgagagggcgcggcggcgggggccgtttcggcggcggcggaggccggggtggcggcggcggccggttcggcggtggaggccgcggtggcggcggaggccggttcggcggcgggttccgcgacgagggcccgcccgcggaggtcgtcgaggtgtcgacgttcctgcacgcgtgcgagggggaggcggtgactaagctcatcaacgagaaggtgcactacttcaacgcgcccatctatctgcagaacaagacccagatcggcaagtcgaggagatcttcggcccatcaacgaatcctattcctttggaagatgatggatgggatca

SEQ ID NO: 17534 - DNA, 528 bp, Sorghum bicolor
  Clone ID: LIB3476-032-P1-K1-H5
gtttcttggacgtgcatggctacactggggtccatgcaaacagatagctagctagtcgccattgtcgcatgcatgcagtcgccaacagcttaacgttgcagtcgccatgcattgtcgatgttagtagtaggacagctaaaactgtctgcatgcagtttgctcagattttctagctactagaaaacacatacggcccaccctgtccataacctgggttagctgctgctgtatgcgcaacccgaccaatcatcgatgagctagctagctagactgaatgcatggtgaggcgcgtcggtggccatgcatgacttgtcttactacttgtacagcacacactgattggagtccatgcaaacctgtagcgagatctcgatcgtaacatccatccacagatcgacgatctagctatacatacttacaaataagccatgggtggtcgtgccatatcatatatgagggtatgagtactggtatataacaggctagtactagagtagaatatacttatgcatttctagtacatatata

SEQ ID NO: 17535 - DNA, 330 bp, Sorghum bicolor
  Clone ID: LIB3476-033-P1-K1-A10
gtacgccaagctgacggggcgtccgttccgggtgttcagcctggacacgggtcgtctcaacccggagacgtaccagttcttcgaccaggtggagaagcactacggcatccgcatcgagtacatgttcccggacgcgagcgaggtgcaggagctggtgcgcaccaagggcctcttctccttctacgacgacggccaccaggagtgctgccgggtgcgcaaggtgcggcccctgcgcagggcgctcaaggggctcagggcatggatcaccggccagaggaaggaccagtcccccggcaccagggccagcatccccctggtccaggtcgaccc

SEQ ID NO: 17536 - DNA, 417 bp, Sorghum bicolor
  Clone ID: LIB3476-033-P1-K1-B11
atggaaagcgtttcagatgcaggatctaaagctggttgtcagtgatgagtaattttgtgttttgctagagaatttgctttcaaaactttgtgtatgttatatatattctaacatgtttttaacagtgtccgatgaagatgcaatatgtcaccggatggtattggtatgtgggacatcaacatgccacatggctgtttcaaagaacagattgtttatacctggtgtctgggggccgttctggtctgcaatggtacctgagttttggctcacagaaggtggccaaagtgcaactggcgctctactcgattacattattgaaaaccatgttgcctctcctcttctttctaaccatgctgcttctcaaagtatatccatatttgagctactgaacaagatgttgctttctatgtcacatga

SEQ ID NO: 17537 - DNA, 443 bp, Sorghum bicolor
  Clone ID: LIB3476-033-P1-K1-B12
ggaggtcttttactaaacatagttcagtttcttcgggaggcgagaacttaattaggaggcttcagaaagatagtgtggtccaggttggtagctcaaatcagacacgctggatgcaatctgatccacatatattgaccgaaggcgaaattattgaaattggatctcaaatggattggcatgctgaaccagatagtggaattgttgtggcaaacaaaagacatgagactgtctcgggagaaggtttgtcatcacagaatcaagaaatttctcaaggaggaaaaatggtgaataatggagatggtcgacaaaagaacattgtgagaggcaaggtatctcttgctcatgttattaaccaggcggaagcttgttcccaacaaggtggctggtctagacacaaagctatatcaattgcagaaaagctggagcaagataatttgagattg

SEQ ID NO: 17538 - DNA, 405 bp, Sorghum bicolor
  Clone ID: LIB3476-033-P1-K1-C10
ctcaactccaaaccaacgcctcccataaatccaaccactcgaggtcactctctgctggcctctctgcctctgcccaacaagatagagagccgccggcctgcaggttgcatccggccatggcggcgccatcatcatcatcgccacaaccaccacggcgaaccgccctactaccagtcctgctgctggtggtggtgtctctcctcctcctctccgtcgtcgctggccacgccgccgcagcgagagtagtggtggcggctgaagcgagctcgagaagccaagagcagcggtacaaagatgttgtggtgagttaagcctaccattaccagcctagctagcttttatgtttcgcgcaagaacgacggtcgtggcgtcaagaagtcgatgagagtgcaatattgtgtgaca

SEQ ID NO: 17539 - DNA, 356 bp, Sorghum bicolor
  unsure (1)..(356): unsure at all n locations
  Clone ID: LIB3476-033-P1-K1-C2
gtaacgaggtggagctgatcgccaagctgcagcaccgcaacctggtgcgcctgctgggctggtgcgccgagcgcgacgagaagctactggtgtacgagtacctncccaaccgcagcctcgacgccttcctcttcgatcggagcaagagcgcgcagcttgggtggagcacccggcacaacgtcatcctgggcattgcgcgcggcctgctgtacctccacgaggactcgctgctcaagggggtccaccgggacctaaaggccagcaacgtgctcctggaccacaaaatgagccccaagatctccgacttcggaatggccaaaatcttcgaggacgactccgacgggatcaacacgggc

SEQ ID NO: 17540 - DNA, 387 bp, Sorghum bicolor
  Clone ID: LIB3476-033-P1-K1-C7
aaaaaaatataaaattaaatgaatgaccctaaattaacccctacaaggaacacactaaaaaaaaataacaacacataggggacggggtatacttatacaaactaatcttcttcaacaaaaaaataaaacccatacggggggggccgtttacgaggtccaagttttctccccccggccttccggagtttaccctttcttttgggtcccctaaaataaaatctctcgtccctgtttttaaactttcttatctggaaaacccttgcttttcccaattttaagggcttggcgaaaattccctttttatcccgcggggatattatgaaaaggcccccaccatttcccctttccaaaaattggcacatcttaatggccatatggaccccccct

SEQ ID NO: 17541 - DNA, 392 bp, Sorghum bicolor
  Clone ID: LIB3476-033-P1-K1-D6
gaatattttggagacatagtcattctgccatttatggaccggtatgagctggtggttctgaaaacagttgcgctgtgtcaatacggggtgcaaaatgtcactgcagattacatcatgaagtgtgatgacgacacctttgtgaggctggatgtagtattgcaacagatcgctgcctacaacagaaccttacctctgtatctgggcaacctgaatctctaccacagtcctcaaagaagcggcaaatgggctgtcacctttgaggaatggcctgaagcggcgtatcccccgtacgccaacggacctggctacgttatctcggccgacattgcgagagacatagcatcccggcatacaaatcactccctacggtgttcaagatggaggtgtgagca

SEQ ID NO: 17542 - DNA, 316 bp, Sorghum bicolor
  unsure (1)..(316): unsure at all n locations
  Clone ID: LIB3476-033-P1-K1-E3
cccacgcgtccgnaaaaaaaaaatatatatataagagcaatgaaaacgcataccaatgctaataagcataaacgaaaaatacaactttgggcatacggtatgctaaatggctacaacacctaggggggcgcccttataaaggacccaactttacttactgctccttcaaacgacagagatctactattgggtcccctaaagcaaattaacgggccgtcatttaacaccgatgggcctaggaaaacctgtgattaccccaatttaatagccttctgggaaaatccccttttacacaggtggataaatacctaaaagg

SEQ ID NO: 17543 - DNA, 427 bp, Sorghum bicolor
  Clone ID: LIB3476-033-P1-K1-E6
tgatcttcctcaataatcttctcagctggcagaagtctgagagcacgctacaatggcgaatatgggagctgctattctggtctgcatagtggttttagccctggatgtcacagctggcatactaggaattgaggcacaggctgctcaaaacaaggttaaaaaggtgacaattctcttcatccaatgtgagaaaccagtttacagagcataccaacttggccttgcagctgcagtgcttctggtagttgcccacgcgatagccaacttccttggtggctgtgcctgtatctgctctcagctggagttcatcaaggcgtccattaacaggaaactggcagccactaccatcattctctcatggattgccctgattgctggattctcgctgcttgctcgcggtgccatgtccaactccaagtcccagaca

SEQ ID NO: 17544 - DNA, 403 bp, Sorghum bicolor
  Clone ID: LIB3476-033-P1-K1-E7
atcttcgtgttttaggagaacaagagcgctggaatattggtgtccttcttcgaatgttgactgagttgctaccatttattcatcagaaagctatacagacttgtccctttgcatcagtcaatccgagttctacaccagaaaacttctcagcatcctgcctaaaatcatatgcagcaggtgactcagagtggtcagcatttgagtggatgcacactgattgcctgccgaatttgatcaagcttgcctgcttgttgcctgtgaaagaagataacttaagaaccattatcacaaagtacctcttggaagtatctggactctatggcaaagattatctggagcacattatgctacctgtatttcttgtagcagctggtgatattgatagtggcgattttacctattt

SEQ ID NO: 17545 - DNA, 402 bp, Sorghum bicolor
  Clone ID: LIB3476-033-P1-K1-E8
ttctacatcagtcatgcacagaacatcccttttattgagaacatagagaagagggtccaaggtgctacaaaactgcttgatggtagcttggagcgctgctttgtggatggtctggaacaccgtgatgctaaagttatatacaactgtttgcgtgcttatgctgcaattgacaatacatcatcagccgaagagcttttccgtacaacagtggtgtctccattgattcagaaaatagtccctcaaaattatgcgagggctgttgctggggcatcatctgatgaactggaagatgattatcaacagataaaagaatgtgttaaaaaagattgcaaattcatattggaaatatcttcatcagaaaactctggattgcatgtttttgattttctgggcaattcaata

SEQ ID NO: 17546 - DNA, 284 bp, Sorghum bicolor
  Clone ID: LIB3476-033-P1-K1-F2
gttcacctccctttctccactccactgcccgtcgctctcccccgcatcccatcgcgacccaaccccgcgcccgccccggacacggccggtgcggtgcgcgtctccactgatccgcacgatcgcgcgctagctagcacgcccgcgccccggccccggccccgggccgggagagcagcaagcatctcagcagctgcgtcggccggcgtgtgcatggatccctcggggccagccgccgggccgtcgtcctcggccggctagggggcgtgcgacaactacgcgcacgc

SEQ ID NO: 17547 - DNA, 436 bp, Sorghum bicolor
  Clone ID: LIB3476-033-P1-K1-F7
gaggagtacatcaaagcactagaccgtgctaaaggtgaactgtactataatcattcactgggtatgcagtacagcaagataacagaacaaatatttgttgggtcatgtattcaaacagagaaagatgtgaagatgttatcagaaactatgggtattactgctgttctgaatttccaaagtgaaagtgagcgcattaactggggaatcaattctgagacaatcaacagttcttgtcgtgagaataacatcttgatgggtaactatcctatacgagaggttgattccgtggacctaagaaagaaacttgctttctgtgttggacttatgatgcgtcttattaggaagaactaccgtatatatgtgacttgtgccactggatatggtagatcaccttcatgcgtgatatcatacttacactggggtcaagatacacgtt

SEQ ID NO: 17548 - DNA, 494 bp, Sorghum bicolor
  Clone ID: LIB3476-033-P1-K1-G1
gtggtgaagaaccacctgtcgatggtggccttcaacaacatcacgcggctggccttcgggaagcggttcgtgaacgcggccggcgagctggacgagcaagggcgcgagttcaaggcgatcgttcacaacggcatcaaggtcggcgcgtccctctccatcgcgcagcacatcccgtggctgcggtggctggccccggtcgacgagcaggccttcaaagcccacggcgaccgccgcgaccgcctcaccgtgaagatcatggaggagcaagccaaggccctcaagcagcacggcgcccagcagcatttcgtcgacgcgctcttcactctcagggacaagtacgacctcagcgacgacaccgtcattggcctcctctgggacatgatcaccgccggcactgacacgacggtgatctcggtggagtgggcaatggcggagctgctgaggaaccccagggtgcaagagaagctgcaggagggagctgaacgacgtcgtcg

SEQ ID NO: 17549 - DNA, 415 bp, Sorghum bicolor
  Clone ID: LIB3476-033-P1-K1-G10
gtaatggacaatcctcccatggatggtatattgcatctcctcatggagtccaatgtctcagctatgcctaaaaccgagaggtggctttcttttaaaccttatgtcctctagcaccacgttggggcacacctgaactacccaatgcatgcttatatgagcaaaaaacctcatggaaaatgctccaagctggctcaacaggcatttgctccattagctgcttgtttgcctcgcgatgtacatattgtgaacctgaaagttcctcaggctgtaagatttcctcacaccgaagcagcagaaccaagatttgctgttctgttgcacaggagacgctgggacacatcatactgtaaaaggggtggactgcactgtacaacagttggggaagtaccactaaatcttttctacatgttcaaag

SEQ ID NO: 17550 - DNA, 325 bp, Sorghum bicolor
  Clone ID: LIB3476-033-P1-K1-H1
aaaaaaaaaaaaaaaaaaaaaaaaaaaaaaaaagaaaaaaaaaacaaaaaaaaaaaataaccaaaaaaaaacacaaacacaaataaccgggactaggtaaacactaaaaacactcagcaacagcacaaaacataaacaacggggggctctcctccggccttaaaaatttttccccacatggaacaaactccctttttgttcaaaaacaaaaatttccaacatacctgaccccaaataccccccactggtttgactctaaaggccttcttttccctctttaaaaacccacccgttaccaaggctttatttcttgggtgcatatttt

SEQ ID NO: 17551 - DNA, 219 bp, Sorghum bicolor
  Clone ID: LIB3476-033-P1-K1-H5
gctggcctatgtgatcttctgcgtgtcccgagcggcggctcaatccgagccttcgcggagttcttctcagctgctgctcgtgagagtggctctcgagatctctatctcgatctagagagagcgaacaaggatcatcagccttgctaccagagctagagaaacagggcagaacgagcttgttgcttcagagcaacagtgcgaagaccctgagatcaatgc

SEQ ID NO: 17552 - DNA, 324 bp, Sorghum bicolor
  Clone ID: LIB3476-033-P1-K1-H9
cgatgtggcacatgatgtacagcagagccagaagattccccaggatcctagtactttacatgactttggagggatgacaaggcttactgcttcagacgtccaaacttctgattactggctcctaacagagggggatgttagcatgactgatatttggagaacagaacgtatccttgataatcattcattaagctagtttaaaatcatctgttctgttacgcagttgttgttacagcttgaagttcttaacatggaaaatagaagaagtgcagtgggaccagatggatttcttgtctgaagatgttgtcacccctcgagcccata

SEQ ID NO: 17553 - DNA, 348 bp, Sorghum bicolor
  Clone ID: LIB3476-034-P1-K1-A12
gacccacgcgtccggctagagcagaaaaacacagaaactttggagaaacatcggcttctggaagaggaaaagttatctgcgaacaaggagaatattaagctacaaaagcatgtccaagaccttgaagttcagctccagctagcaaagcagaagattaaagttaccgaagcagaaagcaaatgcaaagaagagagatatgcagcaacagcggaagcgttgcgggcagagatctgtcatcttgaacaatcagtacagcagttttcaaggagaatcagcttgctggaagggacttttctgcaaaataaagggcatgctgaaataagggtctttaaaagggccttccaaatg

SEQ ID NO: 17554 - DNA, 443 bp, Sorghum bicolor
  Clone ID: LIB3476-034-P1-K1-B10
cccacgcgtacgatttcccaaagcaaaggattgttgttgctggcgcaggcagtgctggtattggagtggtgaatgctgcaagcagaaccatggcaagaatgttgggaaacaacgaggttgcttttgagagtgcgaggagtcaattctggatagttgatgcccttggcctaataacagaagaccgagaagatatcgatccagatgcacggccttttgctaggagaaaaagtgagcttggtcaccaaggccttaatgagggggcaaagttagtttaaagggttaaaaaggtgaagcctgatgtcatacttggattatctgctgttggtgggttgttctcagaggaggttctagaggcactaaaagattcattctcttcgaggccagcaatttttggcatgttcaattcaactaagaacgctgagtgtacacctggggaagcattt

SEQ ID NO: 17555 - DNA, 217 bp, Sorghum bicolor
  Clone ID: LIB3476-034-P1-K1-B12
gcggcgagtgttaattcctcggaccgtgggatggtccgaaatttaatccgggacttgataaggaatgcttttccaaagggaatgcaaagggaggacctttttgatgtgttggagaagggccctttattagggcgggaccccggttcaggaaaagtggttgatttttttggccgaataaaataaaaatttcttggacttcttaggttcctaagggcct

SEQ ID NO: 17556 - DNA, 430 bp, Sorghum bicolor
  Clone ID: LIB3476-034-P1-K1-C8
gaagatctcaagacatctatttctccagtgttgaatattccatatcgactggagcctgatgatggcactagttcagctgtcattgacatggaatatttcaagcgtttatcaattaagttccagaggttcttggttgaagcaaaatctaagaagcttggttgtttctacttatccgagagtctggatgaggatatggactacatatttagggtaccggaagcataccagcgtgacgaagtccatgacttcaatcacatgccagctgaaactgccttatattctgatggtaatcttgaaaaatacaaggacagacacttttgcctgtaccttggtcatcaagatggcgaaatgggacagtgcaatggtcctgaagcttttgcaaattattttggtctacttgactcccttccgcataatggaagcaaatcaa

SEQ ID NO: 17557 - DNA, 303 bp, Sorghum bicolor
  Clone ID: LIB3476-034-P1-K1-D5
ccccactagctagccactactagcagctaggagcgcgccgccggtctccaccgcggcggccaagaaccaaacccaacaggagtcaggcgagtcctaggtagccaagaaagctggggaacagcctgcttcctgggaggaggaggaggaggaggagggagacaaggagaaaaggggatctggacccgacgctccgatggcggtgacgggcacctccgtggccgcggcggccacgatgctggcggcggcggcggccatcttcatcaccttcgtcatctgcttctacctcttcctctgcgccaagcg

SEQ ID NO: 17558 - DNA, 341 bp, Sorghum bicolor
  Clone ID: LIB3476-034-P1-K1-E6
tcctaaaagaggctggtggagaaactgcaaaacagcaagtacatcctccgaattccgcgaagcaactgaagcaaacagtcagtgatattagacatgatgtccagtcccagatcaagcaaacacgtcagaccaagatgcaagtcaatcaaatcaagaagaggctcgaaaagcttcacattggcgggctggacaaccccattcacttccaccaccgtggttgttgtcttaatcgccccagccgctttggccgccttattcacggtccccgaaaccttgggggaggatttgacccaggcgcctcccggcatgtccttggggcaggcgtccgtggcgagcaaccc

SEQ ID NO: 17559 - DNA, 201 bp, Sorghum bicolor
  unsure (1)..(201): unsure at all n locations
  Clone ID: LIB3476-034-P1-K1-E7
ttctgctagcacagagagggggaggcgagatggagaggaagaaaatggcgatttgnggtgccgaggcggagaagaagagggcgatatcgggtggcgaggccgcgccggccttggcgaaggcgatggtggcggcggcgccaaaagggaaggcgatcgttccgtcgccggtccccatcagcatttgcgggctacgggaagcgc

SEQ ID NO: 17560 - DNA, 338 bp, Sorghum bicolor
  Clone ID: LIB3476-034-P1-K1-E9
atccaaaaatggtcaatcccctcttcatcttcctccccctcctcagcgtcgccgccgtgccccgcgccgccggcacggacgggccggacccatgcgcaggccggcggatccacatccgcagcctgcctccgcgcttcaacaccgacctcctccgccactgcggggccgacgccttcccgctcgccgacccgtccgcggcggccacctcgaccccgccctgcgagtcgctcgccaaccacgggctcgggcctcgcactcacccacgcagccggtcttggtaccgcaccgacgcgcggcttctggaggccttcttccaccgccgcatcctggagcgggac

SEQ ID NO: 17561 - DNA, 213 bp, Sorghum bicolor
  Clone ID: LIB3476-034-P1-K1-F10
cgagaggtacaatggcagacgctggtgacgtctccgccgtagccgctgccggtgccgccgccgcatcggcgctgccagcgggcaacgcccagccgctggcggatcgcgtggccatcgtgactggcgcgtcgcggtgcatcgggcgcgccatcgggcgcactgtctcctagcgcgagctgtctgggacgctcggcgccacaggaccgctgcgcg

SEQ ID NO: 17562 - DNA, 418 bp, Sorghum bicolor
  Clone ID: LIB3476-034-P1-K1-F4
gagtcttactggacacctatgtgccggaatcatacaccatgacttaaaacacagccagggccacgggcgagcccaacgcagtgctctatcaagcgggataagacgagctctacagtctacctctaccttggcttcacaagctcacctgagggtaaagggaagtgtctcatggctgctacaagaattaggcgatgctcccatactgagtacattatatctcttggatcagaggacttatcacaagggcgccatgcatacattgggcaactgagaactgatttctgggggacaaacctgaaaatcatacatagccagccaccattttaaggtgcttaagcattaagtcgactatctaggcgactcttcgggagcatgaggatcagtccccaagtatcagctggtaactatggagactgac

SEQ ID NO: 17563 - DNA, 582 bp, Sorghum bicolor
  Clone ID: LIB3476-034-P1-K1-F6
cggacgcgtggggtaatcattggcgagccaggagttggcaaaacagctattgctgaaggactggctcaacgtattgtacgaggagatgttcccgaacctctaatgaatagaaggcttatttcattggatatgggagcactacttgctggagctaaaattcgtggtgaaattgaggagagactaaaggctgttctaaaggaggtcactgcttctaatggacagaacatcttggtcattgatgagaaccatactggtgttggtgcaagagccgctggtggagcgatggatgctggtaacctggtgaagccaatgctaggccgtggagaactccgctgcattggagcaacaacattggatgagtaccggaagtatattgagaaggatgctgctcttgagcgtaggtttcaacaagtttattgcggtgagccagcggttgaggataccatctccatactgcgtggtttgcgagaacgatatgaactgcatcatggtgttaagatatcagatggagctcttgttgctgcagcagttctatccgatcgatacatcactggacgtttttggccgacaaagccattgatc

SEQ ID NO: 17564 - DNA, 346 bp, Sorghum bicolor
  Clone ID: LIB3476-034-P1-K1-F7
cccaaatctccattggatatgttggagagcaattgtcagtcatgtgtggttgagacatccaatgcagtttccatcagtatgcttgtgagtgtggatgacatggagtgcagcagtaatatttcttctcaggaattcttaaagcctgtatctacctgtatttatttccctgtttgcaaggaactagttgctgctcaaaggatacaaaatgcataccgaagatatttgaacaatagaaacaggataactgctgcaattaaaatccagagccagtggcgttgctattcagtacgcaagggcttcacaaagcaagttcaggctattgtaggaatccaaacatcaataagag

SEQ ID NO: 17565 - DNA, 158 bp, Sorghum bicolor
  Clone ID: LIB3476-034-P1-K1-G11
gcagacttggatttcagagtagaagggcttagcttagagatagcagaggggatatatctcttctagttgaataacttaagaactaaaatcagtgcatccttgtttggtgcatttatttctatagaaaaataaatggatgccttcttgctatggacttt

SEQ ID NO: 17566 - DNA, 525 bp, Sorghum bicolor
  unsure (1)..(525): unsure at all n locations
  Clone ID: LIB3476-034-P1-K1-H6
tgaagaaagctgaagtgaagatgcttctgaggatgcttcaagcttactacaatcatgtccgtgcatttgaggataccttagtgacaaagttctttggcctacattgtgtgaaatctggagcacaccagaagaaggttcgttttgtgataatgggaaatttgttctgctctgatcatactatccataggcgatttgatctgaaaggatcatctcttggccgtataactgacaagccaccagcagagattgatgagtatacaactctgaaagaccttgatcttaactttatctttcggttacagaaacattggtaccaagagtttcaaaggcaagtggacaaggactgtgagttcctcgagcaggagaagattatggattacagtctatnggtgggtgtacattntagaggtgccattgacattgatggtgacaaacctgcaacactctgtgtttcaagatgggacagggatctatttcgntctgatccaaatagatggtcaaaaataaacttggagcaaacatgct

SEQ ID NO: 17567 - DNA, 347 bp, Sorghum bicolor
  Clone ID: LIB3476-035-P1-K1-A12
cacaccacttcttggctctcgcacactcctgccgccaccacctggtccgtccacgtcgccggcggcaatgtcggcgcacctggccgtcgcgctgttcctcgcgttagccgtcgttccgtcggcccgcggctccgacgtgccgtcgttcccgctgtcgcaggcgcagtccccgtccaactcctcgtccccgtccaactcctgctcgccgccgtgccacctcgacctatccgccgagctcttcggtggcgtggccgaagcgtgcggagccggcggcggccccgcttcgctagaccgtggccattgctgatgggtactggaaccccccctgtacggggcccatactcgca

SEQ ID NO: 17568 - DNA, 489 bp, Sorghum bicolor
  unsure (1)..(489): unsure at all n locations
  Clone ID: LIB3476-035-P1-K1-C10
cggacgcgtgggggctggtttgccaagttcccgcagtacaagggcagagacctgtatattacaggggagagctacgctggccactatgttccacaattagcccagcgcatggttgagttcaacaagaaggagaagctattcaatctgaaaggcattgctcttggcaatccggtgctggaattctccacggatttcaactcgcgcgccgagttcttctggtcgcacggcctgatatcggattccacctacaacatcttcacgacggtgtgcaactactcgcggtacgtgagcgagtactaccatggttccctgagcacggcctgtgacagggtgatgagccaggtgacgagggagaccagcaggttcgtcgacaagtacgacgtcaccctggacgtctgcatctcgcngtgctcatgcagtcccagatcctcgccccgcagcagggagccggagcttgacgntgcgtggagacgagcgatgactacctga

SEQ ID NO: 17569 - DNA, 354 bp, Sorghum bicolor
  Clone ID: LIB3476-035-P1-K1-C11
gccatcctcaatgattctttcaccgtctacgatgatgatgcatgcaagcagcaagaatatatccaagtatataataatactgatatacagtaagtaatactcctacatatcagatttacagtaatttgtggatgttgagtcccaccatgtatgcaagctccatgctgttgagatgttggagcgtgagggggccatcagaatccccatgctggtgcttcagtgccatctccagctgaaccgactgcatgtacatacatacttttgcatttaattaatttgcatcaagaacacagattcagattctacgttacattcatttggactgactgacccacccacaccgtacccttaagg

SEQ ID NO: 17570 - DNA, 472 bp, Sorghum bicolor
  Clone ID: LIB3476-035-P1-K1-C12
cccacgcgtacgccagatctcacatggaccaggcctcgaccgctgacccagccgcctactgatcggactccgtctccccatcgaggtgcggctatgaagaggcgtacgtagcagattcacagtcaggggacgatgtcgagacgcagcatgactccacgccgcaggccggggagatgtagcagcgtgcgcgggccataataatccccatgctggcgcttcagcgccatgtccagctgaaccgactgcatgtacatacatacttaggcatttaattaatttgcatcaagaacacatattcaaattctacgttacattcatttgaactgactgacccacccacaccgtacccttaaggattcttggaagtctttgttgtcaggcaggtactggaccatccatataattacgcttgctgtcgcaatctggcctgttattctttatatatataataagagaagatgcacaagcaaac

SEQ ID NO: 17571 - DNA, 543 bp, Sorghum bicolor
  Clone ID: LIB3476-035-P1-K1-C6
gagagaacatacaaaacgctagctagttgttgtcccgccgtccgtcgtcgcctgctaggctgctactccggcgagaagagcagctatagcagggcagtttagtcttctccatcagccggcaccgccgcgccggcggcagctagctagctagccgagatcggggaggggtgcggtgtcatctctcctgaggaaccggcgcggcgatggccggggggcaggcgcccgaggcgtcgcccgggcggtaccagcgccgccgcgacgagatcgacgacgacgactgcgccgacgtgctcggcatcgacgtgcgtggtcccgacgctgacccgttcgacatccccgccaagcgcgcccccgtcgagcggctgcggcgctggaggcaagctgcgcttgtcctcaatgctaatcgacgattcagatacacacttgacctaaaaaaggaggaggagaaggaacaaataaggaggaagataagggcccatgcccaagttatacgggctgctttacttttcaaagaggctggggaaaagcagaatcctgacacag

SEQ ID NO: 17572 - DNA, 575 bp, Sorghum bicolor
  Clone ID: LIB3476-035-P1-K1-D1
cagcatgttcgcctgcttgattcagaccatcagatgttgactgcccttgcaaatactggaatagaagtgatggttggggttccaaatgatcagctacttcgtgtgggccaatctcgttccacagctgctgattggattaataagaatgtcgctgcttacactccggcaactaacataacatatattgctgtgggcaatgaggtccttactaccattcccaatgcagcacttgttctcgtacctgcactgcaattcctccagtcagcacttttggctgcaaacctcaatactcaagtgaaaatttcgagtcctcattcaatggatgtgatctcgaaggcgtttcctccctctgctgccactttcaattcgacatggagctcaataatgtctcagtatcctgagtttctcaagaataccggatcttcgtttatgctgaatgcccaaccatactatggctatgtcggagggcaagggcgtattccccttgagtatgcactattccgctcacttaatccgaacagtcaaatttcagatcctaacaccaatctctttataccaaaatgttgatgctataa

SEQ ID NO: 17573 - DNA, 471 bp, Sorghum bicolor
  unsure (1)..(471): unsure at all n locations
  Clone ID: LIB3476-035-P1-K1-D12
cccacgcgtccgcccacgcgtccgggcaaacggaatcgcgcctcccatcctctgctttccccaaaggccagctccctccaccgcggcgccaccgctcctataaaccatcagctccccgtaggcgcgctttcaccgcgacgacagcgtgagcagccatgccggggcggcgggcgatcgaggtccggctgctgcctggcggcggcgacgccgcggcgcccaggtggcgcatgtcgctgctggagaacacgttcagcgggttcctcctgcagggcgccggcgccggcgccgacgccgcagcgagggccgtgttcgtgggagggtccctgttcagcccgttcctgttcggcaagttcttcgacccggccgacccgttcccgctgtggagttcgagtccgtcgtgctgctcgccgcgctccgncgcggcaacgccaggaccaccgtcgactgggccgagaccgactncgagtacta

SEQ ID NO: 17574 - DNA, 448 bp, Sorghum bicolor
  Clone ID: LIB3476-035-P1-K1-D9
cggacgcgtgggcttccaccatcagtactggacttcaattgtcgtagtccacaggagttgctaaaaagggtggcagttgagatatttggcaaaatggagtccttgcatgtggaggtgtctgaatttcttcaccgtactgaattgaacattgtaaatgaggatgaacctgtgaaggaatgcgttcaaaggcagattattgagatgaaggatttgcttaaaatggaaagaaatgaatatgagatattgcttttaccagtcatgagggaaagcaatcaccccatgcagacatcaattgatattctggagctcaaccgcttgaggcgtggtcttcttcttgatgcctacatttgggatcggaggctatgtcatgttgattcagttcttaaagcacatggccatatttcaaaaaccaatccaaatagtcttgataatctcctatacaccagac

SEQ ID NO: 17575 - DNA, 398 bp, Sorghum bicolor
  Clone ID: LIB3476-035-P1-K1-E2
ggagcccgtgtctgtcgaggaaacccagctccaccaccaggccgccatttccgtcgaggttggcacttcacagacgagctccgagcctagtagcggcattcatccggcggcggccaccgacggcagctcaagcccgccggtgacggtggtgctggacacggccggcgacgtgccgtggatgcggtgcgtgccgtgcaccttcgcgcagtgcgccgactacgacccgacgaggtcgagcacctactccgcctttccctgcaactcctccgcgtgcaagcagctcggccgctacgccaacggctgcgacgccaacgggcagtgccagtacatggtcgtcaccgctggcgactcgttcaccacgtcggggacgtaccagctccacgtgctcaccatcaact

SEQ ID NO: 17576 - DNA, 224 bp, Sorghum bicolor
  Clone ID: LIB3476-035-P1-K1-E3
tttgcctcggcatattcgcccgcagccgcgcgccggtgccggtacgctggtggtgaggcgcccgcggcccgccccatgtcaccaccatgtgtggtgggctggtggcggtggtggccgtgctgctggtgcgggccgcgccggtgcagccatcggtggcgcccggcgctgccataccctgcgtgaacccattttctggctgcctgcttgtcttttttttggggggc

SEQ ID NO: 17577 - DNA, 580 bp, Sorghum bicolor
  unsure (1)..(580): unsure at all n locations
  Clone ID: LIB3476-035-P1-K1-E4
cttgtgttcttgttgttcttgctttgttcttcgtgttcttcgtgttcttaagataggatgaatcgcaaagttggaggagcacttaggagcatcggaggacactctcattccgcagcatccagagccggtcatcatctcaagcaccttcacgtgtcggttccgggatggacatcgattcgctatcatcttccgagcatcacacctcgtcatcctcttcccaatgggaagagagttttactttggcaggtgtccatcagcatgcatcagcaggctgtccagaattgtttacactggagctgacccagcaccatcgggtccagctcatttttattatacttaatgatccaggtgcgtcacatgagccacatcagccatggtccacccactcaggatgggaggaccaagccacgtacgagcaaggagagtcgtctacatccacaggatggggaacattcctcacataggagccagataagaccaggcaaaattttcaagaggggtcgtgcatcattttctgtgcgcggaaatgcggaccacaccactggtggaccatacncgttccatgcaccaccagtagatg

SEQ ID NO: 17578 - DNA, 517 bp, Sorghum bicolor
  Clone ID: LIB3476-035-P1-K1-E8
gaatctgaaaagtgaaaatagtcattgccttaaatatgccatgtttttcttgtctagtaatatgttaattccatccatgtgtcattccatcttgagtccaaaattttctttaaagcaaagtacaatcatacatcctttcaaattgaatgtgatcacaccttaaaagcctgctttacacggtatttctgtgttgttttcagcttctggagaagcttgcaatgatattatggcatactccctaatattgtcctgctgctgttatacatgctgtgtaaggagaaagcttcgccaaaagttggacattgcggtaaatatttaaggatatgttactagtagattttgtatttctccttaagtagaaatgcccatttcttaacttggcactgaactacctctgggattgaccataccatatgcaagtgacttattaattgctaaaaccagaatatccagaaaaaatagcttttgattatcttgatgaaattaacttatacagcacgtctattttacccactac

SEQ ID NO: 17579 - DNA, 561 bp, Sorghum bicolor
  unsure (1)..(561): unsure at all n locations
  Clone ID: LIB3476-035-P1-K1-F12
ggacccgctccgaacgcttcgcctactcggttatgccgtcgccgtcacgcgcgcccaccacgtcggcgccggtgaagaagaggtcactgttcaccggcttgctgtcttcgccgttcagcaaggcgtctctgaagcagacgtcgccgagcaagccggtggccagcgcgttcaggaggacggccagcccaaccccggcccggcgctctaccgaggtgcctgcctccgccgggaacacgctgttcaaggcttcttctggcggatgcggcgtggacggtgacatgaagttcaagctcccggtgccggcggcgatcaagtccgaggatgagcaccagctgagactactctacaccagggagttgcagtggcggctcgtgaacgcgcagcttggagctgcgatttcgncgcagaccatgggtgcagagaaaaagtgtgtggcgcaatggatttaatcctgaggatgcgcaaatctgtcgccattagaaagatgcagcttcagttgcttcgaaacaactgcaaactcatggcaattctgagaggacagatgncataccctggaagaat

SEQ ID NO: 17580 - DNA, 542 bp, Sorghum bicolor
  Clone ID: LIB3476-035-P1-K1-F6
ccaccaccgcatttcttcaggctcctgtccccgccgccgccgtcgccgtccggtcctctatggacgggatgcagccaggaggaggcggcggccacggatactccgcgcatggagatggaagcaagaggtcctcctcgccgccgggaggctaccgctccggccagggtccatcggcgccgcggtgcccgaagtgtttgaagatggagaagaggtttctgaaattggagaagcagattaagaagctgaagctgagacagttttatttgggcaagaaagtgtgggtgcatggcagcaagctctatgacttatagatggagcctgtcgacaagccagaggccaagaaggtgctggtggtgattgatgattaagatgcttgatgctgcctaatgaagatggaactgcagtgtgcatggtgggatgtgtcttttggttctgtcttttggaaagtcttagatggaactgcagtgcatgctaggatgtgtcttttggtctgtcttttggaattcttagatggaactgcagtgcatgattagatgggtatc

SEQ ID NO: 17581 - DNA, 524 bp, Sorghum bicolor
  unsure (1)..(524): unsure at all n locations
  Clone ID: LIB3476-035-P1-K1-F8
cccacgcgtccgggtgaattgaatgctgatttgaattacttatgctatctattgtttgtttcttgtaggtccatgacattgttgcagctgcttgtgtccatctctatctcaggtaagcaacacaacattggtggcgagtagcagtagagccaactcattttagtttcagctttgagttatttgttagattcataggagaaggccaacagttttagatttacagcagaacctgtctttgcatattaactgctctgttcattgacataagtttgtgacttgcctactcacatgaaccttcgttacatatcaaccatcatttcataatcatttaattattactagctgcttattttgaactgatgttgcttgtctcagttttgcattgaatttttttctttgtcgagtgtgctctttttcatatgcagtctgtatgcacatatgagtatntaattcactggaattttataaatctgacagatgcctggatctgaacttttataaaccccaagatggattatctgtta

SEQ ID NO: 17582 - DNA, 336 bp, Sorghum bicolor
  Clone ID: LIB3476-035-P1-K1-G10
gcgcacaacacagcagcacatccttcaacaaggcaaaaaaaccagacctcctcacaacagaagacatcatgggcctattcattagtgggaggcgtcttattttaaagcgtctgacgatcacttacctgatgtaagaccacattgtcataaacctaccacaatacattaactcacgcgacttttgtccatgccaatcctttcacaccgcacagagatacacatctatacgcaacaacctctcaatcacacccccaaaatccaccctaactggtcccgaatataaaacttacgctgactactacatagatcacgaatacacatgcccaaacagaactc

SEQ ID NO: 17583 - DNA, 408 bp, Sorghum bicolor
  Clone ID: LIB3476-035-P1-K1-G8
cactccaagctcccgctcgctcgcagagtcgcaggcccggagctcctgccaccagaagccaccatgggcctctgcttcagcaagaagaagccaccggccaagcccgggaagatcgccgtggcggtgtccgacgacaaggccaagaagccggcgccgcagcccaagagggcggcggcgggggaggccgcggcggcgacggcgaacaaggctgccgcggtgttcgtggtgaggccggggtcgtcggcggcggcggcgcccggggaggatccgaagaagaagcggtcgtcggggtcgtcgcaagagccgcagccagcgccgaagcagctgccggtggtgctggtgccctcgacgcccgtgcgtagctccagctgcaccaagggaggggtggacgcgatcctgatccagtgc

SEQ ID NO: 17584 - DNA, 487 bp, Sorghum bicolor
  Clone ID: LIB3476-035-P1-K1-G9
cacaatctccaggacatccttcaacagtggaaaaaaaccaggaccatgaagatagtaaacattctggtcccagtgatgaatcagagccaaatcagcttagagagtctgccggagacttacctgatggtagtgcatcttcttcgtcgcctaccaaaatagataaatcaagtgacaccgaaacaggggaatctattcatacaggaaaggaagacacatctgatgggaacgcctctcagtcacaaccagcagaatccacgctagctagtccagataatataactgaagctgacgacaagattgctcaagaatatgatgccccaaaagaactcagtagcccacaggagaatagcgatacagtagacagagttactcatcttgaagtcaaattacatgatggcaatattaatactgaaaaaagtgaggatgaaaggaataagatggaggcaggggaagcatctgttgtgtacaggaggataatgtaatggag

SEQ ID NO: 17585 - DNA, 339 bp, Sorghum bicolor
  Clone ID: LIB3476-035-P1-K1-H9
gggagagggaattcaggttcagatactgagaagaaggttgcagaggatggcaacgcatctggccccaagattccaccaaggccacatgggaatcggctagagagtttccggcaacagttccaccatttgcggcccatatctagaaggtttggtgacacacatgggcttttgtctacgtggaggcgcatttttgatcagcatttggtgaatagcatgagtagacttgaagcgcctcctgaaccatctgtctcggaaactgctcagcatgcaagccgtttgggccgaatgactactaagttgagagcgaggaggttgcaaagggaagcggaaaaccctaca

SEQ ID NO: 17586 - DNA, 399 bp, Sorghum bicolor
  unsure (1)..(399): unsure at all n locations
  Clone ID: LIB3476-036-P1-K1-A4
caacaattggaatggtgctgtttatgatgtcaatataggtggattcaataacaatttgcactgcctagcaaggtgtgtaagtgctatagttgggggaagcgaatacaccagggtcgaaagggagcagcgaataaattctctttcaaatggacatacagatgagctccaagaggctgagttaccaagccgtgtctcagcagaagcaaatattaaatcttctatgcaaatctacgtcaaattgtctgcagggatcgtcctggattcatggaatgacactagcangccacacatcgttccaaaactgatattcctggatcaactctgcgagctgtncccctaccttccaaagagcaccttagaagttcacataccatacaccattctgcgctcaatatacca

SEQ ID NO: 17587 - DNA, 414 bp, Sorghum bicolor
  unsure (1)..(414): unsure at all n locations
  Clone ID: LIB3476-036-P1-K1-B10
attntagaaactatgacagcaaatggatttgaaattgatgttgtcacatatggaacactcattaacggtctatgcaaggctggtaggactcaggttgctttgaagcttttaagaggcatgcgaattaaagggattaggcctactccaaaagcttacaaccctgtgatacagtctttgtttagacggaataatttaagagatgcccttaatcttttcagggagatgactgaggtgggtgagcctcctgatgccctcacatataagattgttttccgtagtctctgtcgtggtggagggcctatcaaagaagcttttgattttttggtggagatggtgaataagggtttcatgcctgagttttcatccttccgtatgctagctgaaggtctattgaatctgggcatggatgattat

SEQ ID NO: 17588 - DNA, 431 bp, Sorghum bicolor
  Clone ID: LIB3476-036-P1-K1-B12
ggcaggtacagtcatgaagaggaagaagaagaggaaaatcagcgatcattgctaaggagaacaacaatcgggaatggccctccagaatcgttatatgactggacccgtgaaaatgatttgggaatatcaaatcagggaagccctgaccaagttttctctagaggacactggcgccttgtcagatgccagaatggcaagaacttatattttgctcgtaactctgtttctctgctgtgtaactgggttgctcctctgatgtggtgttgatttcttcaggcctccgcatttttgaggagctccaagatgttgattaccttgcaagaagctgtagcagagcaatgaaggctgttggtgtggttgaagcctcctgtgaggctatatttcagcttgttatgagcatggatactactcgttttgagtaattctttctt

SEQ ID NO: 17589 - DNA, 438 bp, Sorghum bicolor
  Clone ID: LIB3476-036-P1-K1-C12
ccccccgcgccaccatccccctccttcctctctctatctcctgtctctttctctctctacaaactccccctcgcgaacagccgccgctgcagctgcgttggtttttgagagagagagagagagaaagcgagcaagggagggagagagagggacagcaactccctgggtcgctttcgacggcctggatctccccgcacgcgggatcgtacggccggcacgctgctgtcgctttccaccgcatagtaaattgccaaggctgttgtaatgggggtcaatggtcatcatgaacctcgcagaggatgtaatggcaccgtctgcaatggtagtgtaagaccactcgatcattttggtgatgtagatccatggacggcatgggcatacaagcctcgtacaatctcgctcttgctgatgggaacatgctttttaatttgggcaagt

SEQ ID NO: 17590 - DNA, 316 bp, Sorghum bicolor
  Clone ID: LIB3476-036-P1-K1-D11
gttcttaaaccagacatacttgcacctggcaatcttatatgggctgcatgggcacctaatggaacagatgaatcaaattatgctggtgagaggatttgcaatgatttctggaactagcatggctgcaccgcatattgctggcattgcagcactgataaaacagaagaacccaaaatggagcccctcagcaataaaatctgccctgatgacaacggccaatacactggacaaagggagccatcctcttagagcgcagcagtacactgcatcagaaatgatgacactctcacgggccacaccatttgattgtggtagt

SEQ ID NO: 17591 - DNA, 486 bp, Sorghum bicolor
  unsure (1)..(486): unsure at all n locations
  Clone ID: LIB3476-036-P1-K1-E5
cccacgcgtccgcagccctctagtaacactagctagctagcagccgacgctggtgcgatcttccctcaactccgaccccaggaacgcgcaggcgctgcgcccagcctacctgcatccagcccacatgcttcatgcccaagctcttcggccagaggagcaagaagagcagcggcggcggcagcgccaagaaatccaagggcgccgagccctgcaggcagcagcaggcgcccaccggcctgccggagctcgtcgtggagccgaccggtgcgcgctccatgtcgttcgtgggcacgcacgagtacctggccccggagatcatcaagggcgagggccacggcagcgcggtggactggtggacgttcggcatcttcctgcacgagctcatgtacggcaagacgccgttcaaggggcagacgaaccgcgccacgctgttcaacgtcgtcgggcagcagctcaagtcccggactgncccgcacgagcacgcca

SEQ ID NO: 17592 - DNA, 503 bp, Sorghum bicolor
  unsure (1)..(503): unsure at all n locations
  Clone ID: LIB3476-036-P1-K1-E8
gcacaatcatctacaaaaggccaaattttccgaggcagtaaaataaaggtggaagaacaagaagaatgcagcagcataagcaatgcaaggaaggaacaggaaaatgaagatctaagtcccctatctgtgcttgaaccaacctctctaagtgagagttgctggtcttctgagtgttcaggcagcagcagtgggggtaagggctattcatcactttttgatattaagaatgcccaagggaatttcttgattaacccagcatcagttgatattgaggcaaagacaacagactcagcttcttccgcatcagtagatacatcagatatttctgatgtcacccaatgttctaaaagatcaagacacacagagctggagtacattgcagatgtgctaagcggtgtcaacttgacaacagatgaactgngatcactctttgtcaatcaggatacatcagctttggaccccctnctttttgagaaaatggagaatattcatgtgtatacaca

SEQ ID NO: 17593 - DNA, 552 bp, Sorghum bicolor
  Clone ID: LIB3476-036-P1-K1-F5
gtttcaaccagtcataattttcagctttagtagaagagaatgtgagcaccatgccatgtctatgtcaaaacttgatttcaacactgaggacgaaaaggaatgcattgagcaggttttccgtaatgctattggttgtttagttgaggaagatagaagtttacctgctatagagttgatgttgccgcttcttaaacgaggtattgcagtacatcattctggacttcttccaataattaaggagctggttgagttgctctttcaagaaggtcttgtcaaagctctctttgctactgagacatttggcatgggtcttaatatgcctgcaaaaaccgttgttttcacctctgtaaaaaaatgggatggtgataccaaccgctatattggatctggagaatacatacagatgagtggaagagctggccggcgtggcaaggatgaacgtggtatttgtgttataatgatagatgagaagatggaaatgagtgttatcaaggacatggtgttaggcaaaccagcacctcttgtcagtacttttcgactgagctattacac

SEQ ID NO: 17594 - DNA, 116 bp, Sorghum bicolor
  Clone ID: LIB3476-036-P1-K1-G3
acgaggagctatgcatcagcgtgagtgtaccagctgggaaaatctcatgaacgatgaaacactcactccagaagcgcgtgcttacctacgggaggagggacacctacatgctgcca

SEQ ID NO: 17595 - DNA, 406 bp, Sorghum bicolor
  Clone ID: LIB3476-036-P1-K1-G5
cctgaatgatattcatgctctagactgagaaacaatggtatggtcaagggtcaaaacccatggtcatcatccatcacctcgagcaggatgctgcggggctctttgtgggactaaatggtatattgcagggggtggaagcaagaaaaaacggcatcctgaaacatgggttttcgatgttctcgaatccaaatggtctgtttgtgtagtgcctcctagttcctcaatcactacaaagaaaggtttcagcatggttccattatactacagggacaagattgcgcttgttgcttttggagggaacaaaaaggaaccatctgataaggttgaagtactagtggtgctgcaaaacgagcactgtttcagttggcgatccgcacctgatgtggaacccttactgtatgacgac

SEQ ID NO: 17596 - DNA, 444 bp, Sorghum bicolor
  unsure (1)..(444): unsure at all n locations
  Clone ID: LIB3476-036-P1-K1-G6
caaatcagctctcagatccagcaccgacaccatcgaaataaacccattcgtccaaccaccatccctaccgacgagcacacacccgncacgggcacctccggctgcagggccgtcgtcacctnctnctncgccaccgncgccgncggtgggctactgggagagccgtgtccggaagcctgacacgtccaaagaaacacgttcgccggcactgtcgccgccaccccaagctgcaaacttcaggagcgtncctgcacccaccgacgcgttcccaagccggctgcccgagagctccgaccaaggcgacaagtccgaggacacgacaccacngccgaagctgaagccgctgcactgggacaaggtccgggccagctccgaccgcgtcatggtgtgggatcagctcaagtccagtcattcaggtaacgagagatgatcgagacctgtcat

SEQ ID NO: 17597 - DNA, 242 bp, Sorghum bicolor
  Clone ID: LIB3476-036-P1-K1-G7
gcttgcgacgcgttgtgtagcgtgttcaagcagctgtgcatacagagatgtatcgggagaagttacataacacattacatgacacaaagggagagatgaaggtatacatcagagtatggtctttagtgacgaatgaattacgaactgaatcatgtgcaaagagatatgcaaacagtggccaaagcatagggctgggccatgatgcacaacgttatgcacatagttattgataaacttttgat

SEQ ID NO: 17598 - DNA, 323 bp, Sorghum bicolor
  Clone ID: LIB3476-036-P1-K1-G8
gagagcgtcgacgtcgacggggtgctgcattggccgcaggaacgacggctcggacagctccgagtactctgcgtcatcggacggcgagtgcgaggacgaggaggacctcaaaaagagagggagcttcatcggccggagcaccccgcaggagcatggcggcagcaagaagcacagtctgccccagcagcagcaggcagcccccgcgcctgcgacgctggtgacggtcgacggcgacggcgagctcgagatggaaacgctgctcaaggcgtcggcctacatcctcggcgccacgggctcgagcatcgtgtacaaggccgtgctcg

SEQ ID NO: 17599 - DNA, 305 bp, Sorghum bicolor
  Clone ID: LIB3476-036-P1-K1-H1
tgcagacccgcacaaaccaacgctgcgggtctttcaccaccaagcaaaaagattgtccaggcctccaggggcaggcagggcgcgcagagcaagctctagctcctctggctgcgcaccgtttgttctcggcaccgtctcctgccctttgcggcgccctccgcggcgtcgtccggccggtccgggaaccaggatggctgcggtggtggtggccgtcgaggccgcggcggtgccgagcggcgcctgcaagagcaagtcgtcgtcgtcgtacctggtgaggagcctctactggaggctgcgcgcgggcc

SEQ ID NO: 17600 - DNA, 580 bp, Sorghum bicolor
  unsure (1)..(580): unsure at all n locations
  Clone ID: LIB3476-037-P1-K1-A7
gtccgaatcagttcccatgtccacctgaaccagagcagagagcacagccttggaattgcggccctccggcccattcctatcctgagagatatcagtatggtggacatgatagaggacaccatggatatgatagaagaccttactttgatgatagggggcaaatgcaccatgaagttatggatggtggaaggtttccctcattctttccaccaggccccccatgtccagatcactttgaagcgccgccacccaaccaatttcactgcggacgaccattagatcctccaccaggtccatgttctgggtggcctatgcctcataggagatccaagtaccctcctgattccagacactcaatggaacctccagtctccaatggaggaggttggaggacgcatggaagacgtgattatgatagataccattgatgactgactggtattagaaattntatgttggaactactgtgcttacacgttagccccattacaaatttaacttctgagatgcatgatttacttgggataagatactcgtgaagtgtggaataagagcattccccactaaggttcctacatac

SEQ ID NO: 17601 - DNA, 582 bp, Sorghum bicolor
  unsure (1)..(582): unsure at all n locations
  Clone ID: LIB3476-037-P1-K1-B9
caccaatcccctctcccctcctccctccaaggctcccaatccccgctatttcccgcaccggaatcccacccgatcccccgcagagtctccgtgattcaccgcgctcctctccgtggcgcgctcccctctctcgccgcggcagaatcgttcacccatcccaatccgaaccgttttttctctctctctctctctctctctctcggaccgagcatgagcatggcgttctcctgcgcgggcgcgcgcctccacggccgcaccggcgtcggcggcgccaaatgccgtcccggcgccgcggccctgctcggccggcggggcagctcctgcttccccgcgaccgcccggaggtggagcaccgccttccccaggggaatccgcgccgacctcccgccgccgcgggcgagcgcggatggcggcggcgccacctccggcccggcggcagtcgctgtccccgaagcggnggacgctactgagcaggtggccgncgcggntgcccaacctgctgttgtgctcccggagaggcttgacgtcgatgatggggctggtgggaacggcangctcccgcccgccgccggcggcggtggt

SEQ ID NO: 17602 - DNA, 560 bp, Sorghum bicolor
  unsure (1)..(560): unsure at all n locations
  Clone ID: LIB3476-037-P1-K1-C9
cacgaattcatgatgatgcacgcataccccaacctccaatggatggtgtgaagacgatcctctgctccggtgatcaccacctgacaaacttctgcgcgccttcgaagaagtccagcatgtagtcctcgaggtcctcgaggctgcacttgacgtgcctcgccgggtgccggctgccctgcccgaggaacgcccggtacgccgggatgagccgctccgacaccgcgatgcgcagctcctcccgcagctggacgtccgccaccttccacgccgtctgcgtccggtacagctcctggaacgccgcgttgaagctcttcgccgacgggcccgacggcgccctgtgccctgccggcggcctcgccgacgcgccgtcgtccctcctcagctgcgacagcacggcggtccaggacgcccgcaggtagccggtctcgtactgccggatctggccgcggtgccgccggagccagtcgtcgccgacgagctcccgcagcgccggngactcccgcaccttctgcaccacgtagtagagggtgttcatcaggaagatgttctgcagcccggcg

SEQ ID NO: 17603 - DNA, 610 bp, Sorghum bicolor
  unsure (1)..(610): unsure at all n locations
  Clone ID: LIB3476-037-P1-K1-D5
cggacgcgtgggcttatgaagatccagacaccagatttcctttgatcttccaccccttcaatgatgctctcaacaaggatcatgacgtgatgatggcaattatcaccccaagagccataccagtgaatttctttggtagtgggaaagcctccaatctgacctatgagttttataacccatcggcactagctcgccaactagcttttggccaactgccgattgcactctgctacgccaatgtgataaagccgagggagatcattaccaacaatctggaatggatcagggtagcccaacttccaccaaatgccgatacagatgtcgatctatcggcttggatcccggctctcttcatcactcaggcatacaaacagtggtgggaagaatggaaagaacatctgttctgcagattggctctcacataccgtggcatgatcgatccncaatacaaagttctcgataacactgtcgatggcatagcaccattggtcagcaggagctgattgagctccttccatcaggtccaatntctttgatcagcaacaacgcttcaaactctgctgctataatgcatcgaggtgtacgccttaagaagtcactacaaacgaac

SEQ ID NO: 17604 - DNA, 499 bp, Sorghum bicolor
  unsure (1)..(499): unsure at all n locations
  Clone ID: LIB3476-037-P1-K1-F5
aatgggccctctagagccgccgccgtcgtcggagccggaggaggacggcgacgacgccaccgccgtcacgaggtcgcggtcgcggtccaagtccaagtcgcagcacctgacggtgatgaaggcggccggcacggtggggtacatggacccggagtactacgggctgcaccacctgacggtgaagagcgacgtgtacgggttcggcgtggtgatgctggagtcgctgacggggcggcgcgccatcttcaaggaagccgagggcgggagccccgtgtccgtggtggactacgccgtgcccaccatcgtgggcggngagctcgccaaggtgctggacccacgcgccccggagcccgcgccgcacgaggccgaggccgtggagctggtcgcctacaccgccgtccactgcgtccggctcgagggcaaggaccgacccgccatggctgacatcgtcgccaacctggagacggccttcgcgctctgcgagggtagcgccggcagc

SEQ ID NO: 17605 - DNA, 576 bp, Sorghum bicolor
  Clone ID: LIB3476-037-P1-K1-G6
cccaatgctagggctgcctgctagcgatggcgttcgcacgacgacgactaccgtgacagtccccggggcctcggagcgactcctgaccgttcctgatgcgctcccacatggggaccagagcgcgacccgaccgtttgtgaaccgccgatcgcacagtgaggaaggactgcctgcccgacctggccgagggtgccagatgactgtcagactcttgacgagctgcaggtcgcagcccgtccagaactgccgaaatgcacaaccgaacacactgacgaatatgtcacagaagatatgaaaagtcgagtcacttgatggttgacttttcaaggaacgatgcgtttacatactctggactgcataacgacatggaagctcttgagaaagatacatgcgcaagcctaggcaacgtgctgatacacagctgagcgaaggactaatagaggaccaaaatgaggagctttccacctgatcctgacagagaatcaaggccatttactcgacagcttgtggagaagcatatagaataacatacggcacggtagactaaggatagtgactactatgaattcatgagca

SEQ ID NO: 17606 - DNA, 565 bp, Sorghum bicolor
  unsure (1)..(565): unsure at all n locations
  Clone ID: LIB3476-037-P1-K1-H1
gcctcctccatgtaaggaagaggaagcgccacctccactgatagaggatcacactgcagttagtaccgggccacctgtgaaaaagaggcagcggggccggcagcagaaccggcagcctaagtcaccaaagcctaaaaagcctaagaaggctgctgttccagtggaggatggagcacccaatgggcatgcgccccgaaggaggggacctaagaagactgtggggatggtgattaatggtattgagctggaccttgccaacataccaacaccagtctgctcgtgcaccggatctccccagcaatgctaccggtggggtgcaggtggctggcagtctgcatgctgcacaacttctatatctatgtatccacttccaatgagcacaaagcgccggggtgcacgtatttctggaaggaagatgagccatggtgcattcaaaaaggtgcttgagaagctggctggtgaagggtacaaccttgctaatccaattaacttgaagacgttntgggctaagcatggtacaaataagtttgtaacgatcaggtaaagaaataggcatgctatgttt

SEQ ID NO: 17607 - DNA, 674 bp, Sorghum bicolor
  unsure (1)..(674): unsure at all n locations
  Clone ID: LIB3476-037-P1-K1-H12
cgctcgcctacaaatcacggcgccgtgaccacgcgccgctgctctctccccagtcctccacctcgcaccgccgttcccatttccggcctcgccggtgcgtgcatgcgcgcgcgagggacggcaagtgagctcagctccagcacgcaatcggcagcagagtgagctcaacctctccctccgtcgctgctccgcggcctattgaattatgttcacagttcggggatcaagaccatcgggccaaactattccaaagaaattttcagacatgagatactccaatgtttcctggacattccttctactgctatgttttgtttcgatggcagatgcagagtacatgaagtacaaggatccaaagcagcctattaactctagaatcagggatcttattggtaggatgacccttgctgaaaaaattggccaaatgacacagatagaacgccaagttgcatctgcaaatgtcatgaaaaagtactttataggaagcatcttaagtggtggtggaagcgttcctgctccccaggccagtcctgcaatttgggtgaacatggtcaatgaattccagaaaggtgccttgtcaacgcgtctaggaattccattgatttatggaattgatgctgntcatggtaataataatgtctacaacgccactttattccctcataacatcgggc

SEQ ID NO: 17608 - DNA, 474 bp, Sorghum bicolor
  Clone ID: LIB3476-037-P1-K1-H3
gcccatcggccggccaataagccggcagtctatggagagggctttgtagagacactagtacatacacctgatgcctgtgcgaatgactgtgaggaagacgaagatggcgttgaacatatgatggtgcatatggtgataaggcgggacgtaaagatagacgaccctgtagctaatcatgactgtcctaataacgaccatattgatggcgatgtagatggccttaaaaacgaacatcattacatagagcgtgacatgaagatgaatatgcacatgtatagtgacatcgatagtgtggtcgaagtgactgctaaaacgactgataactccaaggatcacgaagagtgtcaggatgaatgtgatctgtcactggagctgaaactgaggtcacatgacagtataccagactggatgaaccaggaggcacatccagcagcaccagcagcatgtgcaggcgccatgctaggagatatgctg

SEQ ID NO: 17609 - DNA, 577 bp, Sorghum bicolor
  Clone ID: LIB3476-037-P1-K1-H6
ggacgagagatgaagggtggcaatcaagcagccatacctcagactttggatggatgcaaatggcagagccagtgatgaatctttatacagaatcaactgatggatcctatattgagaccaaagaaactgctttggtatggcatcatcaggatgctgacccaggctttgggtcttcccaggcgaaggagatgctggatcacctggaaagtgtactagcaaatgaaccagtcgcagttaagagtggtcagttcattgtcgaagtgaaacctcagggagttagcaaagggcttgtagctgagaagatactcacattgatgaaggagaaagggcggcaagcggattttgtattatgcatcggtgatgacaggtcagatgaggacatgtttgaaaatatcgctgatgtcatgaagagaaacaatgttgctccaaagacaccgctatttgcatgtacagtggggcagaaaccgagcaagccagggtctaccttgatgatacatttgaagtagtcaatatgctgagcttgctagcagatgcttcggaacctgaccctgtaatagagttggaggaggatgacttg

SEQ ID NO: 17610 - DNA, 249 bp, Sorghum bicolor
  Clone ID: LIB3476-038-P1-K1-A1
cccacaccagggaacaagcaagcagggattgctgcctccatgatctagacgtgaggtttggtggtgccaccgtccagggcgcacgggctgtctgccctagctcggcgtgccttctacttagacgctgaatgtaggaacccgcacgaagatcaagaccgtcaagcccttactgatcggagggggactgaccgacgataaggatgcctacaggaggaagaggaaggtcaagggcgcactccagatcgacta

SEQ ID NO: 17611 - DNA, 327 bp, Sorghum bicolor
  Clone ID: LIB3476-038-P1-K1-A11
tcggtcgtgctactcgcaccctgccaagaccaagccctcctacccatcgtcgtcgtcgtcgccgaagcccaagaaccccaagggaccgaggggtcctccgtaccctgcgccggagcaccagcaaccgcccaagatcccctcctacccgtcggtcacgcgttctccagtcgtcggcccgcccaagggccccgttacgcgctcgtcggtcacgctttcgctggttgttggaccaccggtgacctacccgccgatcatcggtctacctgtcactcgttcgtcggtcgttgggccaccgttgacctaccctacgattaccgtgctttcgac

SEQ ID NO: 17612 - DNA, 506 bp, Sorghum bicolor
  Clone ID: LIB3476-038-P1-K1-A12
caaatgtgaagggatgaacctgaggagttgagcggcaatcttttatattagggtttctctattgcagcaactcagtgtcagtaatttagatttaagtactttatcttatttatttgcagaaccatgttaataacacaaaggggctgcttctttcaggcttcaaagcttattatccatcaaagaaaataaaatctcatgttccagcttctgatctttgttgaccatacaaatatgcccacattcatgttcttttgacttagcgtagtttgcaacagaactacatgcttactgcctacagttcaaattgactaggaacttttgtgctgaagctatatattcatgtttgagggcatataatggtgaatatcttctattggtgtcctaatcaatctaacacattaaaattcttttgaaccttctgctccttactacccaactttactacatttattcttgatgagggatatattcttcatatgttagtagctaagccttataatatttac

SEQ ID NO: 17613 - DNA, 387 bp, Sorghum bicolor
  Clone ID: LIB3476-038-P1-K1-B1
atctgctggtgttaggctagaggatatgtctaatcaactgagaaaacgaataatgaagaagcgcagagtcaaaactctttcatttgcgattacaaatgatgtgtgcatagaagtgaatacatatgcgctggtccgtcctactactccagggacaatcacatggcttgattcactaagtaaccttccattaaaggctgagaggtctttcatatgcaatgatactggggctctacttcaggatgcacagacacgtttccagatgtacaatgacacaactgtcaaattttctgtacgtgaactctctgaggttaaaagggttgcaagccatcatcttcgccttttaggtttcaagccattggattgcttgaaagattatcataacttaag

SEQ ID NO: 17614 - DNA, 279 bp, Sorghum bicolor
  Clone ID: LIB3476-038-P1-K1-B5
cgcaccaccaccaacctttccgatccattccagtgccgcacgcctccgcactccccgtccccgacaccacccatgacacgcaagaggcgcaagcagcacgccgtcgccgccacctagggttccgatcccctccgcatggactcgctgccgcggaagcgcaagggcggcgcgcgcgcctgctgctccctgtccggatcccgccacgacgcgcctgccgccgcccgcaaccgcaagcgcacctgtctcgagcccaatccgcgggccgagaagaagaagccc

SEQ ID NO: 17615 - DNA, 395 bp, Sorghum bicolor
  Clone ID: LIB3476-038-P1-K1-C1
aaggaatcttgtatctaggtgctacactctaacaggacatatgcgaacgccttcgacagaaaggtacatgcacacatgcatatcgacgatgttgatactacagagccagatatcaagaaagctctataaacaaatcctgacaacaccgatgtcaagatggggtacaggaggctaaacgagaatgaaaagggttcaaaccaaggaatgccaaaatgtctggcaacatgataacacacgctgatgaagcttgaagacacttacaactatcaccaaatgaatgaggtcatctacaaaagccatgctctgttatagtcagacactcacaaggagaggcatatgtgctttccccccttagcatgttgttgaggcttgaccatcttctgagggtattgatt

SEQ ID NO: 17616 - DNA, 479 bp, Sorghum bicolor
  Clone ID: LIB3476-038-P1-K1-C4
gtggtaggcaacaggcaggttcgagttcgatccaatcgaccgcagccctccgtctcctctcgtcgcttcctccatctctcggcgtcgaatctcctcgggccaccgagcacactctactagccgctcggaaggagttcttccgggattggagccgttgctgccctcacctctgctggggcggcgtcgagcggagacccaatcggaaatcgagctgacttcgtcttttgttgcttccccatctggagaagcaatgtcaggagtgatcacaaagtttgcggttacatccatggtgatgtggatggccccggttgcgatcatgtatgggttctactaccaggtgtttccaggttcggcttctgttcctgttttcattgctgcatggtgtactccatctatttggtaatggtagttttttttcccttaattttaggtgtgagtcagatgtcatcctctgggcagacactcgccagcgggttcct

SEQ ID NO: 17617 - DNA, 350 bp, Sorghum bicolor
  Clone ID: LIB3476-038-P1-K1-C9
ggcgctggccgaggaggaagggctggtgccgtgttgcaacgacagtcccatggtgccgaacgacaaccagtggtgcgtcgacgcgctgggctccgtgctggagaagcgcgtggtgaacctgactcaccgcaacaccacgtgcgacacctggctatgcttatgcgggatacggctccatgagatcgggtcgctgcggtgtcccttcgtgttggcagacatgactggcgccaccagcaataacgccacgcccactgtcggcgctaatgacctgattaagagctagcggaacgccttctacatcggctgcttccggagcgtgcagtccctgcaaaagctgaaaggagaacgtg

SEQ ID NO: 17618 - DNA, 532 bp, Sorghum bicolor
  Clone ID: LIB3476-038-P1-K1-D5
cggacgcgtggggagcgtatcaagatgggcatttgagcaagggcttgtatgcagcccaaacaactggaactgcatggagaaattgttggaggtgcttatagcaataagtgatgaagtcgcatgcctttctgtagcaaatttaatacttaagagttggccatcacatcatcgtgctttacatgtgaagaagaccattgaatgtgctgaaccggtaccttttgcacctcggggtattgacatacttgaacccaagcatgcaaaactcatcttttccaataaaagaaaatctgtagatgatgaaatctgtcaagaaatagggacaaagaagagtaaacagagtgctacattgcaattgaatgaagcaaaatggttggcccttttagatggtatcctaagcttcataagtgcaaacaacgagaaggctggtgaatataattgcacaaatactgttgataggtgtcagtcagcgagagtagtgacaaggggcttgcttataacatgattgatgtgtcatatctacagatacaataaa

SEQ ID NO: 17619 - DNA, 500 bp, Sorghum bicolor
  Clone ID: LIB3476-038-P1-K1-D7
caggagcttattgcacgggatattcatgatgtcgagtggaaattcaggcatatcttccgaggccagcccaaaagacacctgctgactactggctggagtgtgtttgtcagtgctaagagacttgttgctggagattctgtgctattcatatggaatgagaaaaaccagcttttgcttggaatcagacgtgccagccgtccacagactgtgatgccctcttctgttctttcaagtgacagcatgcacattgggctccttgcagcagcagctcatgctgctgcaacaaacagccgcttcacaattttctataatcctagggcaagtccatcagaatttgttatacccctttcgaaatacatcaaggctgtttttcacacgcggatatcagttgggatgcgattcaggatgttgtttgagactgaggaatctagtgtccgcaggtacatggggacaataacagaagtgagtgatgctgacccagtgcgttggcctagcttcta

SEQ ID NO: 17620 - DNA, 440 bp, Sorghum bicolor
  Clone ID: LIB3476-038-P1-K1-D8
gcaaatagacaatctgcagcacggtcaaaggaaagaaaagctcgatatataacagaattggagcggaaggttcaaactcttgagacagaggctactactctttcagcgcagctaacactgttccagagagacacaactggactttcggcggaaaatgctgagctcaagataaggttgcaggccatggagcagcaggctcaactgcgtgatgctctaaatgatgcactgaagcaggaagtggagaggcttaagatagcaacaggtgagatgtcgaagtccaatgaacaatttaatatgggaatgcagcacatctcgtacagcccttcattctttcagctcttagagcaacacacagttcagcagcatggaaatattcagctggcacatcatttccaacagccgccaccgaatgttccgagtcaccagatgctattccaccc

SEQ ID NO: 17621 - DNA, 427 bp, Sorghum bicolor
  unsure (1)..(427): unsure at all n locations
  Clone ID: LIB3476-038-P1-K1-E2
ggtgcacaaaaccttgtgctatccacagtagaatcagctgctcagcttcaaattcccagttcctggggaacatggcgcaatatgcaaagcattgtttcaggtgtccagctaccacctttgcggcaagaggaagaccactgagtgtctcagcaattttccttccaatgttctccaattttgagttgatggtatgttctgtctcatcaaacacagaagtctttaccagggaccaacagtcattaacttgcaaggtctccaaactaattatataggatgattgcagcatctctgctactatacttgaccgagttgtcagaagtatcttgctcccaattgctcctttgtttagaggggctagcagcttctgccagttctcttgttctattgctattgntctgttgtcattgttccaaacatcatctaagac

SEQ ID NO: 17622 - DNA, 455 bp, Sorghum bicolor
  unsure (1)..(455): unsure at all n locations
  Clone ID: LIB3476-038-P1-K1-E5
ccaggaagcattcgctccagactcctggaaaagaaggtggtcatgatgggttggtttttatgaatgacacaatctacattgaccctgcgatatctgatgagatgaggaaaaagatttctgatgctgctacgagagaaggtgcaaagttgctggagcactggtttattggctgccctgccacgtatattgtctgtgaggatgcttctgttaagagatatgtaggccactcagataacattgtaactccactttggatcttgaaaacagtgaaggagaaaaacttgcagcgccttgtccatttgtcttccgacctagctaggcatgttgccatggttctggaaaatgtccagacatctgaagagaataggaaactttgaagtgttccttctataagcacaagctcctgtggtcgtccatcaacccaagaggagatngatgaagtccatcaagagaga

SEQ ID NO: 17623 - DNA, 158 bp, Sorghum bicolor
  Clone ID: LIB3476-038-P1-K1-F2
gatgtgccgaacgtgcgtctcgaccattctaaacggccactgctccagatgacgatctgattttgattgtgaatcagcactatgtaacgtttgtgacggataatacacctcatggatttcaagttactgcacaccttatggggaatgagttctttgta

SEQ ID NO: 17624 - DNA, 574 bp, Sorghum bicolor
  unsure (1)..(574): unsure at all n locations
  Clone ID: LIB3476-038-P1-K1-F4
gaggcgacttcccccccggaggttttgcatcttctctcacgagtcctcacctcgtccctcgcagaagcatcttcattcctcactcctcttctctcctccgcattgttcttggaatcgaagactggaagagcaatgagcaacgaattcgattacctgttcaagcttctcttgatcggcgattcctcggtgggcaagtcctgcttcctcctccgtttcgctgacgactcctatgtagacagctacatcagcacgattggtgttgactttaaaatccgcacgatcgagatggagggcaagaccataaagctgcagatttgggacacggcagggcaggagcggttcaggaccattacaagcagctactaccgaggagctcatgggataattattgtttatgacatcacagacatggagagcttcaacaatgtgaagcagtggcttagtgagattgatcgatacgccaatgacaccgtatgcaagcttcttgttggcaacanatgtgatcttgctgagagcaagactgtcgatacttcagtagcacaggcttatgctgaagagataggcatcccgttcc

SEQ ID NO: 17625 - DNA, 522 bp, Sorghum bicolor
  Clone ID: LIB3476-038-P1-K1-G3
gcgcctcaaagagctggttgatttcaagatggatggcaaagggaagaaggctgcagtgatgattcagaatcttgaagcagagaactctgcattaaagctcgagcttgagaaagcaaaggctgctgaagagaaggcagttcaattggagcgcttggttaatgaacttaagagtgatgctgatgatgctaggaagtctggttccgagtcggagctgttagctgatgaatggcagaagaaggcagagctgcttgaggtcagattggaagaggctgatcagtctaatattttgaagggtgagtctttgaattcagcaatggaagaattggattcaacaagtagtttgcttcgtgatagagaatctgaagttgctgctcttcgggacaaagtcacgttcttggaggatgagctggcaaagctcaagggtgatattgatgtgtcgggcaaacgggccaatgctgcagagaaagaggcggcagatctatggacagaggttgaagggcttaggttgaagctccgtacagc

SEQ ID NO: 17626 - DNA, 498 bp, Sorghum bicolor
  Clone ID: LIB3476-038-P1-K1-G7
atcgagatcaaaatgataatgatccagccatccagggaagggagggacagcgagcgacccagcacttcacttccgatccattagccgttagtctcagcagcagagcgggaggagatcgagcgcgcgcgcgcaccggcaccgtcgcgccggggcagctagcaaacggatggcgcacgtcgaccggccaccgagccgcgccgtgctcgccgtcgccgtcgctgccgcggcgctcctccttgtcgtcgccgcgggcgccccgcgggcagccggccagacgacgacgacgacgacggtggtggatccggacagctgggccgatcgcggcgcggcgtgcacggtggaggagtgcggcatggccaggagggagctgggttacggcgggtacatcagctacgacgccatgagccgggggcgcgtgccgtgctcgtactcgggggcgttctactacaacttgtcggccgggtgcgccggccaacccttacttccgcggctgttccg

SEQ ID NO: 17627 - DNA, 428 bp, Sorghum bicolor
  Clone ID: LIB3476-038-P1-K1-H1
agggatttgagcttcactgcaacaagtctcaggatggccaaaggaacactacgtacctctttaacatgccggtggccaacatattgctgctccaaggtcaggttcgggtgatgagttacattgcttccatgtgccacaaccgctcaaccacgaccttcttggaccttgctggcacgccattcacggtctcagagaaggagaacgtgttcacagtcgtaggagtcgacacgcttggcttaatggccggcacaaggcaatctgccatctatgtgattgggtgccaaacggaggagagctctcctaaaaacctggcagcagtagaggggtgcaccggtgtgggctgttgccaagttgcgctcagtagcaacgtatcctaccaacaattttccttcggtaatagtacatccgacaggaacataagtgccatt

SEQ ID NO: 17628 - DNA, 552 bp, Sorghum bicolor
  Clone ID: LIB3476-038-P1-K1-H10
gagcctgttgcaaaaagtaggtgggagcctgttgcagaggaaaatgttgctaacaatgtggaaatttctaatgagttggcaaaaattaatgtctgcagtagtttcgaacccactaaaagaacgagtaacaattgggatctgaggaagcatgtccaatgccaagctcctttaagccaattcagtcataggcctactaaaatgcagcgaactggtggtgatgcaagtcttactgaaaatggaaatgccttaagtgatgctgacaaggagcaggatctaatgaaatattacactagttcaattgcacaagcaaattcacctgaggaaaagaaacggcgggagcatagatctaagcgatttgaacagagtcaaggcacaccatcaaaatctagaagttctataccagataaggttgccacagacaacatatatacaagtagagctatgtcactgcttttcaatagaagtaatggagatagtgctggtttggcagtggaggattatgattgggatgcactgacaatcaagggaacatgccagcaaattgagaaacaa

SEQ ID NO: 17629 - DNA, 449 bp, Sorghum bicolor
  Clone ID: LIB3476-038-P1-K1-H11
gcgattatctacatccaatttccactgcctactctttagttcagtaattcttcttctctaaaaaggtggtttagcttagtaattcagcaaccacaaattttgtttcctcactgacacatgacaaagtattactcaatggaaacctctagtccatatggacaaacaaggccatcttgaggatcacttaagctgcaagcaatttcagccaaaataatcatatgagacagcattctttttatccacaggctgtctgactagacacgcccatcttcaaaataatcagttgtcattggtttatctgaagctagtcataaactgatgatcaccaatctacacactagtaggcaaaccaatgagtgcaactgcgactgagaccactgggattctcattctccccaggttttgtgcatgaacacatttcaataagtattaaagtgctttctctaccc

SEQ ID NO: 17630 - DNA, 484 bp, Sorghum bicolor
  Clone ID: LIB3476-038-P1-K1-H9
cggacgcgtgggccaaggtcatgaagggcggctggctgcccttcgccatctcgctcgtcctcgcgctcgtcatgttcacctggtacgacggccggcagcggaaggcggagtacgagatggccaacaaggtgacgccggagcggctgggcgagctgctcgccgggcccgacgtgcgccgcgtcccggggctctgcttcttctacagcaacatgcaggaggagtggcggtggctcacgccggtgctggcgcactacatcaagaacatgcggtcgctgcacagggtcaccgtcttcgtcacgctccgctacctgctggtggccaaggtggacgccaagagccgcgtcgtcgttcggcggttgggttcccgtggggtgtacggctgcacgatccactactgttacgccgacccgctggacgaggaggagggggacggtctctcggggcaagtggtgctgggcgtgcgcgagcacatttaacgggaggc

SEQ ID NO: 17631 - DNA, 423 bp, Sorghum bicolor
  Clone ID: LIB3476-039-P1-K1-A5
aaaagctagaggctaggaagtatatcagaatttttatccagagctttacaatcacctgaatctctatcagtacaaaatgctattgaatatctcaaagtcattggagcttttgatcagaatgaagagttgacggttcttggaaagcacttgtctatgcttccagttgaacctaagttaggaaagatgcttatttttggggctatttttaattgtctggaccccatattaaccatagtttctggacttagtgttagagatccttttttgactcccttcgataagaaagatcttgcagagtcagctaagttgcagttttcatgccgggactacagtgatcatcttgcacttgttcgtgcataccaaggatggagggaggcttgaagagacccggctggttatgactactgctggaaaaattttctc

SEQ ID NO: 17632 - DNA, 339 bp, Sorghum bicolor
  Clone ID: LIB3476-039-P1-K1-A8
cgcagcatctccacgccgtcacacctcgtcgcgtcgccaccggcgagatgatggtcgttccgtacctctacgccgagatcggcaagaggaccaaggatctgctgtacatggtctacctatctgaccacatattcatcctttctacctacaccttctatgtcgtggctgtcactgcttctagcacaaagaatgttgttctgatctttggtgtgatccaatctcatatttatatcatgaacattaccgttgatgtgatatcatactttgagtcaaatttcattacctcagtttcttgtgatgagattgcatcatcaggtctgaaatccatcttttgttttg

SEQ ID NO: 17633 - DNA, 179 bp, Sorghum bicolor
  unsure (1)..(179): unsure at all n locations
  Clone ID: LIB3476-039-P1-K1-A9
tttagctaaacactactaaagagacataatgacgctatgaactgtgtattcattgtcaaatgacagcaattgtcttttactcagcagacccccaaataatatattntactcagcacagattcatagctgggtagctgcaatgggctccactaattcgtttctacagatctatccttttg

SEQ ID NO: 17634 - DNA, 404 bp, Sorghum bicolor
  Clone ID: LIB3476-039-P1-K1-B10
catttctcaatttcggtttcttgagcgacttcttgtcgtccatgggcattggtgctacaagagaatcgcccaaatgatttgctacttgttttacaagaatattgcctttgggcttacaatattttactttgaagcattcgctgggttttctgggcaatctgtatacgatgattggtttatgctgcttttcaatgttgttcttacctcgcttcctgttatatcgctcggagtatttgagcaagatgtttcatccgaaatctgcttacagttcccagcattataccagcaagggccaaagaatcttttctttgattggtaccggatccttggatggatggggatggcctctactcctctctggccatattcttcctcaatctctgcatattctatgatcaggcaat

SEQ ID NO: 17635 - DNA, 422 bp, Sorghum bicolor
  Clone ID: LIB3476-039-P1-K1-B2
gcggagcggcggagccacggcgaagctgccacggctgcggtatggctacatcctgtggcgctacgtcgtgcggacgcttcggcgcgttgaggcgcgcgtcaccaaccgctgggtgcggcggagctacctggagcagtggaacaccagcgttcagctcgatcccatgctccccttcgccttcaccagcctcgatgacattgtctctccatgcgccactgccgacgggcacgacatctccttctgccctatctgcgactgcgaggtgaagctgcgtagcaagcactgcatgacctgtgagcgatgcgttgatggatttgatcaccactgcaggtggctaaacaattgcattggaagatggaactatgcaacatttattcggctcatgttctttgtcccgctgatgcttggcattgagggaggaa

SEQ ID NO: 17636 - DNA, 422 bp, Sorghum bicolor
  Clone ID: LIB3476-039-P1-K1-B5
gagaaatcctaacgcggcggcgatctgacctggtacttgttctacgttgaattgaatttgatccgcttattgggatttgctcttgcaatagtgcgcactctggaatgggcgcgtgcgtactgttcgctataatgcttgatcgctgataattaagttgttgggtcgtttgtaaatagctgctggcctttgattctctgtttcagtggccaatcgaccttacatgtcaaactaaaatcctatagcttcatgacctgtcttaagcttgcctgaatgcctggttcaacatgtacatttgctcagttgagagtgaggctgaggatatgggctcacaggggctggaacaggtgtgtgtaatgctgttcgttgcaatgcctgatttgtggcaattagtttgatgcatcacttatgggcgtctgattgtc

SEQ ID NO: 17637 - DNA, 377 bp, Sorghum bicolor
  Clone ID: LIB3476-039-P1-K1-C10
tttttgatgaaatgtgcaagaagggcttgaagcccaacgccaccacgtttaccactgctctggctggtttctacaaggaggagaggtttgatgacgtcgggaaggtattagagctcatgaagaagaatggatgtggtgagtccctgccggtatacaatgtgagggtgcagagtttgtgcaaactcggtcggagtggtgaggcgagggcattagtggacgagatggtgaagaagggcacaaagccaagctgggtgacctacaatcatctgatttatggattctggaaggaggaggatttggaggaagcataacgtctgtacaaggagatgggaaggaaggtgcttgttggagaaatcaatttctatattatgcttatt

SEQ ID NO: 17638 - DNA, 397 bp, Sorghum bicolor
  Clone ID: LIB3476-039-P1-K1-C2
aaccaagcaacgcaacacaactcgctagtgtaccgtgtacgtacgtccctgcgcagcgcagccatggcatcctctggaaatggaagcatcgccgccggcatcgccaagaggtggcgcgagctccatggcgagaactcgtggaagggcctcatggacccgctggacctggacctccgcaagaccatcatctcctacggcgagctcgccgaggccacctacgacggcttcaacacggagcggcggtccccgcacgccggcgcctgcatctacggctactccgaccttctggccagctccggcgtggcggcggccggccactacgaggtcaccaggttcatctacgccacctcagggcagcccctcccggacgccttcctcgtccggccactggcggcgc

SEQ ID NO: 17639 - DNA, 517 bp, Sorghum bicolor
  unsure (1)..(517): unsure at all n locations
  Clone ID: LIB3476-039-P1-K1-C4
cgcaagcattctgccacgtggtgatcagactatcaagggccctgttgttcgtctcttcaaaccatttgacgagctctttgctgattcacgggattttgatacggatgctcttgaaaaattcattgacgtgtctggtttcccagcagtagttacattcgatgctgatccaaccaaccataagtttcttgagagatactacagcactcctagtgccaaagcaatgcttttcttgaacttcagtgacgacagagtggaggccttcaagaatcagattcaagaagctgccaagaaattcagtgctaataacataagttttctaattggtgatgttgaagctgctgaccgtgccttccagtactttgggcttaaagagaacgatgtgcccctcctttttgtgattgcacagggtgggaaatatctcaatccaactattgaccctgatcaaatcatcccttggttgaaggagtacatatatggaaactngacaccttattgtaagtcagaggcaatcccaaag

SEQ ID NO: 17640 - DNA, 475 bp, Sorghum bicolor
  Clone ID: LIB3476-039-P1-K1-C8
gttaagcaagataacagaagagaattaagtgcaaaggttgagcaattggaacaagagttatccgagctaaggcaagctctatcagacaggcaggaacaggaacaagcaatgcttcaggttctgatgcgtgtagagcaagagcagaaagtcacagaggatgcccgtatctgtgcggagcaagatgctgctgctcaaaaatatgctgcacatatactccaggagaagtacgaggaagctatggcttcacttacgcaaatggagaacagagcagttatggcagaaactatgttagaggcaaccattcagtaccaatctattcagcagaaagcacagctgccatcaccctctccttctccaaggaccttaactcgagatgcatcaccaggccaagggaaccaagattcaatacaggagttccagcctagaatgataagtttgcttgccccatttttccttggatggcgagacaagaaca

SEQ ID NO: 17641 - DNA, 473 bp, Sorghum bicolor
  unsure (1)..(473): unsure at all n locations
  Clone ID: LIB3476-039-P1-K1-D10
gtaatagctgaatgccgtaagagctatgggctgggaacccgtcaggggacaaatcttggtcctacattggacaaagcacaagctgcaaagatacaggagcaggaaggcctacttagagcagcagtaaactatggtgaaggattacgggtacctggagatcagaggcagccacaatctcttcctagccatctgatagaagtgcttcctttaggagacggtgcacaaaattttggtgatagttctggtagttatcccaaaaatacgtcaacatttgcacctaataatgtcaacaaccagggaaatcaggcatccggaggacagttacttggaagacctgcgccatcacctggaaccacaggaacccctaatttcgagaatgtgtccactccttcgatgccatatgctaactctnctaggcaggcaccaatatgatgaataccccgtccccccagcagcatctaacaccacaacag

SEQ ID NO: 17642 - DNA, 476 bp, Sorghum bicolor
  Clone ID: LIB3476-039-P1-K1-D2
ggatgggcttgtctacacttccaatatgaatacataaagttggaggaaactcgcaaagaactcatgattagggttaagaacaagaaaaaacttctccaggaaattgaacgacagtttgatgacctccagaatatcaagtttcgcaaccagttactacagaggccagctgagagtgcgaatggtatctgccttccattcttattggtcaaggcatccagaaaagcaagggtggaaattgagatttcagagaactcaaagtttgctggtttcgacttcaactgtacaccattcaccttgcatgacgatgtctcaatccttgaagcgatcaggtgtaataattattgcataaaaagagctagctagctagcttcggcactcatcattggatgatcgagaatgtgatttgatctgttactgggcaaaactgttataatcagctccttttgcacagacattattatgcttaggtaaatata

SEQ ID NO: 17643 - DNA, 351 bp, Sorghum bicolor
  Clone ID: LIB3476-039-P1-K1-D7
gtacaaacctaaaggttttttaagtgactaaaccccaatttattatgctgtcttgctttttgtttcaggcaacaggaaaaccaggaaggcactagtgctgaacttgtagggttggccactggtgaaagcaagggtgaaaacacaagcattcggctgtgcttcctcaatgaactgaagactcctgtttaccatgacgatgagataaaatctgagagcaatacagccattaaggttggcatatttaatggggacaagatgatcgagtcgggcggtctttcaaacctgcaaatggagatcttccgccttgatggcgacttttcttatgctttccctaagagttggacctctaaa

SEQ ID NO: 17644 - DNA, 403 bp, Sorghum bicolor
  Clone ID: LIB3476-039-P1-K1-D9
accaaatctcgcagcggctgcaatccccgagcccgaagcgcggatcagcggaggaggacgccagattctgatctgcggccggcgcgacccacagaaaaccggagatgcagcagggcgacggcacggaggcgcaggtgacgtgggaggaccagcagaacatcaaccgcttcggtcgcctcaacaaccgcctccacgagctccaggacgagatcaagctcgcgaaggaaacgaatgagaaccttgatgatgctgggaatgaactcatcttatctgatgaagatgttgtacgctttcaaattggggaagtgtttgctcacatgccaagggatgacgtcgagactaggctggagcagatgaaggaggatgcggctaagaagctggagaggttagaggaggagaagga

SEQ ID NO: 17645 - DNA, 148 bp, Sorghum bicolor
  Clone ID: LIB3476-039-P1-K1-E12
cacaaggctcgagcataatgatcctgtgcctgccactgcccatgtgccaagtcgtgctcctgccttggtcaccctagcagcaggggcgtgtcgtctgcacgttcacgatgaccagctctctattgatgagacgatggctactcgccac

SEQ ID NO: 17646 - DNA, 310 bp, Sorghum bicolor
  Clone ID: LIB3476-039-P1-K1-E3
ctgcaaggcagtcatgctcgatgagattatcaactatgtgcagtcattgcaacgacaagtcgagttcttgtcaatgagaacttgcaactgttaaccccgagcttggctttgacattgagcagatcatatccaaacagatgatgctttcacaagacagacaatttgctttctatggagtcgatccaggatcaagcaggctcactgctccattcaaccaaggaatcatgcagccagaaatgatgtgcaacattttcaaacctggtgatgttttgcacggaactattcacgacttgtcaacaatgaaccagat

SEQ ID NO: 17647 - DNA, 423 bp, Sorghum bicolor
  Clone ID: LIB3476-039-P1-K1-E5
ggcagttggcttaaaagtttctctgcccttctccgagccatgcctgatgttgtgaaatttatagatcctctaccaggtgatagaggtgcaggtgctgctgtggttggtgtcttcaagagatcaagggattctgctccaagtagcattccagaaaaatgcaacaaggaagttaaaagtgaggagccatcaccatgtacagaaaagagaacacttcaagcagaagtcccaccatacccatcagatcagtcatctagagacaacaggaaagctcctggatttactcaacgaccgaagccgcctttcaaacctgagggaactgatgttactcgcgctgaggacgttccagcaccaccatctgatgcaccatctatagaccaaaggattgatgtggctgtcgatcctgttatgcaaacagaacgaccc

SEQ ID NO: 17648 - DNA, 399 bp, Sorghum bicolor
  Clone ID: LIB3476-039-P1-K1-E9
cataggcatatattcgtgttcttcctaaattacatcacttcctctaataattacatagaagaaatcatcgtcaatatagtaaggaggcggtgtaaatatagctataagacaatgtaagtgcatgggtaaaaatctagctgccgggaggggctaaaacaccatgtggaagattttcagcttgaagaggcggacgagcactggctcggatctgaagtttacttgcacgaatcggaacattcaacagagcattcaaaccatgttctagtgcccccaacaaatatgcatccaaggtgcatgggactgcacagacaagatatttcatgttcacaaaaccttcagaacaggcttcttctttgtttctgagacttgggagtgaatgtgggatgccctgagtggaat

SEQ ID NO: 17649 - DNA, 489 bp, Sorghum bicolor
  Clone ID: LIB3476-039-P1-K1-F11
gttgggttcacgccgtattcctggggggagagagggcgccgccgccgcgccggtgagacgcccagccatggcattgccgggggcggtggtccgcctggcgctgctgctgctcgtcgcgctgccattctgcggcgcacatcccggaccgggaggcttccctgcccctcgtcactcccagaggcccgcgctccactctgatggatttggcttgctggcaaggaggtcaattgctgaagctcctactgacatcaacgtcactacgaatagctcctttgtattggcggcagataggacatatcgaaaggatcccttgaatggtttcaggaaatacccgggcggctggaatatcagtgaagtgcactattttgcttccgtcggatatacagccattccgctgttcgctattgctctggcgtgagttgtgattctttttcctggtatgcttgagattgctgccgatattctgttgccgcatacacctacaagtat

SEQ ID NO: 17650 - DNA, 311 bp, Sorghum bicolor
  Clone ID: LIB3476-039-P1-K1-G12
cccacgcgtccggagcattctgcagcattcagtaacattctcggaagggatttctcccttgctgcttctgcggatttctgtgagaagggtcagcgggattcggcgaagcagaggaagatcctcccatggagatgactgacatgaaaccggaggagatgagccaccctcccatggaccagctgctgggaatggagtactgcatagactcaaacccatcctggggaggggctgttttgctgggcttccagcatttcatcctttgtttggggacagcagtgatgatccccaccttgctggttcccctcatggga

SEQ ID NO: 17651 - DNA, 323 bp, Sorghum bicolor
  Clone ID: LIB3476-039-P1-K1-G7
cactcgctggccggccctcttggcatcctgctcgatcgaatgctggatcaggcagcacggagggtgcagcaaagacggcggcgcggccgtctgctccgtggaggggccgggggacccccccacgagggctcagtccgggccggctcctgcgcggctggagcgccgctccgcccctccccccgccggaaggcgcgggcgcccgccgcgcggccgcccgccccccgccgcacccgcccccgccccggccgcgccccccgacggcgcccgcgccgcccccggccggcccgccccccgcccgccgggcgcggccccgccggcccccc

SEQ ID NO: 17652 - DNA, 331 bp, Sorghum bicolor
  Clone ID: LIB3476-040-P1-K1-C2
agctgctgcggacatgatgatgctagtgtggtgctgttgaagaatgagtgccagtcttagatctctaccgatggataagcacaacacccccactgatggggaagtggcgaacaatgcgtttcgcaggatgattgttaatcagaccgtttgggacttaggcctagatgagtagaatgtgccttgctataccccgagaaactgtgatcactctacattccgaggcttatcatgaggcagggcatttgcttctactagttgatagcacaacactgattaatagatgccactccagtatgtggagatcctggatccctactgagtttacaaccgt

SEQ ID NO: 17653 - DNA, 449 bp, Sorghum bicolor
  unsure (1)..(449): unsure at all n locations
  Clone ID: LIB3476-040-P1-K1-D1
cccacgcgtccgttatattgtatggtttctgggcattatccatttcttggggatacattgcaggagacttatgataagattgccaatgatcctgtgcaaatacctggagacatgaacccccaacttgctgatttgctcctaaggcttctctgcaaagatccaggagatcgcatcacgctgcaggctgcggctgagcatccttgggttgctgggggtgaggggccagtccctgaattcatctgtagatgtgggtttggccgcaggaagaggaatgatgtccgggaagaagtaaataacanagcatnctcggatggtctgcangtctagtgtagataattgatgaagattggcaaagcgaagctctaacgatgagtttgtttgttgtttcgtgttcccaatttccaatatgagtgctgggtgctcgactgaaaatttttcttttttggaca

SEQ ID NO: 17654 - DNA, 416 bp, Sorghum bicolor
  Clone ID: LIB3476-040-P1-K1-D10
gcttggatacactaagaagcaagaggagagacattttcgaggcgtcattgtcctggaggaatgtaacctggaagagatagaggaggaagaggtctctaagaattctaaggattcaaagaaggcaaatggacaagagaaagggccaagtcttgtttttaagattactaacagggttgcctacaaaagtgtcttaaaagctcacagtgccgttatattgaaggctgagagtatggctgacaagattgaatggatcaagaagataaaaggtggtatttcaaagcagagggggctctgttaagggtccaactgaggatggttctatgcgacaaagccgttcagatggatcccttgatacaatggcccggaggcctgctgatcctgaagaagaacttcgatggatgtctcaagaagttcgt

SEQ ID NO: 17655 - DNA, 360 bp, Sorghum bicolor
  Clone ID: LIB3476-040-P1-K1-D4
gaaagtgatgacttatctacttattactcaaagaaacaccacagtttcaccttcatctgtggtgattgctgcaagcagaagaatgtttttgttgaatgaagcatattaatgtggatagtggtgctgcaaatcaggtggtttctctgtaggatacatatgacaaatcaccatgaagcaaattaatgttgacagtggtgctgcaattcaagtggttcctctgtaggatacatatgaaaaatcaccatgtgtggacttggccacccaggttctagtctcaacttgcacataagggggctcttgcgagttgtgacacaatcttctgacatcaaagcatgaacactagccctgctaaatcccttc

SEQ ID NO: 17656 - DNA, 429 bp, Sorghum bicolor
  Clone ID: LIB3476-040-P1-K1-D7
gaagccaatcacagctgttctcttccaggagtctcctactccttttccttcaaagcgtctccgacgctcagtgccaccagggctgccaagacctgtgtgtaaagctgcaccctcacccagagttttactatacgaggaggagctttgcgaagcggtggcacagaataagcttctctgaagatccaaaaagtgcattgctttcatctatagtgtacagtttatctatgtcaagcccctagtatgagttttgtctgccagctcttaagctggcatattagattattgtgttcaggttaggttttagactagtgttagactgtgctatacctttaataagtatggagtttggtttatttcatgagtttgtatatagcacataataaaatggacttttttgtgcatttatttatacctatatcccttttcatg

SEQ ID NO: 17657 - DNA, 378 bp, Sorghum bicolor
  Clone ID: LIB3476-040-P1-K1-E10
aactttttctagacgactcaaaggttcagagattgattacaagattaaccaactacagttctagtatgctccatttggttttagtttcagatagtgtgtgctgacattgggctgtcgaagtatctggtgtatcaactgctctactctatagcatctatttgacttgttcagccctatactgtggcaggacagaagtttctttggacaatttcaatagtgaggtgccttctggttattgcagccttgtattcggggatgcttatgtttgatttcttattcaggactcttacccatgtctcattgccatgcaaaatgcatctgattttggatcatttatggataatagtttgcttcgtcttagtttcctcaatggatttt

SEQ ID NO: 17658 - DNA, 441 bp, Sorghum bicolor
  Clone ID: LIB3476-040-P1-K1-F4
ctcattagcatttctgttagcttgtttggagctgagtaacagacacttatgaggattgacatttgagatttagggcctgtttggttctccttgctaaattttagccagctaaactttagtcactttagctaaacttccaaacacacgactaaaaaggagctaaaatagtttagtcccactaatcacccaagagtaactaaaatagttttagctacctaaaaaattagcaaggggaaccaaacaggctcttagaaattaacgacggaaatgtggcacaactcattcagatttgtaggattctgataaagagtggcgtctaggaattatgaaaacgtttcttttctggttagttattctcgtgactgttaaaatcatgtggttctgtttagtgccagtatagggcatcaaatgaaggcaagtttcccactgtaacaaataccc

SEQ ID NO: 17659 - DNA, 463 bp, Sorghum bicolor
  unsure (1)..(463): unsure at all n locations
  Clone ID: LIB3476-040-P1-K1-G12
ggaagacactaacaagggcaagaaagagtgagtagcatgacctgaaatcttgtggtatttcctttctttttcaacttgtggatagatgtttccactaatcatcaatttacttatggcaaacatggcaatattgcgatagcatttaccatttgaagaatgccttttatttttcttctttgaaaaaatgaaattagtggatagtagtcactaatgctttgctgtaaataagcttccagttatgatctgccatgccttttcttttaaaacgttgatactaatatgtggaaaagtacgagtttcttttgaatacaaggtgcatatgatgttgttgattggatccctcaaccatcatcgacatagcagatcattctcctactgcatataaagtgctcgaggaactagcgtcacctttgacaaatttgcctttgtcaagcataaaactatggncagtgcattatcattg

SEQ ID NO: 17660 - DNA, 371 bp, Sorghum bicolor
  Clone ID: LIB3476-040-P1-K1-H10
gcccaacctctcgcagccgccgaccgaggagcggcggccgaagaagaagaacatcctccggcgccgtcgccggcgctggcgccggaggaggcgagaccgtgactcggaggtgtttctgggcggtggagaggttcctggctcacggcggcgagcggtgcgtgagggaggtcaccagcgaccgggcgctgccgagcctgctggtgagcgcgttccacacgggcgacgccgccaccaagcaggtggccgagagcgtgctccggtgcctgcaccgcatgccggactactccgcgacctacgaatccgtcgaactgtaaccaacaacacatgatgcacacacctgtgcatgtcttcgactctttttttccatgttt

SEQ ID NO: 17661 - DNA, 312 bp, Sorghum bicolor
  Clone ID: LIB3476-040-P1-K1-H5
ctcagctttgactgctcttgcattgcttgctgctcagttctcttcccccctgttcctcctcctcttcttctcccacctcggcgcctgcttcggcaactgcgagcgagatggaggcgcaagacgactgcaagtggcgccagatcccggcgttcggcgactggaacctgtgggacgacatgcccgtcacccagtacttccaggcagggaccttcttcttcgccgcgccggccgagaaggacgacgaggatctcttcaaggtgccccagttccctgccaagccctacagctacaagaagtgcgttgttcgagtga

SEQ ID NO: 17662 - DNA, 367 bp, Sorghum bicolor
  Clone ID: LIB3476-040-P1-K1-H6
cccccgacaccagaaaaaaaaattccccattgtttgtctctgtcagtgaagagtcgcggcggcggcggcgatgtcgggcgcggcaagggccgcaggggctgggcagggcggcgcgaaccgccccgaggtgctccggacacatccaggcatcccaaaccggcatccgagctggccggagggcgggtgagcgctctcgggctcattacaggagaccgcgcgtgctaagatcttctggagaacgtaccgcgacccgtacctacccgagcacgcccccgaagacgcaccgcatgacgtgtctcgcgctaagcgcaggccgacccttacgcttcgggctagatggcggcgcccttctcttgagctgttaccg

SEQ ID NO: 17663 - DNA, 459 bp, Sorghum bicolor
  unsure (1)..(459): unsure at all n locations
  Clone ID: LIB3476-040-P1-K1-H8
gagccagccatcgcctcgcggaggctcacgccaagttcgcttgccgcttccctcctccccggaatcctcctcgatccccagagcccaggcgcctagcacgggggagctgcgtcgggcgaatggagcancaggtcttctacagggcgctcgggctctcgctcgtcggcggcctcagcaccgccctcggtgcgctgtgtgtggttatgaatcctgcccctaaaccttaaagtgctcgggcttctacagggttttgctgctggacttatgctcagcatttcctttctagacttggcacacaatgccctgaattctattggcttctagaaggggagcctctggttttttgcaggggttcttttttttgggtttcattatctaagtttattccagagccaaatttttcggcaccagctgatccaagcgagaaaaaggctgatgatgctggaaccgtgtaagata

SEQ ID NO: 17664 - DNA, 449 bp, Sorghum bicolor
  unsure (1)..(449): unsure at all n locations
  Clone ID: LIB3476-041-P1-K1-A2
cggacgcgtgggctcggctcgctcaccaaccagtccccagttgccttcgctgatggccaccgagaccatccaggttccggcgccggccatgccggcagtggctgggcgcgccgccaccactggcggtgccagcagggcgggcctgccgccgccgccgcggaggggccagatcaaggggaagatcatcaaggacgtcgtcgctgctgtctccgccatggccgcgggcctcgtcaagaacaaccgcgccgacgacgaccgcgaggagggtctcccggcctctgacgacgccggcgacaagtgaaacaaccgatgacgacgccggccgccatggatggctctccgcgttctcccttcccgtccgctcgatgctgtcgctcctctgctgctatcatgtgctcatnttagtgcacgcagcagagggaccaaggatggagagggcaaaaatacta

SEQ ID NO: 17665 - DNA, 153 bp, Sorghum bicolor
  unsure (1)..(153): unsure at all n locations
  Clone ID: LIB3476-041-P1-K1-B6
gngtatcccgcggcgcaccacgaactcttctttcttcgccgtcgccccaccgctcccgctcggactaccaccaccgctccacacctnccgtcgcgccgncgagcgacggcggcatccgccttctncggtccgtcctcgcacccgcgccgtctc

SEQ ID NO: 17666 - DNA, 406 bp, Sorghum bicolor
  Clone ID: LIB3476-041-P1-K1-C4
gcaggagtggtaattctgttgatgttgttggtgaatctggagctccttttttcggtgaagttaactcggagaataaaggtacaacttgatagatccagacttctgagtgttcgagatcatgtcaggttcttcttttgtccatccctcatcttcaccggtaattgtgtagctaacggagtttctttggatgttggtttagtagcttgggagatcgggttggttgttagatcccacctactccggtggtttgcatcttcttctgggtgtcctctacactggcgtgctgtggctgatactgttcatagtgtcaggccttttctacaccggcgaagagatggtcgttgaccatcttgctcggcctattcgttcaacgactacacggcaatgtggttttcccgatgtgcta

SEQ ID NO: 17667 - DNA, 187 bp, Sorghum bicolor
  Clone ID: LIB3476-041-P1-K1-C6
aaatctgccattttgaaagcaacacaatccctaaggaaagcaaaagggagtccaatggcaacgatgagaaaacagatgcctcagcagctgataagtatccgcttgtatctgtccctgatgagacccttaccccagagcagtttaagggaaaaaagaaacagattttcttaaaccacaacaaggcaat

SEQ ID NO: 17668 - DNA, 348 bp, Sorghum bicolor
  Clone ID: LIB3476-041-P1-K1-D10
gaatgactaactgattctagaataaaatcctataaagcgccttattttgctgttactaatagctgcaccacactacttgcatcacgcgtaggcatctatataaatcagcgaaaatgcatttgcagagtaataagcaatatatcattacacaatttgaacaacaatatagaaatgaagtcgctctacacaagatactaaataatttgtaatcatatgacttgatcatcatgattaaacactcccatgataaccctaacgtgctctatatgcagtcttacataactaaaatccactatgcacacgccgaccacacatctgtccacctcatctcataaccacagaactatc

SEQ ID NO: 17669 - DNA, 415 bp, Sorghum bicolor
  Clone ID: LIB3476-041-P1-K1-D11
ggatgacttcctaattgtagaataaaatgttataatgagccttcttttgctgttactgatggctgtaccacactgcttgcagtacgggggggcatcgtatcttagatagaaattgaagtttcaaagtcacaagcaatggatcatgtgacaatttgagcaacaatatagaaattcagtcgctctacaaaagatacgatatttactctgtgcatatccctagctcattgaggtataaacacacctaagatgaccctagtgggctatcgatgcagctctgcataacttgaatccacttcggacagactgacctctcatctgttcaccttagcacagaaccagcgaactatttgagtgcttatgtggatgttccatgacctatttagagacgcatgcttcaaaagctaccgatctatgg

SEQ ID NO: 17670 - DNA, 244 bp, Sorghum bicolor
  unsure (1)..(244): unsure at all n locations
  Clone ID: LIB3476-041-P1-K1-E10
gcgccgtgcaccagaaggtcccagggagcggcacgaggaggccccattgcggcatggctgctgctgctgcggcggcctccgacgacggggccagctcattggcgccgncgtggccactcttctagcggcggtccttgttgcggtctgtttggggcgcctccgccgccgggcccggacccaggcgcatctggtggaagccaaacccgcgccgtacggaggctgcgcggtcggcgacagccgtacg

SEQ ID NO: 17671 - DNA, 179 bp, Sorghum bicolor
  Clone ID: LIB3476-041-P1-K1-E4
gttgcccggacttctcgtctctactgcacccgactcgttacacgctgggcgcgcgtgcttcaccctcgcggtggattcgtggtgcccggctcagcaatgggggcagccttataccaccacacacaccacgagtcctttctgtagggggggacccgaagagcgtggggggatgactgata

SEQ ID NO: 17672 - DNA, 444 bp, Sorghum bicolor
  Clone ID: LIB3476-041-P1-K1-E7
caatttgctgttgagagtccgcgttggcttgccaaggttggaaggttcgatgatgccaaaaaggttgtagagagcctttgggaaccttctgaagttgagaagtccatggaagagatcaaagccgttgtggtaaatgatgattcacggggcagctggtcagaccttctggtggaaccacataacagagttgcattgattggagggtcccttttctttctgcaacagtttgctggaataaatggtgttctttacttttcatcgttgacattccgtgatgttggcattacaagtggtgctttagcaagtttatatgttggaataaccaactttggaggggcactagttgcttcaaatttgatggacaagcaagggcgaaagaaacttttgataggaagctaccttggaatgggctttgcaatgttccttatagtatatggtattagc

SEQ ID NO: 17673 - DNA, 293 bp, Sorghum bicolor
  Clone ID: LIB3476-041-P1-K1-F6
ccttcatacagaagcactggtcggcgcagcagctgcggcgcgccgagaagcagtgctggcggccccagcgcggcctgccggagaagtccgtcgccgtgctcaaggcctggatgttcgagaacttcctgcacccgtatcccaaggaccatgagaaggacgtgctggctgcaagaagcggcctcagcaggaaccaggtgtcgaattggttcataaacgcacgagttcgtctgtggaagccgatgatcgaggagatgtaccaggacctgaaggggagctcgggtgcaggaggagga

SEQ ID NO: 17674 - DNA, 170 bp, Sorghum bicolor
  unsure (1)..(170): unsure at all n locations
  Clone ID: LIB3476-041-P1-K1-G1
cccacccctctcctccctccgcccgcctnctccgcgcccccgaaggcagaaccctcgctccctatcccggtcccctcctcgcggcgtcggtcaaaccctagccacggacgcgcagacccgncgccgctccattcccatcccaccatgggggcttcggcctacccggcggc

SEQ ID NO: 17675 - DNA, 443 bp, Sorghum bicolor
  unsure (1)..(443): unsure at all n locations
  Clone ID: LIB3476-041-P1-K1-G6
cggacgcgtgggtgaatccaaggacctccgattcttcgggaccggaagctacctggaaggaagcaagggtcaaagggagtgtaatgctttccgaatctgctaggggtgccaaaatactagctttggactactttagcatagttttgctgggggtggagcgagctgaatctcgtgaatctgttgcccgggatgtggatgcagagggatagcgcatgctatgttcccaagttacctgctctgcgctgagatagctaaatcttgaagcgaaccgaattcttccgttacgttgggctgactgaatctaatctgttacatgatgacgtagagagagtgccctaggatatatntcttttttttttttttggccttttggctttcggtttcgggagaagcttgagttacccagctttcctgcatccatcagccgcagctgatttcattgc

SEQ ID NO: 17676 - DNA, 208 bp, Sorghum bicolor
  Clone ID: LIB3476-042-P1-K1-A10
actggttgtgtatgaaatatttggtcagtcatatagaggggctataacttacatcttcatcaccgtatccatgtggttcatggtgggcacttggctctttgcacccttcctgttcaatccttctggatttgagcagcaatgatgttcctttggcgaccactctgctgatcaaacatttgtttattgctaaagaggatgctagatctgt

SEQ ID NO: 17677 - DNA, 372 bp, Sorghum bicolor
  Clone ID: LIB3476-042-P1-K1-A11
gcatccgaaccgtcccccaagcgcagcgcgtccatggcgtccaccgcgctggtggcagtggcagtggggggcggcctctgtcccggtctcgtcgcctcctgcagcgtcgcatcctgctccctgcgcgccggcggcggtgactccccacggcttggccgccgcctcgtcctcctgcagagaggaagaggcgccgagggagagaggaagaagatacggaattgcccaatatttcgttgtgccaatgaagtggatgtcgtgaccgaggatgacaatgtggatggtgatgctaccgacgatgaaaaagaccttgaggctgcagctgatgacgctattgatgctgacgttgatactgaagatgaactggattcttcg

SEQ ID NO: 17678 - DNA, 261 bp, Sorghum bicolor
  Clone ID: LIB3476-042-P1-K1-A12
gcatgctcatcctcaaccaagacacctacttcaatctcatccacctcgcttggtcgatcgtctgcttcaggtggaacttggagaggcctgctatcatcctgaagtgcatcttgatcctctccgacgcccggctcggcatagtcatgtccagtctggctctgtttatggctctggcgccacggatcatctcctgcggtaacaaggtggacactttcgccatggccgtgctgatcctcacctgccccgacgttatggccgccg

SEQ ID NO: 17679 - DNA, 252 bp, Sorghum bicolor
  Clone ID: LIB3476-042-P1-K1-A9
gctacacttctgagttcacgtcctcaactgccacatggagcggcacaccgagccggtctgccacagggtgcgatggactgctctatggcactgtctcccttactggcaccttttttaacaccttgaggaaccttcggagagaggctccaaaagagggtacccgccaaggcacccgggaggttcgtagcgccttcctacgtccctgccaacctggagctgacacaggaacccaggatgaacgccaggcttata

SEQ ID NO: 17680 - DNA, 452 bp, Sorghum bicolor
  Clone ID: LIB3476-042-P1-K1-B10
agataggttatcagattggttgaagaagaacccaacaaaagagccaacagattgtaaggacaagttggaagaagactatggcatcaagctgaagtattcaaaggcttggtctggtatgatggctgccttagataaaattcatggtaaatatgaagaaagcttccaattgttgttcaattgggctgctcaaataaaaatggtgtcacctggtagcattgtagaggtagaagtagaaaaaattggtaagaaatacaggtttaagaggatgtttgttgccctcaaaccttgtattgatggattcattgctggttgtagaccatttttgggagtagatgcatctagtttgaatggtaaatacaaagggcaattggcatcagtaaccagtgtagatggacataattggttgtatcatgtagcatatggtatttttgattcagaaactgaggaaaact

SEQ ID NO: 17681 - DNA, 282 bp, Sorghum bicolor
  Clone ID: LIB3476-042-P1-K1-B4
agaaaaatctacattgaggcgcttcagctggcgctacataattattgatgaagctcaccggataaaaaatgagaactctcttctatcaaagactatgaggatttacaacactaattatcgtctcctcatcacaggcactccactccagaataatctccatgagctctgggctctcctcaacttcttgttacctgaaatatttagctctgcggagacctttgatgaatggtttcaaatttcgggggaaaatgatcaacaagaggttgtccagcagcttcataa

SEQ ID NO: 17682 - DNA, 248 bp, Sorghum bicolor
  unsure (1)..(248): unsure at all n locations
  Clone ID: LIB3476-042-P1-K1-B6
cccacgcgtccggtaaaaatggcctgnggtcaaggtgctaagaggtccatactagggcttctctttcgtgctcagcagcaaactgctcggccatactcttcttcagcattccagactcatcaattgagcactcatgttccccaagatggcgtgtttcttaggagattcagctctgaggtgtcttcttcagagcaaatgaaccttataaagcaactcagacaaaggacgagtgctccaatcaaagatgt

SEQ ID NO: 17683 - DNA, 326 bp, Sorghum bicolor
  Clone ID: LIB3476-042-P1-K1-C6
ggcaaggcagaccaatcgcgaagcgaagccacgccacgaggggagaggggggaggatggggcggaagaggaaggagctgctgtcgtcggcgccgtggcggacgggggaggcggcggatgaccaggacccggcgaggatgagccgcgaggggaaagtcagcgtcaccagcaaccctggcgagacggccaccatgagcgtgccccggagcaagcgccaggaactcgacctcaccgtcgacgacttcgaggaggacgagatcgaccccgagctgcgctacttctttcagcgcaacagcaagtttctgaaaaaaggttttagtgtggaca

SEQ ID NO: 17684 - DNA, 308 bp, Sorghum bicolor
  Clone ID: LIB3476-042-P1-K1-C7
cggacgcgtgggtccagatcactcgcaatctctcattggatggagttcttgattttctgaactcaaagaagatgacagatgctggcgcactagatctcattgacgatgaagacagtgatgttgaagaaggaattgatcgacaggctagaggaaacttaaggcttggtttacctggatcaatggcaaatcgtggaagacccatagctcggacaaaatgtgttaagtttgctccaactggaagatcatttgctgcagcaaccactgatggtgttttattgtactcaagtgatgaatcatttatttttgat

SEQ ID NO: 17685 - DNA, 288 bp, Sorghum bicolor
  Clone ID: LIB3476-042-P1-K1-D10
cccacgcgtccgcagggggtgatcctgtcagcggactacagcgaagccggagacgggcgcttgttgctggatgacggatcctgcatcgtcgacctcttcgtcttgcccagagaagcagagggcgggtactggcggccaggtacgccggttcttaatcttgctggttatttgatcttgccttatgttgtgagaaaccataaattccatgtgtagctctcaacatacccgaatattatcaattacattgttcaattatattatttgcatagatgttaatatgttattccc

SEQ ID NO: 17686 - DNA, 285 bp, Sorghum bicolor
  Clone ID: LIB3476-042-P1-K1-D3
cggacgcgtgggtccaatccgcgcaacaccaccaacctcctcccaatctccatctcggggtggccgccactctcgccgctccggcaacaacccccccgacggcggcggcatggacgcgctcccggaaggcgtggtgcagcacatcctctcgcagctcagcaacgcccgcgacgtggccttctgcaccgtcgtcgcccgctgctggcgcgactgcatgccctttctcccgtcgctctacttcccgcggggcgccttcgaggccgtcggcagcggcgagccggcggt

SEQ ID NO: 17687 - DNA, 277 bp, Sorghum bicolor
  Clone ID: LIB3476-042-P1-K1-E4
gtggaggaggaggaagacgagcgcggcggcgccggcgggcgcgggccgcaccgctccaagaagctccgcctctccaaggagcagtcccgcctgctggaggagagcttccgcttcaaccacacccccacaccgaagcaaaaagaggccttggctggcaagctccagctgcggcccaggcaggtggaggtctggttccagaaccgcagggctaggacgaagctgaagcagacggagctggagtgcgagtacctgaagcggtgcttcggctcgctgaccg

SEQ ID NO: 17688 - DNA, 255 bp, Sorghum bicolor
  Clone ID: LIB3476-042-P1-K1-E6
ctggctctgaattgactgccgttgcattctatgatgccccattgcatgttgtgagcctgaacattgtgaaaaactttgtattatttggtgatattcacaaaagcatatattttcttagttggaaagagcaaggttctcaattgaatctgctggccaaagattttgggtcacttgattggtttgcaactgagttcttaattgatggaagcaccctgagccctgtaggttcagattctgaccagaacctgccgaatt

SEQ ID NO: 17689 - DNA, 233 bp, Sorghum bicolor
  Clone ID: LIB3476-042-P1-K1-E7
gcttttacctagcagagcaggaatgccgcttggacttggaaagtcagaacaaagatttgaaggtaaatcttgaaaactggaagggaaagtttctggatcttcaagaagttcattgcaaagctaaaagggagaaagacttcattatctcaaatttacttcattctgggattttttttatcataagtaactaagtaatttctaactaaaagagttaatatatgtacaactcttca

SEQ ID NO: 17690 - DNA, 197 bp, Sorghum bicolor
  Clone ID: LIB3476-042-P1-K1-F11
attcccatggtgaccgacggcggcgagaaggacagcgggcatgcggcggagtggcggttcgcgcaggcggcggcggcggccaaggatgaaggcgcgctggccgtggccgacgataagatgagcatcctggcggcggttaagatcaaccggcgggttgcctgaccgggccggctgcgttccacggaccctggtccgct

SEQ ID NO: 17691 - DNA, 316 bp, Sorghum bicolor
  Clone ID: LIB3476-042-P1-K1-F12
gccacaagtacacagtatgctgcattgatttgtgctcacgcacaccggcaagagctcattcacgacctttacaaaacatggcaggatcactcagagaggcactgtgacaagcagcatgatcaggtagctcttaatatccttaaggaaagccactgtgcagatgccattgataataatattctacagggactgtgttagtgaaggccatatctaccatatgcctccattacgagttagatgccatccagaaggcatgtgccttcctataaccaaattaccagcctactgtaacatatgtggaattgcaaaaactcat

SEQ ID NO: 17692 - DNA, 184 bp, Sorghum bicolor
  Clone ID: LIB3476-042-P1-K1-F6
ctcgcgtctgaattgactgccgttccattctatgacgccacattgcatgtactgagcctgaacattgctaaaaactctgtataatttggcgagagttacaaatgcatatatggggtgagttgtaaagaccaaggttctcaattgaatctgctggcatacgatcttggttcacttgatcgatttg

SEQ ID NO: 17693 - DNA, 260 bp, Sorghum bicolor
  Clone ID: LIB3476-042-P1-K1-F9
gaggatcaaatggccggaaggtctgccacaagacttaaactcggaaatgctgtgtctgagggaactgtgaacaatgagacccttggctacttcattggaagggtctaccttttcttgacacaacttgggattgacaaagatcgtctccgtttccgtcaacatctgccgaatgaaatggctcattatgctgctgattgttgggatgcagagattgaatgctcctatggttggattgagtgcgttggaattgctgataggtc

SEQ ID NO: 17694 - DNA, 368 bp, Sorghum bicolor
  Clone ID: LIB3476-042-P1-K1-G10
gggggaagcaggagcaggaaatcagccatcagccatggatttctcttccgtctctgtttgatttgattgggattggttcttggttgctgctttgctttggtcgaaattccattccatttccattgcatcggcagcctccatcccatccagtttggctggattcctctcatccgatccaccaccaccgtcgaccgtcgtcgctgcttggttgcctgcttggctcccttaccttaccttaccttaccttaccttaccttaccttacatgatggatgctcgaatcgccaccccttgtgttggccttggccgccggccccggacctgttccggccgccgattcctcttggacctgccgcttgggcccccggg

SEQ ID NO: 17695 - DNA, 236 bp, Sorghum bicolor
  Clone ID: LIB3476-042-P1-K1-G6
ccaacactgatggaatacacctgcaaaactccaaagaagtcagcattcaccacactaacctggcttgcggtgatgactgtgtttccatacagacaggatgcagtgatgtaaacatacataacgtgaactgcggaccagggcatggaatcagcattggtggtctaggaaggtacaacacaaaagcatgtgtattcaacatcaccgtaagagatgtgaaaatgttcagaacaatgact

SEQ ID NO: 17696 - DNA, 302 bp, Sorghum bicolor
  Clone ID: LIB3476-042-P1-K1-H3
cggacgcgtgggcggacgcgtgggcctttagctagctcgttggtcacatgtaattttgaatgttgatcctctttcttgatttgtgcaatataattattccatgaattgccatgattttgtaccatccacaacacctgctatttctttgttcgtggtcaaaatttatagcatatattctactggtaaaaatgcatagtcagatattttttaaatagctgaccttattattatgagtgatctgatggtgtgtgagagattttgaccttttccacgctagctaaatggacttaatttttgttagt

SEQ ID NO: 17697 - DNA, 241 bp, Sorghum bicolor
  Clone ID: LIB3476-042-P1-K1-H5
caaagctggaaatctccagaatattcagccattaactcgagcaagggtcccaatagtgaagcttatggatccggaaacagggctttcctgtgatatatgtgtcaataatcttttagcagttgttaacacaaaacttttgcgagattatgcacaaatagatagaaagttaaagcagttggcattcattgggaagcattgggcttaaattcgacggtgtaatgaaacttaccaagggacactt

SEQ ID NO: 17698 - DNA, 459 bp, Sorghum bicolor
  Clone ID: LIB3476-042-P1-K1-H9
aaatgtcgtcgtcctcggcgatgccgccgccggcgtcgccgcgggagcacgtggagaggatccggcgggagcgctactacatcgggcgcggcgagcagaacccgctggcggaggacatgcaccaggccgtcaactacctctcgcaggaactctactccaaggacgtccacttcctcatggagctcgtgcagaatgctgaagataatgaatacccttctgaagtagcaccttcgttggagtttctcattacatcaaaggatattactggatgtggtgcatcctcaactttactcatcttcaataatgagaggggattctcttcaacaaatatagaatcaatttgtcgtgttgggaaatcaacaaagaaaggaaacagacatcagggttacatcggagagaaaggtattgggttcaaaagtggtttcttgatatcaaagtagccccacatattcagcaata

SEQ ID NO: 17699 - DNA, 262 bp, Sorghum bicolor
  Clone ID: LIB3476-043-P1-K1-A5
cggacgcgtgggtgagtttgatgatgacttatcatgcattttcaatgatgataatgcggataagctcatcctccgtatccgcatcacaaatgatgaagctccaaaaggagaaatacaagatgagtctgctgaggatgatgtcttcctaaaaaagatagagggtaatatggtgacagagattgcgcttcgaggcattccagatattaaccaagtggtcaataaagaagggaagggcaatactttttattcagaccaaaggttc

SEQ ID NO: 17700 - DNA, 249 bp, Sorghum bicolor
  Clone ID: LIB3476-043-P1-K1-A6
tttaagtggtaagccaagtcaacttcgcatcctcaaagatattaatttgaccacagttcagatatcattatgaacaatcatcttatctaagcataccttacagttgtgatttcattcaataatcgtgatggttttcccgcgttacaagatcctgcatcagacctgtcctcgaggaacaaaaggaagctacattgggggtatttttttcattattgtatcttgcttctgcactcttatgttattcttaac

SEQ ID NO: 17701 - DNA, 380 bp, Sorghum bicolor
  Clone ID: LIB3476-043-P1-K1-B1
agaagatggcgctcttgaccgcggaggagaagaagacggcggcggagatcgtcgccgctctggatctgcagcgccaccccgatggcgggttctacctggagaccttccgtgacccctcaatcgcactccccacgtccggtctcccaccccgctataaggttgaccgtgccgtgagtagtgccatctatttcctactgcctgctggggagattgctaggttgcaccgtatcccttgtgctgaaacctggcattactacctaggagaacctctcacggtatttgaggtgcatgatgatggacaaatcaagacgactgtcgttggtcctgacctgcgacagggccagagaccacagtacacagttccttcaaacatatggttc

SEQ ID NO: 17702 - DNA, 295 bp, Sorghum bicolor
  Clone ID: LIB3476-043-P1-K1-B10
tgtgacccaacagaaaggaggagttagcaatgatattggtgacaacaataagaaggataactcaacagaaggaactgacgtcagcagagatgacttgacaccacagccaaaggataaagataacagcataacaaagccttcacagcacgagattttgggagatccttataaggaggcatcatacatagatgatatgaaataaaatcatcgctgtaaagtttgggagactatacttgcatctgggcacaaggaaccatgtgtagatacgccaatatgattgtgaagcatcagtaag

SEQ ID NO: 17703 - DNA, 370 bp, Sorghum bicolor
  unsure (1)..(370): unsure at all n locations
  Clone ID: LIB3476-043-P1-K1-B12
aaggtttcaatcctgaaagtgccaagaagaggttttttgagatatatcttgacaagtacgcaaagccaaattctggcatcggattccctggggctctggagctcatcatggagtgcaaaaattctggtcttaaggttgctgttgcatccagtgccgacaggattaaggtggatgccaatctggctgctgctggtttgcctgtgtctctatttgatgctattgtttctgctgacgcgnttgaaaatttgaagcccgctccggacatatttctggcagcatcaaagaacttaggtgttgacacanacaagtgcattgtgatagaagatgcacttgctggtgttcaagctgcaaaagctgcggaaatgagatg

SEQ ID NO: 17704 - DNA, 451 bp, Sorghum bicolor
  unsure (1)..(451): unsure at all n locations
  Clone ID: LIB3476-043-P1-K1-B2
gttaatagacttgagactgctaagttgtgaaggaatcacatctgcttccatggctgcaatagcttacagccgtctgcttgaggcactacagcttgataattgcagcctgttgacatcagtgtctttggacttgccacatcttaagaatataagtctcgtgcacttacgcaagtttgctgatttgaatttgcgaagccctgtgctttcttacatcaaagtttccagatgttcagcgctccatcgagttagcataacatcgactacgcttcagaaattggtgcttcaaaaacaagagagcttatccaatttgtcattgcaatgccacaacttgattgatgtggatcttagtgactgcgagtcattaacaaatgcgatttgtgaagtatttagtgacggaggtggttgtcctatgctaagatcatngatccttgacaatngtgagagtttgagc

SEQ ID NO: 17705 - DNA, 352 bp, Sorghum bicolor
  unsure (1)..(352): unsure at all n locations
  Clone ID: LIB3476-043-P1-K1-B3
atgaaaccagtcagtgctcagtcaccttccatctctagtgatgaagtttcagagttcttcccttttctcatgcccatcagcatacccgcgataacaagggtgatgatcaagaccgtggtggtcacctataattcctgaactcttgtatggcgctatcccaaatgagcttttgattgagcctataatgttttccctgccatacaaaatgggtgtttctttatcttcttaacggaggatggggaaacccttatgttagtgactgtcangctcttggccttgcaagggcaaggttctggcttagtacactgcaggcagggctgctgatccacggtgataggctcatcccctgtaa

SEQ ID NO: 17706 - DNA, 258 bp, Sorghum bicolor
  Clone ID: LIB3476-043-P1-K1-B4
cggacgcgtgggcagaaccttctttgttatgagcttgttcccaatggaagcctagaggcttggcttcatggtgcactaagtgctagctggcccttggattgggacaccaaggataagataacacttggtgcttgcaagggaataagaataccttcaataaggatcaaaagcctggcgaaatcaaaaggaatttaaaagcatttaatatatggctggaaaatgatttcaatgctaaagggtccaattttggttgggcaa

SEQ ID NO: 17707 - DNA, 194 bp, Sorghum bicolor
  unsure (1)..(194): unsure at all n locations
  Clone ID: LIB3476-043-P1-K1-B6
catggaaagagtttgatgtaactcaggatgctacaaatgctgaaagtctacaacatggtcctactcttgaaattcgaatacctgcggagtttgttacttccactaatcgtcaagtaaaaggtgctcagcttttgngaacaagacgttatacaaacgattcagatcttggggtgtgctaatgcatactggttact

SEQ ID NO: 17708 - DNA, 379 bp, Sorghum bicolor
  Clone ID: LIB3476-043-P1-K1-B7
gcggtgagcttcatgatggcacgaaaattgctgtaaagcgcatggaggctggtgtgatgggtaacaaggggctaaatgagtttaaatgcagagattgctgttttgaccaaggttcgtcaccggaaccttgtctcactgctgggctactgccttgatggcaatgaaaggattcttgtgtatgagtacatgccacaggggacactgagccaacaccttgttgagtggtcagagaacaatttgcggtctttggaatggaaaaagcgactaagcgttgcacttgatgtagctaggggtgttgagtaccttcacagccttgcccagcagacctttatccacagggatttgaagccatcaaactttcttccttggcgatgacttg

SEQ ID NO: 17709 - DNA, 344 bp, Sorghum bicolor
  unsure (1)..(344): unsure at all n locations
  Clone ID: LIB3476-043-P1-K1-C10
gccgggcagctgcatccctagcgcgccgcgcgcccctcgttttttttcttctccttctcgtggacaagaacacacgcacacacggaagaagctactagctctcagcctcgctcgctcgcaaagtcgccctctcgattctctctcagtccagctccagcgtccagccgcagcagcaagtcccttccccttctccatcaggcnngtgcctccgcagatccgaantggaatttggccttcgtctcacaccaccaatcgaaggaaggaaaggagtgatggggagtgcaggcgcaaggatcagggctggaggagctgtgcggaccctggcctatcttcgaactgcgtga

SEQ ID NO: 17710 - DNA, 399 bp, Sorghum bicolor
  unsure (1)..(399): unsure at all n locations
  Clone ID: LIB3476-043-P1-K1-C12
ccagagactgtgtgtactccttgctgcggctaattcggttcctacgagagaaggttctatctccaagtcaattgattgacagtgtcaaagatggatgttggatgaagagtactgttggatataggcgtccttctgattgtatcatcaaagattcagaatgggcagtggcatcttgtatcagtgaccaaccattccttgatgtcgagttctatggcgaggacatcctttcatataaatcagagctggagttgcttggtgttattgttgggttcaaaaacaaataccatctttgtattgataacttcaaagtcagatcctctgctattacttctgagtctactgtattaatnctcaaatgcattttcgtatgtggatcatgtcaagatttcataaggaagc

SEQ ID NO: 17711 - DNA, 182 bp, Sorghum bicolor
  Clone ID: LIB3476-043-P1-K1-C7
gcgggaaggcgcaggaggaggaggaggagcatcagcaggcggcgcccaggatcggcttactacccagagcttgtaaccatggctaggggattgaataaacatatcaagaggctcaatgcgctcaaccattggatgctgaacatgcttcgcacaacttatatcttcaagctatcctattgcac

SEQ ID NO: 17712 - DNA, 196 bp, Sorghum bicolor
  Clone ID: LIB3476-043-P1-K1-D11
gcgcggacgcgtgggcaaaactgtgcttgatgcgaatatttatgctgtgatatccccacagatgggaaagcaagttgttgcttttcttgctgccatggaaattatgtcagagcaatttcctggtgcattttctggttacaaactggaggtcatggagtctcatcaagcaacaaaattggacatttctgggactggc

SEQ ID NO: 17713 - DNA, 504 bp, Sorghum bicolor
  unsure (1)..(504): unsure at all n locations
  Clone ID: LIB3476-043-P1-K1-D12
ccttgagtctctggaagctcttgctgatgagaatacttgtgcgatggtcattataaatcctagaacccttgggggagggtatcctcatatgatcattgggcaaaatgcagagactgcaaggaaacttggaataataatcatagctgacgaggtatatgaccatttggtttttggcaataagccttttataccaatgggtgtctttgcggatatagttccagtgatcaccttgggatctatatctaaaagatggcttgtgcctggttggcgacttggttggatagcaacgtgcgatctgaatngtgtgctaaaggaagctcangtngacaaattgattgaaaactatataaatatcacaaatgatcctgcaacatttatccagggtgcagtccctcaaataatagccaacacaaaggaggattacttcaacaaaatacttaatcttttgaggaactctgcagtattattgtataataaaataaaggagactaggggcattacatg

SEQ ID NO: 17714 - DNA, 287 bp, Sorghum bicolor
  Clone ID: LIB3476-043-P1-K1-D5
ggcggcagagagccaaagaaacgtatgtatgaaatgtcatcatcatcactgaagtcaaaaagaataagatgtagcaatgatggtgacaagtgccagagacatgaatcaaatgggtgcgcatgacaataacttgtgcagttcccctggaaattcactgcatctaattcctaaagaacatcacgttcctagcatgggaggtgattttgaatgcaaaatgtctcaagatgacaaggccgttatctattccaatgggagccctacaattatgctcatgaatattgcagacg

SEQ ID NO: 17715 - DNA, 410 bp, Sorghum bicolor
  Clone ID: LIB3476-043-P1-K1-E12
gagaaactgacatacatggagtcggcggttgctgaagccaacaaggctgtgcaggaggcaaaggctgagagttcacaactgaaggagcgtttacttgacaaagagaacgcattgcagagcataacccaggagaatgatgaattcaggatgcgagaagctgatgccatgaagaaaatagaggagctgtctgctctgcttgctgaagccatgacaaagaagcatcctgaggaggaagagaagctggtggttgttgatgaggcgcacaattctgtgcgtgaagaagttatccgttctgttgcagaaaatgaagatacagaagaaactgatgatcaaaagccaaggcttgaagttgccacagccgatatgaactcgaacggagaatcgaagcatgaagagaaagatgaacagta

SEQ ID NO: 17716 - DNA, 287 bp, Sorghum bicolor
  Clone ID: LIB3476-043-P1-K1-E2
aacacatctcgatcactctgcgaaacacaagaaattaacacacagcacacaagaagcaacaacaatggcgtcgtccaacaacgtcgtggccaccgaggtgagcaacgcggtgaccaagctcaacgaccacctcgccaccgccctcaccggcagcggcgagaacaccaccaccaccggcaccggcggggccaccaccaccaccatcattacgctggcgggggagaacagcggcgccaccatggatgccgctgccgcttgtggcgacgtggaaggacctcgtcgtcgtc

SEQ ID NO: 17717 - DNA, 257 bp, Sorghum bicolor
  Clone ID: LIB3476-043-P1-K1-E7
agccgcggactcgtagggcagttctctgcaaaacatgaaggcgccgaagcatctatcgccgcaccctattcacttcacttcgatgcgatggaactcaataccacggagcgggctttctttaaattaattttcttatattcaatacttatactttattaaattaattcattttattacctctattaattaaatgtttaattctttaattttttatttctttatttatttaaatatttatttatttattttttaaattt

SEQ ID NO: 17718 - DNA, 459 bp, Sorghum bicolor
  unsure (1)..(459): unsure at all n locations
  Clone ID: LIB3476-043-P1-K1-F12
aacactgtttagcagtgatagatgattgcataaagcgatctggcctaaactctgcagctcctgattttgttccattatctattaggaaatcaaataccggcgatgctacaggttcctgtttttcatctggagcgaacatatcaggaattctggaggcgatcaagagtttatccgaggtgctatgcaataatttttctggtgaaattgagctagaggagcatgaccactgcctcctccaatcagtaattgagaatcttcagagttgtcttcataaagcaagcaaggttcctgttatgggtgcttttgataagtcaggaggactaaaggctngctatgctcagaatgcagtttcaaaatctgtcacagggagactacatggtagttgcactgctgataatggaaaagcatanttatctctaaatctgggtgatctagtcggttgttggtgacttaaggaaa

SEQ ID NO: 17719 - DNA, 130 bp, Sorghum bicolor
  Clone ID: LIB3476-043-P1-K1-F5
gaaatccactttgttgtcttacgatgatcctagttctatgtctatttgccaaccctaccagatacctggtgcaaactcatcttctgcatctgtcacatccttttttgagtatggtgcggataattcgttg

SEQ ID NO: 17720 - DNA, 450 bp, Sorghum bicolor
  Clone ID: LIB3476-043-P1-K1-G1
gctttgtctgcttcagcacagcgagaagattgctgttgcattcggtttgatcagttgtacatcagcaataaaaccaataaggatatttaagaacctccgtgtatgcgctgattgtcattcagcactcaagtatgtctctaaggccactggtagggagataattctgagagatagcaacagattccacaggatgaaggatggggaatgctcatgcggagaatactggtaacaagcaagctggctcacgtagtcacatttagctgaagagccatgtacagagtctggcgcaccataacattattgactgtgagtgaccatgttcatagtttttgtagcaccttcacaaaatcataggttatacaaagcatgagttggtgggataagttatactatgggtatagaaatttgacaagtgtatgcaccataaatacgaaatgttttgagacttgc

SEQ ID NO: 17721 - DNA, 415 bp, Sorghum bicolor
  unsure (1)..(415): unsure at all n locations
  Clone ID: LIB3476-043-P1-K1-G6
tgcaaagcttgtcttattattattggttttgtttgctctagagtagaattcatgttaaattacattagactgataaatcagctcaaacctgttttaattttcagctgagatcccagtgttatgtccaaattaaattgttttgcattggcttctgcaaatgagatccttatgtaactcactgttatctgcacacacttacctttccttttcttgaactggcatacgtcataatacgcctttgctagtgtcgctttcatgcttctgcatcattggactcggtctctggttagtttctgtcttcctcagctccatgacattcttctatctggatgcacaggccacaacacggcactagggtctacgatatcnatgagtatttctgcatcagtcagttgaaagcttcatgatcatgaca

SEQ ID NO: 17722 - DNA, 253 bp, Sorghum bicolor
  Clone ID: LIB3476-043-P1-K1-H2
actagcatcaagcttctagcaatcattgccgtcctttctaatgcagccttgatgaccgtttccaacgcgacgcagttaagcttccggggctgcattactgcgacgctggcggctgctatgcccggattacaaagctccatgaccgaaaaatcgctgcgcagagacacttaccgcctggacaattccatcaccttggtgagccatgttacaacagttatggccataggcactatgagactatctactatcactg

SEQ ID NO: 17723 - DNA, 271 bp, Sorghum bicolor
  unsure (1)..(271): unsure at all n locations
  Clone ID: LIB3476-043-P1-K1-H6
cctagctcggcgctctccaccgncgctagggtttccaccgccgccggcgatgggcgcccttaccgacagccggaagcgcctctcggcggaccactggctntcgggcgaccaccggcttccctaccccttcttttccccggcaggccttaccccttccttcaagcgggccaagctcgccccattccctgagcttgatcccttcaacttcacacggccggctatatcggcctgttcccaaattattcggcttcttcacggcggggcctttctt

SEQ ID NO: 17724 - DNA, 177 bp, Sorghum bicolor
  Clone ID: LIB3476-044-P1-K1-A11
aagctggtgattccgatggtgccacaaatatattcatcaagatgaccatgcatggcttgaagccaaatgagtttacaatgtctagtgttattgatgcttgtgctagtccgacagctggagttgacctgggtaggcagttccatgctatttctatcaagcatagatgccatgatgcac

SEQ ID NO: 17725 - DNA, 170 bp, Sorghum bicolor
  Clone ID: LIB3476-044-P1-K1-A3
accagatgctagtcacgctttatcgagcgatcaggtttcttctcctgacgatggtcagatcagaaatttgggaagcccacttatcgctaaagacgcctctcgtgctggacgtgcttctgaaggatctactcctgaagtgcatagtgcccgtgtagataagaagatgacac

SEQ ID NO: 17726 - DNA, 345 bp, Sorghum bicolor
  Clone ID: LIB3476-044-P1-K1-B1
ggcaagaactagtaaacaacccacctgctaaggaaacctcatgtgtttttgtgagcaaaggagatgacctagaagcagtcagaggcgagctgatcaagggattccttgaaattgatactggaggaaggataattgggataaaagaaatgggggaattggatgagaaggcattcgaggctgcttgtcttgcaaaagtgcctcctgaagaagttggtgcagcatcttctcagttatatgcatcatggaagcagcaacttggtgacctaagttggtatccattcaaggcgatcacaagtgatggcgaccatcaggagatcgagaatattgatgatgatatgctgctag

SEQ ID NO: 17727 - DNA, 359 bp, Sorghum bicolor
  Clone ID: LIB3476-044-P1-K1-B7
tgctcgccagaggaatatgaacaacttaaatctgagaagacaaatttggagggagaactagcgaagtgcaacgaaataatagaagaaacaaaggttagattaagtgatatggagaaaaacctggaagacctcagatctaagttggctgacagtgagaaatcaaatagcttgagtgagacacagctgaagtgtatggctgaatcttacaagtcacttgaatcaaggaaaattgaattagaaaatgagatagaagtgttacggtccaaaatagatgctttaacagctgaactctctgatgaaagacaaagtcatcaggagggcttagttaaatacagagatctcgaggggaagatggaaag

SEQ ID NO: 17728 - DNA, 493 bp, Sorghum bicolor
  unsure (1)..(493): unsure at all n locations
  Clone ID: LIB3476-044-P1-K1-C11
gcgcagaaaggaaggaacatcaagatgtaaagtttgctggtgccgtgtcacaacttcaacggattttcattgtgacacctgatttccctgttctattggcaagctgcccacttgtacagtttgaggggtcatgcttgccatcgaatgtctctgatcatgatcgagaaggatcattcagtattgggtgccgagttatcctnccacctgagagctttcttacaatgaggcttncttttgtctatggtgttgagacaaaagagggaagtacatttcccctcaaaaactttgagcaacaaccagaactcacagcatggcttgttggaggcacagccttgcaaatcgtatcggtaggggacgtcaccgagaaagaaaccgttatgaagtgatagacatgtcatctaaagcttaactggttttaacatgttctagtcacgtgtcaatgatgtgccaatggatgcaggatggatgatataatcccgcctaggtttacttg

SEQ ID NO: 17729 - DNA, 315 bp, Sorghum bicolor
  Clone ID: LIB3476-044-P1-K1-C12
gttgaagttcaataaaatctatattatgtaatgaagctgaccttgacaaatttataaatgctttagcaaaatactctgtatatcattaattctttagctggtatgccacttacaaaagaccacacatattgggtatctaatcttgatttgaaatgtctgacttgataaattaagttatgggagataaaaatgagtattacttttccaaggcgttcgatgcggcatttgcctggtctttgaacataccatttgctggtctttagcaaggaatttctggtttgcgatgtcactgttatgaaccttaattcatttggg

SEQ ID NO: 17730 - DNA, 174 bp, Sorghum bicolor
  unsure (1)..(174): unsure at all n locations
  Clone ID: LIB3476-044-P1-K1-C6
cccacgcgtccgatcacgcttcattgctgattggttatgtgttgattgcagactgcaaggattacttcagcaagtccctgtttgtggtcggggagtttgggggcaatgactacaatgcgcctctgttttctggtgtcannnatttctgaatcaagacttatgtgccccttggta

SEQ ID NO: 17731 - DNA, 129 bp, Sorghum bicolor
  Clone ID: LIB3476-044-P1-K1-D1
cccacgcgtccgggcagaagattcaaatgactcaaccaatgataaggatgtcatagaagattcaaataattcaatcaatgctgaggtgccatgtagttcagctactgtacagttaaaagaagataagat

SEQ ID NO: 17732 - DNA, 274 bp, Sorghum bicolor
  unsure (1)..(274): unsure at all n locations
  Clone ID: LIB3476-044-P1-K1-D2
cggcgagatggggttccttgacgtagtcgacccacacagctgatgcggcggacggcgtcatttaaataattcaatcaatgctgaggtgccgtgtgatttaactactgtacanggaatatattattaaattgaatgactncatgaaggcaaaatttatgaaccaagtgttcacgttatttaacttgattattattgtgaaccattatttaatgcatcagttattatttccaagctttatatcttatcatgacagtataatataccccaagacctc

SEQ ID NO: 17733 - DNA, 290 bp, Sorghum bicolor
  Clone ID: LIB3476-044-P1-K1-D6
aacgagaccgctgatcaatccgctggtcatggcgctgctcatggaacccgtcgctgaacccctgactgagagcgagcatgccagcgtggccggcatcctcgccataatggagtccgttgcgcacgaattcaaggagcatgggaacgagctcggacagatgggccggcagcactacaccgaggccgactcctggtacacgtagggcatcgcccaggtgggggcccagttcgcgctcgacgcatctgtcgacgccgacgccttcgttgtcttcgtcaaacgattacacatca

SEQ ID NO: 17734 - DNA, 294 bp, Sorghum bicolor
  Clone ID: LIB3476-044-P1-K1-E2
cggacgcgtgggccgaagctcaatggacaggaattcttgctcggaaggctcctctcagggtaaaaaaaattcaaatatatccaatatttacggcaaccggaagggtcagtttgattatttccgggataaaccaagactgctgaagcaaattggcagtggcagtgaagctcactcagctcacttgagcaatgcttgctgtttccaaaacctgacagcagataacttttcaagtgctgattgcttaaatgagaaagtattgttcacaacagatgaagacttagtgctacaaccacc

SEQ ID NO: 17735 - DNA, 299 bp, Sorghum bicolor
  unsure (1)..(299): unsure at all n locations
  Clone ID: LIB3476-044-P1-K1-E5
gcgcaaagcttcagcagtcagaagctaaaatgatagagcacaaagcaagcatggctgtgttaggaaaggaagcagcagctgcacttgcagctgttgaatctcagcagcaacgagtgacccttcagaggctggttggcgtggtanaagcagaaaagttattccatctgagattagctgctatccttgatgacgttgaagcagagatgtcctctgagaagcaaaagagagaatcagcaccacctattatattttttcataagcgtgctgagaaagcccagtactttcttgctgaggtgaaa

SEQ ID NO: 17736 - DNA, 294 bp, Sorghum bicolor
  unsure (1)..(294): unsure at all n locations
  Clone ID: LIB3476-044-P1-K1-E9
gcgcccacgcgtccgcacgccaacccatctcgctgtggaagctgaagctcaccacccgctcggcgaaatgccgaagcggagccgcgagaactgtggggcactggcggtggcgggcaacgacgaccgcctcggttccctccccgacgacgccctcctacacgtgttgtcgctgctgccctcggaggacgctgcgcggacctgcgtgctggcccggcgctggcgccacctgtggcggttcacggtcgggctgcgcatcgcccgctacgacaacangcggtggagcgtccggtggcc

SEQ ID NO: 17737 - DNA, 495 bp, Sorghum bicolor
  unsure (1)..(495): unsure at all n locations
  Clone ID: LIB3476-044-P1-K1-F12
tctatcgcatgtatcgtgctcttgctgcgcgatatgacagtgtaactggagaactgcgcaaaaacattccatcatctcttcaatcatatggctcttttggtgtctctgaatcagattctgagacacaatgttcctcatctccagagtacgacatgcaagaaaatatgccacagcaaaagcaaaagcctggaccagatttccttgatatttccattggctctggcgttagctctgatgtatcaaagaagggtagtgaaaggtcttcatcatcttcagattctgattcagagcttgatgaggccaaagaggaaaatggcagtattttttatgccctgagccaaaaaattaatgagctagaagaagagcttcaagaagcaaggggaaagcttgatgctttagaggaaaagcatgcacaatgncagagtgatntgagtaccaacctcaaagttgctgaacatgaagaaaaactgcatatttcaatgtggatccaacaac

SEQ ID NO: 17738 - DNA, 534 bp, Sorghum bicolor
  Clone ID: LIB3476-044-P1-K1-G12
caacggccggccgcggcggcggagcggagcggagcgagcagccatggcgtcgaagcagatggaggagatccagcggaagctgtccctgctggagtacccgcgggcgaacgcccccgcgcaatccctcctcttcgccggcgtcgagcgctaccggctcctcgagtggctcttcttccggctcctaggcgacagatcgcccttcacgcagcagaactggcagggggatagcctggaccgcgacgaggagaacaacaggatccaacacctggcggagatagctaacttcctgggcatcacaccttcggtggacaccgaggcgattcagggtcgaggtagctatgaggagcgggtggaacttctccatcttattgtcgacctagtggaagctagttgctacgctgacaatccagagtggagtgttgataagcaattggagaaggatgtgcaactcgtagattcaattgctgagaaacaagcccaaattttttcggaggagtgcaaacttttccctgcagatgttcaaatacaatcaat

SEQ ID NO: 17739 - DNA, 213 bp, Sorghum bicolor
  Clone ID: LIB3476-044-P1-K1-G7
catgcaatgacgactcctctggaggtggttccctggatgagcaggtggagcacgaagcaatacatcctggcggctctgctggggatgctggccatggtcgccgtggcggccgacatctccatcagcctccctccggcgcacgtcgacttgttcgaccgagacgccaacataacccacgcaaacaagacaagccaggacgggaagcaagtgctc

SEQ ID NO: 17740 - DNA, 425 bp, Sorghum bicolor
  Clone ID: LIB3476-044-P1-K1-H1
gaagagattgcactccaagatgaatacgagggatctgaggatggcaactctactgtacactttcgctttattgaaaaggccctcccttcacttgtaccgatgctgctagaaactttattgaagcaagaggaagatcaagatcaagatgataatgtttggaacatttctatgagtggtgggacgtgccttggactcatttctagaactgttggtgatgcagttgttcctcttgtgatgccatttgttgaggccaacatcacaaagcctgattggcattgtcgcgaggcagctacttttgcatttggttctatccttgaaggcccctctgttgaaaaacttgctccacttgtccagggtggtcttgatttcttgcttaacacaatgaatgatgcaaatagccaggtaaaagatactactgcttggac

SEQ ID NO: 17741 - DNA, 268 bp, Sorghum bicolor
  Clone ID: LIB3476-044-P1-K1-H2
cccacgcgtgcgcattttccacctgcagaagccccgccgaaaactcagaggtcctgtgcctgtctgaagagtgaagagtgagagtgtggtcatccattcccctctacgtacaactctagcccgatagcttcctccaatctctccctccctgtgtcacaactcacaaatatcaccccactgtggagtgaagtgaacgagctcactcacccacacccacacacacaagctgcttgctttgcttggcttgtgctctcttccacacagcccc

SEQ ID NO: 17742 - DNA, 378 bp, Sorghum bicolor
  Clone ID: LIB3476-044-P1-K1-H8
cccacgcgtccggtgggacaataccttcatctctaactaagctgaattttctctccaagtttgatgtgtcatacaacaatttgactggagatatccctaccggtgggcaattctccacattcgcacctgaggattttgatggtaaccctacactctgccttcggaattcttcatgcgcagagaaggattcatctttgggagctgcacacagtaagaaaagcaaagctgcccttgtcggccttggactgggaactgcagttggggttctcctttttttgttctgtgcttatgtgatcgggtcaaggattgttcattcaagaatgcaggagcgcaattcaaaggctgttacttaatgctgaagactctgattttaactct

SEQ ID NO: 17743 - DNA, 157 bp, Sorghum bicolor
  Clone ID: LIB3476-044-P1-K1-H9
acggagggaagcacccagcagcacaccatcaaagagtggaccttccagacgttcggcttcccgcccacggccaactcctcctttgaatccaatgccaccagcaactcgtcagagccggccaccgtgccagtctccaacgccgccaacagccacaaga

SEQ ID NO: 17744 - DNA, 311 bp, Sorghum bicolor
  Clone ID: LIB3476-045-P1-K1-A12
ggcgagatggggagaggcttgagcgccgctcccgtctcgccgcgcctcgtgctcggggcagcggcgctggtgctgctcgcggcggcggcgctgccttctccagcagctggggtcaacgtgacggccgtgctctcggcgttccccaacttcgccgacttcgcgcggctgctggcatccacctccgtggccggggagctgtccgggaggtcgtccctgacgctcctggccgtgccgaatgccaacctgccgcagtcacccttggctttcgtagctggcgccggcgccgacatcgtcgacgtgctgaggtacca

SEQ ID NO: 17745 - DNA, 413 bp, Sorghum bicolor
  unsure (1)..(413): unsure at all n locations
  Clone ID: LIB3476-045-P1-K1-B10
agcagctatccaaggtaaggcaccccaacctggtgtgcctattcggctactgtgacgaggagggagatcagtacctggtgtatgagtactgtgccaatggaaaccttgcccagaacctactgagaagtgactctgcgctaccatgggaaacaagagtgaagatcctgagggactgtgcatctgtcctgaggtttcttcacacacaccctgatggatgcattgtccatagagacattaagctcacaaacatcttgctgacagaggacaaggtgccgaagctggccgatttcgggctggcaaaaatgctagaaatggaggagaccaaggtgttcacagacgtgaggtgaaccattgggtacatggatcccgagtacatnacacactccaagctcacttgtgccagtgacatatac

SEQ ID NO: 17746 - DNA, 461 bp, Sorghum bicolor
  Clone ID: LIB3476-045-P1-K1-B9
ctcagatccctagtgaagaagtggcagacattaattgaagcccatgttgatgtcaagacaactgacaactacatgctgcgcttggtctgcattggcttcaccaagaggcgcccaaaccaggtcaagagaacgtgctatgctcaggcatcctagatccggcaggtaaagtttctgtccttatcacatactccatacctataaagaaagccgtttaggacagcgatacagtctccaaagcctaactttgactccttatgtttataaaaatatttatcaaaaagtggtatatttatatttttatgaaagtatttttcaagacacattttcaaactcaacaacttaacagttattgatgatttatattcccaatgcatgatccaaaccttgtccaaaatgactttctttatatgtatggagggagtacgtagcagaattatataactgtgttagcaacgacgaca

SEQ ID NO: 17747 - DNA, 460 bp, Sorghum bicolor
  unsure (1)..(460): unsure at all n locations
  Clone ID: LIB3476-045-P1-K1-C1
gccatgggctatgcccagtgggagctgcgctactccatccctctcgggctcccgccgcatcgtctctgccgcctgatggctcttgttgctggtggcacccgaattctgctgtggagtgatttcattctctacgaatatgatctggcaacctctaagctgagcaccgtgtgtgagatggatcgaatgaggtaccagggtcgtcgaacgaggaaatggaagaacctctggagcttcaactntgtgccctatacggagagcctccttcggatcggatcactgctgcctaataattagcttctttagctagccatgagatgagaattgtgatactttgtagctatgattaccattgatgtcatgagaacaattctgtttggattggagtgcttgtatcttcctcttcactatntattctgtgactcttctttaatcgtatgtgagaataatgcanacatgtgta

SEQ ID NO: 17748 - DNA, 184 bp, Sorghum bicolor
  Clone ID: LIB3476-045-P1-K1-C3
gttagattattggcgagctcaattcaattcaatcagttccttcgacggaggatgtcgtgctgcggaggcaactgtggatgcggttccggctgcaagtgcggcaatggctgcggagggtgcaagatgtacccgaacatggctgagcagcaggtgaccaccaccgtcaagactctcgtcatgggtg

SEQ ID NO: 17749 - DNA, 504 bp, Sorghum bicolor
  unsure (1)..(504): unsure at all n locations
  Clone ID: LIB3476-045-P1-K1-F1
cgccgtcttcgtctacctatcgacacgccatgtgcacggtgactatgtcaatggcgcccaccaggacctccgcgcgctgctctccttcaaggcgtacaacccgaacgccacggccctggcgtcgtgggtcggccccaacccgtgctccggcacgtggttcggngtcaggtgctacaggggcagggtggcggnggtcttcctggacggcgcctcgctgtccggcgccgtggcgccgctcctcgggctcggccggatcagggcgctcgccgtcaggaacaactccctgtccggcaccctcccgccgctggacaactccacggcgagcccctggctgaggcacctgctcctctcccacaacaagctcagcgggagcctncgcatcttggctggtgctctgctcacccttcgagcagagcacaacggctttcgtggagggctggaagcgctgcccgtcccgatgcttaggagcttcaacgtgttcgggaacaagctcgccggggagat

SEQ ID NO: 17750 - DNA, 301 bp, Sorghum bicolor
  unsure (1)..(301): unsure at all n locations
  Clone ID: LIB3476-045-P1-K1-F5
agagacccgccacgcgtgcgcgaagcttaagctagctagcaatggctgcggcggcgactcctcctggtgggcgtcctagcagcagcagcatggggnngnttttcnnccgggggggggnncccttgctgctgctggcggcggcgattgccggcttcgtcgccgacgcgcantttttttgtggtgtctgcttcgggtcatgtatttggtttagccgttcaaccgcgcctacaccaacaagtggggcccgctggatcagacgcttttcggcgaccatatcgccctcatcatctgggttgacagg

SEQ ID NO: 17751 - DNA, 338 bp, Sorghum bicolor
  Clone ID: LIB3476-045-P1-K1-G2
cccacgcgtccgctcaatttgatgttacgctggaagtttctttgtttcatatggatggagctatgatatttatctttaactgttgcatactatgatgcaaactaatgtgatcatgcaagtctttatgagtcggttgatcatgcaattcttatctggaatatcaacaggttgattcaagtaatatttttagtttgccaatcatttcgatgaagaaaacaatgatcatctggttgatctagctgtacatagtatgtgacatagcttaggctatgacagaatgtctagcgtcataaaatactataaaatgtctattctattgacagtgtaaagctgaatta

SEQ ID NO: 17752 - DNA, 426 bp, Sorghum bicolor
  Clone ID: LIB3476-045-P1-K1-H1
cccacgcgtccgcccccatccaccccgcccatgggagcccccacccctcgccgctgacccgtgggcccactgccccctgctccctgggcccccgcccccgcccccgccccggctgctgctgctgctgctgctcgcccacgcaaaccctaggctttgctgctagaagagctccagcgaccgaggaggagaagagaataaagctcaaatcttggatgcaccgtaaccgatggcgacacctgctgcagagaagccggaagatgtagagatccgcgaggtttgggcggacaacctcgaggcagagttcgccgggatccgcgacatcgtcgacgactacccctatgtggccatggacacggagttccctggcgttgtgtggccgccgctcggcacttacaagacggcggccgagttcaactaccccacacc

SEQ ID NO: 17753 - DNA, 498 bp, Sorghum bicolor
  unsure (1)..(498): unsure at all n locations
  Clone ID: LIB3476-045-P1-K1-H2
gcggtttcacagacttcaggattaccccctaaactcccagtaaaaaagaacagcaaaagtcaaaactcttatatccgcaagggtaatgccctaattagaaacccagccactggaaatcttcattcttctagtctagattctcaaaataagagtaagcctgttatgaggagaagcatgaactttgtcaggaaagtcgattcaaaagatgtaggacattctcatatttcagttgaaagacccaagaccccacctttgccacttcacaccaagtccatcagttgtgatgtgaatatnttggagccattgtctcaaaatttgcagcaacaggtcattgaaactgaaaaggaagattccagtgggcaggttaactcaggtgctgacattccaagcattattagttcgcacaagtctgaagcccttgatgctggtaaagcaatttatgttagaccaaaggtaaatcaagtagttgttgcacaggggcaacatcnttgtgagtcg

SEQ ID NO: 17754 - DNA, 165 bp, Sorghum bicolor
  unsure (1)..(165): unsure at all n locations
  Clone ID: LIB3476-046-P1-K1-A10
gcgagatattaaagcattttccttatagagatatatataaaaaattagaacacaaaggttctttcttttcgcgactccatctgccaccagcaacctagttcgattcggacgncgtagcgtatccggatagttccactccgggactctctcggtcgacgagagggt

SEQ ID NO: 17755 - DNA, 121 bp, Sorghum bicolor
  Clone ID: LIB3476-046-P1-K1-A9
cggacaactgtttgtctttcctcctggaatcatcagaagtcaaagacgatgctgcttatagagcaccagaaaatatgaaatccaacagaatgctgaccccaaatcagacatatatgctttg

SEQ ID NO: 17756 - DNA, 247 bp, Sorghum bicolor
  unsure (1)..(247): unsure at all n locations
  Clone ID: LIB3476-046-P1-K1-B11
cgcggcggagatccgcgacccgtggaggaagacgcgcgtgtggctgggcacctacgacacccccgtcgaggccgccatggcctacgaccgcgccgccgtcgcgctgcggggctccaaggccaggctcaacttcaccgctgggcgcggngcctgcccncgcgccacgcccgtncaggctcgcccgttcccactctcgcacccggcggcgccaggcggccacttcgtcggcgggctcgacgtcacccac

SEQ ID NO: 17757 - DNA, 104 bp, Sorghum bicolor
  unsure (1)..(104): unsure at all n locations
  Clone ID: LIB3476-046-P1-K1-B4
gctctcgtcattacattgaggatgagaagcctagacagagaaagtataaccatggctctcgggcttctgaggatgagaagcctanaaagtacaagaaagctttc

SEQ ID NO: 17758 - DNA, 346 bp, Sorghum bicolor
  Clone ID: LIB3476-046-P1-K1-C8
ctttctattattcacactgaccttaagccagagaatatattgcttgtgtctaccattgacccctctaaggaccctcggaaatcaggtttacccctggttttgccttcagcgaggacagacgagccacctccaaaggtgcctgcacaatcaggaaatggtggcctcaccaagaaccagaagaagaagatccggaagaaagccaaacgtgcagctgctgcaacttcagaaggaagtagtgctgtggcatctgctgacacagatggatcagatgaccgaggagatctgggtacaacaaatgagggtagtcctattcaggatggagctaagaagcggcaacacgagatag

SEQ ID NO: 17759 - DNA, 355 bp, Sorghum bicolor
  unsure (1)..(355): unsure at all n locations
  Clone ID: LIB3476-046-P1-K1-D2
cctccttacacacagcggcggcggcgagcggcgccgggatcacgcagcagcggagctccagctcggccagcacagcggggtcgcagcgaaagagcgacggcagcggcgtggccaatgcgagcgcgagggacgggcggagaatgctggatcccgtgtgggagtggatccaggccccgccgncgncgcgctgcttgtgcttagcaaccgcgttggctcgccggattcggttcgatttgtttggtttgtttgccttgtttcccttctgctcgacaacgattcagtgcaatcggagctggatttcgtgaatcagaggaatattgattcgtgggtctagcccgcgcgatgcttacagtta

SEQ ID NO: 17760 - DNA, 230 bp, Sorghum bicolor
  unsure (1)..(230): unsure at all n locations
  Clone ID: LIB3476-046-P1-K1-D5
gatgaggggttggaggaagattttgtcatcatagctaaccgggctgagggggaggagttggaggaagaagacacagaanaggtggaagagtggaatggtgttttgagtgatgtggaagaggaggagttcgattttgaggaggtgagccaaagccaaagtgagacgatgctggataacaatttatctgttgcttggagagtttgaacatgatgatatacaggctgtaagat

SEQ ID NO: 17761 - DNA, 224 bp, Sorghum bicolor
  Clone ID: LIB3476-046-P1-K1-D6
atcatccgcagccacccctcaggactcaggagcttcgcacggcacgccgctccgcagtcgggaaccatggcggttacgccgctccgcacggcggagggccacgacggcgtagatccggaccccatccggagagctctgagaggcgtcagcagcgttctcggtcgcgtggcctgcgcgctcgcccctgcggcgggctctttaggcaccgactgcagctgccgtcg

SEQ ID NO: 17762 - DNA, 255 bp, Sorghum bicolor
  unsure (1)..(255): unsure at all n locations
  Clone ID: LIB3476-046-P1-K1-E11
ctgaagttcgtctgatgatgaaccctgtcacaaagaagaataaaggctttgccttcctgcgatatgcaactgtagagcaagcaaggcgtgctgtttcagagctaaagaatccactggtgcggngtaaacaatgtggcgttgctccaagtcatgacaatgatacactctntgtcggcaatatctgcaaaacatggacaaaagaacatttgaagggataaactgaagagtatggagttgaaagtntngatgacttac

SEQ ID NO: 17763 - DNA, 111 bp, Sorghum bicolor
  Clone ID: LIB3476-046-P1-K1-E2
ctagtactggccacatctaagaattattttgaacgcggtataatgaaccaaagtagtagagggaagatactgacaaacttatgtctggcctagtcaagtttcaatataata

SEQ ID NO: 17764 - DNA, 248 bp, Sorghum bicolor
  Clone ID: LIB3476-046-P1-K1-F2
cccacgcgtccggttacatcttgtaggtgaagcaaaattagggatgcaaggccttgatattgcagtatttattctatttctcgcaatgtgttctgccatcaataattttagtttcagatgacataatggcaagaaacatatcccttcatgtttggttcgttggattgatcaaattcctactcctaaattctttgttgcatgctgattgttggtgcttactgtcgtataaattgatattgcatttttta

SEQ ID NO: 17765 - DNA, 313 bp, Sorghum bicolor
  Clone ID: LIB3476-046-P1-K1-G10
cccacgcgtccgattcagcgttggaggaggcaaaagctgatatagttggtctctgggcactgaatttgcttattaagaagggattgcttcctaagagcctgtcacaatctatgtatgtctctttcctggctagctgcttccggtcaatccgctttggactggaagaagctcatggaaaaggacaagctctgcagtttaactggttgtatgaaaaaggggctcttgtcttgcactctgacggaaaattctcagttgactttacaaaggttgaggaagctgtagaaagcctgagcagggagatactgacaataca

SEQ ID NO: 17766 - DNA, 280 bp, Sorghum bicolor
  Clone ID: LIB3476-046-P1-K1-G8
gcgctggcgtcgaggctggcgcagctgcaggccaaggcgtgcgaggcgacgcggttcgtggcgcggcacgggtgcgagtaccagcggtccctcgtggagaagaacaagaagtacgtcgtggagccgcccaccatcgagaagtgccaggagctctcaaatcagctcttctacacccgcctcgccagccttcctggtcgctatgaagcattctggaaagagcttgatcaagtgaagcagctgtggaagaacaggaacgatcttgaagtcgagcacgccggtg

SEQ ID NO: 17767 - DNA, 401 bp, Sorghum bicolor
  Clone ID: LIB3476-047-P1-K1-A10
atgggtggtcagataaactttgtcagccgaccacaagttgggagtacattcacatttactgcagttctccaaagatgtgacagaagcgctattggtgacagtaagcctgttatgttgcaccctcttccatccagtttcaaaggtttatctgcactattggttgatacaagaccagtaagagctactgtaactaagtatcacttgcaaaggctgggaattgcctgcgatgttgttgctaccattgatttggctcttggtgtgctgtcagggcgaaatggcagttccctaaccagcacgaagcaaccatgcatgttattgattgagagtgattcatggggcttcaagattgatgtttctttaagatctagactcctggagatgaagcaagatggtcacacaaa

SEQ ID NO: 17768 - DNA, 373 bp, Sorghum bicolor
  Clone ID: LIB3476-047-P1-K1-A11
cggacgcgtggggactgtacctttgcttgctcaaagactgccattttcctcaggttatagagatgtaccatccgctggctttgagaatgttcttacttggcacacactacaggtccccaattaactacacaatagaacaactcaatgttgcatcagacagattgtactacacatatcagaccttgcgtgattgtgaagagagttgtcagcagcaaggaagcaacactggaaattcattgcctcctaataccttaaattacatccaaaaacttcatgatgaatttgagacctcaatgtcagatgatcttcacacttcagtggcattggctgctatttctgagccattgaaagttatgaatgatctgttgcacac

SEQ ID NO: 17769 - DNA, 436 bp, Sorghum bicolor
  Clone ID: LIB3476-047-P1-K1-A12
gctctttgggtgcaccacggagaacaagtttgggtacatcgtgtgcaaccctgcaaccgaggaattggtgaccatacccgccagctctggttcttgtccgcctccttcgcttactccattggaagacaaaactatcgctgtctgtgatggggatatatatgcacacacctatctgatgtttgacccgattgtctcctcgcgcttccacttggtccagttctggcaggataggtcgacgtgtgaggtgaaaaaggtgcactcttactcgtctgaaaccagggcatggagtgacacgtcaaacaagtgggagccaggtgaagagcgctgtggatggggggtactgcggggtcgtggtgaagccataatcgaattcacgcgtggcaaggctttggttgatggtctgttgctttatatttgaagctgttcttcttttcat

SEQ ID NO: 17770 - DNA, 481 bp, Sorghum bicolor
  Clone ID: LIB3476-047-P1-K1-A9
gctctttgggtgcaccacgtgataacaagtttgcttacatcgtgtgcaaccttgcaaccaatgatatggtgaccataccggggggtgctacttcttgttcatatacttccttactttttataatgtcatacttatttgcatgctttattggtataatcattaatctcttttatatttgacaatttatcatagttatttaatatttttaatatttctttatgatcttcatttatattttttattaatatttttattgtattttatatttatttcatgattttttgttttttttattttgtttaattttttaatgttttatatttttttttaagtctatttattttttataatttttttatttttttatttttatttatctaatttattcattatattattttttaattttatattattgttatttttttttttaatatttattattatttttattattttaattttttattttttatttttt

SEQ ID NO: 17771 - DNA, 335 bp, Sorghum bicolor
  Clone ID: LIB3476-047-P1-K1-C10
cgaagatgggcctggacaagcccactgccaccgccgccgccgccgctgacggccagtcgcccaagaagaagaagaagcctgctgcaccgaggccgcctggcgtaggcaatgaccccaccaaagccggcgtgaagcgcgggccatcggaccggcagggggagctggccgtgaagaagaaagccaagctcgataagatcaagacactgtccagcgagaagaaggccgccggtctcggtctggagcagaaagacaccaccgctgtggcagcggcggcggcacagcagcagcagcaagcagcacgggcggctgcaggcggcggcaaggacaacaagggc

SEQ ID NO: 17772 - DNA, 212 bp, Sorghum bicolor
  Clone ID: LIB3476-047-P1-K1-C11
ctgaaggaagcggatatgcttcagacctctggtatacgtagcgttgcagatctatctcagagagagacactgcattctacgagcggacatttattatgggctgttcgacattctacttaagctgctgcttatatatacaaagctatcagggtgtaatcctgccatagaaagcatgcaagttaatatggggataataaaagtagtatcaatga

SEQ ID NO: 17773 - DNA, 281 bp, Sorghum bicolor
  Clone ID: LIB3476-047-P1-K1-C5
ctcacgccggcacgccgccgccggagcgccatgatccaccttcggaagcgcatcgtctccctcctcccccggacaccaacccgcgtgccttgcccccacaactccccgctcttctatccccaccgccttctctccgccaccaaatgcgtcgctacaactacaaaccagttcgccgtcgaggactacctcgtcgccacctgcggcctcacccgagcacaggcgctcaaggcgtcgttgagaatctcccatctgaaggacgcctcgaggcccgacgcggtcgt

SEQ ID NO: 17774 - DNA, 368 bp, Sorghum bicolor
  unsure (1)..(368): unsure at all n locations
  Clone ID: LIB3476-047-P1-K1-C8
catttctccctcctcttcttccatcttgccggcctgtctccgccgcgctcacacagctcacaaaccaacgagaaatcgaagtcgacctcagccgcgggctgcggctgcgtgcgagcactctattggagcagtggcgccgtgccgtcaatggcgggcctcgggttcgaggagaccgagctccggctcggcctgcccggcggcaacgacgccggggatgccgcggcggcgaggaagcggggtttcgaggagaccatcgacctcaagctgaagctggagcagccggcggcgccgcacttggagaagggaggagaggtgncgctggcgacgccgtcgcccccgggcgggtcccactgtcgtcgcctccagca

SEQ ID NO: 17775 - DNA, 447 bp, Sorghum bicolor
  Clone ID: LIB3476-047-P1-K1-D11
cccacgcgtccgagcaaaccctccgccgcccgccgcccgcccgcccgcccgcccgagaggaggaagagaaggcgaaggagggcagcaccgggcaacatgaagacgatcctggcgtctgaacgatgacatccggaggcgtgacgggacgtggccgcaactgtaacgtgagtcctcttgatgtatctctattaagtacttacattactttatttaaaaggttgtctatatagtgttctattttttcttatttttttatttttctcttatttttttttttattttattatttatattattttttttattttttatttgttttagttatttttaaaaaatttattaatgttttttttatatatattttttttttattttttttttatattttttatatttttttttttatttttttatttttttagttttttatatttattttataaattt

SEQ ID NO: 17776 - DNA, 415 bp, Sorghum bicolor
  unsure (1)..(415): unsure at all n locations
  Clone ID: LIB3476-047-P1-K1-E4
cggatgggttccaaactgtgacacacttcatgctctgatccgtgaatacagagatgccaggaagattttcttgaatcaggagcacaaacttatgttggcttttgcacccgattatgatcacttacccctcattgcaaaggtggaagtgtttcagcatgctttgcaaaacaccgagggaaatgaccttgcaaaggttctgtggcttaagagtcgaacttcggaagtctggcttgagcgccgcacaaactacgctagaagcctggctgttatgagcatggttgggtatttgcttggtttaggagatcgtcacccaagtaatcttatgttagatcgctatagtggaaaaatattacacattgactntggagattgctttgaggcttcaatgaatcgagaaaagttccctgaaaaagta

SEQ ID NO: 17777 - DNA, 364 bp, Sorghum bicolor
  Clone ID: LIB3476-047-P1-K1-E7
cgagcgcgcacgcttgtttctctctccggcttccgtgacctcgcgcaagagtacctgccgaccatcgccgtggtgtgcgcccacttgaagagccttgacttaagctacaccgcggtcaccccgaatcagattctcatgttcattggccaatgctacaaccttgagacactatgggtacttgactcggtgcgtgacgaagggctcgagtccgtgggaatgtcttgcaagaagctccaatctcttcgtgtgctcccgttgaatgcacgtgaggatgccgacgagttggtatcagaggttggccttactgccatctcacggggctgccctgctctccgttcgatattatatttttgccagacgatga

SEQ ID NO: 17778 - DNA, 406 bp, Sorghum bicolor
  unsure (1)..(406): unsure at all n locations
  Clone ID: LIB3476-047-P1-K1-F1
gcctaatccatccggcacaggtgacaggcacacacggtacaggcctcacgtacactgcgctcctgctcgttgatttccagcccacacaacaattatttacaagctactagacagtcaaatttacaagctactagcagcagtagtaaacatgccacatgcacatgatgctgtcgtcgagactcgacactagctgcatgcatcgttagttaacaatggccggaagaaggtcatcagtacatacacgtacgtcactgatcgagcagcggctgtttctgtttgtgtttattgccgcagcacgcggtggggtacgtgaccggcgggcagttctacggcgccaaggcgagccttgaacggtggncggcgcaggtggcgtcgcggcgagtcagctggcgagatctgggtattc

SEQ ID NO: 17779 - DNA, 180 bp, Sorghum bicolor
  Clone ID: LIB3476-047-P1-K1-F11
gggggtacggcctactgctgaggcagagagaccaggatcttctggtagtggaagcacatctttctggaatcaaatatttacttccactgaggacaaaacacatgctcctgcaagagataacacagcaaacaaatcttatgctgggcctgcacccaatctggaacattcactctccacgat

SEQ ID NO: 17780 - DNA, 357 bp, Sorghum bicolor
  Clone ID: LIB3476-047-P1-K1-F7
cggacgcgtggggttgcacgtggcattgcaaattttgcaaaatgtgaatctagagcagctactcaaggaaataaggtgggaaaatcactattaatcgatgacggatcacttccttggattgtaaaaaatgctaataacgaagctgccccaattaggcggcacattgagcttgcactgtgtcatttggcacaacatgaagtaaatgcaaaagatattatcaatgaaggtgccctatgggaacttgttcggatttcaagggactgttctcgagaagatataaggaaattggcatatcggacagtgacgtccagccccactcttcaagcagagataaggagattaggaataaaaatgtga

SEQ ID NO: 17781 - DNA, 302 bp, Sorghum bicolor
  Clone ID: LIB3476-047-P1-K1-G11
gtgggcgggcccaagatccgggtggccaaggccagggaggcgttcgccggcgtcgcggacgccagcgggtaccctttcgccgtgatgccgtccgccaagggccttgtgccggagcaccacccgcggttcatcggcacctactggggcgccgtgagcaccacgttctgcgccgagatcgtggagtccgccgacgcgtacctcttcgccggccccatcttcaacgactacagctccgtcggctactccctgctgctcaagcgggagaaggccatcatcgtgcagcccgaaccgcgtggtggtcg

SEQ ID NO: 17782 - DNA, 392 bp, Sorghum bicolor
  Clone ID: LIB3476-047-P1-K1-G8
accgcttaggtttgcagagacatgatagtgtctagagatcgccgagatcatgttacaggtgatatttgaccgatcggacgctgcgcgtatgagcgggatgtctgacaaggcctacatcagatcattcaacgcgctccaaaatggtcttggtgtcaagacgactttagatgtgcgtgaattgggcatccagtttggttgtgtcatgctgataccttttgctcagaagggtttgtcactctataaggagcgctttcttgctgaattgccaccttaacgccgggcaagcactgactttggtcgagcagagtttactgcagcagcattctacttatgtgcgaagaggcacaagctcaaggttgacaaactaaagctgatagatctatgtggcacat

SEQ ID NO: 17783 - DNA, 363 bp, Sorghum bicolor
  Clone ID: LIB3476-047-P1-K1-H10
aattaacttgcctatagtgctttcggaatataaagatgaaaacatgttaaatgcaaatgtgaaagtaagcaaagttctccaggcttaatggatgtagatttatggatattggtgacctgcagaattggatcatgaactcaattgcatttgcgaggtacataaaaggataaatgcctattgaatttgtagtcccatttaggatttatcttttgcttgacttgtacagaaattttcatatttagctcagttttattttgtacactgacatgcttggatacctcagatgacagtcatgcattgatcactgaatgcacaggccttgtttactttgaaaagcttcacaattagttgtctattggatta

SEQ ID NO: 17784 - DNA, 315 bp, Sorghum bicolor
  Clone ID: LIB3476-048-P1-K1-A1
agcgtgaaatatatgatcagcttggaccagaagcatacgagcgtcaagcatcaggtggtgaccctggagggccgggttttcctcagggtaacccatttggtgacatctttggcgatatctttgataatgcctacagaggtggccaagatgtcaaggtttctgttgaactatcattcatggaagctgtccaaggttgcagaaaaaccattacatatgaagctgatactttttgtggaacttgcaatggaagcggtgtcccccctggaactgtgcctaaaacatgtaaaacatgtcgaggctctggtgtgatataca

SEQ ID NO: 17785 - DNA, 157 bp, Sorghum bicolor
  Clone ID: LIB3476-048-P1-K1-A3
ctttgttcttggagtccaactattttgatcctgttgggaagggcaaggtccgtttgtggcattaatttgcatggcaggagcttggtgtatcgtaaaattgcaacagaaacatcagagagagtcagaactctctgttgctgaccctgtttggtgattc

SEQ ID NO: 17786 - DNA, 215 bp, Sorghum bicolor
  Clone ID: LIB3476-048-P1-K1-A4
ttcgtctcatcagactaaaaaactttacatcgaaggtgcagccgcaaccgatccactctgctgccgcccgacgagcagcgtgacagttgcctgcagccatgggtaaggagaagactcacataaacattgcggtcattggccatgttgactctggcaagtcgaccccactggtccctgattaaagcttggggattgacagcgggatcaaggtcaga

SEQ ID NO: 17787 - DNA, 305 bp, Sorghum bicolor
  Clone ID: LIB3476-048-P1-K1-A5
gaacatctcaggattgtcgacccggtgctgcaaatgctgctggacggttaccctgatccggtcacaagtgtcatcgacagcgatttccactgccagaattcaatgttgccagaaggagagctaggcatggataagaaatcactctcttcaccgataacaaaacaagcaccggaggtgtatacaaaaagggatgcacctggagatggagaagacaacttcgtccaagaatctggagatttttcagtgtcactactgatgctggcaaccaacacggcaatgagagaaaatgtgagcgtaatgggatg

SEQ ID NO: 17788 - DNA, 180 bp, Sorghum bicolor
  Clone ID: LIB3476-048-P1-K1-A7
gaacgcgctgacccgctgctccgccgtgatctccaactcgcccttcatcctcaacctggactgcgaccactacatcaacagctcgcaggcgcttcgcgccggcatctgcttcatgctcggccgggacagcgacacgggggcgttcgtgcagttcccgcagcggttcgagggcgtggaccc

SEQ ID NO: 17789 - DNA, 355 bp, Sorghum bicolor
  unsure (1)..(355): unsure at all n locations
  Clone ID: LIB3476-048-P1-K1-B10
gcctttccataggtgtacatggactttccattcttagggtctttttttccttttgttttcaggaagataaatgattctttgttaatctaattcaccactgagctaagatggctatagaatgagggaatttgtttggataatctatgtcaaagagagggtttatgagcttcaccattttgttaacttaaacaatttaattaattcgccaggcaaagtggcgcttttcattatcttttttgcgtaacatttctgcttgtctattttctctacaggcaattacttctatgcattggttcttcatgtatgatctatcctacttcttaaactttaacaagattatatttnttctctcaca

SEQ ID NO: 17790 - DNA, 232 bp, Sorghum bicolor
  Clone ID: LIB3476-048-P1-K1-B7
ctattatcaagggataaggagtcaattgtattctacagagggaaagatttcctccccccggctgtctctctggcaatagaaaaacgcagaaagctgggcagttctacaatctacaagccgaagcctgacattgaagaaaacatgcctactcaagagactctgtactgaggtatcaatgatgtctcatacacatctgagaggactctgcacaagtagacaaacttatctgtgc

SEQ ID NO: 17791 - DNA, 168 bp, Sorghum bicolor
  Clone ID: LIB3476-048-P1-K1-B8
tcgcggacgcgtgggaaaatttccccccaaccaaaaaccctctctcccaaaccctagctaccttcggatcccgatggcgaaccggcgcgtgttattcgacatgacggtcggcggcgcggctgctgagcggatcgtgatggagctgtacgcgaacgaggtgcccaagac

SEQ ID NO: 17792 - DNA, 324 bp, Sorghum bicolor
  Clone ID: LIB3476-048-P1-K1-E10
ggacaatcatttgttccttatggccctccaaatggggtgcataagcctggcgtgcacccagcaggctatgctgtacctcggatgccggttcctccatttcctggggctccacattctcaaccatatacgattccgacccggggtttgcatgggcccattggagctgttccaccggtgcatcaacctggaagtagaaactttggggcgcctcgttcaaatactggtgggcctattggtggccaccttgctcatcaacagaactcccagcaagctatggggggcatcgggtcaaacttaactacactggcatggagaatccgagta

SEQ ID NO: 17793 - DNA, 394 bp, Sorghum bicolor
  unsure (1)..(394): unsure at all n locations
  Clone ID: LIB3476-048-P1-K1-E6
cccacgcgtccgcccacgcgtccgctgcgaaatgtcaagcctcgaggagctcattttcggtaattgcaccaatctcagagagttaccgctttccatggctcaactgtcaaatctattagttcttcatgtcgaggggactcagattacagcttttccagatcacatgttccaaaacatgcanagcctgcatacactgaagctaatcaataacatggtattgatatcactaccgatgtccctgtctgaagccaaacagcctgaagtgctacatcttagtaactncattagcctaaggcactccatcatactgtcaaagcaaatgcctaagagctcattctctactgataggtacactcaatcttggacatacantctgaactattcaactgagatg

SEQ ID NO: 17794 - DNA, 276 bp, Sorghum bicolor
  Clone ID: LIB3476-048-P1-K1-E8
aacaaagtatgaccttgtgtacatgatcaacaaagaagtcggggacgctgcaccttcctcgctcgcggacattaaaaagtttgctagtgccgtttccgttgatactagctctgtcttccctgaaacccactacttcacagtgtatgaaaccaatcttgtccagacactgcagtcggcaggcctctcggtctacgtttatactcttatgaacgagtttccgtctcagccatacgacttcttctcagatgctacagcgcagattaatgcctatgtcaa

SEQ ID NO: 17795 - DNA, 161 bp, Sorghum bicolor
  Clone ID: LIB3476-048-P1-K1-E9
cggacgcgtgggcggacgcgtgggcggacgcgtgggcgcgcctctgaaagttccgagccgccgaccagtcctgccttcctgtgcgggtgcggtgcccaaggccaatagttttgaagtggtaatggccgaccaagctaaccaacccactgtccttcataagc

SEQ ID NO: 17796 - DNA, 505 bp, Sorghum bicolor
  unsure (1)..(505): unsure at all n locations
  Clone ID: LIB3476-048-P1-K1-G11
gcacccaacaaaccctacctgccgccgcccgcgcgcagctcccgccttcgtccgcgccggcgccgctccatcgccctaaacccccgcttgtaattccaccgggaactagctgaaaggagagggagcagaggggcatggcgtcctcggatgacgagacgagccggctctaccgcatccgtcgcacggtgcatgagatgctgcgcgaccgcggatacgcggtcagcgaggaagaaatcaatctcccaagggacaggttcatcgaccgcttcggcaaccccgtccgccgcgacgacctcgccagcagcgccatgaagttggacggctcctccgagcagatctacgtgttcttncccaatgaggccaagcccggggtgaagacgatcaggaactacgtcgagaagatgaagcatgagaacgtcttcgncggcatactcgtcgtgcagcaggcgctcagcgcgttcgcacgcagcgccgttcaggaggtctcccagaagtaccacctcga

SEQ ID NO: 17797 - DNA, 364 bp, Sorghum bicolor
  Clone ID: LIB3476-048-P1-K1-G12
cctgtcgctgtcatcctcggcttctcctagaagctcgatgcgatggcgacgctgctgcggctgcccgtgatgcacggtcgcgtcgtgggtggcggcgggaacaaagacaagctggcgcagcggccgtggtgggacgggaacaagcccgactcaccgcgtcagccgtggcagtcgggcgggaacgaggcgcgggcgacgggtggcgaaccaggtgcttggcgtgctccgccgcgactgcgagttcctccaggccggcaggccaccaccggcgccccgcgacgtcttctggctccgtttcatcgagaagcagcggcggaagcagcagcagcaaatacgtagaagaggactaacactatgggaaact

SEQ ID NO: 17798 - DNA, 389 bp, Sorghum bicolor
  Clone ID: LIB3476-048-P1-K1-G2
atgaaatgcagcttcataaaaatcaacttgcctcccccttcatttctgaaggaaaatgtttttggtgaacttgatattttcttgaaggagaatgcaggattttttttgaatgactggtttccttggctatgcattttatcccaaaactaaatgaacattaataaagtttgtaacatcagtgactgttataattctttcacttctggttttttgatgctttaatcagtttggattgccatgtcaacctgccaactatcttgttttatgaaacagcttgacaattaccttttccttcattactcacgtatgtagcaatgtaggttgacaactgaattgttcaagacatttgcaccttgtttcatgactgtcacaggtcacatcactacata

SEQ ID NO: 17799 - DNA, 263 bp, Sorghum bicolor
  Clone ID: LIB3476-048-P1-K1-G8
gcggacgcgagaggagaagactagaccaggggaacgtcgaagaggcctcggatcggatccatcgacgcgtgaagatgtcttcgcccgccgagtactacaaatcacttccacctataagcaaggcatatgggacattgtgtttccttaccaccgtgctagttcggcttcatatcatggatgggggttttcttgtattatattaccctcgggtgtttaagaagtttcaggtatggaggctatttacaagtttcatctttctggga

SEQ ID NO: 17800 - DNA, 274 bp, Sorghum bicolor
  Clone ID: LIB3476-048-P1-K1-H1
gcgcggacgcgtgggcggacgcgtgggggttctggtcctgctggaaaccaatgataactgtactcgcatgctggcgttatgtcgtcctgcgcgcgctcctctcggggctcatctactagcagtcgctgttgcgttgtgtgtttaggggtgcatggcagcacagcaccaggccatgccccctgatgtgtgcgcacattgatcgggtgcgactttgtttgcgctatgttaccatacatctattacctataatatgcgcacgtctttgtgtactcgc

SEQ ID NO: 17801 - DNA, 113 bp, Sorghum bicolor
  Clone ID: LIB3476-048-P1-K1-H11
gtcgctgtggcgcactccgagtggtcgcagcacgcccacgttgtgtatacattaacctgggatatcatcatacgattccggtactaggggctctatcattctggtcgccgtca

SEQ ID NO: 17802 - DNA, 263 bp, Sorghum bicolor
  Clone ID: LIB3476-048-P1-K1-H4
gttcaatttttttggtgcttgtgtagcactagcttggattattcctagtgctgtaaacaaaatcctgtggtcaaatttacaacagagtggaaactggacagctcttgcgttaatgtggaagacaaccccaattaccatatttttctttgttgttttgatgccactgttggatcctccaggccttttatctttcaattgggacttgaagaacagcagcgcaattatcacatctgctttgttcggtttccttcttcagtggtctg

SEQ ID NO: 17803 - DNA, 336 bp, Sorghum bicolor
  Clone ID: LIB3476-048-P1-K1-H9
gcgagaagtgagaaaactcaaatgaccatgcagcacaaagagtctgcgagtgaatggcaaattgatgtgaaaagaatgctactaatcacatccatcaaatcatgtatcacaatcccaagatctataaaacatttagctacatctgccctgcaggccaaattctaatgcgcagcatatagatatataaacggtttatgtgaaaaatacttctaagcactactagcatcttatgctttctttttaatgcttgtacattccgcttgaactactaaagtatagtacttcacctctatttttgcaaaaaaggctgtatccatggttataacaaaaagaaag

SEQ ID NO: 17804 - DNA, 250 bp, Sorghum bicolor
  Clone ID: LIB3476-049-P1-K1-A10
attggagtgagatcaaacgcccatcttgactggtggcgaccattaagtcccgacttctctcactatgttttcacttaaccctagccattacactggctacaagtgtttctgggcttgttcataataaggtgattgatctaaagctacaacccaaaccaataccgcaaccttgaccaaagactgtgccacaaccagacccaaaggccgaaccccagccaacaccgcagactgacccaaaaaccacaccaca

SEQ ID NO: 17805 - DNA, 173 bp, Sorghum bicolor
  Clone ID: LIB3476-049-P1-K1-A2
cggacgcgtgggtccggacgcgtgggcgtggccacacacagagggtgacagacatggctttctttgctgaggatgtccatcgtttggcaagcgcgagcgtagatgggcggatatatgtgtggaggatcgatgaaggacctgatgaagaaaataaaccacaaattactggaaag

SEQ ID NO: 17806 - DNA, 419 bp, Sorghum bicolor
  unsure (1)..(419): unsure at all n locations
  Clone ID: LIB3476-049-P1-K1-B4
ctcgtcgttctcccgtgtccgccgggcgctgtctgtctctggtggcgacgactgggcggncactgccgccgncgccctacgccaggttcccagccctccatcttccgtaccttcgccggcgacgagcagccgccaggagggcctcgccaccggttgggagggaggcggagatgagccgggggcggtcgccggagccgctggatttcttcatctggactgtggaggatgtagggttatggttggaggaaataaatcttggaagctatcgacaggcttttgaagagaatggcgtcaatggagagtatctagaaagcctgtcgatgttcactactgaacagattcttcgatttataagacggtgtcatatgaaatggggagatttatcaccctctgtaaagagtngagacgcatcaaagttg

SEQ ID NO: 17807 - DNA, 241 bp, Sorghum bicolor
  unsure (1)..(241): unsure at all n locations
  Clone ID: LIB3476-049-P1-K1-D2
tttgaggaattacctgttcaggtggagctgcagcgcaatttgccgccaccagttgacggtggagtgccacgcatcgtgagctntgccgccaagtactgcaatcagcttcttgatcagccgtatcgatctgtgctgacacaggtgatcaccatccaccgcagctggcgcaaagaagtgttcaacgacaagatgctggttgaggcaatgcttagtatcattaagacgctagagataaactttg

SEQ ID NO: 17808 - DNA, 134 bp, Sorghum bicolor
  Clone ID: LIB3476-049-P1-K1-E6
cattgattgctaagcaccaagctgagggctttggcttaacacatacattacattgtactacttatttggcaaaaaattcagaaatggctagccaaccatacccacatggaaattattaatttgtgacacccggg

SEQ ID NO: 17809 - DNA, 184 bp, Sorghum bicolor
  Clone ID: LIB3476-049-P1-K1-E8
catccaattgcgtttggacccagctagcagtagcactctttccgccagggggaatgggtcaatcacacaaaggcttaatgttacccacaaccagcattggccgaaaccactttcaatgcgtattccgatgtcttataaaaagaattgtgaggaccagcttgagcaaaggcgaataaacaatttt

SEQ ID NO: 17810 - DNA, 411 bp, Sorghum bicolor
  unsure (1)..(411): unsure at all n locations
  Clone ID: LIB3476-049-P1-K1-F6
gcccccaccgcgcctctccatcactcccccgacgccatgactctgtagcggcacgcagcaccgcaaagccagccaccatgggcaggacgagaggcagcaagagcgccggcggcgtgaggtcgttcccgtcgccggcgtcgtcgtcctcggcgtcgtcgtcggagttcgagttcacggtcacgctgtcgccggcgtccaagcagcggtcggcggagcagctgtgcccggcggacgagctcttctacaagggccagctcctgccgctgcagctgtcgccgcgcatctccatggtgcgcacgctgctgctgtcgtcggcgtccacgttctccgcctccgcgtccgactccacctccacgtncaactcctcccgcgactccaacggcagcacgtcgtcgtccttctccgcggact

SEQ ID NO: 17811 - DNA, 418 bp, Sorghum bicolor
  Clone ID: LIB3476-049-P1-K1-G6
cggacgcgtgggtgcaacctcaaattatctttcctcgatctatcgaataactcattatctggtctgcccgctgaactaggtgaaatgactaccctaagaaagcttttgcttactggaaatcctatgaggacacttaagagttcattggtttctggaccaacgacaacattgctgaagtatctgcgcagtcggctttcgtctgatgaggaagcatcacgatctggaagcaccccgacaaaagatgaccaaattgctgcagcaaggcgattgtccttatcttcaaaggaactggacttgagcggtcttggtgtgaccagtgtaccagctgctgcgtgggagacaagtgatgtggtgaaactggatctttctaaaaattcaatagaagatctaccaaacgagttgtcattatgctcatcac

SEQ ID NO: 17812 - DNA, 373 bp, Sorghum bicolor
  Clone ID: LIB3476-049-P1-K1-G9
ctccgatccctcgacatggcggccaccactactaccatccttctgctcctggtcgccgacaccgccgactggcggccgacctctcctgtaccactcgtgcacccgcgtcccgtcccgctcgagtcaatatcggctcgcccggccgcgacccgcggtccttttctttatcaaggcgggtctcgtccggggggtactttcgtcccgtgctccggcagaccccgcctcgtacgtgtccggcgggctggcacccggtgcagcacttcctctggcgttgaaacagggcggcgccacctggcgcactgcgcccgtgcgacacgtgccccgcggcagccgcttaatcctgcagcttctctcgtacgcctcctcccgtgcg

SEQ ID NO: 17813 - DNA, 180 bp, Sorghum bicolor
  Clone ID: LIB3476-049-P1-K1-H4
ctggattcaaaacgtttttataagaatctagaactctaccaaacgcacactagtcagtactaatggtgtatatggtttatctactaaacctttgtgatgagctatggtctatttggtggtgtatcgggggtaatggatgggttggaaagtgagaatgctatcttctatttttactgggtc

SEQ ID NO: 17814 - DNA, 397 bp, Sorghum bicolor
  Clone ID: LIB3476-049-P1-K1-H7
gcagtgaagagggtatttcttcaattgatcctctgactagtatgccagacccgcaagttggtttgacagtggggccagagctggtactggtaagtcaggaaaaaaaaggcgaagaggatatttgtttcattgacgctccaacttgcacgccagaccctcaagttggtttaacaatggacattcatgagcaaccaaatgtcagtgctggtgcagatcagtgcaacgagaattgcacttcgaatataacacctaacacagcttcaggatcgaaatacaagttctcaggaaaatgctatgagcgggttaaaaagggtgctcgcccaaggaatgtctggcttagagtttcgacccaaataataaccagggtggatccactagagctttggatgaaggatgc

SEQ ID NO: 17815 - DNA, 145 bp, Sorghum bicolor
  Clone ID: LIB3476-050-P1-K1-A2
cacctggtagtcacactcctcaagagtggcccctgatgcatatgttgcattctcttatgacgttacttttgagtccagtgatatcatatgcgcatcttgatgagatgtataccttcttatcagtgatagtcaaatcactgctctc

SEQ ID NO: 17816 - DNA, 250 bp, Sorghum bicolor
  Clone ID: LIB3476-050-P1-K1-A3
aggagcgacagcgctggcggcactgaggaagacgccgtcctgcgcgcgtacgtccggcagtacggaccgcgcgagtggcacctggtgttgtagcgcatgaacctggtcctcgaccgtgacaccaagtcctgcctctagcgctggaagaactatctgcgcccatggatcaagaaagggtcgctgtcctaggatgatctacgcctggggatccccctgtaggcctagcgcggttgcaagcggtagatgatcg

SEQ ID NO: 17817 - DNA, 379 bp, Sorghum bicolor
  Clone ID: LIB3476-050-P1-K1-A4
ccctttttagtttttgcaatcactagcttgtactgttgattctacattcctgttacatagctaaaaagtggtccttactgaaaataatatgcaattgtcaacttatatgcattgatgcaaggtttgtgtagacatctttgcgacagattatgtgcttagatttctatggtcgtgctgcatcaggttccattatatatctgtttgataaaccagtttgaactatttcacatgctgtcagtacattcagttggtaaaagcttcaatgttatcgggttggatttgatttgggagttcattgtgcctatggactgtttcaaagcccttactatatctaattagggccctgttggatccaagggcttattactagctctaaaaa

SEQ ID NO: 17818 - DNA, 383 bp, Sorghum bicolor
  Clone ID: LIB3476-050-P1-K1-A5
tccaaggttacaccaggtattttgagcccctttatgattcttcatttgagctgtacatatgtctgcttgctgctgctattttagcagccacatctcaaataatatataggtagtacgtatagttgtacatatgttgctgcaacatatagctgaatatatgatgttgctgctgctagccacatctggaatggtatattgtgcgctgtacatatagctgaaggttttctataaaatgttatatgagattgcaaatagatgtacatatgctgttattttctaagatatgttgctgatgagattgcaaatagctgtacatattttagttcaaattgcaaaatagctgcacatattttagcatatgctactatcttatgaaaaaacaa

SEQ ID NO: 17819 - DNA, 308 bp, Sorghum bicolor
  Clone ID: LIB3476-050-P1-K1-A6
cggacgcgtgggtagttcatgacctagcatggaccacaaatgcaatgttcctgaactcagttgatagatgcaatgaccttgtagcgtctgcatatgtaactgctggtcataccagagtcatgttgctccatgactcacgtagcgaagatggaataatatgctgttgtcaggaggtccatgaactgtacatcaagatattgctcaacccgatttacctgaccggttctcgtatcacatactcttatatcgataccaaggtcacggtcctcgcatggaagtacctgtaatacgggcatggaggatttcac

SEQ ID NO: 17820 - DNA, 307 bp, Sorghum bicolor
  Clone ID: LIB3476-050-P1-K1-B10
ccgactgcgttcgacgatctcctggccgcccgcctgtctatcctcgtctctctcctctgcgatcgccgtcatgaacaatctcctgacggttgcctatgagctctctcgacgagactcctccagagatgcgggcattgatatggctatgcactaagccgatgcttcagacaacttgaaggatgtcttgacaaatgtcagtgcaattgagaggctgattgctctgctgactaatctattgactgagcttgaggctgccaatgccgaatccaaagcaggttccatagcaggttccatgcaagcgattgag

SEQ ID NO: 17821 - DNA, 246 bp, Sorghum bicolor
  Clone ID: LIB3476-050-P1-K1-B11
cccacgcgtccgcactactccaccaggccaccgtcaccgcgcaccgctagttcgcgacgccagcgcccccagcctagctccctcactcctgccgcgctccccaccgtgccggacaagcgacgcgacgccgcgacacgcagggagagggaatggccacgcgcactgcaccgcccggggagagagagcgctgcgtgtgtgtgtttgtgctgcgtggctagcgcgatgcatcgcgatcgatcctgccgc

SEQ ID NO: 17822 - DNA, 133 bp, Sorghum bicolor
  Clone ID: LIB3476-050-P1-K1-B5
aggagaccacactcgttgtgtggaggatgcacacacgggaagatatggagaccactttcatgggtacaggttcatctcagacgttaaaataccgagaacgtgaagaccatatatattaactcatgcgcacgag

SEQ ID NO: 17823 - DNA, 255 bp, Sorghum bicolor
  Clone ID: LIB3476-050-P1-K1-B8
gtttgttggcaaagatgatactggaaggaggatggagattattgaaatacccaaccaccgatattttgttggtgcacaattgcatcctgagttcaagtcaagaccttcaaaaccttccgccctatctgtgggactaattgcggctgcatctgggcagttggatagggtgctgcaagactgctgcaatggtcatgttatttcagctaagcatgttctgagcaatggctcatatacacccacagtacaccaaaatgg

SEQ ID NO: 17824 - DNA, 515 bp, Sorghum bicolor
  unsure (1)..(515): unsure at all n locations
  Clone ID: LIB3476-050-P1-K1-C2
aagcgtacggccccatcgcgcgggcccgcgtcgacgcctcagcggccaccgggtacgtcaccttccggtccggtgctgccgccgtggccgccattgccgcgtccctcgaccccggtggaggcatcgtcatcggatccaagaaggttttagttgtacaggccagcgcagcaccacataactcaataagggctgctgaatccgcagggcgatcgtcgcacgatgcaacggtgaagaacgtgactgataattcagccatgctgagctccaaagcagcttctggagtgacttacaaggcgcgggaaatagtcgcttatgatgatctgttctagatttctagtgagtgtgggtagttaaagagttttccaagggacaaaccagcgttgtcaccttcgtacaacctagtaagaaactgagagctgcgcacatgaacctctgtaatcttaattaatctagccacaatgttcgtttaagaaaaaaaanngtatttnttctatacttattatatatataaaatt

SEQ ID NO: 17825 - DNA, 373 bp, Sorghum bicolor
  unsure (1)..(373): unsure at all n locations
  Clone ID: LIB3476-050-P1-K1-C3
caggacgccgaggagcgcgacgtccccgacaggctcatggcgctcgttgggatcggtgattggcgagccatggagcaggatgatgctggggaccacgaggaggactaagatgatggggttcatacacaagtgacattttctatctaattcangccttgtttagatgcgaaaagattttggatattgtttcgctactagtagcactttcgattgtttatggtaaatattgtctaattatgtattaactaggatcaaaagatttgtcttccgatttacaggtctgtgcaattagtttttattttcgtttatatttaatgcttcatgtgtgccgaaagattcaatgtgacagggaatcttgaaaacattgtggttt

SEQ ID NO: 17826 - DNA, 292 bp, Sorghum bicolor
  Clone ID: LIB3476-050-P1-K1-C4
attgacttacgtgaggtcgacctatgcatatggctgcgctaccgcatcacacatcctgtgagacaatgcatatgcactgtggctgttatggcgcatatgtgagatcaggtatgctctgtccaggctcatggatcatttcccatagtggtcccgactcgaccgtgtaacttatgatgataggctggctttaacgtctgaccgacaaggtgaaccgtatcaattagctcctgtagacatgtatgtccgtactgcggatgctatgaaggagccttctcttgtcactgcaaatact

SEQ ID NO: 17827 - DNA, 325 bp, Sorghum bicolor
  Clone ID: LIB3476-050-P1-K1-C7
gcggccgacaccttgcatacgcgagccaaacgcttctgacaggctcagtctccacactagtgtatccgcaatggcgcacggatgatccacgagtggcacagtctaccagctccaaatacagtacttactctgcggacggtataacgaggcatagctgcagcgaaacaattcagtggacgacccatagatgaaattccactgcagatcgagaaagatctaccgtcccagggacttaatgaatgacagaagcctcatccaggctgtgtgcttgcacgctacgatgatgctacgacagctagctaattaatgaggtacgaggtgctca

SEQ ID NO: 17828 - DNA, 301 bp, Sorghum bicolor
  unsure (1)..(301): unsure at all n locations
  Clone ID: LIB3476-050-P1-K1-E10
agatcgtgtcatgtgcagcctcttcttacacaggctggtgccggctgctaggctcctcggtcattgacggccaccggccggatgaaggagctcgtcatctccaccagctccctccacaacgtgttgaactgttgctgcatccaagagcaatggggctgcttgcaccagctggcttgagctactaactggagttgctaggcaggtactcaactaccactactaatgctatgcaactgaagtcaccatgcanatagaaggcgaggaaggaaatgtgacatctaaaactgatctcacccaacat

SEQ ID NO: 17829 - DNA, 371 bp, Sorghum bicolor
  Clone ID: LIB3476-050-P1-K1-E3
ctcggtgtgactcggtgtgatccattagcaatgcaagcactaccagaatatttgagttctccgagtgggtgggattctcctagtacttgatagttatgcagcttttagcatttaagaagagttggtttactaccccactcccgactaattgtctccgagtaattatttccgtgtgcccttgcacagttggtaagttgctctttactgcactaggagaaatgcatcaatctggtagtgaagcaagctacattggcattctatgcaatattgatgcgttcatttagagaaaaaatgtttctatgcttgcatacatgagtttctatacataacaattatgatttggcaatctgactaaataaaatatctattta

SEQ ID NO: 17830 - DNA, 278 bp, Sorghum bicolor
  Clone ID: LIB3476-050-P1-K1-E4
attcctcgtactcaaatcgacctatctagcgaatccctccttccacgcagtctcacccctacagcatcgatggcgcccaatgcggagaagaagccggcggcgaatatagcccgcggaggaggagcccgcggccgagaaggtcccggctgagaagaagcccaaggcggttaagcgcctccccgcgggcaagtcttccggcaaggagggctgcgacaagaagggcacgtagaaggccaagaagtcgcgtgatacctacaagatctacatcttctaggtgc

SEQ ID NO: 17831 - DNA, 307 bp, Sorghum bicolor
  Clone ID: LIB3476-050-P1-K1-E6
gagcaatgatacattaatggtcaaagctgagacagtggctgctggttcattgtttgatgattggttttcctcacgcaatgttgaagatgaagactggccttaaaaaattcctggtcatgcaagtgttaatgactgtcaaacactttctgccaagaccgaatcaaatgctcgaattaggaatgcagctgacaagaggaaaataaaaactgttcaagacaagtctggtggctagtttggcaaagttgtagtgccatacatttgaacaaagcttttcataaagagactgaggttttatgcattcacaagt

SEQ ID NO: 17832 - DNA, 295 bp, Sorghum bicolor
  Clone ID: LIB3476-050-P1-K1-E7
agttgtcagagtatgacgcaggaggagcattttagggacagctactcaactttgtcaactctggagagatctgccaagccaatacatgggaactgacaaggactgatgatgagcagctcatcgtcaaaggcgtatagagcgtagtaggaatccaaaatcagatcaatttcaggcggtcaggaaagagcccaactgaaagcctgaccgaggtaggcgaaagccaaggccaaggcttggagcacacatacgacgccatggacagggacagcaactcggtgttcgacgggagctctga

SEQ ID NO: 17833 - DNA, 233 bp, Sorghum bicolor
  Clone ID: LIB3476-050-P1-K1-F7
ctcacgcgtccgacaatcacaaaatgcccagtcgagaaactcactcttaacaatcctctactggaacccctacatcgcctggtcgtacgtgagcatacacgacggcgaacatgatgttcacggcgggttcattgacaaggtgaaggacttcatacaccacatcggctagaagatcaggaggcggtcgggtccgcaagcccacggacgacgtctgcagcatcacatccgacatc

SEQ ID NO: 17834 - DNA, 310 bp, Sorghum bicolor
  Clone ID: LIB3476-050-P1-K1-G11
cggacgcgtgggggaaacacatgatggcgtgagcaaagggaagtataccattgggcttgggcaggaaagtatggcattgtgcactgaagttgaggatgctatttcgatgagctagacagtggtgaagtccctcctgaaaaattataacattgacccagagtgcattggacgttcggaagttggcagtgaagacagtaatagacaagagcaagtctatcaagacatggctgatgcaaacattcgaggaatctaggcactactgatatagaaggagttgactactgaactgcatgctatggagggacagctg

SEQ ID NO: 17835 - DNA, 120 bp, Sorghum bicolor
  Clone ID: LIB3476-050-P1-K1-G5
ctcctcgcgccgcatccatccttccgttccctctcgatctctctgctgtctcgcgggtcgcagatcccggtcgagcaagaagcaagccggcgccagggccagcgcacagaggggtgtgat

SEQ ID NO: 17836 - DNA, 277 bp, Sorghum bicolor
  Clone ID: LIB3476-050-P1-K1-G6
ccgcgccggccttatccattcttctgtgcccgccggctctctaacctacctatcgaggtcgagatccccgtcgagcacgacgcaagagcagagcccgaggacacaccagaagaacatacacgtcctataccgatgcgaatgagaagagctcgcgcctcaaagtcgcgctctgctgcgaaactacacacctctagttgatgaactggcggagattttactaccgcttgccgtacctgttcatcaacaaggcccacgacatgctggtgcagtacgtggc

SEQ ID NO: 17837 - DNA, 364 bp, Sorghum bicolor
  Clone ID: LIB3476-050-P1-K1-H10
cttgctcaagtcatcttcctcctctagccacccccagcctgccttgtcatcccactaatctgcttcctgcactccattgcttctgaaaaagctcagcccgcccctcctcccccggtgcattttgttggggtggcgtagactgcctgcaggccggcagacactactgcagagcaaggcaggcaggcaggcaggcatgaggcttcctctgctgggcgccctggtgtgctgcgccctgatggcgtggcagcattgcgcggcggaggcggccaaggcccggcacttcaagtgggagatcagcaacatgttctggtcgcccgactgcgaggagaacgtggtgatcggcataacggggcagttccggccc

SEQ ID NO: 17838 - DNA, 283 bp, Sorghum bicolor
  Clone ID: LIB3476-050-P1-K1-H3
gcggccagcttcctcctcctcctccccaccaaggcactaaggccaggcccggtcggctcaccgcctcggtgaccgccgccttctttgacgcctgcctccgacgctgccgatacgccaaatctccgtgcgtgtttggccgaaatccacgggaggtgctcgtcctcgtctctgctccggagcggagctgtgcctacttgagttcaggtttgtttcgccatccgaggccggccaagattcggagcgtcgccggagggaaggcgatgaaagggaaaggcggggcgat

SEQ ID NO: 17839 - DNA, 212 bp, Sorghum bicolor
  Clone ID: LIB3476-050-P1-K1-H4
ccgtggccaccgcgtgggacacgccataactggctgcgataattggatctccgcgcacgccgaccagggcattggactcctcccgaaccctagctgcggcgcctccactgcctccaactacaaggtcggcatcgacgacgatgacttcgaggcttgtgtgcgtaggatttaggtaggcacacatgtttcccaaaacagaactcgctcgacct

SEQ ID NO: 17840 - DNA, 273 bp, Sorghum bicolor
  unsure (1)..(273): unsure at all n locations
  Clone ID: LIB3476-050-P1-K1-H6
cgcgctcttcccgcanacccctcagttccgctccacattgccctgctcccccactccaactggcgtctgcttgcccggtgaatgcgaccgcacgccagagcatgccccgcccggagcccgagctagggttcctcgctgcccccaccgtccccgcccgcgcgtgcaagccgacgccggagcgccgccgtaagaagcagccgccgacgaggcggaggcgaccgcccggtgccgcaccggtggggccgggaccacgcggggcggccgatccagatc

SEQ ID NO: 17841 - DNA, 388 bp, Sorghum bicolor
  Clone ID: LIB3476-051-P1-K1-A3
cggacgcgtgggttatcaagaagatgtgcgaggagactaaagcgcgcatcaaaatacttgatggcccgcctggtgtgccagaaagagcagtaatgatttcagcaaaggatgaaccagatgcacctctctctccagctgtggatggcttacttagagttcataaaagaataactgatagttcaaatggtgaatctggtcagcttcaacgaagtgctggtaatataggaccaacacgtcttctagtgccatcttcgcaagctggcagccttattggcaagcagggagcaactattaaatcaatacaagattcttctaaagtccgtgtccgtattgttgagaatgtgcctcctgttgcactaaatgatgaatagagttgtggagatacaag

SEQ ID NO: 17842 - DNA, 403 bp, Sorghum bicolor
  Clone ID: LIB3476-051-P1-K1-A5
aaaccttaccacaacatatatatgtcgaacggcgtatcactacatgagctgtcaatttcactcttgaaaggtcaaaagatgtcaaacagacaaagtgatgacttgtgcagcatttgttcagatggtgggcaactactgctttgtgatacctgtccaagagcttttcacagagaatgtgttagcttatcttctgccccgaagggaacttggtgttgccgatattgtgagaatagacaacagagggaaagttgtttggcatataacaacaatgcaatagctgctgggagggttgaaggagttgatgccttggaacaaatatttacacggtcaatacgtattgctacaacaccttgagacttgattttggtggtgcgcactgtgcaagctccatgatttagcaaaa

SEQ ID NO: 17843 - DNA, 526 bp, Sorghum bicolor
  Clone ID: LIB3476-051-P1-K1-A8
ggattggtgcggcgtggagtcgtcagtggagctccatctatccggactgactcggatcgaccgctcctctctcgggttgtggagtttgatcagttctatcagaggagtgcttatggatgattgcatggctgtagcttgctaggccctgctttcctgtttgtagagatacatcatggcaccacgcagtagggcttcatctagaaggcctctctggatcattgtcttggtcgcttttgtttgcgcagtagcccttggagcctatctttatactccacggcattacacagcctgttatctggtaccatcagaagcctgcaattctcggccgcctccagaacctgctagggtatacactgatgatgagattgctgctcgtgctatcatgagagacatcattcgggcacggccagtgcagtcaaagaatccaaaaattgcttttattgtcttgacacccaattcgttgccatttgagaagctatgggaaaaattcttcatgggtcatgaagacagatacaccatattcgtg

SEQ ID NO: 17844 - DNA, 466 bp, Sorghum bicolor
  Clone ID: LIB3476-051-P1-K1-A9
tgttagagcacgtgcattcgctaagaaattattgaacgcccgtttagctattgttgataaaagaagacagggtcacaacatgtcagaggtcatgaacttaattggtgatgtgaaaggaaaagtggctatcttgattgatgacatgattgacacagcagggacaatcactagtgcagcagctttgttaaagcaggagggagcagaagctgtatatgcttgttgtacgcatgctgttttcagccctcccgcaattgaaaggctttctggaggtgtctttgaggaagttattgtgacaaactccatcctgctgccagaagacaaatgcttccctcagctgacggtgctttcaatggcgaaccttgtagccgaaacaatttggcatgttcatcgtgatggctccgtcagcagcatcttccaataacagaaacgcctatcagctatcatcaactcgtcttaccattcgtgt

SEQ ID NO: 17845 - DNA, 467 bp, Sorghum bicolor
  unsure (1)..(467): unsure at all n locations
  Clone ID: LIB3476-051-P1-K1-B4
gccgctgctgctagcgcctgtgcttcgggcgggctgctgctggtgaccgagaatcatttcagtccagtccagagaagggtcgggggtgcggcgagctagctgcctatagctaccatggccgcggcgttcccggcctcggccgcgctggcggcggtcgccgtggtggcgctgctgctctgctcctgcaatgtggcgcgcgcgcagacgccggtgttcgcgtgcgacgcgtcgaacgcgacgctggcgtcgtacgggttctgcaaccggtcggcgtcggcgtcggcgcgcgcggcggacctggtgtcgcggctgacgctggcggagaaggttgggttcctggtggacaagcaggcggcgctgccccggctgggcatnccgctgtacgagtggggtccgaggcgctgcacggcgtcttctacgtcggcccagggacacggttctcgtcgctggtgcccgtcgccaccagc

SEQ ID NO: 17846 - DNA, 476 bp, Sorghum bicolor
  Clone ID: LIB3476-051-P1-K1-C2
aaaggacccactcgaaagggctgttcttgatggtcgtcagcttgcactgaaaataagtgcaaactcagtttatggtttcactggagcaactgttggtcagttaccttgcttagagatttcttcaagtgtgaccagctatggacgacagatgattgaacatacaaaaaagcttgttgaagataaattcacaacagtaggaggttatgagcataatgcagaggtaatttatggggacactgattctgtgatggtacagtttggtgtttctacagttcaagatgcaatgaagttaggaagagaagctgcagattatattagtggaacctttaccaagcccatcaagctggagtttgagaaggtctattttccttaccttctgatcagcaagaagagatatgctggtttgtactggacgaatcctgagaaatttgacaaaatggatgcaaaaggtattgaaactgtgagaagggacaact

SEQ ID NO: 17847 - DNA, 529 bp, Sorghum bicolor
  Clone ID: LIB3476-051-P1-K1-C6
ccagagttctctggactatctctttgcatttgcggctttggtcttctgtgtaatcatcaaagcgattgcaagaattgagggaaagtcaaaagttttacgctatatattcgggggactttctggtggaacctctagtattccatcctgttatggagatttggatgaaaactattctagtatgaatggaggtcgccaagatggatttggcaagcttcatggtggataccagagacgtacaccaagaagaaactcaccttttgcaggctcagcgaagacatcgtcgccaggtgttgctagcgacagcttctattctacatttcacactaccccagagaggaggaaattctcaaaagaggaatacgaagcattcacgagagaggagacaaagaaagctatgaagcaactgttgtcatcaccggatttcaacaggttggcgttggctaacgcagacagaatatctgtggctccaccaggaggaagctacagcagcagcaacagccagcagcggcatcgtttttgggactgtttg

SEQ ID NO: 17848 - DNA, 532 bp, Sorghum bicolor
  unsure (1)..(532): unsure at all n locations
  Clone ID: LIB3476-051-P1-K1-D12
gcggcgtccgcggcccgcccacctcccgcccggtcccctccgctcgcctccctggtcgacgcggtctcgaccaagctcggtcccgtgctgcagcggctacgcgagcacgacagcgaggtaggtgccccggtaattaccgcctctgatcgtctttttctgcccttggatgtttaccggggttaaaaatcagtatgaaaggataaactttaaaagctggtaacatgaatttttccaaaaagctggtaacatgtcagggttcgggtcccactcccacccttgattaataactggactggtctccttggtgtggaaatattggataaaatttggcgtgcacgtagcatgcaccgatgacctgtgattagaagccctaaatccgtgagctacctgatttgcgaaatggcatatgagtaggatgancttaggttgcacaatgcagtgtagcaccggtttggaggtggggagaagcgcatgcaaacgcttcatttttctttgattcgtacaataataataataatagctgcttgatgct

SEQ ID NO: 17849 - DNA, 450 bp, Sorghum bicolor
  unsure (1)..(450): unsure at all n locations
  Clone ID: LIB3476-051-P1-K1-D2
cggacgcgtgggtctgcatctccaagcttgtgtttctcctgctgctctgcgccaggatgctgcttcttccggcgggcgtatcctctgcaaagatccatgggaacccagccaacgaccttgtggccctcatcaacggcaagagggcggcgagcaagctgcctgcgctgcgcaacagcagaggcctcgggtgcatggccctgcagtacatctccgagtgcatggccacgggcgccgcctgcagcagcggcaacacggtggcgtgccagcctcccgaggcccacatcacggaggtctacgctgccaactgcggcgtggagctccccacggtggacgtcatctccggccgnctcgtcggctgccaccgggaccgcgacggaccggaggacgcgctgcanngcgtgctggcatcacccaccggcaacggcaacgcggcaacagaccaccaccaat

SEQ ID NO: 17850 - DNA, 404 bp, Sorghum bicolor
  Clone ID: LIB3476-051-P1-K1-D3
gagcagactaccaagccttgtggattttaagactagtacaaaaattgatgccttgagagaggagataagaaacatgattgagcacgatggttctgccaaagggattgtcttcagccagtttacatcattcttggatttgattcagttttccctggagaagtctggcatcaagtgtgtccagctgaatggagccatgaacattactgagaaaggaagagccatagacaccttcacccgtgatccagactgcaggatcttcctgatgagcctgaaagctggcggagtcgctctgaatcttactgtagcatctcatgtgttcctgatggacccttggtggaatccagcagtcgagagtcaaggcgcaggatcgtatccatcgaattcggacagttcaagccaatcaa

SEQ ID NO: 17851 - DNA, 346 bp, Sorghum bicolor
  unsure (1)..(346): unsure at all n locations
  Clone ID: LIB3476-051-P1-K1-D8
atccggtccgcatccggtcctgtgctcaactccggatggcatctgccgtcgccgtcgccgtcccggccttaggcagctccaccgctccgatccttggacaccaccaaaatcaaaagtggtcgtgcggccttgtgcctggacggtcgtcgtctgccagagacagagacagagtcggtggagtccgccagcgcaagatccttgctctggtggtgccgccgcccctcgtttcggcgtctgaccactggggcaactggaccttcctcctaagcaccgccgcgctgggcatctggtcggagaagcggacccccgtgggcaaggcgctgagcggngcgctggtgagcgtcct

SEQ ID NO: 17852 - DNA, 463 bp, Sorghum bicolor
  unsure (1)..(463): unsure at all n locations
  Clone ID: LIB3476-051-P1-K1-E11
cccacgcgtccgcggacgcgtgggtgccggtgcgtgcgtggccgctcgcaaagccccgccccggtgcaccgcatcgcactcaaccacgtccacgcaccatgccgcgccgcagctgcctcactttcaccaccaccaccagcagcagcagctactgccgccgcgccatgtgctcgccacctgcgcctccgactcctcctgcaacgcactgactgacccgccgcccagccagccagccagacgacgacagacagcgccagccacgaccaccatgcgggcgcggcggcggccgtccactgctaccccggcgcctgctccgtccgccgcctccgtcagctcaccgccttctccctacccggcggcattcgcgtcgctgggtccagctccgtcgccgggtcccggtccgggtccaggtccaggtcccgccccggcgccccgagccgtctgctgggcggngttcgtgggc

SEQ ID NO: 17853 - DNA, 499 bp, Sorghum bicolor
  unsure (1)..(499): unsure at all n locations
  Clone ID: LIB3476-051-P1-K1-E12
cgaccaaatgtacaagctgacgtacccagcgccgggcgcgccggacgtggccaagagggccaagcagctcctcgaggacgccgggttcgggccggtggccgaggaccgccgccgcgggctggaccacggcgcgtgggtgccgctgatgctcatgtacccggaggccaacgtcccggtgtgccagctctcggtgcagaccgaccgcgacgccacgtaccactacgacctcggcaaggcgctggcgccgctgcgggaggacggcggcgtgctcatcgtcggctccggcagcgccacgcacaacctgcgccggatcctgcgcagcttcgccccgaccagccacgagccggcgnncgggtgggcggccgagttcgacgcctggctcaaggagtccctcctcggcggcaggcacgaacacgtgaagcgctaccaggagaagggcgccgtacgccgaggggcgcacccgcggcccgaccacttctacccgcttgacgtcgcgctc

SEQ ID NO: 17854 - DNA, 471 bp, Sorghum bicolor
  unsure (1)..(471): unsure at all n locations
  Clone ID: LIB3476-051-P1-K1-E5
tgtcataataactcgtattggaggtttccttgaacttgaaattcaagaatggcaaaaggcaatatactcttttggtggtaatgaagtaaaaaagtggcctgtgcagttacggcgatccatacctgagggtattccacctagttcaaatggtcctacactccagcagcaagacatggccttaattcaagatagaaacatgccttcctcaccaaacccattgtacagccctcattcaaaatcaagcttcatgaaaggtgcacttggacaatctggcaacaaaaagcagatccttgtagaacaaaccggaatggatacttcaaggngaccactgcacttagttcgcagcatcaatttggttgcagtttcccaagatcattcgttgcatctcacatgccanacagatctgttgacgagacctgcttttggcgaagggaatcaaggcagcagtggccctttcgagtactttggaag

SEQ ID NO: 17855 - DNA, 446 bp, Sorghum bicolor
  Clone ID: LIB3476-051-P1-K1-E8
caccccaccttggagcaagtactgtcgaggctcaggaaggcgtcgctatcgagatcgcggaagccgtggttggtgcgttgcgaggggagctcgcagccacagctgtgaatgcgcccatggtccctgctgagatcatgtcggagctggctccatatgtttctctggctgagaagctcgggaggctggcggtgcagctggtggccggcgagagtggcatcaagggcgtgaaggtggtgtacaccacagcccgtggccccgacgacctggacactcggctcctccgcgcaatggtgaccaagggcctggtggagccggtgtccagcacattcgtgaacctggtgaacgcagactacgcggcgaagcagcgcggcctccgcatcacggaggagcgcggtcgcgcacgacagcccggcagcggaggcaccggctggagtccgtccaggttc

SEQ ID NO: 17856 - DNA, 300 bp, Sorghum bicolor
  Clone ID: LIB3476-051-P1-K1-F1
aaaaaaaaaaaaaaaaaaaaaataataaaaaagggcaaacaaaaaaaggggcggcacgctctacaaagctcctaaccttacataccctaagcgggcggatgggggtcctcttatttaaagtcactgtccttcaattcactgcccggcgtcttacaacatcttgactgaaacaaacttaatgttcctcaacctaatcaccttacagccagtccgtgttataccagctgggtccataactaacaggcttgcaaacaactcctcttccaacatggggactgacagactggctgatgggacgca

SEQ ID NO: 17857 - DNA, 458 bp, Sorghum bicolor
  Clone ID: LIB3476-051-P1-K1-F12
cggacgcgtgggcggacgcgtgggcggacgcgtggggctcgagatcttaaaactggcaagtttgtcgcactcaaaaaagtgcgttttctcaatgtggatcctgagagtgtgcgctttatggctagagagattcttattctacggaaactcaatcatccaaacatcatcaagttgcaagggatcataacatcttctttttcacaaagcctgtatcttgtatttgagtacatggagcatgatcttgttggtcttgctgcgaccacaggccttaagtttactgagccacaggtcaagtgtttatttcagcaattactcagtggccttgatcattgccacagcaatggagtcctgcatcgggacctaaagagttccaacctattgatggataacaatggtgttctgaagattgcggactttggtctagcaacctcaattgatcccgacaatcagcaaccact

SEQ ID NO: 17858 - DNA, 419 bp, Sorghum bicolor
  Clone ID: LIB3476-051-P1-K1-F3
gcggcagcggcgtgggagtgggatgcgcaagcgggcgggacgaaagcgcgtgctccacaccctttgtaagcgcgccgtccagccccgcccgcgacccgtcgttctccgctgccggttgcttctacagcgcgccggcgagccccgcgcgcggcggccccggcaccgcggacgagtatgagtatggctgcgagctgggattcgacttcgacttcgacttctcctcgcgctgcccgtctcccgccgcggcggcgatgtcctccgccgacgagctcttccacaacggccagatccggccaatgcggctcgcgtcgttcctgctccgcccgcaggcgctcccgcctctcgacggagacgtcccaccgccgcacagccgccctcggagagccggcgcctgcgggggccgaggcggacaacgcggc

SEQ ID NO: 17859 - DNA, 410 bp, Sorghum bicolor
  Clone ID: LIB3476-051-P1-K1-F8
caccattcatctccgcctcggcctccctctcccctccctcggtccctctccgctccaaaccccatccatggcgaccgccgccgcggcagggagcaagaggggcggcgcccggggccgcaaggcgctcgtggccgtgctcgacaacgaggccaacatctccgccgggaaggccgctgcgcaggccgccgacctctcggcctcctccgcgcagaagaaggcgaagcgggcgccggcaaggaccaaggccgccgtcgcggcgtcggcggtcgtggacgacgtcgccgagctgcaggggatgctggagcgcctgcggctggagaaggagaaggcggaggagatggtgagggagcgggacgaggtcatccggaagaaggaggaggagacggaccaaagagaagggcaggggcgcc

SEQ ID NO: 17860 - DNA, 461 bp, Sorghum bicolor
  Clone ID: LIB3476-051-P1-K1-G3
gccgccgcgagctcctgctgtccgtcggtgcagctggcggggctggagccgccttccggacggttcatcttcttcggcgagcaaggtcagtccggccgtggtgcgggcactgtcagttgctaaggagtcttgtcgcccccctgtaccgcagctgcaatgaagatacagaaagcaaatgcagggattcttactaactttgaagttcttgacttcttgcaaacaagaggtgccaaagttgaccctatgggatgcttgggggctgttgctgcatcagagtgtaaggtgtatgagtacctcttaaaaacccctgcttgcaaccagacaagggaatcaatttatgaatttgtgaagagaagtgagggattcaagcttgcagaagctgataagctaaatgtcatcaactggagaccatcctcagctgccgatgcttatgcgatgatagaaaaatgtgggaaacgatt

SEQ ID NO: 17861 - DNA, 462 bp, Sorghum bicolor
  unsure (1)..(462): unsure at all n locations
  Clone ID: LIB3476-051-P1-K1-G5
tggtgaattacctcagggaatcaaattcctcactaacctaaggcatctggaactgtcatccatggataactggaatatgtgcatgccatgtggaattggtgagttaacaaacctacagacaatgcatgtgatcaaggtcggaagtgattcaggcagctgtgggattgctgacttggttaacttgaataagcttaagggagagctatgcatctcaggaatagagaatatcacaagtgcacaaattactcctgaagctagcatgaagagcaaagttgaattgcgcaaattgattttccactggtgttgtgtcgactccatgttttctgatgatgcatcatctgttttggatagtcttcaacctcactctgatctagaggaatnggctatcaggggcttttgtggtgtcagatttcctttgtggctggggaatgagtatatgtttagcttgtccattttagaact

SEQ ID NO: 17862 - DNA, 483 bp, Sorghum bicolor
  Clone ID: LIB3476-051-P1-K1-H11
cgacgttcgaccacggtggcggcggcgcacgagaggctgtacgctgcgccgaaccgcgcgcaggcggaggagatgcggcggcgcacgttccttccctaccggcagggcctcctgggctgcctgggcttcagctcccgcggctacggcgctctccacggcctcaccaaaaccctcaaccccgtattctcccggtgaaaagtcgccgtcaaaaggctcccaggaaaaaaagagagtataacgaaagaaaatcagagatcagaccaggcggagcttgagaaaaaaggtgttgagccgatttgattagccacctgttcgtcatgttcatgtaatgtatgcgagcattttttttttatcttggttgttttgtgtgcgttctgtatagcggtaatgttgagttcggagtggaaggtagtttggcgatggtcacgtcaagcagagcatctggatagagaggcagacatgcaatgcaattcgataaatatg

SEQ ID NO: 17863 - DNA, 522 bp, Sorghum bicolor
  Clone ID: LIB3476-051-P1-K1-H4
gagcacctaggttttcctgcacgcgggcgcgcggcgcggcgttgcggcggccggcggcgacggcgacagctgcgcggccagcagcacggcggacgggatcccagcgacgcggcggacgggatcccaacggcaacgggcagcggcaggccggcagcggacgggcgacgcggcagccggcagcccagcacgccgtcggtaggcggcagcggccactggccggacggcggacgcccacgcgagcagggactgcacgcgcggcgagcagccgagcaggcaaggcgctgaggtgtattgcaatttgcaagacgccaagacgcaagccgccgccggcaagcaagcgacagcaagcaaccaagcacctagcggcagatcatggaagcttttggagacgccactggtctgcgaatcaacatgaccaaaagcacggtggccacaatcagatgcacaggtgtcgatcttgacgagtatatccaagacagggcaaagaacaaagtcgctggctggcagggtaaaatgatcacg

SEQ ID NO: 17864 - DNA, 561 bp, Sorghum bicolor
  unsure (1)..(561): unsure at all n locations
  Clone ID: LIB3476-051-P1-K1-H5
cgattggcccagaaggtgacttgttggaaacaactgaaaaacaatgcaaccgcctcgcacttaaaggtcccttggtatctattgatgaaatggaggctattaaaaagatgaattatcgaggttggcgaagcaaagtgctcgacataacttatccaaaaaagtctggaaggaagggcttggaagaagctttggacagaatttgtgcgaggctcgtgaagccataagcaagggttacactattttggttctctcagatagaggattttcctcggaccgtgttgctaccagttctctcttagcagtgggagcagtgcatcagcaccttgttgcaaatcatgagaggacacgcataggattgttggttgagtcagctgaacctcgtgaagtgcaccatttctgcaccctggttggattnggtgctgatgctatctgcccttatttggctattgaagcaatttggtgcttgcagaatgatggaaagattcctcctaatggtgatggacaacgctactcaaaggaagaactggtgaagaagatttctatgcttctaactatggaatg

SEQ ID NO: 17865 - DNA, 546 bp, Sorghum bicolor
  Clone ID: LIB3476-051-P1-K1-H6
acgtgctgttatggcaacctgtgaccatggtgctgttgcaaagatcaagagggttgtgatggacagagacacatacccaaggaagtgggggcttggtccagtggcactcaagaagaagaaaatgatcgccgagggcctccttgataagcatgggaagccaaatgagaagaccccagccgagtggcttcgcaatgtggaagtggtgcttcccactggtggtgatgtatcgattgctagcattgcagctgctcctgagccagagaaggtgaaggtggagcaggacgcagtcatccatgaagaggtcaaggagaagaaaaagaagaggcagaaggatgagaacaatgacgacgatgcttctgttccggccaagaagatcaaggttgaggaagctgccgaggcagtggaaggggagaagagcgagaagaagaagaagaaaaagaaagataagggcgaatcagaatcagcagacgcggtggaagtgaaggaggcagagaaggctgatgtggctgatgagaaaggcagcgaaaagaagaagaagagaagaag

SEQ ID NO: 17866 - DNA, 468 bp, Sorghum bicolor
  Clone ID: LIB3476-052-P1-K1-A5
atcctgtactaccggacggcctttcctgtctcttggttagcttcctgctaactctgtttgtttttctctaatatatgcctggggagctttgctccacagttttcctcaaaaaaatcctgtactactggacttctttttctttcttggtttatgatacgtttttttcttcttattgttgttttgcttgagttttttcctttttggttttctgttttgatctattcatatgcctttaattgttttgccatgaaatttttatccctgttgacttgaagtttcagattatttagtgttgttacatgtaggtaagcttttgttttaagggctgactagataatttaggatgtcagtcattctatgtgattggaataaaggactaaagcattagtggatttatgcatgtgtttctgtaaagataagttaacaagcatctggtgggctgtgtggatggtgtgcttataagtgata

SEQ ID NO: 17867 - DNA, 312 bp, Sorghum bicolor
  Clone ID: LIB3476-052-P1-K1-B10
gcgctgatatactgtcgctctgctccttagaattgttaggccactatggccgccaacttatggacgtcgctgattcttatccagtgactggaccccgatgatgtggacctggtgccggctgcagacctggagcggtgcatcacgccagaggagatacgtcttatcaagagccatatgtcgttccatatctgtgtaggctggcacaacatgttaaagttaggcatttgggctcacggacaaattttatctctgtcgttgaacctattttgttcaatcttatatacgttgtcttccttctactggtattttcat

SEQ ID NO: 17868 - DNA, 247 bp, Sorghum bicolor
  Clone ID: LIB3476-052-P1-K1-B12
gtgcacacacgatcatcaacgaaaatgtgaacaggaaccatccaacatgcttttgctactgaggtatatagcggttgctgcggcggaggacgacaatagatgagagagagcaagggaggcgagcatcgactaccacactgatgaacccaatgctggatcttttatgggtaattagtactacctatcatcacagaagatattgcacttcatgctgtgacccagcaaccagttagtggaagaatatgtg

SEQ ID NO: 17869 - DNA, 368 bp, Sorghum bicolor
  Clone ID: LIB3476-052-P1-K1-B3
acgcgccacctcattccgcagccgaggagagatctcatctcggcttctccgcccccgtcgacgccaatgcctgcctccgcatcctccgccggcgcgggcgccgcctcgccttccggttccgcgtccgcctcagcctccgatccgaccccgtcttggtgggagtccgtctcgcaggcgcggtcccgcatcctggcgctctcctccatcctgcccgccgcggtctcccacgacgtggcggcgctggccgacgccgaccgcccggcgcgcgcgctcctgcgctcgcccgcggcctacgcggggctctccgacgcgctcagggcgggcggcggcgccgacgaccccggctgccactggctctacgacacgct

SEQ ID NO: 17870 - DNA, 484 bp, Sorghum bicolor
  Clone ID: LIB3476-052-P1-K1-B7
attcaatcatcagttgaactcttatgtgaggagcgtgaaaagaaatttcgtagaagagaggaggaccgagttagacaacgagagattctagaacaaatggcatatggtaaaactccaatgaacaaggcagttgacatgcagaagctgaaaggcttgactgctatcggatttgagaagtatcttgctgcagaagcactgcgcataaatgaaaatgatgctgacaaagcgttagaccttttgacaaatcctgaacaaaactgcatcctacaaagtaaaattcaggcaaagagaagccgggcatctcgtgggtttagtgcaggatcatcgagctccaaggcagctgttgccagggctgctccagcaatcaacaactctcagacttctgtcaatgatgtaccacatcctgctgatggagatgctccaccacatcctgcagatggaggagcaccacatcctgcggatggaagaaatgctccccacatgc

SEQ ID NO: 17871 - DNA, 292 bp, Sorghum bicolor
  Clone ID: LIB3476-052-P1-K1-C1
atcagacgtgctgggcactaatggcggacgagctaacatgtatgaaacggggtaacgttgtacagacagaagcaacggactgtactatagccaaggaagagcatcatgagtacattaggatttgcgcttgatgctgtcttgctatacctgtgttccgctgtgcccatcataaatcaggatgaaacgacccggtggagagatatatgctgagttggcatatactgagctgctttatgtctattgagagctagttgagatatgatattacgaacaccacttgtctgtatgttga

SEQ ID NO: 17872 - DNA, 456 bp, Sorghum bicolor
  Clone ID: LIB3476-052-P1-K1-C12
ggcgagcgagcgagcgagtaagcaggagcgtccaaccccgccaccgccgccatgaagcgcaacccccggagccggagccgggagaggacgtggcggtgttgctggtgcacccctacaccatcctcggcggcgtgcagggcctgctgcgcgggatggcggagggcgtcgctcggcgcgggtacaccgccgtcaccttcgacatgcgcggcgccggccggtccacggggcgggcgtcgctcacgggctccaccgaggtcggggacgtcgtcgccgtctgccgatgggtcgcagagaacatcaaaccgcgcggcatcctcctcgtcggatccttggctggggcaccaattgctggatctgcaggtgataaagtggatgaggtgattggttacgttagcatcgggtacccatttggtctgatggcctcagtcctattcggaaggcattatgatgctatac

SEQ ID NO: 17873 - DNA, 363 bp, Sorghum bicolor
  Clone ID: LIB3476-052-P1-K1-C9
accattggtaatacatgtgggccgttttgggcgtgaaaaaaatttggattttctgaaaagggttatggagaggctcccaggagcaaggattgcctttgttggagacgggccatacagggctgagttggaaaaaatgttcatgggcatgcctgcagtttttactggaatgctccaaggcgaggagctctcacaagcttacgccagtgcagatgtatttgcaatgccttcagagtctgagaccctcgggcaagtagtgctggagtccatggcttctggagtcccagttgtcgctgctcgtgctggagggatacctgatataatacccaatgacaaggatggttagacaagctttttgtttacacc

SEQ ID NO: 17874 - DNA, 448 bp, Sorghum bicolor
  Clone ID: LIB3476-052-P1-K1-D10
cttacatttttgacatgcggttgccactgggagagagcaggtaggcgaaaggcagcgacaccaggcgaagcgagcgccgccatcttccgatgcgatgcgagcgggcggagatctggtgtgggtggatcctttggtccttcctgaagtagtgagggatcccttcatcggtgcttgggctcatcaccggagcggcggcgccaggaacaacatgggctcacatctcgagggtggcgcatcggcgtcgcacggacccggtgacggcgggagcacaagtactagacatgagctacctgagctcgtatctagagttgcttctggtgggggcggcggtcgagctgagatccaaggtgctgggcttctttacgcattaccatccccaacttggggagttcaatttcaataagaaagcatacagttcaagcgattagcatgacagaagctacttatt

SEQ ID NO: 17875 - DNA, 317 bp, Sorghum bicolor
  Clone ID: LIB3476-052-P1-K1-D12
cgaccgttgggccgccgccgccctatacgccaggtgctgaggctttccctggtctcttcgccggcgacgagcacaccagatatctagtcttcagtacagaacttggtgtagattgtgatgtcggtgccaatgtttaagaaacagaactcattgagcacccctgtccacaagacaaacccgtttgattcagattcagattctgaaaggccatcaagggcacagtctgttccagtacgacacaccaatcaattctgtcaagagttggaagattatgctataaccaaagcaccagaaaccacacacaaagttaatgattg

SEQ ID NO: 17876 - DNA, 348 bp, Sorghum bicolor
  Clone ID: LIB3476-052-P1-K1-D8
accacgcgtaccagcacgcgtacgcggacgcgtggctggacacctgtaggtcctaaagagagagccccgcaatatggaccatcggtacactcaaaggcttatgagcactaagcgtccactactacaaataatgcagcaacatgaggatagacagacggaagacaatcctatgtacaatccatacatgggacactgccaaagcacgagtgaactactgccgcctgatattgcagtgaaggatgatgatgaataacccagactgtgctggactgtgcttatgacgaatgcgagacacggctaacagctggatgacgttggactagccacgtacattaacatgtgttattc

SEQ ID NO: 17877 - DNA, 330 bp, Sorghum bicolor
  Clone ID: LIB3476-052-P1-K1-D9
gctacaccgaaccgctcactggcactgctcctgccgctgtcggcgaccagctcgatcctcaacatgagcttgaacattggccttctgaacgaggtgagcgacacggcgatcgacgcgctgctcctggaccaggacctgctgacggacgccgtgatcgaggccatgatctatgcgatcctgtcgcaggtgaaggaccggacgaagggcgagccggggtggcacaaggtgtggaccgactactcggccgactagctggtcttgaacgcgtacttgaagttgttgtcgcggctgctggaggcgcgcttgacggctctcagcattcacttgatc

SEQ ID NO: 17878 - DNA, 248 bp, Sorghum bicolor
  Clone ID: LIB3476-052-P1-K1-E4
gcgcgtggccaggaaacaaaatggcatcttccatgaaatttctctgcatacttggactgattctcctcatcggaacagtcgtcgacggtgcaggggaatgtggtcgatcttcgccagacattgatgcgtttaagctggctccatgtgctggtgcatctcatgacgctcacttcgctctgccaggaggttgcagtactcagattaatagattcactcattaccctaaatgtctatgcgccattcttctt

SEQ ID NO: 17879 - DNA, 546 bp, Sorghum bicolor
  Clone ID: LIB3476-052-P1-K1-E6
agaaggccgccggtctcggtctggagcagaaagacaccaccgctgtggcagcggcggcggcacagcagcagcagcaagcagcacgggcggctgcaggcggcggcaaggacaacaagggcgagatgggtggtgcggcggccaagaagaaggagccggcgccggcgcccagggtccggaccccgtcgccgacggcgctgatgatgaagttcccgctcaagagcacgctgccgtcggtggcctccctcaaggcccggttcgctcggttcggcccgctggacgtcgacggcatccgcgtgtactggaagtcccacatgtgccgcgtcatctacaggttcaaggccgacgcggaggccgcgctccggtacgccaaggccaacgccatgttcgggcaggtggacacgcagtaccacctccgcgaggtcgagtcatgggcggcggtggcggcgcctgaagcgcccccgcagcaacagcagcagcagcggtccgaactgcggctcatggagacggcttcgttcatgccgggaagctccggcaatggcgctccgc

SEQ ID NO: 17880 - DNA, 187 bp, Sorghum bicolor
  Clone ID: LIB3476-052-P1-K1-F10
atgaagctcttctgctgcaattcgtctctgtccttaatctggcgtcggccccgctgactgctcagagctctatcttagcgagcggctatgtatatctcgccagccatggcctgccacacacgagacactcagtgtcaaggccctgatgaaccaatcactatcattaatcactgagacttattactca

SEQ ID NO: 17881 - DNA, 177 bp, Sorghum bicolor
  Clone ID: LIB3476-052-P1-K1-G11
cacccacagccggccagggccagcagccccccaacccatgacaatggcacctgagccctcagccggcggagcggcaccgccgggcgctagtagggtgtgggagtgggaagggaaggtggcgtctgcgttggccgatgcgacggcggacgaggcgtgggcacttctgtcgtacttcct

SEQ ID NO: 17882 - DNA, 482 bp, Sorghum bicolor
  unsure (1)..(482): unsure at all n locations
  Clone ID: LIB3476-052-P1-K1-G2
cgcccacgcgtncacggctctccttcctcgtcccgagggtcacaagtcactcgcattcgagtggcgaccccgacagtggctgagtactcctcagcgccgtgtggctggagggcggccacccgaggcacgcgcgcggagggcatccggtcggcagccccgctcgctcgagggcgaagtccggcccaagtgctatagaagggccgctcgcgccccagtgaagatagaaccaacgccgactccacgccgctcgtaccgccgagaatgaaatctcggagggcgatnctacgtcgctcaagagagaaggacgaggagtccagcccagtacgccgatctgcacaagttctgtggaaggacatagcacaatggaccaagctcctctcctcaacttccgcaaggctcctgctcgtgcagnctcaagaagctcgtcgccgccggcaagctcaccaaggtcaagaactcgtacaagctgcctgccgcacgcg

SEQ ID NO: 17883 - DNA, 511 bp, Sorghum bicolor
  Clone ID: LIB3476-052-P1-K1-H10
gcgcttgcagagacacaagatgggagttgaagattttgaacttttgactattattgggagaggtgcatttggagaggtgcgtctttgtagagagaagtcctctaagaatgtgtacgcaatgaaaaagctcaagaaatctgaaatgcttcgtaggggccaggtagaacatgtcaaagccgaaaggaaccttcttgctgaagttgatagtgcttacatagttaagctctattattctttccaagacgaagagttcttatatctcatcatggaataccttcctggtggggacatgatgactttacttatgcgcaaggacacactaacagaagatgaagctagattttatattgcagaaacggtgcttgccattgagtctattcacaagcacaactatattcatcgggatatcaaaccagataatcttttgttagatcgcattggtcacctgaagctttctgacttcggtttgtgtaaaccttttgacagcaataatttttcatttttgaatgaa

SEQ ID NO: 17884 - DNA, 439 bp, Sorghum bicolor
  Clone ID: LIB3476-052-P1-K1-H2
cccacgcgtccgcccacgcgtccgatcttgcctcaagaagctttctgggtatagcgaccgacaagatgaaattcccaatgataatgcactgtctgtctcagaacgtctgcagtgctgcatagttgcgtttaaagtctggaggagcaaccttgaggcattgaatgtggatctacaggatttcttcgtgcagctttataacctcatactggagtatcggcctgacagggatcacggcgaggtattggctgatgctctgaagacacttctttgggaaggcaaacagcaggatatgctaagagctgctgctttcattaaacgtttggccacatttgccctctcatttggctctgcagaagcgatagcagcattggtcacactgaagcatcttctccaaataaatagcaagtgtcgcaatatgctggaaaatgattctggtggc

SEQ ID NO: 17885 - DNA, 185 bp, Sorghum bicolor
  Clone ID: LIB3476-052-P1-K1-H4
gcgcaaggttgcctctgaccttcccatgctagaagaaagtttgcagcgtctggctaagtctgatcctatggttctctgtacgaggggggaatctggtgaacatatcattgctggagccgcagtgcatcatcttgagatctgcctgtaggatctgcaggacgacttcttgggtggtgctgaaaata

SEQ ID NO: 17886 - DNA, 441 bp, Sorghum bicolor
  Clone ID: LIB3476-053-P1-K1-A9
gagaaatccaggtttggaaagatgttgatggtgttttaacatgtgacccaaatatccatcctaaggcaaaaccagtgccatacttgacatttgatgaggcagccgaacttgcctattttggagcgcaggttttgcatccacaatcaatgcgaccagctagagaaggcgatgtacctgttagggttaagaactcttataaccgtcgagcccctggtactcttatcactaaagcaagagatatgagtaagactgttttgactagcattgttttgaaatcaaatattacaatgcttgatatagtgagcacacgcatgcttggccagtatggttttctagctaaggttttttcgatatttgaagactcgggcatgtctgttgattgtgtggccactagtgaagtcagcatatctttgacactggatccatcgaaactatggagtt

SEQ ID NO: 17887 - DNA, 511 bp, Sorghum bicolor
  Clone ID: LIB3476-053-P1-K1-B1
gaagaaaaaggggtataagaacccagaacttacaatacaccaccacaccacacacacactacacaagccaaaacagccaagacacagatgcatctaagctggcagcaaggcgacccacatcgacctcaggaattaatcacctgggagatgggcagtcaagagggaaagccctcgagcccctgcagtgctccacatccggcgctcctcaccagccactactaaagccccagccacacttggagctgatccatcaaaaatgcagcgattgcgatgattccaaagagtccaggcacccagaataattagggagttcaccccttgcctcaccaaattagttgtagcattatcggctctctcccaccagtccaggaaggagttatcggtaggttggggagataggatctggagaccgacctgcctaagcataaaaaaccaaaactccctagcgaagacacattccaccaggagatggttgatggaatcttctgcttgatcacaaaacgggcagcga

SEQ ID NO: 17888 - DNA, 515 bp, Sorghum bicolor
  Clone ID: LIB3476-053-P1-K1-B11
ctcagcaagatgaaaatggcgacttctctgtatcaatctctgcaattgaggacagcctggtctcggatgcaccgggggaccatttttgtgaatcactctgccccttccgcacaagagaagggtgcagatggccagatgctccgtgtgcacagcttggaagtcagttcgtcggtttgaaggcaaattttgatgcttttgaccggttgtcaatacaggactgctattttggaccagagtagttgatcatgaaccagctgtgtcagtacacgcttggcagttgccaatggattttttcagtagttggcacctccaggtctgcatcaatagcaaaagaatgctgggaaacaactcaatgatgcatatttgacgagtatttacaaattccttcattcaatattttttttcactatctgggtcctccgaatctgcatcaacagaatagcctggaaagcaaatcaaggatgcatacctgatatgcatcacaggatttttcttgttccaatggtcttataagc

SEQ ID NO: 17889 - DNA, 542 bp, Sorghum bicolor
  unsure (1)..(542): unsure at all n locations
  Clone ID: LIB3476-053-P1-K1-B6
gngcttcaaggacctcgagggcgtcgtcgcctacatgcacggctgggaccgcgacggccaccccgtctgctacaacgcctatggcgtcttcaaagacagggacatgtacgagcgcgtcttcggcgacggcgaccgcctctcgcgcttcctccgctggcgcgtccaggtcatggagcgcggcgtgcgcgcgctcaccctcaggcccggcggcgtcaacgccatcatacaggtcaccgacctcaaggacatgcccaagcgggagctcagagccgccagcaaccagatcctctccctcttccaggacaattacccggagatggtggcgcgcaaggtgttcatcaacgtgccgtggtacttctccgtgctcttctccatgatctcgccattcctcaccgagcgcaccaagagcaagttcgtcatcgcgcgcgagggaaacgtcgccgagacactctacaagttcatccggccggagctggtgccggggcagtacggcgggctgagccgcgccggcgacctcgagaacggaccaccaaagccggcgt

SEQ ID NO: 17890 - DNA, 534 bp, Sorghum bicolor
  Clone ID: LIB3476-053-P1-K1-C12
cagaatcagctacatgtgttgccttcagatgatctgcaatttgttcatagaggtcactctgcaggaacagagaagccaatttttgagaaagttggcagtggtgcaataccatcagcggatgtgtgcatcgaggatgattttgataaaaggtttcaagaagatcttgatgaagcaatgcgccaaagccttggatacgatgcttatcctgctggtacgataagcacttcgaatgggacagaagtgtatgggactggccttaaaaatgctgctggtgaatacaattgtttcttgaatgtgattattcagtcattatggcatataaggcggtttcgagacgagttccttaaaacatcatcactgcacaagcatgttgaagatccttgtgctgtctgcgctttatatggtatcttcattgacctgagcaaagcagccaagggacaaggagaagctgttgcgcctacttcattgaggatcgctttgagcaaatcctacccgaacagcaaattctttcatgagggacagatgaatgatgca

SEQ ID NO: 17891 - DNA, 534 bp, Sorghum bicolor
  Clone ID: LIB3476-053-P1-K1-C7
gcttcactgagaacaccaagcaaactgaagattaatagcagaacctcctcatggccgagaaggaaccttgacagtggactggcaaaagttgctgcactggagatccttgagaggtggacagtggatcgctctgagttgctcatcggccatagatttgcatccggggcgtatagccgattgttccatgggatctacaaggagctacctgttgctgtgaagttcatcaggcagcctgacgatggcgaggatgacgaattgtctgctaagcttgagaagcagttcacttcagaggttaccattctggcaaggctccaacatcgtaatgtcattaagcttgttggggcctgtaattgcccgccagtcttctgtgtcatcactgagtttttgtcctggggttctttgagggctttcttgcgaaagctggagcgtaaaactcttcctttggagaaggtcgtttccatcgctttggatatcgcacgtggcctggaatatattcacctcaaaggaattgtgcaccgtgacatcaaacccgag

SEQ ID NO: 17892 - DNA, 487 bp, Sorghum bicolor
  unsure (1)..(487): unsure at all n locations
  Clone ID: LIB3476-053-P1-K1-D1
ggtgtctatgagaatcttatttcagttctggggcctaacatattttgctggctctgccctgtattgaatactgttggaaatggcctccggtaccgtacatcctatgatattccgatatctacgccaccaatgtgataacaaaagatagcagcagtcacaataggtcagggtcttgtaactctgcaagatacaggagatgatgactaccacagcctctcaccaggtgtctatcctgagtcgagacacgaactcttaaccatgtttttttttatttcattcacatacttgataaaattcaatctgcctcgcttgtaatctggagtaggctgttcttaccaaaaaaaagaagcactgtaattctgttgtaaagttcatgtgtttgagagatgagagccatgtaatgtagccagaggtcatgaaaaccatttttcccagattanttgtgtacattngtttagaatggaatgtgacatctgatgtacttttg

SEQ ID NO: 17893 - DNA, 521 bp, Sorghum bicolor
  Clone ID: LIB3476-053-P1-K1-D11
ggtggttgcaagtatcaactaccttgatagatggtttgattcaaccagcatttgtgaaatggattgaagaagaacaggccttggaaaatggacaaatcaatgaaaaacttatgaaggtgataagcagtaaactaaaggaggacaataagatcttgaggaggtttaacagattcgggaaatctgaactctatttggatatgctctttttcctaagatttggttctgctaggtctgacagctattatgatgtcaaatttcttgctgaacatggagaaagaattttagaggaccttgttatttccttagctgatgtgattgctagtgtttatctggagcttatgtcagttgatggtgatatgtctactgaagttgttagttccagcttagttctatgttctctgtcaaccagagaacttcaaaagctgcgcaatgaggtggcaattaaattggggttgcaccaatacttcaagtcagttgtttcaatgtatgaagacaggttcgagttatatgttctatgcagc

SEQ ID NO: 17894 - DNA, 433 bp, Sorghum bicolor
  Clone ID: LIB3476-053-P1-K1-D2
cggacgcgtgggggctactacaagggctgcgacgacgacaagcgcaagcagaggccgctcacgcccgccgcccaggccgagcaggagcaccgcaagcgcgtgctccgcgagctcaattccctcatctccggcgccgccgctgcccccgacgaggccgtcgaggaggaggtcaccgacaccgagtggttcttcctcgtctccatgacgcagtcgttcctcaacgggtccgggctccccgggcaggcgctcttcgcggggcagcccacttggatcgcctctggcctctcctccgcgccgtgcgagcgcgcgcgccaggcctacaacttcggcctccgcaccatggtctgcttccccgtcggcaccggggtgctcgagctcggctccaacgacgtcgtgttccagaccgccgagagcatggccaagatccgctcgc

SEQ ID NO: 17895 - DNA, 519 bp, Sorghum bicolor
  Clone ID: LIB3476-053-P1-K1-E11
ggcaggcacaggcaatggaagctgataaagaattctacagtcggatacgcatacctgatgaagatgattcatgtagtcagaagcagacatgccgtagttcagcctcacagggtgccgatagcaaacctgcatctgagcggcaatcaagaggtgtggagcatataaaacagggtctcgtgaattttatagcctcactgctgatgccattatatagaggaaaaaagatcgaccgagaagggtacaaatcaatcatgcgcaaatctgttaacaagatcattgatacatgctcagaaggagagaaatcgatgactactcttgagtttcttgatgctaaaaggaaaattaagattgaatcctttgtgaacaaaatggttgacaagcatttgcatgttgttagcaagtctgccaaaccttaagattcacatgtgtagtgaggtgtttgtgcaaaggaatctactctaaaacaccaagctatcaatcagtgattggtgatccaagtgaactaaaacctcacttcag

SEQ ID NO: 17896 - DNA, 537 bp, Sorghum bicolor
  Clone ID: LIB3476-053-P1-K1-E12
cgcgctgtcgggggccatccccgacgagctcaggggcctgaagcagctccaggagctgcagatttcagggaacaacctcacgggcgcgctccccggctggctggcggggctcccggcgctccgcgtgctgtccgcctacgagaacgcgctgtctggcccgatcccgccggggctggggctgtcgtcggagctccaggtgctcatcctcaccttgaatcgcctcaacggcaccatccccgacgccatcggccggtgccgcggcctctccaacgtgcgcatcggcgacaacctcctctccggcgccatcccggcgtccgtcggggacgccaccagcctcacctacttcgaggccaacaccaacgacctgtccggcgggatccccacgcagttcgcgcgctgcgccaacctgacgctgctcaatctggcctacaatcgcctcgccggcgaggtgccggatgttctcggtgagctcaggagcctgcaggagctcatcgtgtctagcaacggcctcggcggcgagttcccgagatcgatcct

SEQ ID NO: 17897 - DNA, 527 bp, Sorghum bicolor
  Clone ID: LIB3476-053-P1-K1-E9
cgtgatggcgcagtcggacccgccctccacgggcgcgttccacccggacgtggcgccgcagctgcagcagatcctggcgttcctcagccggaccggcgcgcccttcatgatcaacccgtacccgtggttcgcgtaccagtcggacccgcgcccggagacgctggcgttctgcctgttccagcccaacgccggccgcgtcgacggcgggtccaagatcaggtacaccaacatgttcgacgcgcagctggacgccgtcaagtcggcgctggtgcgcgccgggtacgggagcgtggacatcgtggtggccgagacgggttggccgacgaaaggcgacgccggggagcccggcgccacggcggagaacgccagggcgtacgtgtccaacctggtggcgcaccttcggtccggcgccggcacgccgctgatgccggggaagtcggtggagacgtacctgttcgcgctctactactaggacctctagcctggcccgacgtcggagcgctcgttcggtctgtaccacacggacc

SEQ ID NO: 17898 - DNA, 485 bp, Sorghum bicolor
  Clone ID: LIB3476-053-P1-K1-F11
gaagggttcatacataaagttgacaaaggtggctcagatgttgagttattagaggatgctaggatcgtagctcctcaaggcatccaatggcatgtctttgctgcatttgggacactgaaaggcggacgtgctgattggcttatagagaaatgtactgaacttggagcttctagtgttacccctctcctgacagaaagatgtcacacgatagcggaaaatcgggtggacaggctgcaacgtcttgtgctggctgcagttaaacaatgccagaggatacatgaaatgtcgctgaagcccccaattcagattagtcaccttctacctgttgtatcacagtcaaagcttgctttcttagcatcagcagaagcgcctcctcttttaagtgttctgccaaaatccagcactgaacaaagtgggcttctgattgttggacctgaaggagacttcacagaagaggaggtacattcactgaaagcagcaggtgc

SEQ ID NO: 17899 - DNA, 529 bp, Sorghum bicolor
  unsure (1)..(529): unsure at all n locations
  Clone ID: LIB3476-053-P1-K1-F5
taaggttgctaaggagcacaagaagccttggttatggtgggactatgttactgattttgcgattcggtgcccaatgaaggaaaagaagtacacaaaggagtgtgctgaaggggttattaagtcgcttggccttgatcataaagcaatagataagtgtattggtgatccagatgctgatgaagaaaaccctgttctgaaagctgaacaagatgcacagattggcaagggctctcgtggtgatgttaccatcttaccaactctggtaatcaacaatagacaatacagagggaagcttgacaaaggagcagttcttaaagcactttgtgctggttttaaggaaaccactgagccagccgtttgcttgagtgaagatatacaaacaaatgagtgcctagagaacaatggtggctgttggcaagataaggctgctaacatcactgcatgcaaggatacnnttccgtggagagtttgtagtgtncagtgtgaaaggagtaaatttggtgggatggtatactcatnggaagctttc

SEQ ID NO: 17900 - DNA, 519 bp, Sorghum bicolor
  Clone ID: LIB3476-053-P1-K1-F9
gtaccgcgggacgatgcccggcggggagtgcgtggcggtgaagcggatcgtgtcggcggagggcggagggttccaggcggaggtggagacgctgggtcggatccggcaccggcacatcgtgcggctgctggccttctgctcggggcccgaggcgaagctgctggtgtacgagtacatggtgaacggcagcctcggggaggcgctgcaccgtcgtaacgacggcgatggcagcggcgtgctggcgtgggcgtcgcgtctccgcgtggcgacggaggcggccaaggggctgtgctacctgcaccacgactgctcgccgccgatcctgcatcgggacgtcaagtccaacaacatcttgctggacgcccgaatggaggcccacgtggcggacttcggcctggccaagtttctggtgggcggcaacgacgccaccgagtgcatgtccgccgtcgccggatcctacggctacattgcaccagagtacgcgtacacgctgaaggttgacgagaagagcgacgtgta

SEQ ID NO: 17901 - DNA, 516 bp, Sorghum bicolor
  Clone ID: LIB3476-053-P1-K1-G3
cgacccatctgatagcatggtttaatttgaacttttagtacgattttgtttttactttgtttatttacaacattgaatattatctagtgcatagtgataaaggaagtgtagaaagcctgaattttgtcttggtgattagcggattgcgtgtgatactgtgatatagagaaagaatgatgattcatgttgttgttaatactccatgttcatttcacatttaatatgatcttctttttgtaaaaaaaaaaaatgcatggatgttgtctgtactatatctacgctttacccaatgaattagtgatgcagtttctgataaatatttgttaataaatctgtatctgaactatttcttctattgaatgaagattcatacaacatcgagcaatccatttctgatattatttatttgccttctgagatgttcggagaggaaatctctgtaacataagaagggatttgtcttaacaatccacttttgcccttgaataggagggcatcatcctgaatgcacaaaca

SEQ ID NO: 17902 - DNA, 449 bp, Sorghum bicolor
  Clone ID: LIB3476-053-P1-K1-G8
ggcggacaccgtgggggcgcttcctccttccccgataccggagtgcgactccgggaggtcctcgccgtcccacgccgcgtcgcccgagttcgagttctggatggtgggcacgaacccgtccccggcgctgctcaccgccgacgagctcttctccggcggcgtcgtgctcccgctccacaacctccaggcgccggccgccacggacggcgacggcgcgcctgcccctcaggccgacgcagacgacgccgccgccaaggcggacttgaagggcgcggacgccgcggcgctcccgctgcctgaagcccatgcgcaggaggcggaaggggagaccgcgcatccgttcgcggagtccggcatcttgccgtgctcgcgtagcaactcccgaggggatgtcttcggtcctgtgccgtccattcccgtctccaccgcagtggcagctgtagctgcag

SEQ ID NO: 17903 - DNA, 397 bp, Sorghum bicolor
  Clone ID: LIB3476-053-P1-K1-H12
catcacgcaacccactgtgcagtctgcatagttggtcattgacaagttcttatcctgagccatcgtctcgttctattttgatggtaagtggggctgcaagcaataatgttgacagtgatgtagagagatctgtaacaaactgggaagaaactgaaggtaccagagaggatggggagcttccagttgtgattcctgctgaaaatgaaccaaatggttctacaattttgcaccctgaggtgtcacctgagattcggagccattctagaggcttatccctgatatcaaagagtgcaacaccatctaagctaagcatctcacagagttttgggagaaatgaagatgatcttgatctcttgatgtatagtgacaacgagttggaagaccaaccctgcatttt

SEQ ID NO: 17904 - DNA, 537 bp, Sorghum bicolor
  Clone ID: LIB3476-053-P1-K1-H2
gaacggctcccaaaggctccccccaatcatcggatttctaccccgcgcctccctccctctctctccgagttgccgtccatcgctcggtacgcccccccaatcgtcgccatgattgacggacagcccatggaggtggaggcgcccgtcctcgcgccccaacaggccgtctcgcccccagcggccacgctgtccaagaagacgctggcatcgaccccaaagtccagggccgcgaggaggaagacgctctgcgacatcaccaacctgagcaagcgcgagccggccgacgtgccggtgccggacgagtcagcgtgcccggcgcccgcgagcgcgggcggtgttgtggagtttgcgcagctagtaaagaagaacgaggaactcgtgaggctcctcgcggagagagacaagatcatacagttgaagcggggtagagattcagaagctgcgacatgccaactgggaacttgcccggaccaattcccatatgttgggcgagttaaccttgggaaaaacaacttgttagcgctgcagcatgagcct

SEQ ID NO: 17905 - DNA, 503 bp, Sorghum bicolor
  Clone ID: LIB3476-053-P1-K1-H6
gatcgtttgattattggcgagcttcattccattccatcagttcctttggcggaggatgtcgtgctgcggaggcaactgcgggtgcggctccggctgcaagtgcggcagcggatgccgagggtgcatgatgtacccggacatggttgaacagcaggtgaccaccaccggcaagactgtcgtcatgggtgtcgcaccatcgttcaaggggcacgccgagggcagattcgaggcggcggacgacgcccgagctgataacgaagggtgcaagagcaggcccaactgcagctgcaaccactgcacctgcaagtgagctgtataataaccccctgcactgcactgcagcccggaggaaggacggactcccctagctagtatagcagtgtctacactgcaaagagtgagtgtttgagtcaaccagtcagtcgagtgccatggcaccatatgctagtggttcatggactgatgggaaccaatcatcattgcactgggatggtggcgtcatg

SEQ ID NO: 17906 - DNA, 524 bp, Sorghum bicolor
  Clone ID: LIB3476-053-P1-K1-H8
agagtaccttgagcctgttcaccgctgtcgccgcctcacagccacagcatccatggccgacgcagctcgtctcttcctgctggtggcggtgaccgccgctctcgccggccgctcagacgccgcgtggtgcgtgtgccgcacggacctggcggacaccgcgctgcagaagacgctggactacgcgtgcggcggcggcgccgactgcaagcccatcctgcagaacggcgcctgcttcgcgccggacaccgtcaaggcgcactgctcctacgccgtcaacagcttctaccagcgcaacaaccagaacccgcaggcctgcgtcttctccggcaccgccacgctctccaacaacgaccccagcggcaatggctgcacgtaccctgcgaccccaagcgccgccgcgacaagctcacccggcgtgtacagccctcccacaatgggtccgtcagccctcaacgacaacagtggtgctgctggcgtcctcccgacggccgccggactggccacacggctggtgatcctagcct

SEQ ID NO: 17907 - DNA, 444 bp, Sorghum bicolor
  unsure (1)..(444): unsure at all n locations
  Clone ID: LIB3476-054-P1-K1-A12
cccacgcgtccgcggacgcgtgggctcccacaaccacctctccggcggggtgcccctcgagctcggtcgcctcccggccaccgtcacgctcgacctccgcttcaacaacctctcaggcgagatcccgcagtccggctccctcgccagccagggccccaccgcgttcctcaacaacccggggctctgcggcttcccgctgcaggtcccctgccgcgccgctcctccgtcgtcggcgtcgtcgtcgncgtccctacctcctccgntgtcctctggcggcggcgcgggcggtgcacggcagccgatcaagaccagcctcatcgagctcatctcggtggccgacccggtggccgacgtgttgattctaagaaagccagtctcgcagaatgtcacgcagcttgaactttgtggaaaaaacgcagtataacagcaccgttgctaagtgcc

SEQ ID NO: 17908 - DNA, 533 bp, Sorghum bicolor
  Clone ID: LIB3476-054-P1-K1-A4
ggagaaacttagcaaggttcatcaggaaaagaaagaacaggaggaaacaaccaaaaatgctgaggcacacagacagagaattggctcacttgatgaatttctggctactaaggaagttagtcagaacagtgggaattctactgaagaagaaactagcgaggtagttgatccttcggtggatagcagcaccgaacataaggagaacacaccagaatgcagtgaccatactagtacggagaattttcagacatcaccccaagctacagaatcgggtggcgctggagagattcaatcaacacaaactgttcgcaaaggcgtgtcacagttaagggcaaagaaaaccagagatccggttgcagatccttcggtggatagcagcaccgaaaataaggagaacacaccagaacacagtgcgaatactagcacagagaattctcagacatcagccccacttacaggatcagaaggtggcgatgaggagaatcagtccacacaatctgttcgcaaaggggcgtcacggtcaagggcaaaga

SEQ ID NO: 17909 - DNA, 419 bp, Sorghum bicolor
  Clone ID: LIB3476-054-P1-K1-B10
cccacgcgttcgccagaatcgtttaagcttgattatgtttcaataggaaatcaagaatgttggatgctgtactacagaggaaattaccaaaagttttactctgcgattaaatctgcctacccagacatcaacattatatcaagttgtgataggccaactatttcaccatccaaccctgccgatctttatgatgttcatgtctacacctctttgactaatatgttttcaaaaactagtatgtttgacaacacaccacgtggagcaccgaaggcaattgttagtgagtacgctgtgactgggaatgatgctggcaaaggaacactggtagcagcacttgcagaagctgcatttctcattggattggaaagggacagtgatgtggttgagatggcaagctgtgcacccctttttgtaatgac

SEQ ID NO: 17910 - DNA, 515 bp, Sorghum bicolor
  unsure (1)..(515): unsure at all n locations
  Clone ID: LIB3476-054-P1-K1-B3
cgacgaatgtccgccacgtctcccacgtcacattcgaccgcttccacggcttcctcggcctccctagcgagttcgaggacgagatgccctgccgcgtgcccagcgccagtgccagtgttttcggtgtctcggctgaatcaatgcaatgcacgtatgatggcaagggaaattcagtccccacgatattgcttctcatgcaggagaggctgtatgcccaggaggggctgaaggctgagggtatctttcgcatcaatccagagaatgaccaagaggagcacgtgagggatcagctgaacaaaggagttgtacctgaggacattgatgttcactgcttggccagcctgattaaggcatggttcagggaacttccaggaagtgtccttgatggcctctcccctgaacaagtgcttcaatgcaattctgaangggagttccttgaccttggntcgagttgcgccccactcaggcagcactcctcaattgggctgtcgagctgatgtctgatgtgtcgaaga

SEQ ID NO: 17911 - DNA, 499 bp, Sorghum bicolor
  unsure (1)..(499): unsure at all n locations
  Clone ID: LIB3476-054-P1-K1-B6
cccacgcgtccgaagtggtcatttctgagaagttccaccacaaaaaatcccagtggagactcattgtcttcataaaagacattgctttgttgtttccatgaaggcaaatcctatctaaacttgtcactgaattttgcatctttgcattttcatgactggccctgtagtgcatttttgtttgtcgattccccattttcagtctttccatcaccttaacatggtttcactatcgaagccatcactatacatatataaatactaaattaccctcatttccatcgtcagcaccaggtactatcttagcctacctcatgctgctttctgtatcttacctgccagtatctcagcatttgatagccttctcggacatgtcttgctagacttatacagagttagtggtgcaggggaccttactggtgtaccattatacctgattgagaacagcaaatcaaaataggcccacccctntgtcctgaaacccaaatccatgcttgtcatg

SEQ ID NO: 17912 - DNA, 443 bp, Sorghum bicolor
  Clone ID: LIB3476-054-P1-K1-C12
agcgaacagaggcgtgcaggggagtctgacggggatcagcatcggcgtggtgaccccgatggacaaagtgtggcgcagcctgcaggcgttcggcgacatcgccttcgcctactcctactccctgatcctgatcgagatccaggacacgatccgggcgccgccgccgtcggagtcgacggtgatgaagcgcgccacggtggtgagccgtgcggtgaccacgctcttctacatgctgtgcggatgcatggggtacgcggcgttcggcgacggcgcgcccggaaacctcctcacgggcttcggcttctacgagcccttctggctcctggacgtggccaacgccgccatcgtcgtccacctcgtcggcgcctaccaggtctactgccagccgctgttcgccttcgtcgagaagtgggccgcggcgcggtggccggactcggcgttcg

SEQ ID NO: 17913 - DNA, 556 bp, Sorghum bicolor
  Clone ID: LIB3476-054-P1-K1-C7
cccacgcgtccgcccacgcgtccggttctgtgggcgcgtccggggggccagggtgccggaagcacgtggcgaaggtcacggagtacggcgcggtgggggacgggaggacgctcaacacggaggcgttcgccaaggcggtggcggacctgtcgcggcgcgcccgcgatggcggcgcggcgctggtggtgccgccggggaagtggctcacggggcccttcaatctcaccagctgcttcacgctctacctcgacgagggcgccgagatcctagcgtcccaggacatgaaccattggcccctcatagctcccttgccgtcttacgggagaggaagggacgagcctggcccaaggtacatcaatttcattggaggatccaatctcactgacgtcatcatcacaggtaaaaatggaacaatcaacgggcaggggcaagtctggtgggacaagttccatgccaaggagctcaagtccacccgtggccacctcctagagctcctccactctgataacatcatcatctccaatgtcaccttcgtcgatgcgccatactggaacct

SEQ ID NO: 17914 - DNA, 430 bp, Sorghum bicolor
  Clone ID: LIB3476-054-P1-K1-C8
ggcagattcggtgaatgcaaatgggaccttaaattcagagagcaaatgtgccatggatcaagaacttaagaatgccatattgaagattcaggactttgtcaagttacttgatcaagaagtctccaagtttcaaggccagtcatctgattatgatgggctatgtgagaaaacacgacagttttctgcattagttgacaaagttctgtcaaacggtgatgtcctaaatgatattgtcatggcactgtctgttatattgtcagaaactagccagattaagttcacaatgttgagagacaatagcaatgaagcagaaagtaataacttagattgtgttgataaagtgactctacttgaaaataaggtgcagcccgagccagtaaaagacaatgtatctggtctcttgccactggtgcctcattcatcttctgat

SEQ ID NO: 17915 - DNA, 308 bp, Sorghum bicolor
  Clone ID: LIB3476-054-P1-K1-D1
gacctgccttcctgctagtagcctctacgcgctcagtccgcatcatcctcttctggggctgccgaaccagcacaagcttctgcagatgccgttggtccaggagcaggctgctgcgaataatcatggcgtgatgctctattcggaccaccaccaccacggcggcggcctcctgtacccgctgcttcttcccggcatcccgttctgccccttctccgccgccgccgacgccgccacctgcgataagaccaccaccaccggcggcttcgcggcgctcgatgccggcgaggcgggcacctcagtggcgaaag

SEQ ID NO: 17916 - DNA, 508 bp, Sorghum bicolor
  Clone ID: LIB3476-054-P1-K1-D11
cggacgcgtgggatcgccatttgttttgagagaactagatcaacctgttgatactttgaagcatgttggcattagtggtccaatggtagagaacatagagacaaggctaaaggaggatatactctctgaaattaaacaactaggtggccggttactgcttcataaagaagaatttaatgcagccacaaatcaatgtagtgtggtaggttactgggaacacatagatctggaggacgtgatgacaccagctgaagtctacagcacattgagagacaagggctattgtatcgactacaaaagaatacctttaaccagggaaagagaagcattggctgctgatgtagatgctatacaatcattaatcgaagaatctgctaggtactatctctttatttcacacaccggataatggtgtgttgcttatgcaatggccattacctgccttggactgggtgcagatgcaaagtttgtaatggaagaaacagcagaaacacactttgtatcaaca

SEQ ID NO: 17917 - DNA, 435 bp, Sorghum bicolor
  unsure (1)..(435): unsure at all n locations
  Clone ID: LIB3476-054-P1-K1-D6
ggtagctacagcaagaagatggttgcgctccttcgtccactctccgccgccgccttcctccgcgtccccgccgcgccgctcactggttccgcagtcgccgctagtgccgtaggaggcaggcggtggagaagcgtgagggcgaacgccggcgggggctggctatccgggctgctgggcggcaagggcggcggcgcgtccacagcgatggcggtgacgccggggaccgtgaaggccggcgaccccgtcctgcacgagcccgcgcaggaggtggcgccggnggacgtgcggtccgagaaggtccagggcatcatcgaccggatggtcgacgtcatgcgcaaggctccaggcgtcggcctcgccgccccgcagatcggcgtcccgctcaggattatnngtctcgaggatacgcaagagtacatcagctatgcacccaag

SEQ ID NO: 17918 - DNA, 530 bp, Sorghum bicolor
  unsure (1)..(530): unsure at all n locations
  Clone ID: LIB3476-054-P1-K1-E8
cggacgcgtgggctaggacgatgacgtcgagaatgtacgtggatgcatgaagccgatggatctgctgcacccagtgttcgcagaacatcgacctccccgatagaagcaccagccgggcgctgtgtaggtctgtaggaatactcccacgacacctcgcgcgaggccttgcagcagagccacgccaccggcaccatggccgctcaccgagatctccctgcaggtgccagtgggaggagggcactgccgtgggagtggggatgagcgcctcggtcatcagcatatgagagcgatttgaaatgtcctgaagagagagagcagcggacagagaaagcaggggctgggttcattattttagttttagatcccgtccaggctgacatgggatggatggtacactcagctggttgggttcgaccatgtaattgcactttgttctggggctttcactaactattgggagccctaagctcctaatagtgtgtgtgtgtgtaggtcataatatgtcgactaggtatntatatcactcatgc

SEQ ID NO: 17919 - DNA, 548 bp, Sorghum bicolor
  Clone ID: LIB3476-054-P1-K1-F10
cccacgcgtccgcccacgcgtccgcccacgcgtccgtgagaaccttgtaacctgggcccgtcctctactaagccataaggaaggcctggagaagttaattgatccttctctggatggaaagttcaactttgacaatgtagctaaggtggcatccattgcttccatgtgtgtgcacacggatccatcacagaggccattcatgggtgaagttgtccaggcactgaagcttatctacaatgatccagatgaggcttgtgatgattcctacagtccaaggaattcatctgatcaagacggtgactatgaaggagacctagtctttgagagtggaagctgggggtttgaggcctctgggtgtctagactaccggaattccttaccgtttgttactatggactacagttctggccgaatagaaggaccgcatgaccctcgcgcagcattgtcagcgggaccccatgtccagtcaccagtgctgcagaatagatcaggccccttgcggatgaagaaaaagctggcctccttttaccgctctagaggcagcatta

SEQ ID NO: 17920 - DNA, 527 bp, Sorghum bicolor
  Clone ID: LIB3476-054-P1-K1-F6
gcatcttgtgtatgatctgctactgaaatttattggctcctcatctctggatacaaaggtaggaaagaaatattttgaccacacattcatcgtgaagctacttgaactgtttgattctgaggatccaagagaaagggattgcttgaaaacaatattgcatcgaatctatggaaagttcatggtccaccgtcccttcatccgcaaagcagtgaccaatatattctaccactttgtgtttgagactgatcgccataatggtattgctgaactactggaggtttttggcagtgttattagtggttttgcattgcctctgaaggaggaacacaaaatctttctttggagggttctaattcctttacacaagccaaaatcagttggtttatatctgcagcagttaacctactgtgtgacccagtttgtagagaaggaaccaaagcttgcaagttcagtgatacttggcctgctcagatactggccaataacaaatagccagaaagaagtatgtttctgagtgagaatggaag

SEQ ID NO: 17921 - DNA, 486 bp, Sorghum bicolor
  unsure (1)..(486): unsure at all n locations
  Clone ID: LIB3476-054-P1-K1-G12
gaatgtttgaacaacaaacagctggtagttctctaaaaaatgtgatcttgcaggtttcctgctcctggcaaggcctccaagatggggaatcttgatacctcattatttccacaaatcaataagactgttcagcagcaaagtgaagtcgatgagaagcttgcatcgatactctacgaagctttacttaccctcagacgacagataatggaggagtgtagtgaaggatgccatgcgtaccacatattcaagtaagttgttattgcaccttcatttgtggaagcattcactggctcctgatacggttgagctttccatcttcaggactgacacgttgaaggagatgagcatncgagtaccaagaacaaaagaagagcttttggatataaacggcatcggcaagacaaagctcaagaagtacggggaccgtgtgctngcaaccatcgaggacttcctgagcaaacacccaaatccaaggagaaacatcag

SEQ ID NO: 17922 - DNA, 274 bp, Sorghum bicolor
  Clone ID: LIB3476-054-P1-K1-G5
aaacaaactttcccatccatatcggatcggatcagcactagcttgtagctagcaagccatccctagtccgccatggcaaagctctggtcttggctcaccaccgcgaggtatccgacgccagctgtgtcctgaccgtactcggcgagctgatcctaaccttactattcgccttcgccggcgtcggctgacccatggcatcaaggaagctggccggcagcagcggcgacacggtggtgggactgacggcggtggcactggcgcacacgctggtggt

SEQ ID NO: 17923 - DNA, 463 bp, Sorghum bicolor
  Clone ID: LIB3476-054-P1-K1-H3
cccacgcgtccgggtgcattaaccccaaaggagagcacaccaagagaaggaaaagaggttgaaaattcttttgctgagggtggtttgccctcaaaactaaaaccaaagatggcactcgatgtaaatgagatccttctagttaaaaagaaaagtgttctaggaaaggatggacctaaggagaagaaacagggtgcaaggggggatactcttgtatgtggagcctgtggtcaggttgggcatatgcggactaacaaactgtgccccaagtatggggaggatccagaaatgtcagaaatggatgctaattcagttaagcccaaccctacggatataaaccatttgcaagcaaagatacctaaaagattaataacaaaagtttcctctgaagttactgaaactgaagggccagaaggtatcgaaaagacaaatctgtcccagtaaaatttaaagtaggggcaccgga

SEQ ID NO: 17924 - DNA, 462 bp, Sorghum bicolor
  Clone ID: LIB3476-054-P1-K1-H9
ctcacgcgtgcgatgatgcgggataccatagtgctagtattaaagatggtcaaaaacatggtacgaaacattacattgtacaagacaccatattattgaccactctaatgctaatgcttattattgcgaatgttaatgctactcctcattctacaacaatgacttgtttcatgagcttatgacttattgagttatataaggtgatgaaccatgctgattaccatgcttgaactttggcctacctctgatctgtacactgaactattaaacatcccacttcacaacctaataaagacctaagatttggtttaagactgtgtgtataactgtatgtattaaccttaagaacatactcaccatcatgtagaccatgctggcctttgcgcttaccaatgcctcacctcgggttacacataactatttcctatactgattcacatggcgtgcgtgttagccagcatg

SEQ ID NO: 17925 - DNA, 435 bp, Sorghum bicolor
  Clone ID: LIB3476-055-P1-K1-A11
gttttagttaagaatacattccagcaacattttgcccacagttttcctcaccatggtctctgcaacaatccacacaactcccgactaagaagtttgaagctggcagcctgctacattccaccattgaagggcttccatgcgctcaccagcctggtcttgcaagatttaccagagtccactccaaccgcagcctatgaagctattttcaccttgtgcccgcagctacaagcactgcacctcaagtcctgcacactgaaccaaggtgttgtggccgtacacgcccccaaatcacagatcaagcaacttatcatggagcattgctggtttgggctgattaagctgtacactctgccaatgctcgagagcatggctgttctgcaaagtaatgtgagttatgagcttagctccttcccatacctcacacacttgaatatc

SEQ ID NO: 17926 - DNA, 429 bp, Sorghum bicolor
  unsure (1)..(429): unsure at all n locations
  Clone ID: LIB3476-055-P1-K1-A5
cgaggcttctacaaagggaacggtgcaagcgtgcttcggattgttccatatgcagcattacattacatgacatatgaacagtacaggtgctggatattgaacaattttgctccatcaataggtacagggcctgtcgttgatcttttagcgggctctgctgctggtggtactgcagttttgtgtacatacccattagacttggctaggaccaagctggcataccaggtttcaaatgttggccagcctggcaatgcttttggaaattctggtcaacaacaaacatataatggcataaaggatgtcttcaagactgtttacaaggaaggaggcgcacgatctttatatcgtggagtaggcccaactcttatnggtattcttccatacgccggcttaaaattttacatatactgagatctgaaaatctaagtt

SEQ ID NO: 17927 - DNA, 524 bp, Sorghum bicolor
  Clone ID: LIB3476-055-P1-K1-B10
acggatccacaaaagcatcttccgccgccgcccgactatattcgtccgctccgcactccgatctcctcccaacttcgacccggcggggatggatccggcgccgcagacgcacccgattctttcctacgtgctctcccgcatccccacccttgttaagtccaacaagggctccactaccttcgagttcgacatcgagcagccgtcgcccgtgcacaccccgtacccgcggacggtgccgatgttcccgttcgcgggggagttcgagctcgtctagcgcatgccggggctgcgccacccgttcgtgcttcgcgccatgacgcgcgccggcttcgacgtcttcgccgcgcgcgccgcgcttcaggtgctcgggccgcgccccgaccacgagctcgtcgactcctaccgcgccatcgtcgtcgccgccgaggccggggacgcgcggatccccgaaggggacgccgaggcctgccccgcggggtgcgcctggagcagacccacgacgcctactaggcactgctgcacga

SEQ ID NO: 17928 - DNA, 431 bp, Sorghum bicolor
  unsure (1)..(431): unsure at all n locations
  Clone ID: LIB3476-055-P1-K1-C5
gttctagatcgtgagctagaactagtcctcatagttggtccgggtgtgctcggccggatcgtcgccgagatgtgnnaacaggggtatacaggaggaaaggtttgtggccggagtgggcgcacagatcatcacagcgaattaactgacattggtatcattccctccttgaagaggtccgtagcgggtcccaaatttccaaatgttattttctgtgctccaccatatcgttctgaggattatgctggagatctgagaatagcagcttcgaattggaatggagaaggttctttcctattcacctcgagtactgctgtgtatgactgcagtgacaatggattctgcgatcgaggtcctcatgtctattggttgtcaaaaggaacccttggatgtgcgtcctgatcatatactcaatctgatacatnatgaagatg

SEQ ID NO: 17929 - DNA, 480 bp, Sorghum bicolor
  Clone ID: LIB3476-055-P1-K1-C8
aacgccgaacgccagtgctgcggctgccgagagtccggaccacagctcgcgccgcccgccgcacccgacccgcgtcgcctcgcctcgcctcgcccaggcgtgcgctccctcccttctcccgcgccgtcgcctccggacccgctgggcccagcgggcgccgcccaactcggacgcgccgccgccctcccggtgtgaggcggaggtgcttggggacccgccccccatggcgagcgccggcaacagcggcagcggggacgacgattcaggagggaagctcctggcggatcgctaccagaagggcgaggtcctcggcgagggcacgtacggagtcgtcttcaaggccatcgacaccaagactggaaatacagtcgcagtaaagagaatccggatagggaaggacaagaaggaaggtgttaacttcaccgcattgagggaaattaaactacttaaggagctgaaagatcctaatattatagagct

SEQ ID NO: 17930 - DNA, 463 bp, Sorghum bicolor
  Clone ID: LIB3476-055-P1-K1-C9
cggacgcgtgggctcatgctagaacaaagggttctacaagggttaggctgcacagagaattggctgcattgctggaagaggagctctctcgcaggggaacttcagtgataccagcgggcgaacaatttgggaaatggaaagggctgcgagaaagcactgatcgggagatagtgtggccaccaatggttattgttatgaacaccttcttggaaaaagatgacgatgataagtggaagggaatggggaaccaagagctccttgattattttggagaatatgcagcaactaaagcacgtcatgcctatggtccctctgggcaccgtggtatgagcgtgttaatatttgaaagctcagctgtgggctacatggaagctgaacgtctgcataggcactttgttaatcaaggtaaagacaggaatgcatggcagctcaacaaggttcgattcgtacctggtgggaaaag

SEQ ID NO: 17931 - DNA, 432 bp, Sorghum bicolor
  Clone ID: LIB3476-055-P1-K1-D3
cccacgcgtccgcgtagaaggcgaaagggtgtgcctattcttgtgcctggcttatgtcttcctaaagcactgcagccttttcttcctatatttcagcagggtttaattagtgggtcggccgaaacaaaggagcaggcagctgaaggtttaggagagttaattgacgtaacaagtgagaagactcttaaggaagttgtagtgccaattacaggacctcttattcgcatccttggtgatcggtttccctggcaagttaagtcagctatcctatcaaccttgacaatcatcatcatgaaaggtggaattgcacttaagcccttccttccacaacttcaaactacatttatgaaatgtctacaggataacaataggtctctcctgacgagggctgcagctgctctcggaaaagctagtgctcttagcaccacgggt

SEQ ID NO: 17932 - DNA, 487 bp, Sorghum bicolor
  Clone ID: LIB3476-055-P1-K1-D9
cccacgcgtccggacgtctccaactatttcagtatctacgggccagttcacgacgtgcgcattccctaccagcagaagcgcatgttcgggttcgtcaccttcgtgtacccagagacggtgaagctcatcctcgccaagggcaacccgcacttcatctgcgacgcacgcgtgctcgtcaagccctataaggagaagggcaaggtccccgacaagtacaggaagcagcagcaaggggacttctccggctgcacgacgccccccggcgggctggacgcccgggacccctttgatctgcaccagctcggcgccaggatgctgcagcactcaaacagcgccaacgagctgctgttgcgccgaaagctggaggaacagcagcaggctgccgaactgcagcaggccattgagctccagagccgccgcctcatgggtcttcagctgctcgaccttaaggctcgtgcagcaacgacagcagcagcagcatcaccac

SEQ ID NO: 17933 - DNA, 555 bp, Sorghum bicolor
  Clone ID: LIB3476-055-P1-K1-E1
gatttggactcgaaacgcaggaaaatggaatctgctggtatcgacgctgctttgatgggtaaaccgaatcgcgagccccgtgttgttgtacaaactgttagtgaagttgatatcttggatgatgggtatcgctggcgcaaatatgggcagaaagtagtgaaaggaaaccccaacccacggagttactacaaatgcacacatacaggatgcccggtcaggaagcatgttgagagagcatcacatgacccgaagtcagtgatcacaacatatgaaggaaaacataaccatgaagtccctgcttccaggaatgcaagccatgagatgtccacagctcccatgaagcctgtggtgcatcctattaacagcaacatgccaggccttggtggcatgatgagagcatgtgatgccagggccttcaccaatcaatattctcaggcagctgaaagtgacaccatcagccttgaccttggtgtggtatcagccctaaccacagcgatgcaacaaaccaaatgcagccctcagttccagaaccttatcagtatcaaatgcaacaca

SEQ ID NO: 17934 - DNA, 375 bp, Sorghum bicolor
  Clone ID: LIB3476-055-P1-K1-E11
gtgaccccgcacgcgccgtcccaccggcgagcaggccggcctcgcggactcgtttaaccgagctacgctggctgaaaggaccggcaccgacttatctgaatgggacggatactgacatcgtacatagtgacatcgtgtcaacatcagcttacaaaatattcgcaaaaactgaacttaatgtgaagtgttactatcatcaaatcctgggaacttcatgatgccaatggtctgatgtggaagatatgacaatgatatttgtaaaaacgcatgatgaagggctctggcttgtgtcatggattgttttctgcaaagacattgttaaagtgcttattctttacagataagctggatgatgtttcatacttatcaaactga

SEQ ID NO: 17935 - DNA, 418 bp, Sorghum bicolor
  unsure (1)..(418): unsure at all n locations
  Clone ID: LIB3476-055-P1-K1-F1
gagattacanaaaatatcgttaatgataatatctnttcccaatatatgcacaagattctgccaactggcaactacctctggaccttcaagaaacaatttgcaatccaagtggccctctcctgcttcatgtcgtatatgctgcagattggtggcagggctcctaataaaattctgtttgctaaaaatactgngaagatcttccagactgacttccatccagcttatgatccaaatggaatgatcgagttcaacgagcttgttccatttaggctgacacgcaacttgcaagctttcttctcgaatnttggtgttgaaggtctcattatgtctgccatgtgttctgctgcccagtcagtggtttctccaaaacaaagccagcacatttggcatcattttgctatgtttttccgtgatgaac

SEQ ID NO: 17936 - DNA, 407 bp, Sorghum bicolor
  Clone ID: LIB3476-055-P1-K1-F4
agcagcctttgctctaagtataacaagagcaaattctttcctgaagatggctttacacctctgaactgaaggctgaatgcctctgaagattaaatcattcctgatagaccaaatactccaactcatggtgattaaaatttccaaagcaaaagggcagtgaagttgagctttaaacatgaccactgtgagaaaaggatcttgcagatgaggcactatcagacccaaagttgcccaacatgcctgagcaaaggggcagtcaaggaacaaatgagtaacagactcctcagttggcatggaagtacaaaaaacacaatgataatcatccaagaacaatatttctccgttcaatatctacgtggtgcttaacctgtctcgtaataggagcccaaaagaaaatcttttttttt

SEQ ID NO: 17937 - DNA, 467 bp, Sorghum bicolor
  Clone ID: LIB3476-055-P1-K1-G3
aagaagaaatacaaaggaagaaattgattggagttatatccagttcgtagataaccaagagattcttgatcttattgagaagaaaccagggggtataattgctctactggatgaaacttgcatgctgcgaaattcaacccatgaaatatttgctgaaaagctgtatcaaaaatttaaggagaacccacacttcagtaggccaaagttttcacggtctgatttcactattcatcactatgctggaaatgttacgtatcaaacagatctgttcttggataagaacattgattatgctgtgaatgagcatcaagttttattacatgcttcgagatgttcatttgtttccaatctttttccaccttctgaagaatcagctaaatctacgaaatttacatcaataggttcaagctttaagcaacaattacaatctttgctggaaactctgagtgcaacagagccacattaca

SEQ ID NO: 17938 - DNA, 405 bp, Sorghum bicolor
  unsure (1)..(405): unsure at all n locations
  Clone ID: LIB3476-055-P1-K1-H4
cccacgcgtccgggcctttggggtcaatttgcaaagggcatcgactagagcagctggttcccatggtttattcgagatcaggtgttcagataacatgcttgttactcaagttattggccctggtgaagaggcgtctcctgattctcatgaaacattcaagcatgatagttctttttgcatccagatgcatagtgttgaggagacacagagtttttctgtgtctatggagacaaagggtgatatcaaaagtgattttgttttctttcagtttgcggtccattattccgatatatatcaaacagaaatcactcgggtgatcactatgaggctacagactgttgatggttgtctgcatatctgtcagtgtgcagcanggatgtgcgtagttatcattggtaaagaact

SEQ ID NO: 17939 - DNA, 353 bp, Sorghum bicolor
  Clone ID: LIB3476-055-P1-K1-H8
atgactcgtacggtgtgctgctgaatgcgacgacaagattgacaggtatagcatcctagactggtacaagggcctaactgtgcgaggggctgtagcctagagaaaagaaccaaagatgccttcatgacggtccaaacagtttgccacataatgaggcgagctaataaaggtggaatacgaactggttctggtgcacgagctgagactgggatcatataacttggtatgagcggtacagttcgtgctagcggtatgactgctgtggtgaaggctaatgatacgcacgatcatgatctgtaacaggtgatcacttaacacaatgaacactacaatgataagagacatgctgagat

SEQ ID NO: 17940 - DNA, 168 bp, Sorghum bicolor
  Clone ID: LIB3476-056-P1-K1-A1
taacaatgggtcacaaggtttgggagaggagacggcaatggcggaggcggcggaatgctcagtcattcatccaccgtggagaagctctacgcatgggagaagaagctgtttcttgaggtcaagagttacgagggggtataagcaggagcatgattaagaaggtgagtc

SEQ ID NO: 17941 - DNA, 203 bp, Sorghum bicolor
  Clone ID: LIB3476-056-P1-K1-B5
gtggcaagtcattgcattgtgagcatgtggaagtgactatgccttgttagatggccgctgaccattctctgcactgatgcagtgtgatatgttcggtcgagtaccctggcatattagtgtgttgcgtgcgctattgaggatgatacatggcctggttggatgacatccgaaatccaaaaactcgctatgacatcgaatcctgc

SEQ ID NO: 17942 - DNA, 383 bp, Sorghum bicolor
  Clone ID: LIB3476-056-P1-K1-C12
acaacgtgtccctatgatgatgccgcggcgagccgcgcatgctagcgggtggcaagcggcgctacgggttcgacgacggtgacgcccgcttagatcgaccgcgcaatgtcgccgttgatgaccgcgacgacgtgtacgtaggacacgaatcgaaccatgccggtcgcaagggcccgccctgcgggtatactactacagctaccggacgtctgtcatgatgacctggagagaatgatggactggcacagaacgctactctgttgagatatgacgagccatgttatgtccctaaaataagtgccatgttagtcgctcgcagaagaaatcctatggctctaccaatctatctagaagctgaaaattgtgcacatgaaaaacacata

SEQ ID NO: 17943 - DNA, 363 bp, Sorghum bicolor
  Clone ID: LIB3476-056-P1-K1-C9
gctcccagacgactgttgtgccgccgccgccgccgccgcagcactaggccaggtgctgaggctttccttggtctcttcgccggcgacgagcacccaccagggcatgaaaatgtcagcaagtgctttgaaagatctcaatgtttctcaatcagcaaacctggagaatggaaaagacaattctgtgaaatcctgcattagcaagcctgtgttaaatggcaacagttgtgccaaaaaggaagaaagttctctgtctgcttgccctgatgcagtgacgaatggaaatgtggctggaaatgcagacgtggagtacattgattctgagaatttagtagatctaccagatgttgatgcagctctaagtac

SEQ ID NO: 17944 - DNA, 215 bp, Sorghum bicolor
  Clone ID: LIB3476-056-P1-K1-D12
gcacacgcgtacgggacagggtaagcagccaccctagcgggacccctggatccgcagccgtgtgtgtagccttggttatcgacgtggggaccggggggaggaacaggaagaccatcagctccgggcctaattccgtcaagttctacttcaggctctccggtaacctgtaccggtggccgattaggaggtccaagactaccttcatcgctgggttc

SEQ ID NO: 17945 - DNA, 129 bp, Sorghum bicolor
  unsure (1)..(129): unsure at all n locations
  Clone ID: LIB3476-056-P1-K1-D3
gtgacagaagcgattctgtgtttggaagggaaagtaacagtggtgatggtgcaaaatggggtggtggaggtaattggaacgctacanatccaccaagtaaccagccttggagtagtagtggaggcacca

SEQ ID NO: 17946 - DNA, 388 bp, Sorghum bicolor
  Clone ID: LIB3476-056-P1-K1-D4
ccgacgcgtacgacgaagtgcaccacgaactctgcgtccttcgctccgtgcctcccgcgctgtctcgcgcgccgtctctccgcggctccttgcggcagtgctggccgcaacacgcggatgcagacgctccaggctccgtcccaggctcagcggatgcgtcagcggatgcttgtcaaggctgttgacatagctgctgaactagccactgtatggacggtggttactgagggctcgaaggaacacctggcggcacatctggatgcaactctgcattcagcgctgggatacagaagctgtcagagaagcgctgtgactcgtgtgcagaaacttgtggcaccgctgggggcaaagctgcgccagaaggtacagccagggagacatctgcaga

SEQ ID NO: 17947 - DNA, 416 bp, Sorghum bicolor
  unsure (1)..(416): unsure at all n locations
  Clone ID: LIB3476-056-P1-K1-D8
ggcggtgtaccagcagttcgacccggccaagtacagccccttggcaacacccagcacaagacccggcgggcggcaagttcgatggtcacaacgtcagcagcggcggcgctgctgcgggcttctaatccggcgggacctgccggattcctgcttcgacctcgcccgtagcgcgctggaggacgagttcagcgtcgacttccctagctgacgctccgcgccgagagtcgtgatcacatgtngtacgtcgagtcaacatactgaactgaagaacacacagatcctcatcatatatatactctagagcaacattaccacaagaatctgagcatttgctgatgtctgtattttcttttgtatcagcgatctattgacgcacatgtataatgtggtgaaaaaaaaaaaaaaggcgttagtca

SEQ ID NO: 17948 - DNA, 385 bp, Sorghum bicolor
  Clone ID: LIB3476-056-P1-K1-D9
cgctgagattgcttttgcggatgctattaaagcatttcaagaggtctttgaccacacaaatgttatactgatcaactgtaacttaggtcatggtaggagagctttagcagaggaatgtgtatccaggattgatgaatttcagaagcatgatcttcctgaaggcacatatatgcaatccttcaagtcagccaagtcagaatattttcaagcaataaactactacaccgcagctaagaggcaactgaagtatgtcaatactgaagtcgataaagtactataccatgaggtttacacacagtatgcccatacctacctgaggcttggaatgcttttggcaagggaaagcttcttaactgatagttatgaaggcggacttgtcgatgac

SEQ ID NO: 17949 - DNA, 215 bp, Sorghum bicolor
  Clone ID: LIB3476-056-P1-K1-E2
atgctgatagggatgaggatgaaaaagagagtcatgctgaacttctttctcttcctcctcatggatctgaagtttatgttgggggcatatcttctgatgtctcttctgatgatctcagaaaactctgcgagtctattggagaagtagtggaagtgcgaatgccaggaaagagtggtaagcttgatgcttttgtcaatttcagaactaaagagctg

SEQ ID NO: 17950 - DNA, 383 bp, Sorghum bicolor
  unsure (1)..(383): unsure at all n locations
  Clone ID: LIB3476-056-P1-K1-F11
caacttatcaggcaggtggagcaagatgttgagactgtaatccacgttctccagccaggtccaatagggattgtggagcacaaattcacagatgcggagatcttggaggccaggggcacagtgaaaagagcagtcgataattggcgaagaaattggacccttgagagaaatcttggcagcacgacttttgataaatggaaataatatactagtgtcttctagcaacagcacttgaaataatagggtgccatggctggngtgcagctgtgctatttatttttagttagaattgagcacgatctgcttatcgggagtatgtaaactgttctaaatgatcagctgttcactttattcatggcttgaaggtcatattagagaatgag

SEQ ID NO: 17951 - DNA, 340 bp, Sorghum bicolor
  Clone ID: LIB3476-056-P1-K1-F7
ccaagattgcacagttcgccgagaagaacccggacgtgctgctcctgcaagtgaactacgagacgcacaagtgcatgtgctacggccttgacgttcatgttctaccgatcttaacgttctacaagggatccgagggtcgggtcagcagcttcagctgcaccagtgcaacgatcaagaagttcaaggacgcccttgccaagcacggggctgacaggtgcagcctatgtcctgcactgggggtggacgtgtcggaacttatggccttgtctgcgaacagagacctgcagttcacgtacgacaagccgggcctcatcgcagcttgctgaagccattgccaagg

SEQ ID NO: 17952 - DNA, 384 bp, Sorghum bicolor
  Clone ID: LIB3476-056-P1-K1-F8
gacccacgcgtccgcaattctgggttctagacaaagatggccttattacgaaagctaggaaggatctggattctgcagtggcacgttttgcccgaggttttggtcctgatgaggtcccagatctccatgagggggctagtcttgttgaagtggtcaagaaagttaagcctcatgtgcttttaggactatctggagttgggggcatatttaatgaggaagttctcaaagctatgaaagaatccgattcccctcgccctgcagtttttgcaatgtccaaccctactactaaagctgaatgcactcctgatgatgtattcaagcatgttggtgagaatgcgatatttgccagtggaagccctttcaacaatgtttctttaggaaatg

SEQ ID NO: 17953 - DNA, 378 bp, Sorghum bicolor
  unsure (1)..(378): unsure at all n locations
  Clone ID: LIB3476-056-P1-K1-F9
cccacgcgtccggcctgaagaacctgcggcccaccgccaagtgggacgtgtacgccttcggcatggtgctcctggagctgctctccgggcgggtctactcggaggtggagctgtgccagtggcacgcggngctggtggccgccgaggagcacggccgcgtgctccggatggccgaccccacgctccgcggcgaggccgacggcagggaggacgcgctgctggcgtgcttcaagatcgccttcgcgtgctgcgccatggcgcccggcaagcggccctncatgagggacgccgtgatggtgctcgagcgaaccacggccggcgccgncgcgagcggcagtgccgccgccgttccctgaggggaacgaaaaaaaaactgac

SEQ ID NO: 17954 - DNA, 429 bp, Sorghum bicolor
  unsure (1)..(429): unsure at all n locations
  Clone ID: LIB3476-056-P1-K1-G1
ggttgattcagttgttgaagcctgttccaatccttcaataattcggtctctgttcagtgccactttgcccgattcaattgaggctcttgcacgcactataatgcatgatgccattcgagtcattgtcggcagaaagaattcagcctcctcactgattaagcaaaagttgattttcgctggaactgagaggggaaangtgctagcacttcgccaaagctttcaagagtctctcaatcctncagtattgatttttgttcaaagcaaagagagggccaaagagctttacanagaactggcattngatgacgttagagttgatgcaattcatgcagatctcaatgagcagcagcgtcaagatgctgntgacaatttgagagctggaaagacctgggtactgatagcaacagaagtcattgcccggggaatgga

SEQ ID NO: 17955 - DNA, 331 bp, Sorghum bicolor
  unsure (1)..(331): unsure at all n locations
  Clone ID: LIB3476-056-P1-K1-G5
tgatgaatctgatggaaaggatgagctggatgaactggatgaggaagattccgacgaggatgatccaaaatttcagcaggacactgcctgtgagtataggaaactgatcaccatccaagctggcaaaccgaaaggccatttgcgggatgcgctaaaggtggatccagaaaaagtcaggcggctntctttgagtgagacacagttagctaaagcaacaacttctcatggtgctgaagtcataaggttcacccagaataatatactccgtgtgtatccaaagggcacgagggttaattcttcaaactatgatccaatgaatgcctggactcat

SEQ ID NO: 17956 - DNA, 193 bp, Sorghum bicolor
  Clone ID: LIB3476-056-P1-K1-H2
gacgacaatggtggcgcgtgcggcttcaagggcgtcaacctcccacctttctcggcgatgacgtcctgcggcaacgagccactcttcaaggacggcaaaggatgcggctcatgctaccagatccgtgcagggccaaccttgttggctccggcgtgccggagaggtgatattaacggccatgaactactacccc

SEQ ID NO: 17957 - DNA, 167 bp, Sorghum bicolor
  unsure (1)..(167): unsure at all n locations
  Clone ID: LIB3476-056-P1-K1-H3
cttcttctgcctggaggaccgcgcgctgctctgccggagctgcgacgtcgccgtgcacaccgncaacgccttcgtctcggcgcaccgccggttcctgctaaccggcgtccaggtcggcaggactggatggacgaccttccggagcagagcagagggcgcgctcccgc

SEQ ID NO: 17958 - DNA, 476 bp, Sorghum bicolor
  Clone ID: LIB3476-057-P1-K1-A10
cccacgcgtccgcccacgcgtccgcatacatgcaaaatctggggaaactgaaaaagctatagaaaccttcaagaaagttacccgtattgacccaaaagatcatcaggcatttgtggaacttggtgaattgttggtagaatccgactgggctgctgctatggaatacttgaagacagctcgaaatctccttaagaaggcaggggaggctgtccctgttgagttgctcaatggaattggacttcttcattttgagaagggagagtttgagatggcagaacagagttttaaggaagcactaggtgatggtctttgggtttcagttatggacgggaaagtaggcagctctatggtcaactggagtgtccagaacaaggatcagagcttctttcaccaacttgaagaagaagggtacctcttgaatacattcaattaaagtaccacactgttaattatgcaagataactggagaactcatg

SEQ ID NO: 17959 - DNA, 489 bp, Sorghum bicolor
  Clone ID: LIB3476-057-P1-K1-B11
ggttggtgacaggcaatgtggtaaaaaggtgacaaagtctgattcaggcaactggctatgtgacaagtgcaatcaagagtttccagagtgtgattacaggtatctcctgcagttgaacattcaagatcacacgggaacaacttctgcaacagcatttcaagaggttggacaggagctacttggttgctcagcgcgagagctcaacatgtttaaagagaatgaagatcctcgctacacagctgtcttgatccattgcttgtatcagaattatttgttgaggctaaaagttaaagaagaacagtatggcgatgaacgacgagtgaagaacactgtggtcaaggtggagagggtggatccttcggctgagagtaaatttctgcttgattccatttcaaggtttatagtatgagagctttattcttacatctctcaactgctggtccatgtgttgctcgcttagaagtggtataattagtatctaagtctccc

SEQ ID NO: 17960 - DNA, 174 bp, Sorghum bicolor
  Clone ID: LIB3476-057-P1-K1-B2
gagagatgagagagctgggcaataggtcgtcgttgatggctccgataactgtacgggcgacgtgtcgtggacgtgacccgtgcgtggtgccctggggaggccgcccccatccagacgtccttcgattcgcaccgccaccaaagcccaacactgcccaacgtcgtcagtcacttc

SEQ ID NO: 17961 - DNA, 306 bp, Sorghum bicolor
  Clone ID: LIB3476-057-P1-K1-B7
attaactgttgtcattgcgtcccagctaacagagagttctagactgaagctagatgatatatgcaggaaagcacatattgatcacggtaagctgacagttcatatggtctaacaggtttggtcagggatagcgtcatggagcactgtgtaatacaatcaacaccagaccacttattggatgatgtgggactgcacaatgcatggactgatctaaagccatttcaagaatcaattgacatatatgatgaaaatcctggtggacacacacatactccatacattgatcttcttgagcgacttgcacaa

SEQ ID NO: 17962 - DNA, 416 bp, Sorghum bicolor
  Clone ID: LIB3476-057-P1-K1-B9
agataagaaaattacagatttagttaccaaacagcaacaaatggatgctgaacgtgatcatgccaagtcggagttggaacaatttaaggttgacattgccagggctatgaagcaaaagtcgtcacttgagaaagcccttggcaagaaggaaaaatcacttgacaacatccgcaaccaaattgagcaagtccagtctagcattgcaatgaagaatgatgaaatgggcacagagcttattgatcagctaacttcagaagaaagagatctcctttcacgattgaatcctgaaattactgatttgaaggagaggtttctaatgtgtaaaaacagtcggattgagattgaaacacgaaaggaagaattagagaccaatttatcaacgaatcttatccagcgtcagaaagagctagaagcga

SEQ ID NO: 17963 - DNA, 490 bp, Sorghum bicolor
  Clone ID: LIB3476-057-P1-K1-D11
caaagaaatgaatgaagtgctatttaaatcattgcctggtgatacacctgaccttgagatgttggcatcaagtcatcttctgagccaaaggaagagtgatttgattgtcaaagaaaggcttggagtacgtaaaaccaggctgaggttgaaagagcagattcttacaatgaagttcaaggcatatcgtcacttgtggaaagaggatgttcgactactttctgcaaagaaacagcgttcaaagtctaataagcgcattgatcagagcaaccgaacatcacaaattggatctcagaggcaacgctcctctaaccgctcacgattagccatgcctgctggtaatttaagtacattctcaactccagaaatgtcagatgttgcaaggaagttgttttcagaattccaaattaagcgctgcagaaattacttgaaaatgcctgcactgattattgatgagaaagagaaggaatgctcgaggtttctgagcaagaat

SEQ ID NO: 17964 - DNA, 248 bp, Sorghum bicolor
  Clone ID: LIB3476-057-P1-K1-D2
cgcacgcgtccgacgacacgtccgtgattccattgcaagacattgccttaagaactcaaacactgctgggttcataaaatatcttagaggctgatgttctaatagtgggggcccaaatggggggtgcggatattccaattttgttggaaccaatttttggaaaacagatggaatttcctttggaaggttccttggagttggcttggattagtcttaaaaagcagcctcgttggttggtcaaggttctt

SEQ ID NO: 17965 - DNA, 341 bp, Sorghum bicolor
  Clone ID: LIB3476-057-P1-K1-D3
agccacagctttttgcagcttggtctgaatgtagcatatgaatcattccatgacttgctcagctcacctggccttagcttaatggccacacatttgatttctcaagctaagtacaaagatccttgcactccaaggggatttacacacatagcaggatcagttaaacttcctgttagtgttcttgagccgaaggttgagtacagaccgtttgctcatgctgtggggaacttttctgagtgtagatctgcagcgttaacactacttgcaaaaaggaaaggagggtgtacatatcataatgtcgccttgagcggcatttgaccctgagttgaaggaaattttag

SEQ ID NO: 17966 - DNA, 462 bp, Sorghum bicolor
  Clone ID: LIB3476-057-P1-K1-E5
gatgattcaagcctttttgagaggtcgcagggtagctgatgcgctccacatgtttgatgacatgttggcccaaggagttctgccaaataccgggatgataacatcatttatcaatccattgtgtacatttggaccgcctcatgctgctttgatgatttataaaaagagtaggaaggctggttgtgtaatatccttgaaagcttataagcttttgctagaaaggctcgctaaatttgggaagagcggaattgttttggacatttgggaagagatgcaggagtgcggatatcaacccgataaagtgatttacgagtttattgtaaatgggctttgcaatgtgggtaaggttgatgctgctgtgtttgtggtggaggaatcacttcggaaatggcttctgtctttggggagagttgttgcagcaaactgaacaacaaagctgttgggaaaatggccaaagttgag

SEQ ID NO: 17967 - DNA, 479 bp, Sorghum bicolor
  unsure (1)..(479): unsure at all n locations
  Clone ID: LIB3476-057-P1-K1-F8
cttgaatgaggaatcggatattatattgaagagacctggcattaaggcaaggttgcataatctaatgattcagctgaggaagaattgcaaccatcctgatcttttggaagctcaagttgattcaataggtttatatccacctgttgagaagatcctggaacaatgtggtaaattccaactttttgacaggttactaaattacctgattgaacaaaagcacaaggttctagtattttcgcaatggacaaaagtgttggacattattgagtattaccttgattcaaaaggccatgatgtttgccgaattgatggtagtgtaaaanttgaagaaagaaggaggcagatagcagaattcaatgacttgaatagcagtatgcgaatcttcctcctgagcacaagggctggtggacttggcatcaaccttacttctgctgatacctgtatcctctacgacgtgactggaatcctcagatggattg

SEQ ID NO: 17968 - DNA, 288 bp, Sorghum bicolor
  Clone ID: LIB3476-057-P1-K1-G10
cgctccctccttcctctcatccgtgtccaagcgacgacaccacacgcgccggccgcgcgccaccgagatgtggagctcagactccgaccccgagctcaccgccgccgccgcgtcgtcctcatcttccacctcgtctgctacctccgtctctgcctccccgccgccgaccccgcctcctgctgcacgccttctccgccaacgcaacggcaaccgccgccgccgccgcagccgcaagcagggcagcgccgtcgccgactcttgtcccgcggtccccgagcctgaggcgga

SEQ ID NO: 17969 - DNA, 314 bp, Sorghum bicolor
  Clone ID: LIB3476-057-P1-K1-G2
gttatccagtagggatgttgctggatgtgctggctaagcacagagacaagtaccatgatttgctgcttgcggattgccgtaggcaggtggcagaggcactggctgcagataagtttgatcagatgctcatgagaaaggagtatgaatactcaatgaatgtccttgcatttggaattcaaagctcagatatcaccccagctttcccatatgttgcaccattttcatgcactgtcccagacatttgccgtattgttcgttcattcattgaagattctgtgagcttcatggcccacgggggtggtgggatacctatg

SEQ ID NO: 17970 - DNA, 380 bp, Sorghum bicolor
  unsure (1)..(380): unsure at all n locations
  Clone ID: LIB3476-057-P1-K1-G6
cccacgcgtccgattacctacgcctcgtcccgctcatcacgctcgtcgacaatgcccgcattcgggatcggcttgagtatattgagagggaccaatgtgaatattcttttgacgaggaagacaagaaagtgcaagatgctctgttaaatcctgacccttgcacgaatcctacaatagtgctcaagaagactctgtcatgttcctatccaaacttgcctttcaatgaggccctccgaaaggaaagtgagaagcttcaggttgagctttcaagatcacaaagcaacatggatctgggttcgtgtgaggttattcagcacctgaattgagtaaccaaaacttgtgaatctacanatccagaggaagaaacaaatgctaaagct

SEQ ID NO: 17971 - DNA, 238 bp, Sorghum bicolor
  Clone ID: LIB3476-057-P1-K1-H1
caaacctgtaaaggacctggaggctgcattccaggatcctgatttagaggcaaatcctatgctatttcttaaccaaattgttttgcaggagtttcaaaaccggcaccatgagatagaatcaatctcaattaaacttaaggttgataagggtgaccatgaaatttgctgttttgaaatcgaaccagtaaagggtaaatggttcccaactttgcggactctggtttcaaaattaaatgac

SEQ ID NO: 17972 - DNA, 308 bp, Sorghum bicolor
  Clone ID: LIB3476-057-P1-K1-H3
cccacgcgtccgcacaaatagctctgcttgcaaactgaagttgggagatttcgagggtgctttgttagatgctgattatgcactgcgtgaaacggaggacaatgcgaaagcttttttccgacacggacaggtacgcatggcactcaaccatattgatgcatcagtcgagagcttcaagcaagcactggagctagagccaaacgatggaggaattaagcgagagcttgctgctgcaaaaaagaagatttctgacaggcgggatcgggagaagaagggtttttaaagttgttccgatctttcaggaggat

SEQ ID NO: 17973 - DNA, 352 bp, Sorghum bicolor
  Clone ID: LIB3476-058-P1-K1-A5
cttgttgcagcactgaaaaaaattgaaccagaagatccatcagaacctacacatgatcctgaggtgcttacacctgaagagcacttctatttcctcaagatgggccaaaaatgtaaaaattatgtgcctgttggaagacgtggaatttaccagggagtgatcttgaacatgcacttgcattggaaaaagcatcaaactctccaagtaattgtgaaaacattcacaccagaagaggtcaaggaaatcgccactgagttagccagactaagtggtgggattgtgcttgacattcaagatgggaacacaattatcatgtacagagggaaaaactatgcacaggcaccaccagaaa

SEQ ID NO: 17974 - DNA, 463 bp, Sorghum bicolor
  unsure (1)..(463): unsure at all n locations
  Clone ID: LIB3476-058-P1-K1-A9
gattcctattttctcttttgcagaaatcaggctatgaggtgtacttgctggaggcaccatacaaggatccaacgggctgtgctgcaaggaatgtgcacggatttacattggatgagataaaaaagatggcagcagactgggaggaggctccaccactgtatctgcagctagatatacattcattattccatgatgataaccttcgtggccattctatacaagaggtagatatggacactgaggatgttgatgatgctaatgacacaactagcatcattgctgagacttcacagaaggctgtacaggatccaccatatgaaggcttctcaaagccaggggagaagtggaactcagaagtagaagatgaccgggatggcttaaaagagctaggacagagtaaatggtcaaaagattttgacgatgacnaccgaaagtctgaaaatacagaggaaaacacacatgc

SEQ ID NO: 17975 - DNA, 387 bp, Sorghum bicolor
  unsure (1)..(387): unsure at all n locations
  Clone ID: LIB3476-058-P1-K1-B11
aaaaaaaaaaaaaaaaaaaaaaaaataaaaaaatataaaaataaaattattatatatataaaaataaaaatatttaaaaaggtatataaaaaaaaattaaatatatataaaaaataaaatttaatattaaattttgggccggcccttttaaagatccaaaatttatttccccttccttttaaaataaaacttttttaatatggtccctaaatttaatattacttcccgttgttttaaaactttgnaattggaaaaacctctggtttcccaattttaattcttttgaaaaaaattccccttttttcaaatttggttaataaaaaaaaggcctcaaccaatccccttttcaaaaaatttcccaccttaaattgcaatatgaacccccct

SEQ ID NO: 17976 - DNA, 241 bp, Sorghum bicolor
  Clone ID: LIB3476-058-P1-K1-B12
ctgcaatctcaacggaaggatcaaaggctccaaatataataaatggatcgacgcttagttctgatttcaggggcaatctggtgcctactttcagtgccaccaagagaaaaaacttcaaacaacataaaaatcagaaaccgcaaccatcagctccaattgacaatgagcacattttgggagttgaagggacactgaacagcctactggatgtggacggtggtatcagcaagcgaaaggatgc

SEQ ID NO: 17977 - DNA, 108 bp, Sorghum bicolor
  Clone ID: LIB3476-058-P1-K1-B2
gcggaagctggggtgatacaccaagatgctacagagaactgatgacaagacacaggactgcatgggcctgcagagagtcgtttcgcgtatactcggctgctatcacat

SEQ ID NO: 17978 - DNA, 428 bp, Sorghum bicolor
  Clone ID: LIB3476-058-P1-K1-B4
cacacactgacacgcccacaacctacccagacccccgcgccgccgtcacgcccacccccaccgcaaatcgccgccgccgccgccgccatgggctcctccgtcagccaggccggggcccctcctccacctcctcccacatacgcgtcgacgcctccccccttcgcgcccgctgccgctgacgccgccttcgccaccccgccgccgaaaccccatgaggaggaggcgaccgaggagaaggtggactacctcaacctcccgtgccccgtcccgtacgaggagatccagcgcgaggccttcatggcgctgaagccggatctcttcgagggcatgcgcttcgatttcaccaagatgatcaccccgtgcttcgctttgagccacagcgtttacaatggatccactgagatcccggcacagggaaaacgatgtga

SEQ ID NO: 17979 - DNA, 493 bp, Sorghum bicolor
  Clone ID: LIB3476-058-P1-K1-B8
cgtacttgtgctggaagtcctgcatctaaagaaacagacctgtactcagattggagtgagtcagagaacaaccatgcgcctttagcaactgactcagagggcacttaccagtccagggatgttcctgctgaagacagtgcagtttaccatgtaccaaacttaccacatcacagtgattctggatcatctccatcagaacattatggagtgggaagtggaagtacacattctgaacctgaagaagtggtaccattaactgcaacttccaagcagaattcagttaaaggattatgtgtatcaaacaagatgcaatctccaaacggtgagtgtgatgttactgaatacacagatgatacattagatgcgcatgatgatgctgagcaccctaatgcatcaaatgacaacaatgattttgtgactaatctgataacaaagagcttcaatattaatattgctatgcgcatcggaagagcatggaattatgttaatggct

SEQ ID NO: 17980 - DNA, 285 bp, Sorghum bicolor
  Clone ID: LIB3476-058-P1-K1-C10
cggacgcgtggttccggtcttggttttggttttggcggcaccaaccggacaacccacaagcgcgcttcgggggccaatggccaacgcggacagggaccaatggccaaggcccccgccccggggccttttcttcttctggcgtttcttggcgttgcaacggggggccgacacgaagcgcccgggccccgggcgttgtggttcattttcgcggggcccgagtattcgcgccttccgaaacgggaccacgggcggcacgccggcgggcccgcgcttccggcggggctt

SEQ ID NO: 17981 - DNA, 506 bp, Sorghum bicolor
  unsure (1)..(506): unsure at all n locations
  Clone ID: LIB3476-058-P1-K1-C2
gctgcagcaaccactgatggtgttttattgtactcagttgatgaatcatttatttttgatccgacagaccttgacattgatgttacgcctgagaaagtagaggaagctcttgcagaaaaccaacagcagagagcccttatacttagccttcggttgaatgaggactccttgattaagaagtgcatattcgcagttgatccatctgatgtaagagcaatttgttcggcaattccttacaagtatctccaaagattgattgatgctttcgctggtcttttggaaagttgtccgcatctggaatttatcctcctgtggtctcaggagctatgtaaggttcatggccactatattcaacagaactccagaactttgcttccttctctgaaatcattgcagaagtctataacaagactacatcaggatttggcagacactngctcttctaatgagtacttgttgaaatatctgtgcactggtggtacaaagaaataaggcggtgggcaaca

SEQ ID NO: 17982 - DNA, 343 bp, Sorghum bicolor
  Clone ID: LIB3476-058-P1-K1-C7
atactgaatggctcaagtttggaaacacttcatcccgtcccatccccaatctctctccatctccggctctccgccttccacagatccccagatcgccacatcaaatcgaatccacccactgcgccaccccttcaccatggagtctcccaagcgagagcgagtttttccccaaggttccccgcgaaggagccccaaggcgatgaggcctggagcagcaaggggggccgacgagaacacaagccctaagcatctcgtggcggtgggggccgcgtcctcgcagaggaagaaggtgctcggggagaggaacgacggcggcgtcggggtcatgaagggcgccacagcg

SEQ ID NO: 17983 - DNA, 435 bp, Sorghum bicolor
  Clone ID: LIB3476-058-P1-K1-C8
aagcataatacattgattcattcatatatgagctagcccaatgtatggtcacacaagtacaaaatacattacaagctcgcagacatgaaagttgtgcatgagaagccatcaacatccctacctatctcatgagaccaaaagtcatacatccactactcgtaaccaaaagcttagctcactaacactaaaagctcattgctcaacttttactaacagtgagctcatagccttttgtctaataggttcaaaacaaaacacagcttcgatgagcacttttcacttgtcgacaccaccaagtacgctgccttggtcttgtaggatggcttatctcagcttgcaataaacaggtagtccatgcttctttccttttctccacaccttatgacaagttaagttacccatctttgcaggaatgagcgcttgcaaactgggcac

SEQ ID NO: 17984 - DNA, 140 bp, Sorghum bicolor
  Clone ID: LIB3476-058-P1-K1-D4
atgaacagcaaacaaagccttgcagatctagctctgaagattaatgagaaggtggggggcacgaacaccgtgctggtagatgcacgctgaggggaatacctctggaaactgatcgacctacaatcatatttcatgctgat

SEQ ID NO: 17985 - DNA, 423 bp, Sorghum bicolor
  Clone ID: LIB3476-058-P1-K1-D7
ccaaagatggcctcgagatcacaaacaatctcatcacctgcactactacttgggttcctcgcgctactgctgcccctgcagttcactgatgcatcatcaggccaaacgacgatctacgttgtgtacatgggtaggaagatgcacgatgacccatccgtggtcatggcatctcaccacgccgcgctgacctccattcttgggagcaaggatgaagccctcaactccatagtctacagctacaagcacggattctccggtttcgcggcgaagctcaccgaggcgcaggcagaggcacttcggaagtaccctggtgttgtgagagtgaggcctaacacttaccatgaactgcacacgactcggagctgggattttcttggcatgagctacggccaacaagcatcgtcgtcgtcgtcgtcgtcgtcg

SEQ ID NO: 17986 - DNA, 339 bp, Sorghum bicolor
  unsure (1)..(339): unsure at all n locations
  Clone ID: LIB3476-058-P1-K1-E11
cccacgcggcggccnccnccnccncaaccncccccaacnccgccgccacnggccgccgcnnngcccnggcacaggaagcagcggcgcgcaaaagcgcccgggaccaggagccaacaacgcccccgaacgcgccgaaancggcgacaccggcaaggcggcggggacgccggaggagcagcagcagcagcggcggagcgccgaggacagggagaccgnggagcncacggagacggaggagncgcaccacaaccgcacgcgcgaggagggncgccacggaggccacggcacgcagcgccgcgaagccggaggacgggaccgggacaagcnaaaagggaaaga

SEQ ID NO: 17987 - DNA, 221 bp, Sorghum bicolor
  Clone ID: LIB3476-058-P1-K1-E2
cggacgcgtgggtttattctctctctaccggtatggctagctgtctgggtccgtagctctgtcgcgtgctctcagtcgtacgcgcattctgagaggagacctgcgatgagaccttggctgagggtagtacaccatgaaggcgactatggtgacagtgcttgtgatgctgttcttcatgctctccgtgacacagtggtgcgtatacaggcacgactccacgc

SEQ ID NO: 17988 - DNA, 424 bp, Sorghum bicolor
  unsure (1)..(424): unsure at all n locations
  Clone ID: LIB3476-058-P1-K1-E8
gtgtggcgcaccacttacctgcacccgctggcggatcatgcggcagtggtggagtggttcaaggcttcggcgttacggccgtttctcgcgccattgtccgatagcgaaaaaaccgcgttcctgcaggactaccaagcgcggattacccaggcctacccagccctggccgatggcaccgtgttactgcccttcccgcgcctgttcatcatcgcaacgcgctgaaacccggcaaacaagcggtggtcacacagccgccgcttggctctgcagatactcatccgccgacatcacgctggcgtangcaaagcccagcgatgccataaaagccccctgcacttgggccgccggaatcacctgcccgttgaactccagatcccgcgtagcgcacgcatcgtgaatcaacgtgaccttgtagcccaagtcc

SEQ ID NO: 17989 - DNA, 231 bp, Sorghum bicolor
  Clone ID: LIB3476-058-P1-K1-F10
cccacgcgtgcgcacccgcgcgcacacagagagcaaagaaagaggcaaagcgaagcagcctacgagcaaccgcatcgatgaaggcggagaaggcagcggtggccccggccggcgcctgcggcgacgaatggaggtgccggaagcaccctgccgcgagatccggcggcggcgtgtgcccgtactgcctgcgggaccgcctcctccggctctgccacaactgcgcgcacgtgc

SEQ ID NO: 17990 - DNA, 330 bp, Sorghum bicolor
  unsure (1)..(330): unsure at all n locations
  Clone ID: LIB3476-058-P1-K1-F9
cacaaaagtatatgaaaaacgctacctttttccctgtcagaaacctatgaataagtcttatggacgtacctaatttctgcaaatggctactatatattaagtcaaggcaaggtccatgtcgttcagtttgttgtcattagtgtaggcttcctgcttcctaagttcagtgtaagtccctaacagtgccggccctagggggagggcagaggtgcgacggccgagggccctcgcgagatgggggcctaaacctaagtatataatacaacatacctntagttataatncttgtttatnaatatatgcatatatatagtgcaatggnttatcacc

SEQ ID NO: 17991 - DNA, 475 bp, Sorghum bicolor
  unsure (1)..(475): unsure at all n locations
  Clone ID: LIB3476-058-P1-K1-G11
cccacgcgtccggacccacgcgtccgcccacgcgtccgcccacgcgtccgcccacgcgtccgaagaaaggagagggagccgcgagcggcgtggccggcgagcacgcgcgcccctccctttcccgtcccgggctccctccgcgccgtgggcgaggcgcccgcgtccaccccggatccgccctcaccgtgaggccaaggatctgggaggggagaggaggggagggagccacgtncggccgcaccagctctcgtccgcgccggcgagcgccaggcgttcccccccccacaggcttggctgaggaaaagctgtgctctgtgcttcttggacagggcttcaccatttaccaagtcttgagttattgctctgctgtcagacaagaaatcaaactctctagccaaacacaatgatgacgatgatgtagtatgttaggccaggttgggtgtgtaggaggatttccctttggaacaagctaatt

SEQ ID NO: 17992 - DNA, 445 bp, Sorghum bicolor
  unsure (1)..(445): unsure at all n locations
  Clone ID: LIB3476-058-P1-K1-G2
gcaattgttttattggctgttggtacaactacaagccaggtgaaaggatgtggagatgcaccatgtgattctcttttctcagcaccattgcagggttacatgcttggaatactttctgcttgtctttccgctctagccggtgtgtacacagaatatttgatgaagaagaacaatgatagtttgtactggcaaaatgtacaattatatacgtttggagttatgttcaacatgggctggctaatttatggtgattttaaagctagatttgagctgngtccatggtggcagcgcctttntaatggttattcaatcacaacatggatggtagtgttcaatttaggatctactggtctgctagtatcatggttgatgaagtattctgacaatataatccaagtgtactcaacttcaatggcaatgcttttgacgatggtttatctatata

SEQ ID NO: 17993 - DNA, 351 bp, Sorghum bicolor
  unsure (1)..(351): unsure at all n locations
  Clone ID: LIB3476-058-P1-K1-G6
cggacgcgtgggcgaggacggtggcgtggccggngtaattttggcaatgacgataatggtggtggaggttggagtggaggtggtggtggcaacagtggaggatggactgataacattggcagcggtggaggcggatggggcacaggtggcagtggcggctcttcctggggtggtggtggtactggtggaggatctgatgccgctggctggggtggaggcattgtacgccatcacagcaaccgcggtggtggaggcctcttttgatcagcttcttatgttgctgacagtgctggtggaccaaatggagcctggtgagccactgctggaggctctaatgactcatgatgggct

SEQ ID NO: 17994 - DNA, 474 bp, Sorghum bicolor
  Clone ID: LIB3476-058-P1-K1-H11
cgtgcccccccaccgatttcgtcggcctcctcgctcctcttctcccccgcctcgccaccccgaattagaaggagctccgaatctaccgggccgagctcgcccgctggcctccccgagggcgaagccctatcggctgccgctcctccgttgacaggggagctcagccccaccgccgccgcggctgcggcgggtggacgtgaccggagctcctcgccgccgccgataagatccgaagggttcctagactttttgtggcgggaggcgactggttccgtcgggtggtccggtgagcatggcggggcccaagttcgggtcgttcaaggcagaaaagggggactccgcggcggctgccggcgccgcggtgcagaggaaggacccatacgaggtgctcggggtggggcgtaatgctacggagcaagagatcaagagtgccttccggcgtatggcactcaagtaccatccagataagaattc

SEQ ID NO: 17995 - DNA, 404 bp, Sorghum bicolor
  Clone ID: LIB3476-058-P1-K1-H9
aatcgaccaacaattccagttggacatgcagttagaagacatatggctatggactactttattaaagttaactcatcagacgcaagcgctcgcatgcttcacaacagtgaacagccttctccaagttccaccctacataatgatgctaatgccatggacctataagagtgcttgggcagactgagatgcttttgtacaatatatctcacggagcctagactctacatcctactaatgttctataatattacctagcactctgtaatgctttttatattggcgtcgagacttgccatctaccaaacctggtaagcatcactatgatatggatggctacctatggttattggattgggcttaaatcaattaagactattatgtgttccaccctttccacttatatt

SEQ ID NO: 17996 - DNA, 272 bp, Sorghum bicolor
  Clone ID: LIB3476-059-P1-K1-A5
cccacgcgtccgaaagccaagaaaccgacgagaccatcatggctgctggcagcacggccaagaccctgctcctcggcttcctccttgctctcacggcgacctcgacgccggcggcggccaccacgctgacgctccacaacctggcccgtaccccggtggcgctgggaccccaacacggttccggcattcgaaacacggcgctcgacgggggcgcggctgttcttcgttccgacgtttggcgccggggggccacgctgacacaatcggcgcgc

SEQ ID NO: 17997 - DNA, 163 bp, Sorghum bicolor
  unsure (1)..(163): unsure at all n locations
  Clone ID: LIB3476-059-P1-K1-A7
cggacgcgtggngtctgcatcacaatactgttagcttcaggtagcacaatagccaactaagttgattgcacaacagtcaattaaagctggatgtgaattcgtttataaaaaaattaaaatggcatccaaaactngaaaacaaatcttgttcatggtcaccaca

SEQ ID NO: 17998 - DNA, 480 bp, Sorghum bicolor
  unsure (1)..(480): unsure at all n locations
  Clone ID: LIB3476-059-P1-K1-B1
atgtgagatagataatatggacgtgtcaagtgtaggtgaaagattgacctcctggagacgtcaacatcaaattggtgagttgagcttgtttaaaaaggctggcataaaaaaaaatgctgcctgtgaagagaaatgaggacctcgacctcaattccatgccatttttcttttaccaaggtttattctggtttgagtcggattcctaggctgaactctctctacctgtttgtaagatatgtgattttagggtttgggcctttattatccttattaggtacgctagaatagtaactattttggcattgcacattcaatttttcaagcatggacaatattctgcatggctgtttagttcacatatatatatatggtggtgacttgtgacctgtataatatagacaccggaatatagagaatttgtggttagccatgtgacaatctcagtgaagatttcaggcttcggngtgcaatacgttttgt

SEQ ID NO: 17999 - DNA, 141 bp, Sorghum bicolor
  Clone ID: LIB3476-059-P1-K1-B10
cccacgcgtccggctgaatactgtaacatgagacaggcaaatgctgtgattcgtgctcttggaaatgagaacatcatccgggagtcgtattcgtctggtgttgatgtactgctctattgcgagatcttactggactataga

SEQ ID NO: 18000 - DNA, 164 bp, Sorghum bicolor
  Clone ID: LIB3476-059-P1-K1-B11
ggaagcatggggcaacttgggcattggttccttcaatctggagaaaccagctgatccctaagcaattgtcacttgaggaataaattaagagtgtcttgggagggtcactttggctggactgaaggacttattctgggggagaatgggaattgatgccaagggtt

SEQ ID NO: 18001 - DNA, 570 bp, Sorghum bicolor
  unsure (1)..(570): unsure at all n locations
  Clone ID: LIB3476-059-P1-K1-B2
ngcgagatgtatccacttcaggagtatgtgaaacgtgcaaaggcttttgcggaggattttgcccaagaacaaaaggatgaaggtgaggtgcaaggaggtgggattatacatgtgctatttgtgaacttatggagattttatcaaagacgcaaggaggagtatggcacaatgacaagagaagagcgaagaaggaaatacctcgagcaaatgaaacggcttgaagagcaaggtgctgtttctaagctctttgtagacctttcatctccgtatccccgtcggcttagtattcttaagcgtttatggaggcttagtgaacggagagcatatggctccgtcagagaagggctcgctagtgcattccttcttctttacaccagtctaaagacttcaggcttccctgtccacagaatnttggaaccggaattaatgactgacctttcgaaaaatctttgtggtctattgatatgatgtcacgtatatttctaccgtgggcatacatccgtctcttgcaccacagccatagacaagcttacagcgatattgatgtcaagatcacatatgccttattct

SEQ ID NO: 18002 - DNA, 497 bp, Sorghum bicolor
  unsure (1)..(497): unsure at all n locations
  Clone ID: LIB3476-059-P1-K1-C2
cttctctaacctcaagttgtccgttgaaaaatattaataagagtgtgttgtctgatttaggcaacggtatcaagatacagagcacatgaaggtacgagccaattcttgtccacgtttttttgcctttgatttttggtatgcaatgccggagtaatttttaggcaaaaaaatcattcagtaacaaaggtctccaaacaaaaaatgatatgtagtcactcaaacagaatagagaattatgtcaaaaatataccaacacttatgatttatttatctcttaacagaccaatggaaatgaagattaagaggctacgtttgtttgtggccaactgaattataataaaagaaatttcagtgatttctcactaattatcatacacatgtgtaaatntttcagattcaaagcanattcattttcgtcagcttgaacagaaatntaaaagatcgcatctctggcataatggtatcatattctcttgtgtactctcagttcattaaaa

SEQ ID NO: 18003 - DNA, 208 bp, Sorghum bicolor
  Clone ID: LIB3476-059-P1-K1-C6
gaagacgagctcttccagtaccaagtagtcctactagttatacttaccagcagtaggaggcttgagcttgctgtgatatcgacgggattgagatggcaatggcgttgtctcaactcatgcgacacgctgctctgcgacgaggacaagagctactttctacgccattgctgtgctgcacgagcttctaaagtgggagcggtcttgatgg

SEQ ID NO: 18004 - DNA, 447 bp, Sorghum bicolor
  Clone ID: LIB3476-059-P1-K1-C8
gaaaaagcttaaagcggtgcagcgcattgacaaagaaccaaacattgttcaacttatttcaggtatttcaaagaatactcaaggcctatgcggctaagttatatgctagattaccaaaaggtggaactggtattgttgcagctgccactggtaccgatgggcagatcaggacctcagacagggacgagagaatgatatgctacatcgtcaacactgctgaatattgtcaccagacatctggtgaactagctgagaatgttgctaagatgattaaccctcagtttgctgacaaggtggacatgtctgaagttcaggatgagttctcggccgtgatcacaaaagcattaatgactctcgttcacggacttgaaaccaaatttgatgctgaaatggttgcaatgactcgtgttccatgggctacccttgaaagcgttggtgatcaatcag

SEQ ID NO: 18005 - DNA, 396 bp, Sorghum bicolor
  unsure (1)..(396): unsure at all n locations
  Clone ID: LIB3476-059-P1-K1-E12
cccgaaactgcagttttcctgcactcgttggtccaaaatctccccatttcgcacggaaatctcgggggtttgcccactccatgcctcactccgctcgttgatccagaccgccaccggagagctgcgatttttccgccccgggagcggcgtcttctcgatccgaggcccatgcatctgtcgctatggaagccgctatcccactgcgccgccgtcctcctcgccaagaaccaccggcgccgtggcggcggnggcggtgggcacggtggtggcagcaacggccaccgtgacgacccggcctccttcctgcggcagctacgggacgcgctcgacgccgcgtcggaggatggctccctctgcccgccgccagacaccgccggcgccgatgcgngacgccgc

SEQ ID NO: 18006 - DNA, 280 bp, Sorghum bicolor
  unsure (1)..(280): unsure at all n locations
  Clone ID: LIB3476-059-P1-K1-E2
cccacgcgtccgcccggcgccggtgcccgtggccgccgcagcctcgtccgccgcccgccacgcctacgcgcagcatcaggcggccccgtccccgccggngatgaaggactcctccgccgacgtcgcggacgacgacgacgacgacgacgacagcgacgacgacgccgtgagcgacaacagcgacgaggacgaggacgactacgatttggaggaggacgacggccacatgtaccccagcaacaaccgccccagtcatcgtcagcacagcggcggcaagcgc

SEQ ID NO: 18007 - DNA, 419 bp, Sorghum bicolor
  unsure (1)..(419): unsure at all n locations
  Clone ID: LIB3476-059-P1-K1-E6
caagagcacgtgaatctgaaactgagttgagaagcaaaattgatggccttaaagggaaacttcgctcttatgaagctcaaagaaaggaggaagaaaaggtcctgtttgctattgataacctggatacttctactgcaccaatgcataaacctaagaactatggcaaggcaaccgacctgctgaaatccgaggaggatcggatgaagctttggtgtgaactacagaaggcccgcgaacagctgtccatggtacaaaaggaaataaaaaacatgaataaatgtgattatattgattgtgagatngcagtccttgaagcagaaatagaggattcctgcctctccatactggaaactgacattgagaagttggccgtaacaacacgttgacagagatttgggagggagggcaaaggacatgga

SEQ ID NO: 18008 - DNA, 294 bp, Sorghum bicolor
  unsure (1)..(294): unsure at all n locations
  Clone ID: LIB3476-059-P1-K1-F10
cccacgcgtccgcgcttcccttcgcctcgcgcaccgatggaccccgcgccagcgccgccgcccccattcgccgtgcacctcgtcaccggcggcgggtcctcgccggagctttccctcctactccgctccctcgccgcatcccgcgtcgtcgcccttgacgcagagtggaagccgcgccgccgcggtagccctgccgctgccgcccctgcggccctgggcgacggcagcacgtcgctggcgttagaggcatctnccagcgccgcgaagttcccgacggtgacgctgctccaggtg

SEQ ID NO: 18009 - DNA, 398 bp, Sorghum bicolor
  Clone ID: LIB3476-059-P1-K1-F12
ctcacgcatcacgccgcccttcgttgtacgtcacttagtgagaggaggcacgagataaactcttcatcgagagtgcgtgctggtcaatgcttaataatcactgcttgactctctccaagcttgtgagtacggattagcttatccctgcacagacggcacctcacttgtcaatatcctctacaacctaccgactcctggcacttcttagcagcacgagagactcaacttttcaccttccttgtaggaagaacactaactagtccgttattcccacataagaggggctcttagcaaatggtaacatctttctcatttattaactgtaactgctgattcaccgggcgaggtacacacatctgtggcagctgtttattgtgactgctgtcactgcaacctgt

SEQ ID NO: 18010 - DNA, 221 bp, Sorghum bicolor
  Clone ID: LIB3476-059-P1-K1-F2
cgagctccacagtccaagctcgcactcgcgagtgctagcatctctcgggaatggcagagctgcgtggcttcgtgatggcttcggcggcggcggctgtgatggtggtggtggccgtggtgtcagtggcgccacgcggcgcggaggcgaagacgacgatcgagccgtgctccgggtccgactcctgcacggcgctgctgggctacacgctctacgccgacatg

SEQ ID NO: 18011 - DNA, 366 bp, Sorghum bicolor
  unsure (1)..(366): unsure at all n locations
  Clone ID: LIB3476-059-P1-K1-F6
cctctacctcccgcccagcaggctgcaccaccaggccgtggcggttccgccgccgatgccgcccctcgtcgcagtggcggaggacgtcgtcgcctcgtcgaagccgtccacggcgctggagctccggacggggcctaaggcactcccgttcgacctcaacgagccgccgtcgctgatgttcggctcgcgatctccatgaacgcacatggagacggaggtgatggtagatcaatagtaggatcgagtagggatcgatcatggaccattgaacccagtggtagggattgcgtagtgagggtaatcaacaggtaggagtggagatcatgggtccggttgtatatattctagtagtatatctatntaagg

SEQ ID NO: 18012 - DNA, 226 bp, Sorghum bicolor
  unsure (1)..(226): unsure at all n locations
  Clone ID: LIB3476-059-P1-K1-G2
cccacgcgtccgcccacgcgtccgcccacgcgtncgctgctctctgccctcggcggagcggcggcgcaggtgttcccgccgtggaacggcacgttcccgatggggcctggcttcngaggcgggagcagcggcggcgggggcgcgggcgcggcggcggcggngacgctcgtgccggcgatgttcgtgttcggggactcgctgacggacaacggcaacaacaacgacc

SEQ ID NO: 18013 - DNA, 540 bp, Sorghum bicolor
  unsure (1)..(540): unsure at all n locations
  Clone ID: LIB3476-059-P1-K1-G4
gaagaaggtgggctttttaggaggcgaattgttgtacaagagctattcaatagagagtttatagaagctgtgttgcaagaatggtgcaagacgatgagtaatttgcctgctggtctccgccaagcttgtgagatgggtttggtgagttctgcacagatggtacgttacttgtcaatatttgcaagacctacaaacactaggtccttctcaagagctcttccaggttggctttccagaggtcttgttggaaggacacttgcagatccatcattcccacataagatggccttggagtttatggctaccttttcctcatctatttggtgggaaatgaatattcgcaaggagaggtttgaacaagaatgggacttggtgattgtgaatgctttgactgcatcgtgttgcaacctgatggttcttgggcttttggcanccgtgccgtcataaggaagtacatctcgatttgacttccaaaatgcaatngagaaactcncaaataacatattngagaagagctatccttngtagagaggttgatct

SEQ ID NO: 18014 - DNA, 486 bp, Sorghum bicolor
  Clone ID: LIB3476-059-P1-K1-G6
gagagactcatttaggagggagggctttaatcttaatggacaaacagaggataatgtggaaaacagaactgcacgaagtactactagtgttggtggcactcaaaatcaggaaagccagcctgaatcagctgcgcttgggcttcataatgcatcattgctagctgaaaatatgcactctactaggcaaattgttgttgaacaggctggtgcattgctgtctcaactctcagctcagctgggagatctagagaatgtaactgatccagcaacacgaagggacattcaaaatagtgcagttcgcgtgggttctctacttcagaacctaggttctttgcttctggaacttggccgcaccacaatgctactgcggataaatccgtcatcttcagaagcggttgtaaactctggaaccagctcttatatatctccatcagggccaaatcctcttatggttcaacctgttccatttccaggaaggtctgtcca

SEQ ID NO: 18015 - DNA, 406 bp, Sorghum bicolor
  Clone ID: LIB3476-059-P1-K1-H9
atgaggtgtgtgtgatgcacgagacttccactggctacttgtaggacacatggggcgagcatacggtatacaatgagggatgagtgcaccagctgtatagaccacttctgcggttcgggcttgactttggggccaggcgctggctcgcaatgctgcacaaccagcgtgaatgcgctggtcatgctcatgtgcccagttacatgctgatgaaatgactcgtgatgtataacccacgaagggaagcgaagcatgctgcaactggcgcgtgggatgacagaaaactgctgcggtgtggtcagcgcgtaaagggcacatgaattgagcaagctcgactgctcaggatggaacatacgtgaggaagtgctggtcatgtgtcggaaaaacctgtgcgaaccttgggagccac

SEQ ID NO: 18016 - DNA, 180 bp, Sorghum bicolor
  Clone ID: LIB3476-060-P1-K1-A1
ctcagacattcgatacgacagtgaaaacgtaagctgaagttgaaactgctgatgacagggatgatgacttgacacaagttacgacgcattacaggaggctacacagacaacaattccgacataacttacaataatactcagactagtgtaggagctgcattgatggctttatacacacat

SEQ ID NO: 18017 - DNA, 277 bp, Sorghum bicolor
  unsure (1)..(277): unsure at all n locations
  Clone ID: LIB3476-060-P1-K1-A4
ctaagagatgcagctgcaacatacgaggctgcagacatcattgcgaccggnggcaccaacggtgagccgccagacctggttgccttcctgaaagaacactggtcccagagtgcgtttgctgaaggggtgaccaccggcgaaatgcacttcgtgaatgtcatgagggtcctcaggagaggtgcgtccccgatctgcctggaggacctcccgtctgagatggtgctcggcatcacatacctgccactgtaccgtgagtgcgtgagtgcaggtgggcagc

SEQ ID NO: 18018 - DNA, 312 bp, Sorghum bicolor
  unsure (1)..(312): unsure at all n locations
  Clone ID: LIB3476-060-P1-K1-B1
ttcacaaccacacgcccgtccaagagagcccggttcacatgcgcttgttcgcttccgcctcaccgccccgcctccttctctctccttctatctccaatctggactactccattgcccccttcgactattccgagctagcccatggccgcaatggcgagcagcagccccatggcggtgatggcgactccggccgccgtgctcctggcggcgctggtgctgatgatgctcagtggcgcggaggccaagtttctgcggcccaacaacatcaccgtcgtgggcttcgtgtactgcgacgcctgctncaacaatacc

SEQ ID NO: 18019 - DNA, 358 bp, Sorghum bicolor
  Clone ID: LIB3476-060-P1-K1-B12
cggacgcgtggggtgaaggtgatcagccctgaatccgttgctgtcacggtgacaccggcgaaactgaccttcaagaaggcggggcagaagctcaggtaccatgtcacctttgcgtccaaggctggtcagagccacgcgaaaccggatttcgggtggatatcctgggtgaacgatgaacacgtcgttcgcagcccggtcgcgtatacatggaagatgtgaggtgaataataattaagctgagtcttcctggtgtctaagtcgtctaatcatgctgcttagcttagcagatgaaagataggatagggtgatgttagtttgctgatcgcttcacaaagagaatcggcgtgaagctctcgac

SEQ ID NO: 18020 - DNA, 105 bp, Sorghum bicolor
  Clone ID: LIB3476-060-P1-K1-C2
cccacgcgtacggtgcccagccgccgccactttccccacttcccggcgcctacaccaacgccgcgcgcagcaagcagacatggcgactccaacgccaccagcgat

SEQ ID NO: 18021 - DNA, 413 bp, Sorghum bicolor
  Clone ID: LIB3476-060-P1-K1-C7
cccacgcgtccgcacatatgcaagctacagagcatgctgtgctaaagaaacatgaccagccattcgtattcacagtatgtgctgatcattgcattaatcttctgcttgagaatatagctaaactggatcacgtgaaagatgtcctaacgaaggcaagggaaatcacgatgtttttgtatggccatgcattacccatggaactgatgaaaaagttcttttattttgactctgagatcataagcaactctaacttgagatcggtggctaagtttctcacgcttgagaccctagtgtctcagagggaaaatctgatggagatgtttagctcgccgaactgggcttcctctgatctggcttgtacaagtctgtccatgcatatatgtgaggtggtaaaacagatagtgcattttggc

SEQ ID NO: 18022 - DNA, 434 bp, Sorghum bicolor
  Clone ID: LIB3476-060-P1-K1-C9
cgcagctccttctccgcgccgtttcttcctgcggcctgcacctccacgccctccgcctccactccctccttcccgacccctcccacctcaccttccccttcgcgatcaaggtcgcctcccggctccccaacccgctcactgccggcgtgcaactccatgcccggtccctcaagctcccctgccactccaacccccacgtcctcacctccctcctcaatctctacgccaaatgcggccgtttgctcgacgcccagaaggcgttcgacgaaatgccccaccccggcaccgtctcctggaccgcgctcatcaccgcgtacatggacgcgggccgcgctcaggaagccgtcggagttgcgaggagggcgttcgcgagtggcatgcgccctgacagcttcacggccgtgcgggtcctcactgcgtgcgctcgagtcact

SEQ ID NO: 18023 - DNA, 448 bp, Sorghum bicolor
  Clone ID: LIB3476-060-P1-K1-F12
cggacgcgtgggggattctaatgtaaagagctcccatattcctaaaggttctcaccatttgcattctggtgaaaaaaataactataatacagatggctctcctatgcaaccaggaaagcatcctgttgatccaaagacatcagccttggataaaggtgtttcaagtatgcatgaaaataccaaaagcacaaattctcttcaggatagaaatggatcaactcattgcccaccagatggaaatcctccgctcggtttaccatctggaaaagagaaatcatatctcaagagcaacaagcaagattcacagaagcctaaaccccaggtggtctgctcacctcagaaagaaagcaaattagattcccattccactccattaaaacctaatgggtcaaaaatgactccacaatcaagacaatacaatgcttgaaaatgaaggcgacatggaact

SEQ ID NO: 18024 - DNA, 328 bp, Sorghum bicolor
  Clone ID: LIB3476-060-P1-K1-F8
ccgaggcgtacggaagaagaacgatgggccgtccggcgtcaccatcggcattgtgcgcaaggacctcatcggcgccgcgcactccatcacgcccgtcatgcttgacttcaagacgcacgcggacaacgccgctctgtacaacaccgcgccctgctacgacatctacatctgcggtctcgtcttcgaggacctgctagcgcagggcgggctcgccgaggtcgataaaaagaacacgcacaaggccggtgttctatacgacaccatcgacgccagcggggggtactacatctgtcctgtccacaaagcggcgcggtcgcacatgaacgtg

SEQ ID NO: 18025 - DNA, 399 bp, Sorghum bicolor
  Clone ID: LIB3476-060-P1-K1-G5
ggaccagctgctgctcctcccagttccatcgaaatggcaagagctcctcctcctcctcctctgcaccggctccctgctcttctcgccgccctgtgccttgccgtggcggtttgcttctccggcgtcgtcgaaaatgctgcagcggcgaccctagcggcggacaggaccggcaggaagatggtcggtgttcacgagctcaggatgggagatttctccatcaaggtcaccaactggggggcgactctcatgtccgtcatcctccccgactccaaagggaacttgggcgacgttgtgctcggctacgacaccgtcgctgaatatgtcaacggcagcgcctatttccggggtctgatcggccgcgtggccaacaggatcgccggcgctcggttcgtgctggac

SEQ ID NO: 18026 - DNA, 379 bp, Sorghum bicolor
  Clone ID: LIB3476-060-P1-K1-H10
gcggcgtgccccttcggctcgacgcggagtagagcgacgacacaccctccggcgccggcatgtgaagctgagcagcagcgcagaccagagctgcagcgccctcccgtccccttccctcgaccccaagccacggcacattctcgaggcaacggtgcgctccttgggcggcgacgtggcctggcacgaccccaagacgctggtgcatgcacccatcaagctcttcgcagggccagtcccctggcggctgtccatccaggcccaaagttgcaactcgtgcccaatttccctgatgaagacttcctgagagcagagttaggaaaccgaccatcgcagattcaagactggatttgccttctggatagcgagcagtagtgcttgg

SEQ ID NO: 18027 - DNA, 385 bp, Sorghum bicolor
  Clone ID: LIB3476-060-P1-K1-H12
aacgcaaaatcttattgtctgtgactgatatattgtacataaatggtggcgcgctatcttatgcctaccaactttctgtactgaatagactgatattcgactatcagagcaagtcactatttctgaaactgtttccaggacaatgttaaatcgcagcttatcggagttgtcatgaagaagcttgaactctatcaacccaactgtttgtgcattgatcaatctagagcagaaatatttagggagccttttgcctttctactaatttttgcaaacatatggggagacttgttttcagtttgctatccatttctggctgcggagactggtcatactgaaacaacaagtaacaaggcaatgtaggcatgtgttctgtagctactttgag

SEQ ID NO: 18028 - DNA, 141 bp, Sorghum bicolor
  Clone ID: LIB3476-061-P1-K1-A9
cccacgcgtccgtaagaaaagcaagaaaggggtagaggagacaataaggagtctattagtggtcactctgatgatcgtggccgcggcctgcatagacgcgccgcggggtgcctactgcgcgggctaatgcagggcgacgcc

SEQ ID NO: 18029 - DNA, 512 bp, Sorghum bicolor
  Clone ID: LIB3476-061-P1-K1-B10
cttcagcatgatggagaggtttgccgatgctgaagctatttaccttgaactgaaggcttcagcttctgtacttgatatgattgcttatagtgtcattgtgagaatgtatattaaagcacaacgactagaggatgcttgttcaattttggcagaaatggagaaacaaaaagaaataattcctgataagtatctttttctcgacatgcttcggacttaccaaaaatgtggtctgctcgagaagttggctgatacatattactggatacgtaagagtcaagttgaatgtgatgaagccatgtataactgcattattaattgctgtgggcgggccatacctgttgatgagctgtccagaatttttgatgaaatgattcaacagggacacttagcaaacactgttaccctcaatgtattgctagatatatatggaaaagctgggctttttaacagggctgaaaaggtctttatcatggctcgcaagcagggcctggtggatatcatatcatacaata

SEQ ID NO: 18030 - DNA, 466 bp, Sorghum bicolor
  unsure (1)..(466): unsure at all n locations
  Clone ID: LIB3476-061-P1-K1-B4
gaaatatgacaccagaagcagctttggatcatgcgaggtctgtgaggcctagagtgcttttagcgccagctcagtggcaggcggttaaaatgttcagcaagctcaacgggagatgcctttccatacagagctcgaacccaacctgctcagtactatcttatgaggaatccagtgaactgttgagcacgcagagcagcagatgcctttcgattcagagctcgactgaagactcaatagcatctgatgaagaatccagtgaagcatcctttgtagaccctgaagttgatggctacgccgccactgagtttgacagcgagcattttattttacctcgttgtcgaagtatgctgtccagaccaacaagccccactggctgtagcgatgcagtcttcgtaaccggngaagatctagagggctatgagacctacgccgatgacgggaaaggacgtggtgagtgcaagtagtg

SEQ ID NO: 18031 - DNA, 263 bp, Sorghum bicolor
  Clone ID: LIB3476-061-P1-K1-B5
gtgaatctgatctgtcaacttatatgccctatccagcaacatcttgtgcactacaaagagaagagcgtgtcccatgtataggagcgtggttgcacatgctcgagtgcagatctcatcatgacgaaatatgatgtaccagtctaaggttatctcgagaatgactcactgaccgtgaaatgcacattatctgagctaggacgagatgaggagcatgccattgcagaggcacaaaccttggacatgcacaaacacttaggtgagct

SEQ ID NO: 18032 - DNA, 449 bp, Sorghum bicolor
  unsure (1)..(449): unsure at all n locations
  Clone ID: LIB3476-061-P1-K1-B8
ggctgaccccacctccgcactgctctttcccttccacctgggcccccacagcgttccccttcccgtcaccaccaaaggcccgaatcctttagggacgagcgaggaggtaattcgtcgcctgatcgatcggccgatccgccgccgctgccgccatgttcaacaagatcatcaagagggggaaccgcaagggcgcgcgcggggacagcgcggagtccgccgcgcgccccgcagcgccctcgtcgttctccgggagcggcggcggctgcagatcggggggtcgctagccccttaccagcaaccactctttccgcgcacagtgccttcgacgcatttgtccacttngtcatatattccgttttttgatctgggtaccaatcatttttttttaatttttttctatttcttatttttgctctatttttttttttgtgtcgtctatcttgtatttt

SEQ ID NO: 18033 - DNA, 224 bp, Sorghum bicolor
  Clone ID: LIB3476-061-P1-K1-C6
cggactcatattccaactcaccttccgtactatatattcaaacaacatcctccctaactatcctaacttaacaaccgcagagagagggtcctatccatccggaatttattccgacttccccaactaactcttgacttctacgatctatccgaaccctacgacgcctacaatataccactactaataactttcttttactaatcacaaacgtttcaagcacacca

SEQ ID NO: 18034 - DNA, 521 bp, Sorghum bicolor
  Clone ID: LIB3476-061-P1-K1-C7
gggaagtctattgatgaaaagaagacaaaacctcggaagtccatggaatttcataacatcaagattagccaggttgaacttgttgttacatatgaggggtcaaggcttgctattaatgacctaaggttgcttatggatactttccacaaggcagaatttactggtacatggaggcgactattctctagagtcaaaaaacatatcatctggggagttttgaagtcggtgaccggaatgcaggggaagaagtttagcaaccatagggaaacacttgagggatctattcctgaaaatgatcttaacttgagtgacagtgacgttggtcatcatggaagacatgatcaattaacagcttcatggttgaagaggccgggcgaaggtgcaggtgatggatttgtcacatcaattagggggcttttcaatacacaacgccgtaaagcaaaggcctttgtgattcggacaatgcgtggtgaagggcataataatgatgaatatcaggacgaatggagcgagagtgatgg

SEQ ID NO: 18035 - DNA, 338 bp, Sorghum bicolor
  unsure (1)..(338): unsure at all n locations
  Clone ID: LIB3476-061-P1-K1-D12
gtattttcggcatgctactggtcaattatatgctatttcaaaagatttggcaacctacatatctataaacaagcatatcctgcacaagtatataaatgaggatgtttcattagggatctgggttcatgggttagatgttgggcatattgatgatcggagacttttgtgggggactcccgctgattgcgaaatggaagctcangcggggacatttgcgccgcgtcattcgattggagatgcagcggcatatgcaactccgagggggaggatcttggaaagtccacaacaagtgcgccgaaggcgagaaggcgctgtggaacgccactttctagcacaag

SEQ ID NO: 18036 - DNA, 442 bp, Sorghum bicolor
  Clone ID: LIB3476-061-P1-K1-E1
caaggtgatatggacggtgaaggagcacgtcggcggcggcgactcaccgtacatcacgctctactaccatagcttcgacggggagcgagggtttccgggcgacctggacgtgtacgtgacgtaccgactctcgtccccgtacgtgctgagcgtgcgcatgaacgccacggcggagagcagggccaccccggtgaacctggcgcaccacgcctactggaacctgggcggccacggcagcgggcctatcctcggcgagacggtgcagctcttcgcgtcgcggtacacgccggtggacgccgccacgctcatcccgacgggcgcgttggcgcccgtggccggcacgccctacgacttccgcgcgccggcgcccgtgggcgcgcgcctgcagccggacctgccgcacggtctcgccggctacgacaccaactacgccgtggatcac

SEQ ID NO: 18037 - DNA, 515 bp, Sorghum bicolor
  Clone ID: LIB3476-061-P1-K1-E11
cccacgcgtccgattataactgatggtgcaattgaacatattgcaaagcttggaacaaacttgcaatatttgagcctcagaggatactggaataacttcacaggcactatgtattctggcagggacagttccaaacctcacctcactgtctttagctaatacaaaaattgatgactctgctctagcatatattggcatgatacctttgctgagaacgatagatttaagccagacaagtatcaaaggttttactcatatgtctgcatttgagcatctcaaatatctggaaagtctaaatctggaggatacaccgctatcagctgaagttatacctcccttggcatcccttgcagcactcaaatatctgtacctgaaaagtgatttcttgtctgatcctgccttgcatgcgctctctgctgcctctaatttgatacaccttgggttctgcgggaatatattgtcgagctcgggacttttacaatttgtaccccctaccacactgtgtgtgttggatt

SEQ ID NO: 18038 - DNA, 450 bp, Sorghum bicolor
  Clone ID: LIB3476-061-P1-K1-E7
cgtaagtgtgagattgacttctagatcgatcactcaacactttaccaactacccttcgaggaggacatgatcgaggagcggagccattataaaatgcattgctaaacagccgtctgcaaaccactcaccgagccactgatcgtcgaggataccgccaaagattacgcgatcgccttcaagatcatcatcacgttcatctgcaacacactttgcaacacatataaaacttacgggaaagctaaatttgcaccaatattaccacacatatcataccacgaagcgtacagcgtagtggagcacgtcgaggagtacgtcgagggctacaccgcggtccacaccttgctgccccagttcttgcaccactgctcgtactcctgcaactacaccaacaagcacaactacatgtccgactcgatgccgctcgtgatgcggcgcgacatgaccaccaac

SEQ ID NO: 18039 - DNA, 151 bp, Sorghum bicolor
  unsure (1)..(151): unsure at all n locations
  Clone ID: LIB3476-061-P1-K1-F2
ggctcatatatagagagcgcacacgcaccacccctaggttccagactcccagtacccacccaccaatcctactcatcatgcgcgctgcgccccttcgacagttgccgcacgatccgnccatatcgccccgccatggacccgctcgagacga

SEQ ID NO: 18040 - DNA, 410 bp, Sorghum bicolor
  unsure (1)..(410): unsure at all n locations
  Clone ID: LIB3476-061-P1-K1-F5
cgccacgcgtccgcccacgcgtccgggctccacggttgccaaccgtggcctcccggcattgatgattggaggagagctggagagtggggtcttcggcacaggtgcctgcgccatgggaggacgccaagaggaagaccaacaacggccgcacgatcctgtgaggttttctcctgtttttttgtttggttggtaaccttagaggagttccgtgcctcggcttgcccatcattcttttagccgcagctgtgcatgcttttggtggaggagctagaagctctgtaagatgctgaagacctgtacatagctcgatcgatgcttctcccaaanaatataaaaagacactcaacacattgcctaaacaacaaagctgcttatgggaaaatcagtatatacttattaccaggggcggc

SEQ ID NO: 18041 - DNA, 272 bp, Sorghum bicolor
  Clone ID: LIB3476-061-P1-K1-G5
cgcacgcgtacttattcacatagttcgtaaaactacgggctgtaaagtagtttgcacatcgacacttcaagcccactcacaaagccaggacgtctaaaaccagctcaatcaggacggatcactctaacagtcttcatggctcaacagagtgcactgttcgcacatcagtaacagatataccttgcagagttgcaaaggaaaaatgagaggctggcacatacgctcagactacagaaagcgttgaatccacgtccaaataaacgctggttgaa

SEQ ID NO: 18042 - DNA, 328 bp, Sorghum bicolor
  Clone ID: LIB3476-061-P1-K1-H8
gtctagggctactagtccgccggaataacacatgctaccagttacaccggttgtcgccgcacgccgtgccgacacaggcgcggcgagtggcgtcgaccaccggatcctcctcataatacgctctatatccttctacacttcttactggagcactctcataccgtgccggcgattcatgcacatgccgcacgagtgcacattcaagcgcactctactaccgacggtgggacggaactgtgcggtggcagcaggggacggagtactggatggataggcatagtcattaacacaggtgtcagtatacatgtcatgtgcttgagcacaccat

SEQ ID NO: 18043 - DNA, 119 bp, Sorghum bicolor
  Clone ID: LIB3478-001-P1-K1-B7
ctgaaggcgagggttatctcgtacctcccccgcaggccgcatccgagcgcaaacaaaactcctctccgcgccggccctgcaccggcgaccgcgcgcccatggctgccttactccgcacg

SEQ ID NO: 18044 - DNA, 192 bp, Sorghum bicolor
  Clone ID: LIB3478-001-P1-K1-C11
ttcattagtcgttttgcagtccatcacatcaatgtgaacttttcctgcagaaagcatggagccaatagagcagatgttcatagttcgagcacatcttctagactggatgctataaggaatgtctatggggcttctgttgttcgtgatctgattgaaatagaagtttcagatgaggatgctggagatgcagtc

SEQ ID NO: 18045 - DNA, 193 bp, Sorghum bicolor
  Clone ID: LIB3478-001-P1-K1-D12
cgccggctccgcctgaagcggccgtgacgagccgagagagctagccgaggactaagcacaaagcaagagagagcgggaggcgaagctgaatcgacgactgaaagaggccgaggaaatggacgagtctaagcgcaccaccgagcaactgcagagacagaccatcctcgaggccccgcaggagtcagaggacgag

SEQ ID NO: 18046 - DNA, 268 bp, Sorghum bicolor
  Clone ID: LIB3478-001-P1-K1-D4
gatgaggcatgtgttcgtccggagaggagcgactactagcggctcgtctgggcgtgcacggtggaggagcattacgccattggcaaggagctgtaccaaaggattcgtgagggtggtgatgggggcgagatcaacctgtccgtgttgaaccaccttatctggcttatgggcaaagcgaagaaatggtgggcggctctcgagatctaataagatttggtggacaaacgcccgaagcccgacaatctggctcatgagccgatcatgtcac

SEQ ID NO: 18047 - DNA, 514 bp, Sorghum bicolor
  Clone ID: LIB3478-001-P1-K1-D9
atctgcaccagaaaagttctagtgataccaatgcattaccagccttttcaataccaaggtctccaaatagttgttatgggtgtagtactacattagttacacaatgcttagagttattacaagtgctttcaaaacatgaatactgcaggaagcagcttgttagtgctggaactttatcagagttatttgaaaacaacattcatcacggccctaagacagcacgcactcttgctagggctgtgctatcttcattctctgaaagtgatgaagatgcggttcacgaattaaacaactcgattcagaagaaagtgatgtattgtcttgagcaccatcgttccatggacattgcacaatcaacacgagaagagttactgctgctatcagagactcgtgctcttgtggatgagttttgtgaggcaagaatacgtgtcacctttcaactgtgttctcttctattaaggtggagcaaacaatctgaatttcggacatatattcttactgttgaggatattct

SEQ ID NO: 18048 - DNA, 308 bp, Sorghum bicolor
  unsure (1)..(308): unsure at all n locations
  Clone ID: LIB3478-001-P1-K1-G10
ctccagtaaaaattgccgaccctttcgattacggagcagggtttgtgaacccaagcaaggccgacgatccaggtcttatatatgacattgatccatcagattatctcaggttcttctcctgcgtgggaggactgggtgtcaacaacaactgcacgacacctaagtcagctgtagcagacctgaacctcccatcgatcgtgatccctaatctcaaggcatccgagactgtcatgcgcactgtcaccaatgttggccagcctgatgcactgtacaaagcattcttncaagccgcttctggcgtggagatg

SEQ ID NO: 18049 - DNA, 132 bp, Sorghum bicolor
  Clone ID: LIB3478-001-P1-K1-G11
agcgataccagctacataggtccatacgagtgccacagaccacagctactagctagacgccagcactcctcttgttcgaacgacgacaaccggccgggcggccacctatactagttaacccaccctacgtac

SEQ ID NO: 18050 - DNA, 390 bp, Sorghum bicolor
  Clone ID: LIB3478-002-P1-K1-B10
caattgcaggagctgcgaaggaatgtgtttggagatactaatgcgcaagggctctttaactacttcaagaaaatgcaatcagagaattccagctttttcttttctacacaagttgacagtaaaaactgtgtgagcaatgcagtttgggttgatgcaagagctagaatggcatacacatactttggggatgctgtttacttcgacactacttatagtcaaaatgagaacatgctgccctttgcagctttcacaggagttaatcaccatggtgacactgttgtttttggctgtgccttaattttggacaggacagaatcttcatacagctggatttttgagacgtggttgacagcaatggatgatcggttgccattttcctttactactgat

SEQ ID NO: 18051 - DNA, 155 bp, Sorghum bicolor
  Clone ID: LIB3478-002-P1-K1-B2
cggacgcgtgggtttccgaacgctccacaggggatcctttgcgccaccgaaaccgtgtaaccccggccgtgccgccgccggcaatcccaatccgccgacccaaccggtccggtccccccgttggaagccatgtcgccgtcgaacccaacccggaa

SEQ ID NO: 18052 - DNA, 287 bp, Sorghum bicolor
  Clone ID: LIB3478-002-P1-K1-D6
atcaaacttacctatatgttgacatatgagagtgcaactgaattgctttacatgaacctggaagaagaggaagaactaaggatgcttcaagaagctgcttccattcgtgctcagtggcgtcatagccagggttcaatagacactgcgatgatagagccacgtatcaaggtgtcaaatcctgatgatcctgaaccaaatatcaatctatatgttgaagatcaagccaatccagcaatgcagcttgtatctgaaatgatgatactttgtggccaggcaatggctgtttt

SEQ ID NO: 18053 - DNA, 439 bp, Sorghum bicolor
  Clone ID: LIB3478-002-P1-K1-E11
cggacgcgtgggcgactgcaccgaggagttcgacgccatccactccgacaaggccaaggcgctcctcgacacctaccgcatcggcgagctcatcaccaccggcaccggatacagctccgacaactccgtccatggcggctccgccgtcctgtccaacctcgcgcccatccgcgaggccgtcagggccccggcccccgtcgcgctctctaatccgcgcgagaagatccactgccgcctcgtcggcaagaaggagctgtcccgcgacgtccgcctcttccgcttcgccctgccgtcgtccgaccaggtgctcggcctccccatcggcaagcacatcttcgtctgcgccaccatcgacgggaagctctgcatgcgggcgtacacgccgacgagcatggtggacagatcggcacttcgacctctcgtaaggctacttaagacg

SEQ ID NO: 18054 - DNA, 136 bp, Sorghum bicolor
  Clone ID: LIB3478-002-P1-K1-E5
gttctagattgcgagcgtccggcattctttatagctcaggaagaacggggcagtgcatattatcaggtcaccgttcatacgaggctgagaggatctatatgctcttcgtcatcttacatacatagtacttgaccag

SEQ ID NO: 18055 - DNA, 379 bp, Sorghum bicolor
  Clone ID: LIB3478-002-P1-K1-E9
ccaaacttgcagacgttggatctctcctggaatattggtctggaggaattgcctgaatcaatcggcagtcttcataatttgaagatcctgatcttgttccagtgctggagtctttccaggttgcctgactctatatccaaccttgtgatgttggaaagtttgaaccttgttggatgtgaacagctgacaaagctaccagatggcataataagcatcagcaatttaaagcacctgagaaatgaccaatgctcagctttggagagactgcctcatggatttgggcaatggacaaaacttgaaacattgtccctacttacagtaggtgacaaaaatagcaatattgctgagctagagtaccttaatgttttaactggtcagc

SEQ ID NO: 18056 - DNA, 428 bp, Sorghum bicolor
  Clone ID: LIB3478-002-P1-K1-F10
cccacgcgtccgcacagaatgacaagacttgacaagaaacattcaaagcaattattcctgaaggaagcttgtccggtggaatattcagagtacatggggcctgatttggcagcaattttgaagaaatgtgatggtcaaccactcgctctgactaccgttggccaattcatgggaaaaaagagttggccaacaggacatgactgtgaagatgtgtgcaaccaggaacggttttaccatctgcagagtggtgacgatactttggacagaatgcataaggtgctgatccatgactacaccagtctgcctagccatgctctcaaagcttgctttctgtattttgctatgtttccaagtgatcatccagtaagggcaaaaaggctaaagaggcaatggttagctgagggatttctgcagcccacaaatttatg

SEQ ID NO: 18057 - DNA, 316 bp, Sorghum bicolor
  Clone ID: LIB3478-002-P1-K1-F2
ggcggcactaaccaccacttaaccgttgaccagccggccaccggagttcctgccgcgaccgcgaatccggcgcaatggccgcggcggcgatgggcctcctgcgtgagctcctgcgaaccacgggcacccgccggttttgcggcacggccgtgggcgtggcggcgggcttcctcagcgccgcgaccgtcgcgtcggcgtccgacggcgccgcctgcccggcctacccgtggtcaccacaggacggggcgcgtggcggccacaaggtgttcatgcagcacgactgcccggcgtgccactccggcctgccgtacgccgg

SEQ ID NO: 18058 - DNA, 376 bp, Sorghum bicolor
  Clone ID: LIB3478-002-P1-K1-F9
cccacgcgtccggtgacagatgagttatgtgttctgaaagctacagctgaattgctcaaatcacaattgaacgaagagaaagcagcacttgctgccactcaacaggtggaagcgatggcatccacaaccatccaatctctcaagatggacatcaagctgtcacagcaggaacttgaagcagtccatgtcaagtcaaaggagtgccgagatagaatggacaaggttctgcaagatgcatcccaggaagttgacgaggctaagatcattgctaccaaggctcgggaggagctaagaaagaccaaggaagaagtggagcaagcaaaggctgctctgagcaccatggaattcaagcttgaagcagttctaagggacatac

SEQ ID NO: 18059 - DNA, 342 bp, Sorghum bicolor
  unsure (1)..(342): unsure at all n locations
  Clone ID: LIB3478-003-P1-K1-A5
gtgatattaataggcatataatcatatgaacttttgcatgtatgtttgactaaaatatgcatttgcgctcttccattttgttgtcaaatttcaatgtttatggttacagtatgctactctataaaactttcttgaagtcgaggtcgattatcttatttatttagtccatggtgtaatgtgttagtctttgcctgtatagttttgacttgagtacagatggatggagtatcatgaccctgattctagtcatcatttctccacttatatgtgttatgttgatgtttgtctttcatttatacattcaacattctatttatatantaaatgatggaatctttcaat

SEQ ID NO: 18060 - DNA, 376 bp, Sorghum bicolor
  unsure (1)..(376): unsure at all n locations
  Clone ID: LIB3478-003-P1-K1-A6
gcttgctttgcatgcattgctgcggactagctaggaccgtgtcactgcatgcccccggtctggttcttgctcctgattctgctccttgtatggaagctgccacaatcagctacatcagctagctcatcgtacgttaagcatgtctgcagtctgctccttgctcctcatcctgctccttgtatggaagctgccaccggatacagcagctcatcgtcaagcatgtaatctactgcttccaccatggtcactggtcaggatcagaggtgaatgcatatgcatgtttgatgctgatcttaccatccttgatattggtagtatggatgagggagactnttatgttaagtttcagctcagaaacaaagtggatggtttcaat

SEQ ID NO: 18061 - DNA, 420 bp, Sorghum bicolor
  unsure (1)..(420): unsure at all n locations
  Clone ID: LIB3478-003-P1-K1-A8
catatggcgtgaccgtactcagccatagtgggcactactatggctgacaagagacagtggacatcacatgtggcataaaatgtgcacatccatgcatcattgatgtactgatactgctcattctaaatgttactgacaaaaccatcttgatatatcaaagcaagggcgaaagacacgacggctaaaaagtgcagtagctagccctcactgtcatatcaaaatgaaaaggagaggcagatggtaacaaatggcgcaaagatgggagcattctcatctgcagctgctgctggacagatcgcaacactgatagggccagacagagaactctaaaccaacagctaaactctgatgactttactgttgcatagatctgcgctacactactgatgagacacgnctaggaacacatcgaactatata

SEQ ID NO: 18062 - DNA, 482 bp, Sorghum bicolor
  Clone ID: LIB3478-003-P1-K1-B9
gttctattggtacacggatgctgttgttggaccaggattttctgagggatatattggtctcatctattcaattggttcagttggttcactaattggagttttactataccaaagcgcactaaaggactatccttttcggagcatgctattatggggtcaagtgctctcaagtctagcaggaatgcttgatctggtgttagtgacccggctaaacctgaaaattggcatgccggattacttctttgcagtggctgataacgcagtttcccaaatggttggtaggctccaatggctaccactacttgtgctttgctccaagctttgtcctcccggcactgaaggaacattttatgcattactcatgtctctacaaaatgccgggttgctgatgtctgcttggtggggggcctgctgctgcacatgctgaacgtgacccgaatggagttcagtaacctctggatcatcgtcttgattagaaacac

SEQ ID NO: 18063 - DNA, 156 bp, Sorghum bicolor
  Clone ID: LIB3478-003-P1-K1-C10
gttcgccgtcctcggccgttccaacgttggcaaatcctcgctcatcaacgccctcacccgccgcaaggaagccgcgctcacctccaaaaagcctgggaagacacagacaatcaatcacttttggtaataagagtggaccttgggattgccggtatg

SEQ ID NO: 18064 - DNA, 542 bp, Sorghum bicolor
  Clone ID: LIB3478-003-P1-K1-C2
aaacattcaagcagcttcagagtgaaagaggtgaaagtattctcacgtttgccgtagacatgacactgaaatcaaccaaagccttggtgcagccaagtaacatgccggatggtcttgacttttggagatccaagttactatgggcctcacgtgtgctaccaatgccgctcgttgggctactcgtcatcactgggctgtgtctgccagtggaaaaccaagatggatttcctgagctggaggcattgtctaggctagattttggagctgcactgaagattttcttggcaaagcaactgacatctgagttcacagctgtgcctacacccgttgaggagaaatcagttatcattggtgagaggaacagagttgctactgagaagattaaggaagcaataaactgtgggtacaagagaattagagtcctgtatggcggcggacacatgccagaccttggaagacgtcttcgagaagagctcaatatggtcccatccgacgtgcagtgggtcaccgcatggtcaataagaatgccggagatagacaac

SEQ ID NO: 18065 - DNA, 407 bp, Sorghum bicolor
  unsure (1)..(407): unsure at all n locations
  Clone ID: LIB3478-003-P1-K1-D12
atacattcatccctggggatgatgataatgtgtacagcacagaattgagggaacttctaagcagaaggagcgtttctaaccttcttcacagtgcttttcgtgaaaacttggatcggcttatccggtcatatgttgaacggcaaggtcgtggtcctctcccttgggatctggaaggaacaactcctgcccctccctcaccagatcaaaatcaggagcagcaaagagatgatgaggatcaggaactgcagaacactgtgaacaggcctcctttagtgataccacctccacctatgcctcctcgtcagccactctggcattcagagttgcatcgtaataattggatcagacaaaacattcatcgntcatcttctgatattgaatgggaagccatcaatgatttaagagct

SEQ ID NO: 18066 - DNA, 207 bp, Sorghum bicolor
  Clone ID: LIB3478-003-P1-K1-D5
cattgattcgtttatagcgttcgtagtatctactatacatgtgtattgcatacagccgcttccagacgtaacatccctatggccacgggtctaccgttcgtacactggatgatggcggggaatgtcgcatcgcgagagttatcgtctgagattggaggatggaggtgcccttggaacctgatgatcgctataaccccattccatggg

SEQ ID NO: 18067 - DNA, 487 bp, Sorghum bicolor
  Clone ID: LIB3478-003-P1-K1-D8
aggagctcccctccgcctccgagtcccacttcctggacctcatctccgccacggcggcgctccgcccggcgttcgcggatgcgctggcgcagctgcagccccggccggacctgctcgtccacgacggcttcctcccgtgggccaaggacgccgccgacggcctcggcgtgccccggctcgtctcgcatggtatgggcgccttctcctgctacgccacgctctctgtactcatacagaagccgcacgcgcgcgtgagctcgccgtgggagccgttcgaggtcgacggcttgccggggctccagctcacgacggccgacctgagcccgccgttcgacgacccggagccagccggccgtcactgggacttcatctgtgagagcggtgtagccatgaactccagccggggcactatcctcaattccttccatgagctcgagtcactctacatagacaagatgaaccagctggagaactcgccggcgatgtg

SEQ ID NO: 18068 - DNA, 483 bp, Sorghum bicolor
  Clone ID: LIB3478-003-P1-K1-F3
tccgtctggtacgccgccgccttccccttccgcgccgaccccatcgatgtcgacttcgtcagcaccgagggtataagccgcctgtcccaccggtccctcgatggattggtcgcctacctctgccaccagtgccctgatctttcccacgacgacgccctctggcacctcgccctctcccttgccgccctccatggcgcctccgcctccgcacgcggggcagtgccgatcggccgcacgggattggaagccgttccgttccaggtggctgcccaggcggcgcggcacccaacaccttccgccctcacgagcttcgtcacctcggtgctgccacctgtggagcgcgatgtgctctcgctgcttgctgcaggccggcgtaggctctcctcgcatgacatcctgcgcctctccgccatgcttcagcctctcccgctgccagatgcactgccgcagcagccatgttctcgagagctgaccataagaatc

SEQ ID NO: 18069 - DNA, 502 bp, Sorghum bicolor
  unsure (1)..(502): unsure at all n locations
  Clone ID: LIB3478-003-P1-K1-F6
gttggtggtcctgaaagacgatcacctggaggactatattatctttcttaccttgatcgtgatatgctcctgggtcgttcagttggtggtgggggagtatttgttttcacaaaagcacaacctcttacgtaaaggttttctgataaccaagagtatatcatctgatggcttggcagctctccttgagctttgcaatctacatttttttgtgacatgcaaatatgtgaccatcacctcattttagtttttaaagagattgccatgatctattttgagttttaagagattatgtgcaacatgttttcttttacacaccagttgtgttgaatatgtagctggctagttgctgtggatatataaagcttcctggatagttctatttcatttgagtgttgtacggatactagaactgtacctacttatttctaattttctggaattagnaatntgacattacgatcagcaaaactaatgtgcagatttactccagttttctattcta

SEQ ID NO: 18070 - DNA, 390 bp, Sorghum bicolor
  Clone ID: LIB3478-003-P1-K1-F7
tttcaaccaattgtatactatgctgtatcttttgtctttatagtacaagaatgttttgcctgttaaaggacactaaatttgagtggtacgtcagtttcttcctggaatcaattatttttatgcacaacagttttgttattgacatgacaaattatcttattctcaattttgatgatcctggtccatatggagcaagtagatattcagaccatacgctacctgaagtcctgaaactatgaagagagaagaaaaggtgcacagtgtggaaacttttgaggcttcagacccactatttacttcatacgtgttagaatgaaaattttaagtcacctgtaccaaggcacaagttcttctcttctttgtttcatgctgcatctcttgtacggcatt

SEQ ID NO: 18071 - DNA, 446 bp, Sorghum bicolor
  Clone ID: LIB3478-003-P1-K1-G3
gttgagccactcctgttcaactaccaggtggatttggttttcttcggccatgtacacaactatgagaggacctgtgcggtataccagggcgattgcaaaggcatgccaacgaaggacaaaaacggaattgacgtctatgacaacagcaactataccgcacctgttcatgtcattgctggagcaggagggttcaccttggacagcttccctaacaatggggaggcctggagcttatcaagggtttcggagtttggctatggcaaggtgcatgctacaagaaccgatatgctgggtcagtttgtaaactcaagttcgatggaagtacgagaccaatttaagattgtgaagggagcttcggtaaacaagacaccgagcctgatacttcaataatagctgctgctcacaacagaaagaagatttaacgggacatattcttccttttttgg

SEQ ID NO: 18072 - DNA, 439 bp, Sorghum bicolor
  Clone ID: LIB3478-003-P1-K1-G6
cccacgcgtccggcgtcctccccgcgacgacgcttcccgagctctctcctctgttccctctcatccccgcgattctcctctgccgctctccgctagggttttgccgccgacctctcgctcgctcgctcccggctccgcgaggcaaccgtacggccggtcgaaatggtggatgtggaggaggccgggaacaagatgcaatcactgatgcacctgcacgccgagccggaggacgacgcctgcgacgacaccccctggcgcacctttcaaaggcacctcgcatgcacgccaacgatgaagccacgccgaggccgaggacggatccggcctgtggataacgggcagcgcagcagggacaaggaggacatgaacctcaagcggtaccgcgtggagcgcaccaacggacagttcacgaggcgcttcctcctgcccgagaacgcca

SEQ ID NO: 18073 - DNA, 342 bp, Sorghum bicolor
  Clone ID: LIB3478-003-P1-K1-G7
cacttgtcaagcctctccctcctgtgatggcatacagcgtatcccgtaatataaactttttcttccggatcttcacacagttctgggatgaagaaggaatcgccaatgcacagaagtcccttggactggggaatgatgatggctcccgccgaatgcgctgattgtggtcaaaccaagtttctgtactgagttcagaactctttgtcctaggcactggagatctgttatatgcttcaaaatactttagtgtgtgacatttcttaagtttgggttgtaattttgtttattatagtgtttgtaacatgcattctctgctagtaaaactggtcgtaccatatattt

SEQ ID NO: 18074 - DNA, 419 bp, Sorghum bicolor
  unsure (1)..(419): unsure at all n locations
  Clone ID: LIB3478-003-P1-K1-H1
caccataattggatacgcagttgcgctatctggtgttgtcctgtacaattatttgaagatgaaagatgtcaaagcaaaccagcttccagcagacaatagttctgatagggctacgaaggacaagaagtctgtaagtatattcaggcctgacaattccatggacaacaatgatgggactgtagtatgaggcctggcatcagaagctgcggcagttgatgaggaagcccctttgatcccttctgcacgcctctgctatgttacacggacccatacaggcagcttcattaacagataaccatggtttgcctatntcgtgggttgatatctgctttgttccggtgaatttgacaggggtgctgatatacgtttggaaaagaatatattttcagaagctcctgcaagtggcacctcttctcata

SEQ ID NO: 18075 - DNA, 538 bp, Sorghum bicolor
  Clone ID: LIB3478-004-P1-K1-B11
gcaatacccaagtttgaaattctgcctccgccactgcttagcagataaggtcgaatagttggattttttattgttgctaatcacaatatactccaattttttatcaaatttgtccaagtttatacgaaggttactgtcacagtggcagtagcctggaatttgggggcgtgctagggtccgggtgggcggacggtaagctcggtccgacaattcctgcccattaattctagcactgtttctgtgctcgtcccggtttttcggtgccgctcctgtaggcaggtagctcatggggtctgttgaagtattgccatcagttttttttctcacccacttgatttggacatgagaatctgcatgcatgcagtgatgtcatcaattttttacaaactaaaaaagtcataactactagaccacatctttacattaaattccgattacaccatcatgtttctttcaataaatcctttaaaacaagatcccacatgaatatatttagataaaattttgtaatgaatatttatataagtaagatagaaca

SEQ ID NO: 18076 - DNA, 524 bp, Sorghum bicolor
  unsure (1)..(524): unsure at all n locations
  Clone ID: LIB3478-004-P1-K1-B12
ggctagctacctcgagctcgtccaaggcggcagcattgcctcctcgtcgggcgccgtttacgccgcgccatgggatgggcgctgcagcgcgcggggaaggatggcagagaccgacagcgacgacgatgacgacgactacgactgcgctcctgctgcctgatcgagaatcaatcgatcgttcgggtgaaactgatctgtgttcagtgttctgagataatgagatgtgctgcgcgtacgaggcgcgcggtaggcgaaccgacgaagagcatgcgtactactattactccagagtagagtacgtgtgctgcttcaagctaataaaattttttgtttaatttctactcctagtaggtacgtaggtatatatgtatntcgggtagcttaattatgagccagtggggttntcggccggggattaagctggagatcatgccggctaagcaataaacactggggtaattagatctatatatatatatggacttcggatccgatgaagaaaataactgaatctagattttttc

SEQ ID NO: 18077 - DNA, 117 bp, Sorghum bicolor
  Clone ID: LIB3478-004-P1-K1-D5
atcatacagatgcacgcaaacagtatggaccttatccttgtctgaggtcactgaaacagaaagtcacctaactaagcttctatccatcctcgggggatacattatcactagtctatt

SEQ ID NO: 18078 - DNA, 285 bp, Sorghum bicolor
  Clone ID: LIB3478-004-P1-K1-D6
gtcaagggtggcgcctggaatgtctttctcttcgaggtcttcttcttcctcaggaaacgcacgcgtgaacgaaaacagaaggctgtgtgccggcggtgcatgatgccatacagcgccctgatgcatgcgcttggttagggccaccatgttctctggacaataatgccccacaaggaagggtgtctcgtgttctatgcactatccctctatcaattgtacgtatctgagaataatagccgcacgccaggggaggccgcgcactctgcagatcgaggatgtcctgct

SEQ ID NO: 18079 - DNA, 507 bp, Sorghum bicolor
  unsure (1)..(507): unsure at all n locations
  Clone ID: LIB3478-004-P1-K1-E1
gttatcgtggatgggtgaagggcaagctgataagcagcgacaacgaagtttgatgttgaagcaactactgacggagatattactaagggatggtggtattcaacttttgcttggtccaaatggaatgggagaagaaggagagctgaaaaagtatatgatggattggagaagtaggcagcaattcttacttgaagctgcccatcggtgtcaagaggctgggctctatgacaaagctgtggaaattcacaaaagagtaggagcctttgccatggctcttcagacaataaacaagtgcctgtccgatgcagtctgtgccatggcacggagtatgctagatggcgagagtcatgctgctgccctaattcattctggcaatgaaattttggagacagctagatattcttctgaagccagcactcaagagaaggatctcatttctgaacaacaaactgtgctgagacagctngaagctattctccatatttataggctagctcgagctggaca

SEQ ID NO: 18080 - DNA, 476 bp, Sorghum bicolor
  Clone ID: LIB3478-004-P1-K1-F3
gtagagggcgatagaggcagatggaggcgcaccacgaggagctagttggtggcattgagcgagcggtgcgagggccacgaccacgagtgcttgcgcgagcaagattggagcttctccttcgacgcagttgtggggaacgcagcgagcgcttccctgatgggcgccggcgcccaggatgatgaggaggagacatccatggtggctgagggaggagtcagagaggatgagctagcggcaggagatggcgcaagataggaggaacatttgctacatagtggaaacagagagccagagaaccttgtctctcttctggattcttgccgactgtagtttggccttcgatcgaaagggttgttttgcaatacccttgtcagctcaccaccccttttgtttgcatacacacacacctcgtttctctacttttattgaggaacatgtctgagttccaaactatatgctattttgatgttgcataa

SEQ ID NO: 18081 - DNA, 156 bp, Sorghum bicolor
  Clone ID: LIB3478-004-P1-K1-G4
gtcgacccgccggagcttatcacgccggccaagatttttgtcattgaacgtctgcacccaatgatcgatcagcgagtgagggacctcttagagttcaggatctactcggacatcaccgaggaagttaaggttgcatggaaaatccagcggaccatg

SEQ ID NO: 18082 - DNA, 120 bp, Sorghum bicolor
  Clone ID: LIB3478-004-P1-K1-G7
tctcatcctttcttcatccatcatgcgcgacattccatccccttctcgactacccacgcatcaagcagttcgtggggggacagatactcaacaccatcttcacaaacaacttttatgaaa

SEQ ID NO: 18083 - DNA, 430 bp, Sorghum bicolor
  Clone ID: LIB3478-005-P1-K1-A10
ttgcaactttcttttttgttggaaacaaaattcagttttctattgaccgcttgattttattagctacaacttttatggatgtaaaacattgttcggtgttcctggtattattagtttatatgagtttagaagttcacattgtaatctgaataagatcaagatacttagtttatttttctacgttgcaggtatacaaataccttccaagattatcacccagtgtgggcaacgttctggatgaaataaagcgccattagagaaaaatttttagtttccttaattgggaaatcgcttggaaaatcgtggccttccaggtagtcaatgggtatattggcttggcatactaagttttcaaatctgaaggatgtctttgtctgaaagacctgcctggccatcaatcaaagtgtccggctgggtgttcgggaagact

SEQ ID NO: 18084 - DNA, 377 bp, Sorghum bicolor
  Clone ID: LIB3478-005-P1-K1-B1
agcacgctgagatgctccctacacgactgcacgtgcggtccagtcgcggccacctctgaccgctgcgactggcgcgaccatcctacgcgggcttgtactttggctaggcgcttagtctgatcgctgcgcctgccaccatgggcgtggtacaacctgcactacccgcagttgtagcagggcttggcgcggcacctgagacgcgacgcgcggcgtctggctgccatggcggacccgtacctgccggtgaccatctccgcctaccagggcaggcggatgaaacgcagcgccgcgtactacgaggtgaacgcctacctcagcgacaccagcgcccgcggagtgcgccagctccgagccgagggctccaaggacgccaacaa

SEQ ID NO: 18085 - DNA, 381 bp, Sorghum bicolor
  Clone ID: LIB3478-005-P1-K1-B12
cacaggcgtcatccctctctctccaactccccctcatgacccctctcatcggcttcaagcagcaggggcaatgcagcggcggtggcatccatgtgtgctcccagatcctggcagcatggggttcggcgcgcatgaggctgtagctcccgacggcacgtgtaggccctcgccccagcactagctttggcctaatctctcctctccaccaacaacctctcagatctcggcagagacgagagaggtagtgcaggcaacagctccagcaaagtgtggggaaccagcagcagctgcggcgagctcacaggggcagcaacctgactcctgttgacgaagaacacaccaaggatgagcacgggtattcgttctctcttttcctcttct

SEQ ID NO: 18086 - DNA, 473 bp, Sorghum bicolor
  Clone ID: LIB3478-005-P1-K1-B9
caagtcgctctcgctctcgtcgggaagcaagcccaacgacccctcggcaaagaaactcggctcttatcttgtgcagtcgcagctacaggggaccctgactacgcagtgcttgtagatgacctgagccttgctggtggtggacataggggagaagctcatgaagtttggccatggatttcgtcaccacagcgacccatgtctcgcctggctcataggagcggatggttggtgggatctacggggaggatcttgaacggtgtctcccggactgaagactggaaggcagctgccaactccagtgctctcttcttgacagcggctgcacagaacctgttgtgtctgaagttagcagaggagattggtgttaatatcggaaactattggtttacttggttcaaggttgctagcgtgccagcacttcttgggattttagtgactccttatttgatttacaaaatattcccccctgaaat

SEQ ID NO: 18087 - DNA, 179 bp, Sorghum bicolor
  Clone ID: LIB3478-005-P1-K1-C8
acggagggagggagaagagcatcaccggctgttgcccgcgcctggcgactggcggtgcttcagctcgcgcggctcgcgcagccccgtgcgtggagcatcggatacggcgcggctcggccctgcaggcgaccggccttggtcccgcgcgtgcacgcggcacggatgtggccacgctcaca

SEQ ID NO: 18088 - DNA, 392 bp, Sorghum bicolor
  Clone ID: LIB3478-005-P1-K1-E10
cacacgtagagcatctcatgctgtgaacctatacagtctggattcccatctcctcatttgtgaatacatgataggctgcagatcgcagcatacatgatgcagaacactttatgccttgttcgttgcggacgaaaatggccaccctcagggcccaacccttgtgaggcgcactaatgagtgaacattcctggactgaatagatagatgtgtattatgaaggcgagccctgacctattgtgccgatatctgttgaccccacacattgaactgacactctacctctactgtttgtaacgaatgatcaagtgttatacgtacccatggtactgtgcatgtgtctaccctactgcaaatacacaacgagcactcagcgctctactgatgtgcctata

SEQ ID NO: 18089 - DNA, 540 bp, Sorghum bicolor
  Clone ID: LIB3478-005-P1-K1-E5
aaaaacttcagtctagacactagatacagtaagccttggcaccaacagaggttaatatctcaacaaggatacttcaaatatgtctgcctcgcggagctcctctcccaactccatgtcaaagtggagccccaaagagaacaagatgtttgaacaggcactcgcctactatggcgagggcacacccaaccggtgggacaaggtgtccagcgccatgggaggcatcaagtctgctgaggaggtgcgctgccactatgaagatcttgactatgacgtcaagatgattgagtcaggccatgtaccgtaccctcagtacaagacacagggattctggacccgaggttaaaatgttggaggctcaaggaggcagaaaacaaagctctacgaatctaagatggacctaggttctagaaggtagcaaaagaatccagctctggttggcgaataaaatgatgaaacaggtgtacatgtatatagtataggttatgagcaaagttatgtctaactggtggaggatctagtgtacattcataaaccgatgta

SEQ ID NO: 18090 - DNA, 462 bp, Sorghum bicolor
  Clone ID: LIB3478-005-P1-K1-E8
caaggatttacattgtgctggagtttgttatgggtggagagctccatgatatcattgccacaagtggaagattgaaggaggaggaagcgcgtagatactttcagcagttgatcaatgctgtagactattgccacagtaggggtgtataccacagagacttgaagctagagaacctgttactcgatgttgctggaaacctaagaattcaaaattccgggtaaagggcttaataaaaccaggggaaaatggttgattggtgtgttcctacttgtggaccacctacctatgttcttcaaaaggttatggttaacaaaggttataatggcgccctggctgaccttgggtcttgtggggtgatcctttttgtgctgctcgcaggatgtctgcctttcgaggatgacaacatcgcatccctttataaaaagatctcagaagctcagtttacttgtccatcttggtttc

SEQ ID NO: 18091 - DNA, 397 bp, Sorghum bicolor
  unsure (1)..(397): unsure at all n locations
  Clone ID: LIB3478-005-P1-K1-F1
cccacgcgtccgcccacgcgtccggnggtaacatttgtgcttaggtatttctttgtaatataacatcatatacatactgggaacatatcgcttattttctctatataatttttagataatttctaagttttattttggttcttatttgttaggtgcatcaggcaaggcttaaattatcaaagacaaatgttgttgtcagggttagtaatattgttatgtgttttggaagcagccatttaaaatctcaaattttttggatgcataatccanttaggccctaattttccgccaagatggtagaaaatatacatgagtgttgcatcttgtgaaaataagatttgcatgtgccatgatgtgattgtgatactacatgctttcagctgccgctggtcaccac

SEQ ID NO: 18092 - DNA, 474 bp, Sorghum bicolor
  Clone ID: LIB3478-005-P1-K1-G1
ccacgcgtccgatcggaatcagctgtggtatcactgaatccactccacatgcatcgctgacaaattaaagtggaagattatcaatagtgtgcaagaccaggtcagtatccagtgttgtagtgctcctttttctgctataacttatgcttgacctgcacgatggctagctgctggtgacggagaaccacgagagcaacacctgctgtgccggatttcactccctcaacgtcgcctcgtcttctaggtgctcctcctccccctcgcttccgagtctcagatgagaaccttaacaatcttaccaagatctataggactggcttcttcgaattttatcacttgagctcaccatcaaaaggtacatgctagatgtaattaaaagggatatgactcagtaaggccagaagtgatgggctgaaccattatttttgaggcgctgtggcgacgtgcggcgccctgcctttacaatgcctagcg

SEQ ID NO: 18093 - DNA, 422 bp, Sorghum bicolor
  Clone ID: LIB3478-005-P1-K1-G6
aaaaaaaaaggcagtttcccttctacatcgccgcctccgtgcctctgtccctgtcacgtccgccgcgcaagagccactcgaagccgccgcggtcatccgcccgtgcgaagcctccgtcgccgccccctcctagagttcgtcgtgggaggccacgccaagctcgccgcgttgtgcgttgcgacggcagcggcggtcgccgaacaattttttatggcttgaggctggaccttaagctttttcgctagggtcgactcgaaggtcgaccgtgtataccctagccgaacggaaacagcgatggctgcggctgcactggaagagaggcggtggcgggagccggaggacgaggcggcggcggactgggcgtggagctggggtgcgggcacggacgggcagctggggaacggcggattcgacgaccacca

SEQ ID NO: 18094 - DNA, 292 bp, Sorghum bicolor
  Clone ID: LIB3478-005-P1-K1-H12
atcaatgtgagcgcagctcctccaggtcgctggggccatactctgtcatgcttaaatggctcttggttggttgtttttggtggatgtggaaggcagggtctgcttaacgatgtattcatgttggatttggatgcaaaacaaccaacctggcgtgagatacctggagttgcacccccagttccgcgttcatggcacagctcctgcactttggatggaacaaagttggtagtttctggtggctgtgctgattcaagtgtactcctcagtgacacatatcttcttgatgtaacca

SEQ ID NO: 18095 - DNA, 405 bp, Sorghum bicolor
  Clone ID: LIB3478-006-P1-K1-B12
aggatttggagactcaattaaatgaacttaaaaatatggaatcagtggcaagtgagcagcatggaagaattgagaaattgactgatgaactaagcagaaaagaccaagaaattgaaggtttggtgcaagcactcgatgaagaagaaaaagagcttgaaatcttggagaataaaagccttcagttggagcaaatgctgcaggagaaagaattttccttgaagacctcagaagtttctaggaccaaagctctagcaaaactgacgacaactgttgacaaatttgatgagttacatagcttgtctgagaatcttcttgcagaagtagaaaaccttcagtcacaattgcaagaaagagattctgagatctcttttctgcgacaagaagttacaagaagcactaatgaac

SEQ ID NO: 18096 - DNA, 232 bp, Sorghum bicolor
  Clone ID: LIB3478-006-P1-K1-B4
aaaaaaaaaaaaaaaaaaaaaaaaaaaaaaaaaaaaaaaaaaataaacaaaaaatgggcggccgctaaaaaaaaaacaaaactaacgaccgcgggcaggccacaacatagcttctctttcttgcgacctctatctatctctctgcccgtcgttttccaaccttctctcctgcgaaaaccatctgagtacccaacttattaaccttgctgtccaccccccttttaacagctgg

SEQ ID NO: 18097 - DNA, 319 bp, Sorghum bicolor
  Clone ID: LIB3478-006-P1-K1-C2
gccacgcggccggcacgttcgtgtgtctgtgcaagtgccactggagggcccatgagcgtctggcggagcgtctgccagacgaccgacgctactatgacaccttatatgcatatatatatccgtctcgtctctagtctgttaggtactgagtgatgggctgaccgcacgggtcaccccattaatctgtgattaagtatacgaatctgaactccgtgtggaactgcagtaagcatggcgacacacagggcgaccgacatggtttccgcactggctgcctcataaactggatcagttatttgacaggctaagcgaccggcag

SEQ ID NO: 18098 - DNA, 427 bp, Sorghum bicolor
  Clone ID: LIB3478-006-P1-K1-C3
ggtaaaacaagcgtgtccttccaaacccctttggacaattcatgttattgacaaaccagtatgccgcttactctattatttttctctattttgtctgtctctcatacactaacacatagacctcctaagttttgatgaatgaccatattactttctaggttctgctttgtgttttacacaaaaattctttgtttccttaggttccatgttggccttattttcctcaacctattcttaacagagtaaaaatcttaatagtcgatataggtatatgctgttcgggagcagtagtcccacgatgttactatttaaaatccaatttatatacttgctcaagttacacgttcaaacaaagccgcctacagcagacctaccaagtacgttgtgcctgatttttatgctggtacattccttaaagcaaattttg

SEQ ID NO: 18099 - DNA, 322 bp, Sorghum bicolor
  Clone ID: LIB3478-006-P1-K1-C5
tgcaaatcgaagtttctaagttggaagaaaattctgttgttgcttggtcacctgcagttgttgcaaagactatctggaagaacaacctattagtcgactacactgtttcaaagtgttatggtactgcattgtctgaggagattgttgatgtcaagcacgtgaggccttgcccaccacaagcatcagagattagtttctgcatcaatgatgaggttgaagcattccaaggtgattgctggtggctaggggtgattactaaggttcatccagaattcaagtacacatttaagtcggcgcatttagggacggaagttgaggtgaa

SEQ ID NO: 18100 - DNA, 358 bp, Sorghum bicolor
  Clone ID: LIB3478-006-P1-K1-C9
attggatcagtctgtaccagaatgcatgagctaaccaaaaacaatcatctgaggaagatggtctgccagaatgcatggggaagggatgtcactgtcaggcttgagatgagcaccaagatggtaggatggggtcgtcttgcaagagagttaacaactcttgaggcagcctcatggaggaagttcacagttggagggcgcgttgagccttcccgatgcaatttcagtgcctgtgctgttggtaaccgtcttgtcctttttggaggggaaggtgtcaacatgcagcctatggatgacacgtttgtgcttaacttggaggctgcaaggccagaatggcgccgcgtcaaggtttctgccttcc

SEQ ID NO: 18101 - DNA, 370 bp, Sorghum bicolor
  Clone ID: LIB3478-006-P1-K1-D5
cttatcctgcctgcatatgacattgtgaacataatagggtctggtttgcggacaattggctattggtccaactattctgggctgtccattgtgtctcctgagactctatacaagaaaccattcaatgtcagtgcaaatcaggaactccactctgcaatctggccaggtgagactgtaacgaagccccggggatgggtgttccctaacaatggaaatgagctgagaattggagttcccgatagggtaagttaccgtcaatttgtatcagttgacaatcaaactgaaacggtgggaggtttctgtattgatgtgtttgctgctgcaataaacctgttgcaatacccagttacatataggtttataccttttg

SEQ ID NO: 18102 - DNA, 431 bp, Sorghum bicolor
  Clone ID: LIB3478-006-P1-K1-D7
ctctcgctctccaatccccccatgagccgtcgccggtgaagaacagcccatggcctgcgtcctggaccgcctcttcatgcccagcaccgacgagccgctccagcgaccctagccgccggcctccgcggcggtggagaccgctaggaaggtgcaacaggcggcgttaccagtatagcggccggccgagcggtggaggcgctcccgctcgtcgtgaatcggcctcggccccagcttcgtcaacagggtgcgtggggagcaaatcaaccgcgattggcccggctggctcttcaacatcgctgtcgaggccatcggcggatggagcccatggcgcgctgactccttcaagaagattggcaaggcttagctttttcttaatgtcatcttgcgaagggtatgcactatgcagagctgtgcaaatcattgggataatg

SEQ ID NO: 18103 - DNA, 293 bp, Sorghum bicolor
  Clone ID: LIB3478-006-P1-K1-D9
gacgttacgctacagtgtccggcgccacatgcgaaacgacacccaactggcctactggaccataagaggacaaaggtttttgagaagctctcttcgcgcgactactcctagccttcacgacaagacgtcttctatccaagtcaggcgacgctatgtcctggcgtatccgtcgtcaactgctccaatctcttcctccatagttcatcgacgacctcgcgccaccaccaccaacagtgtcactatttttatctccatcactgatgacgtcgtatacttctatagtcgaaagcagc

SEQ ID NO: 18104 - DNA, 353 bp, Sorghum bicolor
  Clone ID: LIB3478-006-P1-K1-E3
acttaaaccaatgtaagtagctcctcttacattgaatcatttgcgcttgtctattagatttgacagttgttgtacaatctgcagtggctataaacgaagttactggtctgtgggacaaagagctcgctgatacaatcaacaggatctgtgaagggaacagaaatgcagatgtgggcacagacactgctgatacccaagtgacaaaaagcaactgtcttaccgatgaacctatccagtctcatgatcgtctagctccgcaagatgggaaccaagtggatgagggatcaatcccacaaagtctgcagaatgatgggagctcagtgttgacctctgacaacatcttattgagtagc

SEQ ID NO: 18105 - DNA, 360 bp, Sorghum bicolor
  Clone ID: LIB3478-006-P1-K1-E4
atttaccaccaccattgattttgacttcaatacaatctccagtcgcattcgggagcttgcctttctaaatcctgagcttacaataaccttgacaaaggaagaagggcacacagttcaacataatgaatactgttatgctggtggccttgttgaatatgttaaatggttgaatactgacaagaaacccctgcatgacctgattgcgttcagaaaggagttggatggtataacagtggatgtctcccttcaatggtcctctgattcgtactctgatacagtgctaggatatgcaaacagtatccggactattgatggtggtactcatattgatggcctgaaggcttcattgacaagaaccat

SEQ ID NO: 18106 - DNA, 402 bp, Sorghum bicolor
  Clone ID: LIB3478-006-P1-K1-E9
attttcttgtgtgatgtgttcttccactctctgttatctcaacaaagaagccattggcaaaaagttaaataaacaaataagccagaagaccgtatctttaaattaataccctgtctgtgtttcgtatttctacacatgtttttagtttagtccaattcattcttgaaacggaaagagcattcttaagttttctttcttttttttcactcttagagaattatgtacactgctaaacagtatttctccttttactatgcttctgtgttcatattttcataataagttttcccctgttattccatatctattcaatcttctatttcacccaaatttttgtctcgttgcattttagaatatccgttcttatgccttcacttaataaatggtatctcactattggtt

SEQ ID NO: 18107 - DNA, 361 bp, Sorghum bicolor
  Clone ID: LIB3478-006-P1-K1-G1
tgcacgcatccgtacctgctgcttcacccattgctaccaccacggcgatcatccacggccgtctacacgaccgagatctgcaggtacctctctacgctgggcactacagtgaacgagctaggcctggggatgggcatggagctcgcccagaacatcacctaccacacgacgagcaacatgcccagcaacctcctccccgacatggtgaagcacaagctgatgaacctgctgctgatcctcgccatcttgctggccatcgtgctgatgaccgtccgctacggcgccctctacggccccttctgcttccgcggcgcctgcggcggcacctacggcaaggactaactcgacgacaaccttacca

SEQ ID NO: 18108 - DNA, 191 bp, Sorghum bicolor
  Clone ID: LIB3478-007-P1-K1-A4
gcggcgcgtacggccaagagattgatacctagacccatggagttccagtgatgagaactgaggatgttcttgccaaggctgcagatgtatcacggcgccatgaatgttgcactgattgacatgctcactatgatggccaagagcttgatgcatgagatattgtagatttcggatgacatgcgataaagaac

SEQ ID NO: 18109 - DNA, 347 bp, Sorghum bicolor
  unsure (1)..(347): unsure at all n locations
  Clone ID: LIB3478-007-P1-K1-A5
ggtaaatttggccccggatcagccgcctggcagtccttcagatcacccgttgtgtctcaaaaggatgacatggtgtgcattcacatcaggaggggcggcgtcgacagcgggcagtgccacagcaagtggctctccaccatcaccggcttcccggacgtgatctccatgtcgttcgtgcccataacgagcctgctcaccggcgtccggngcagcggcttcctcaaccacgccgtgaacctctacctcagatacaagccgcccatagaagagctccagcagtttctcgagttccaggtgcctcgactctgggctccagagttcggtgagctccccgctgtgtctccagc

SEQ ID NO: 18110 - DNA, 398 bp, Sorghum bicolor
  Clone ID: LIB3478-007-P1-K1-B12
attttggaaatagtgcagaagagtttcatccccataaaactctctctacttccatgaaactcttatcatctctctcttcattaatacggtgccatcagcatatttaatgttaatgaaactccattgagagtggcctaacaggacacttgtatgcctccaagggagtatattttgctactgcctcctattcaagttggctgtatccatagcagcatgccatttttgagcattctagcataaagtgctatctccccattgttcactggttcccacagagataatgcttgccttcatttctactggataagattaaatgtatcttgcggttttatctcagtttgttgagctgtatggatgttatcttttgaaggtcaactgttggaaattattttcatgat

SEQ ID NO: 18111 - DNA, 428 bp, Sorghum bicolor
  Clone ID: LIB3478-007-P1-K1-B2
aattacacgatttctcacggtgaagaaactcagcatgatgaaaataaagccaatggatcaaattcttgtatatactccataaatgcgaggctaaagaaattttcagattggcttttggatataatagcaatgggcgacctagatgcattcttccctgctgcaacgcgtgaatatgctccatttgttgatgagatgtggaaggaccccgccatacaagcaacatttaaaagaaaggaagaattacattttctccctgatgtagctgagcacttcttgagcagggccattgaggtgtcaagcaatgagtatgaaccttcagagaaagatgtaatctatgctgaaggagtaacacaaggaaatgggctagccttcattgagttcacacttgatgatcgcagcccaatgtcagaaccttatatcgacaaccc

SEQ ID NO: 18112 - DNA, 474 bp, Sorghum bicolor
  Clone ID: LIB3478-007-P1-K1-B4
gacccacgcgtccgcaacacagattatcagaatgaacaaggacatgggccacaagaagaaaatgggcacattcaagacggagatcaaaacaatgaagaaaatggaggttgcaatgatatagagaaccaagccacaacaatatccatgcctcgtccgaacacgaatagtgatgagctaagggactgcccgcagaataacaaggcaatagcattgacttgttttggttctcaagtcacccacaggggaggcgtaacaaatataggtgatcaagtggctcaagtttagtttcataaactatggagccaaggcgggttgatgcttgaagctcaaagatctgcagtagccctattgatcttggtcaaatggctaatccgtgcatagtaaattttcaattaagtttgtaaaatggcacccagtctgtagaacgggtactaaagtttcacatgaaaaactgattattataaaataatcaca

SEQ ID NO: 18113 - DNA, 401 bp, Sorghum bicolor
  unsure (1)..(401): unsure at all n locations
  Clone ID: LIB3478-007-P1-K1-B5
ttctaatgcgaatctatattgaatcagttagagattacaggttgcttaggcatgttggtaagtgtaacataacttactttcaaatggcccgctgcgggtgtctacatgtacttttgccatggaatatgttgagtttcaaacatggtatttgtgttgaagacaaaaatctagcttctaactcaaatctgctgccttgatccacctttggtggaatttgcaaacctcttactaagaaatcccaatataatctgtacgttagatatggagatgcaaagcaattccacatttgtttgaattaggatgtaataccgtattttaaagctggatataatgcatgtgtgaaaactcanaagtatgttatttgagtattgtaaactggtggatagttgtctaaagaggat

SEQ ID NO: 18114 - DNA, 311 bp, Sorghum bicolor
  Clone ID: LIB3478-007-P1-K1-B6
actggtcctagatcgtgagcggcgcccttcggttggtgaaacagctggctcctaagatcgtgatagccatagaccatgacgctgaacggctggggttccctcctgacagcacttcttgaattgataaagtgcggcacgttcctccttgattcgcttgatgctgctgacggtggatgctgattctgccggcacgattgttacgtgcctgattcaaccaataattgatgatacaaagcttgatcggatcaaggtggacaagccaactgcatggagaagtgcattagcaggtgctgggttcgcacctgtttctt

SEQ ID NO: 18115 - DNA, 474 bp, Sorghum bicolor
  Clone ID: LIB3478-007-P1-K1-C7
ggtggtcaagggccctggcgagttcgccgggctcgcgccctgcaacgcgcaggtcctctacgcatgaggcaccaccgccggacccccccccccttcgggtagaacgtctgcatcgccggaccgaggaccgacgcttcggcccagtcggcgcacccacacgggtccacctccaccagcccagcgctgcatcacgtcgccggcgaagcgccgagctggcccacatgtcagtggaacgtgacggctccagcgtctcgccggcaggcaggagcgagtggcctgatggattttccgaagaaaaaaaataaaatggaaaacagaagcgcaagcgcaggtgcacaggctcgccacgtgggaccagtgtgtgagcgagcagtgatgatgggacttggccacttgctagaggctgaaaaagcttttccgccacgtgggaccgaggaagcgtgcaagctgtagaaattatttttctttctcttt

SEQ ID NO: 18116 - DNA, 481 bp, Sorghum bicolor
  unsure (1)..(481): unsure at all n locations
  Clone ID: LIB3478-007-P1-K1-C8
ctttcactgtatctctactttgatcgagttcctttcctacaaagtagccactgaagaaatgcactatgggagagatttttaacgaccaaatagctgaaagatagacaggttaaattccaccaaagttaaatcactttataaagggacgactatgagcagtagattccagatgagtggaaaagccaaatcatggagtccacttcgtcggtgtagctgatcattgaagcaagatgatctactttcctccactaggacatacagagtttgctatatccatactagccttctagaagtatacattttaagttactataccatcatccaaaagatcagttattgtttccatttgtttgttaactatttgaaaaattctatataactcccagtactatatagctaggtaggaagaccctaaccatttatcttcccaaaatttgacaattctatccttcccaatntcccatgtgaaaaccccttttga

SEQ ID NO: 18117 - DNA, 442 bp, Sorghum bicolor
  Clone ID: LIB3478-007-P1-K1-D6
caacctgttcgttcggttttgcatccactttggaagacgggacagttccttctcaagcgatgaggaatctggaggttgaggcaaatgaagtctcctcagtgtatcgtgaccagtactatgaaggtggcatctcgtctgattacatttgggaggatgaagataatgggtttatcgcatgcttcttaattaagaaagatggacatggaaaaagagggtacatgcagattggttcatgggatgctattcatgttattcaggctggtcctgaagaagaaggagcggcacattactgcttgaacagcactgtgatgctctcattgacaacagacagcaagcagtcgcgaaccttcaacttgtctggatcgataagacggcagatgagtatgacccttgctgtagctgatggacaccttgttgatatgggaaaaatgatagaagaaat

SEQ ID NO: 18118 - DNA, 407 bp, Sorghum bicolor
  Clone ID: LIB3478-007-P1-K1-D9
ggaatgtaccttgggtcagtcactggcctgggtttctcacctctgttgattagcagatttggctggccttctgtcttttatgcatttggatcccttggaaccgtttggtttgcactatggcaaagcaaagcacacagctctccagatgatgatccggagataagtaaagctgaaaagaggcatatactgggtggcagtcccttaaaggagcctgtcacttccataccatggaggctgattctatcaaaggctccagtgtgggctctcataatatcacatttttgccataactggggaacattcattcttctaacatggatgcccacatactacaatcaggttctgaagttcaatctaaccgagtccggtcttctctgtgtcttgccatggctgacaatgggctgttt

SEQ ID NO: 18119 - DNA, 413 bp, Sorghum bicolor
  Clone ID: LIB3478-007-P1-K1-E4
gggaagtggggaaaactatagattgattattgggggacaatgtacatgtacatatataggggaggatacggcttatggaaaacacaagcgacctccagtatccttgcctaatacaactcaatctactagagttccggacttggagtccaattacatttccacaaccctagccgacctttatacgagatcaggccagctgggcatgaacccataaggctgaagctaatgaagcctaaggcccataacacagccctgtctaacaattctgagggtaccaagtaaaggcggatgcgggccattattcggcattctctgtccttatcacccccatagtgagggaaccatggaagggggacaccctaaattccatggaggctaccagatttatttatttattttattggttttcccct

SEQ ID NO: 18120 - DNA, 432 bp, Sorghum bicolor
  Clone ID: LIB3478-007-P1-K1-F11
ccacgctctacgagtcaagacactagatatcacatcagcgattcttgctgcgaagagtgctgtctttagcaagcttttctcaaacggcatgaaagaatcggatcagagacatgcaccccttagaactactgactcagaggaaactgccctcatggagctcctaagctttatgtatagcggaaagttgacagctactgagcccactcttgtgctggatatcttgatggctgccgacaaagctgaggtcgtttcatgcatgaggtactgcatgcagttgctcacacacttgccgatgaccacagaatctgcacttgtatacctagatctttcctgctcaatttcaatggcagctgcagtgtaaccactgacagatgcagctacagatgcccttgctgttaaacacaaggatttgactaaggtccaagatgaagt

SEQ ID NO: 18121 - DNA, 450 bp, Sorghum bicolor
  unsure (1)..(450): unsure at all n locations
  Clone ID: LIB3478-007-P1-K1-F4
gcgaaagcggcggcgtactacgacgagctcaaccgcaagggcgagggtgcccgccgcttcaagcaggggcttggcttctcctccacctcatccgacgccgccgccttcccttccaagcccaccgcctcctccttcctatccggcttcgttcgcgctggcgcagcccctgccgccgcccaactccctaatctctccaaacagccgccgccgcattccaggcccccatccagtccgcgccgtcgctccagttcaccgcctccgtcgcgtcccaggatccgctccaggtccaggtcccggtccccgtctcgttccagccggcgccgatcgaggtcgggtcccggtcgagggagcgcatgcgccgctccaggtctagggagagggaccgcatggcatcccgtaggcgctctagntcgcgggcttcgagacgcttctcgccggagcggaggagct

SEQ ID NO: 18122 - DNA, 458 bp, Sorghum bicolor
  Clone ID: LIB3478-007-P1-K1-F5
cataaacaatattcttaaaaaaaaaaaaaaaaaaaaaaaaaaaaaaaaaaaaaaaaaaaaaaaaagggggggggaaaaaaaaaaaaaaaaaaaaaaaaaaaaaaaaaaaaaaaaaaaaaaaaaaaaaaaaaaaaaaaaaaaaataaacaaaaaaaaaaaaaaaaaagggggggccctttttaggggtccaaggttacctccccgggcattgcaagttttttctttttttttggggcccccaaattcaattcccggggccgggttttaccaccgcggggcggggaaaacccggggggtcccccattttattcgcttggaaaaaatcccccttttgccggggggggttattggaaaagggccccgccccgtccccccttccaaaaggtggccccccctattgggtaatgggcccccccctttttcgggcccttaaagccggggggggggggggttccccc

SEQ ID NO: 18123 - DNA, 402 bp, Sorghum bicolor
  Clone ID: LIB3478-007-P1-K1-F7
attgactaaaatttgcccaattttgcctagttgtatatctcattgaatgacaacccaacctactgagctctgttcaagctgtcaaacttgcaacatcttctcctatcgaccaacggtgatgccaccatactaaaaattaatgactttgggtttgccaagtgagagcagtatgccccctcattattgcattagtatttatcgaagcataattttttttgcctcctccaccaaatgtcatagattttatcaggatttgtcactgggacgatgtttcccacctgattttcctccatctatccaactaatgggccttccttgctcctgtgtatgcaggttatgggcagatagaaggggtttgttgctgttggaaatctgtacagatcctatcttctacagtgcatc

SEQ ID NO: 18124 - DNA, 408 bp, Sorghum bicolor
  Clone ID: LIB3478-007-P1-K1-G2
aaaaaaaaaaaaaaaaaaaaaaaaaaaaaaaaactaaaaaaaaaaaaaaaaaaaaaaaaaaaaaaaaaaaaaaaaaaaaaaaaaaaaaaaaaaaacctaaaaaaaaaaacaaaactaaaaaaaaaaaaaaaaaacgggctatcgttctacaagggggggcccccttttcggggtcccagctttccctcccctttcttgaaacctaaattcttttttttggggccccctaatttaaatcccttggcccctcggttttcccccgtgggtccgggaaaccccctggcttcccccacctttattcttttttccatctattccccttttccaaagttccctttatatcgactttcccccccccttgcccctttccaacgatttgcgcaccctgattggctactggcccccccc

SEQ ID NO: 18125 - DNA, 333 bp, Sorghum bicolor
  unsure (1)..(333): unsure at all n locations
  Clone ID: LIB3478-007-P1-K1-G8
gaccgcccaaatccttcaacaggagaatggtacccggcgccattcgattcatctgcagtggacaatatgaggaggcttctggagcatgctggcgttcctgggcacatatatccactatcattgctgtgctatgaggttatgcctccaccacaacaggttgagaaagagattggtgagcagagggtgatatccttccatggagtaggcttgtcagtaactgaagaaataaaatatggggatattactgctcataccaagaatgctgatgagggaagggagctattcacaaatactntgtacaactcagttgttaatcagtacgatgtgctcaaa

SEQ ID NO: 18126 - DNA, 351 bp, Sorghum bicolor
  Clone ID: LIB3478-007-P1-K1-H7
ccacattgcagagtatggcgttgggtgcaaaatctcagttgagagtgacatctacagctatggaattattctgctggagattattaagttttgcaccacattgcagagtatggcgttgggtgcaaaatctcagttgaaactgatgacatgtttaaggatggtgtaaacgtccgcaactttgtggagtcatcacttccactgaatatccataacattttagaaccaaatctcactggatatcatgaaggtgaagacggaggacaggaaatggttgagatacagcactgtgcaatgcaactcgcaaatcttggtctgaaatgttctgagatgtcacccaaggatcggcccaaa

SEQ ID NO: 18127 - DNA, 373 bp, Sorghum bicolor
  Clone ID: LIB3478-007-P1-K1-H9
cccacgcgtccggctttctggagccaacttcgactgtcctagcaaggcctgttttagatgcgcatggatgggatcatgactgtggttatgatggagtgagcgttgaagagacactagctatccttagcaggttcccagcaaatgtagcagttcaggtcaccaaggacaagaaggaatttagcatccatctggactcttccattgcagcaaagcatggagagaatgcatcatcgcttgctggttttgatatccagactgttgggcggcagcttgcatatattctccgtggcgagacaaaaatcaagaatatcaagaagaacaagaccactggagggttctcaagtaactttcctgggcgacattgtggcaactg

SEQ ID NO: 18128 - DNA, 284 bp, Sorghum bicolor
  Clone ID: LIB3478-008-P1-K1-A6
cccacacacccctcgcccgccctcgttcccctcctcgccagtcgcctccactcccatcaccgacgacgtgtcgaggcgagagcagagggcgagtccaaagtctagggttcccgccgcatcggcacgggcatcgcaccgcaccccgagggcgcgggcacggaggaagatggcgcggcgcgggcgcgtggagctgcggcggatcgaggacaaggcgagccgacaggtgcgcttctccaagcgccgcgcggggctgttcaagaaggccttcgagctggccctgctct

SEQ ID NO: 18129 - DNA, 301 bp, Sorghum bicolor
  Clone ID: LIB3478-008-P1-K1-A8
acccttatcgactcaactctgtcctgctggtgatgcatgtaaccaccgcgtatctcttcatagacaacgaccacacctaactctgcctgtgccactctacaactactcatgccacttgaaagttgtcagaactgttgatgccaatgaagcgcgcacatagactgacatgccaagcggatagctgtatcatcttcgaccgcacacctgacatggagaagcggatgctgatgaacactcttgtcatatggccataccattgcgcaccgaatgattggacgatctctactgcaccttgttcatc

SEQ ID NO: 18130 - DNA, 420 bp, Sorghum bicolor
  Clone ID: LIB3478-008-P1-K1-B8
cccacgcgtccgaatctgtcgccaagagaaggtgattggatatgccagaaccctaactgtggaaatctcaattttgctcggcgcactcactgtaacaactgcaacaagttccgctattcatcacatgaagcatatgagcctaggcgcagcccccccttcaggggttaccccagctctccacgagggcctccaaggattggtccacctggtgatcgtgcccctgcaagagagatgaccaggtacagatcaccacctcatggttggggagcaagtgatcctagggcatatgcagctcgatcccctccagaacgtgcaggacggtttacagatccatcacctaaggaaagaatgggcttccgtggtgagcgcgacccaagggaccgtgtgaaatttgagtggtctggcactgatgactacatt

SEQ ID NO: 18131 - DNA, 378 bp, Sorghum bicolor
  Clone ID: LIB3478-008-P1-K1-B9
cagcacaaagctctcgccttgttacgacctgcagcggtagcggtgctcatgatatcgacgcgagcggtggaggcgccgtcgaccttgacgctggcacggaaaccattgggacttcatgacacattcttagacgggttccaaagcgcctttatgaataacactactgtcgctgctgctcgtatttgacgtgggacctgctgcataagcgatgcctcttgactacctgctgggcaaggaacgatgctgttgaactaccagatcatggcttacccttgaaggtacaaatcaatttaatgaagacttgagtgcatctcaagagtagacgtctactatgcttagactgctagaactttaagagcgaagatgacaattatttga

SEQ ID NO: 18132 - DNA, 329 bp, Sorghum bicolor
  Clone ID: LIB3478-008-P1-K1-C10
cccacgcgtccgagaagaccggccagccgcttgaggctggtgccgcccacgctgccgccggcaaccacggtactcacggtacccacaacacccacaacacccacggaaccactggtaccaccggaggcctgaccggcaacgaccacaccaccgactcccacggcgtcaccggctcgcacggaactcacggcactcacggaacccacggaaccggcgcaggtctcggtgagcccgttggtacgaccggcacccaccacaccaccggcacgcacggaaccactggtggcctgaccggcaacaaccaccactcggccaccggaaacgccacg

SEQ ID NO: 18133 - DNA, 394 bp, Sorghum bicolor
  Clone ID: LIB3478-008-P1-K1-C12
gcggcgcgcgaggccgagatactcatgctcgccgcggacgcgccccacgtcgtgcgcctccacgcggtgatcccgtcgtcggccgccggcgccggggccggggaggcgcccgcggcgctggcgctggagctcatgccggggggctccctctcgggcctgctccgccggctgggccgcccgatgggggagcggcccatcgccgccgtggcgcggcaggcgctcctcggtctcgccgcgctccacgcgctccgcgtcgtgcaccgcgatctgaagccgtcgaacctgctcgtcggcgccggcggtgaggtgaagatcgccgacttcggcgcgggcaaggtgctgcggcggcggctggacccctgcgcgttctacgttggcacggcggggtacatgt

SEQ ID NO: 18134 - DNA, 338 bp, Sorghum bicolor
  Clone ID: LIB3478-008-P1-K1-D1
caagagttgtgtccggagaaacgtatgctttattacccataccttcctaaggtcattggttctgattttttggagaggaggctcagagatatacacagcaacagaaaagacggagcagcttgccatgtttttgggcacactcatttctgttgggattctgtggttgatgagatcaggtacgtgcaagcccctctggcatacccacgagaaagaaaacgccggatgaacagtgaaggctggttgccattttgtgtataccgtgatggtttcaacccagaaatatacccggcattgtggtcagactactacaacaagaacaaaagggaacccgagaacac

SEQ ID NO: 18135 - DNA, 434 bp, Sorghum bicolor
  unsure (1)..(434): unsure at all n locations
  Clone ID: LIB3478-008-P1-K1-D6
acacgacacaagccgagccgaggcgagcaacacaaagcagcgcatcactccccaccgtgtccgtctccgacgcgcttcccgcctgagtccgcgcaaccgccccgcatctccccatgtggccgtcgtgggtcaagacgcgcagctctgaccccgctgccgcctccacctccaccgccctcgtccccgccgccggcgcgtcgccgcgcctctccatccccaacccgtctctcaaggacctccggtccctgctcgcgccggactccgccgccgccgccctgccgtccgccgtctccccgtcgccgcgcgtcttccaccgcatccgcgtcgccgcctccgcgctccgcgtcctccgcacgctccagcactccccgtnctccccgcccgccgccggcaaggagctagcaccgggcggcgggccgggggggctgtacttc

SEQ ID NO: 18136 - DNA, 459 bp, Sorghum bicolor
  Clone ID: LIB3478-008-P1-K1-D8
ggcatatgattcagaatgacttggtccatggatggggtcttgactttgctctgaggaaatgtgtggaggtattccgtgccattgtcatgcataatacttcacctccccatttctttgataatccaaggattagccacacagttcatgcctttcctctcacaggatagcacatatcagcatcaacagttatatgattaccaacttaattagtgctttttagagttttagggcatagcaccagtctttcaactaatcgccaaaagacggttcaagccattacagcatagaagatggcataccatctgaaaaaaacactgtaaatgtgttttcgactttggatgttatatgtacgttatactgagctgggactcttttactttaatttatagccggctcatgagaagaatggagttgttgatgctcaatggattgttcatcaagcaggtccctcacttggga

SEQ ID NO: 18137 - DNA, 307 bp, Sorghum bicolor
  Clone ID: LIB3478-008-P1-K1-E1
gccagagaccagtgtggtgcctatttcaaacgtagcctatcttggcctgtatggtgaggataatagggatcgtggttcttctgatgccgcatatggggcttatacttaacatgcgccaccatcctcaagtgaaacggtctgacatgcgtggcctgaatatatacctgttgccaatgacaacagcctgagcctcagctctttccatgagacggctcaagatgacacaacgtccgaagacgtctctgatgcggtgtacaaaatgacttatgatgctcgatatcagttgaactattgccattatgctaga

SEQ ID NO: 18138 - DNA, 317 bp, Sorghum bicolor
  Clone ID: LIB3478-008-P1-K1-E9
cgccgccgccggcctcaggccgctctccctcgccgtctccgcgcgtccgctgtaccgccaggagcatgtcctctcaaccgtggcggtggcggcggcggcgggccgcaacgaccgctccacgtcccccgcgccgccgtccgccaccgcggacggcgcccggccggtcgaggtcgccgccgcgcccgcggagaacgcgcggcgcgccaggatcggggtctacttcgccacgtggtgggcgctgaacgtgatcttcaacatctacaacaagaaggtgctcaacgcgttcccgtacccgtggctcacgtcgacgctctccc

SEQ ID NO: 18139 - DNA, 482 bp, Sorghum bicolor
  Clone ID: LIB3478-008-P1-K1-H11
atgacctatgctccatccagtgctgtgtggtgggcaagttatggttccagccagcgcataatttggagtgctcttggccatttgcatgacaaagaagaggctcctagccaattgaaactagttggtgttcaagcatcagggggggtttttgccggtgccgtgacctcttttgttacgactcccatagatacaataaagaccaggctgcaggttatggataatgaaaataagccaaaagccagggaagttgtcaaaagattgattgctgaagatggatggaaaggtttgtacagagggttgggtccaagatttttcagctcatcagcttggggaacctcaatgatagtatgctacgagtacctgaagcgcttgtgtgctaaagttgaagaggtctgatttctgagctgccttaaactcagaacgcaattcctacaattctggaagttttgtattagcagaagtgtaataatgctgtacaccaa

SEQ ID NO: 18140 - DNA, 378 bp, Sorghum bicolor
  Clone ID: LIB3478-008-P1-K1-H2
ccaaaccctagcttttgctctgtctatgaataatgaataggggatgtacaagtgtcttctccaagggccagggggcctacttatatagcccttccaaatgaacgtgggctgtcggatcaaaccgaccttaatcgcatggttttccttaatcctttaggtcggtggagcataatccacgaggtggagcctgattggctgccatagctgggcgggcgccctatagggggaggcgggcgccctgtccccgggcccgctcggcctcccgtttgttcccgtgtcttctggactcttctagatgatagaaaattggcgcacacgttaatatctctatgtaaacccgacgtgtgggcctttcctccatattttctgataacccct

SEQ ID NO: 18141 - DNA, 303 bp, Sorghum bicolor
  unsure (1)..(303): unsure at all n locations
  Clone ID: LIB3478-008-P1-K1-H9
gttcattcaagccagccaatttaactataatatctgcacctaaattggagaccttaggctgtctttatgatacttgttttcaaaccaggcttgtgtttggcaccatatttattcaggtagtcatggcactctattttgttcccatgaaaagtctgctgagttttgttttctgttacagagatttttcatatcatctgcattcgcacatggtttgatgttttgttcaatgcttgattcaaggattagaagttgtaagctngacagcaacagtgaacagtgtcaagactctagctgtcgcatcat

SEQ ID NO: 18142 - DNA, 182 bp, Sorghum bicolor
  Clone ID: LIB3478-009-P1-K1-A10
aaattagctatacatcttcaatatctctgctctcttcctcagattatccagcttgaagatgacccttacaatcaccaaattccagaatatgaccgcaaatactatgaaccaattggaccgtggaagcgtttttctcatgtctgcgcagcaccagtcgagtcagatgatttgtccattgtcac

SEQ ID NO: 18143 - DNA, 427 bp, Sorghum bicolor
  unsure (1)..(427): unsure at all n locations
  Clone ID: LIB3478-009-P1-K1-A8
aactttccctttttctccacctgtaacaactgagactgaacttgaattaacagaatctactccaccttcaacagaagaaactgaagaaactgagccaacggatgaggagacagaaacagaattgacagttcccactactcccttatcaacagaagaaactgaagtcactgagcctacgactgaggagactgaggtcagcatcccaccaggtgaaccaacaaccgatgagactgaagaaactgaaggaactgaagagactgaagagacagaagagacagaagtgacattccctttctctccacccgcaacaacagagactgaanatgaattgacagaatctactccaccttcaacagaagaaactgaagaaactgagccaacggatgaggagacagaaacagaattgacagtcccactactccttata

SEQ ID NO: 18144 - DNA, 245 bp, Sorghum bicolor
  Clone ID: LIB3478-009-P1-K1-B4
caacaactattggatattttggagcttacacaccaatcagtatcaagatttcttgaattggattcttactctcttatgcttagcgagatgcaagagaatctttcgttggtttcttattcaagtcgcatctcttctcagatatggagtgagatgcagacagatttcttgccaaatttcatcctatgtaataccacacagcggtttgtccgatccataaaaagaactcaccactcttcgcatagatc

SEQ ID NO: 18145 - DNA, 343 bp, Sorghum bicolor
  Clone ID: LIB3478-009-P1-K1-C11
tccacgcgtccgcccacgcgtccgtagaattcaaagcagatagtgtgcaggatgcgactggcaaaaatgctgacctcaccgcacctacaatggccacagtggtatgaaaatcatatgcagaaccttgtgtcttactaaccttatttgtcattttagtaatgcataggagtagaatatatcctgcttgtatcattaattttattgaacttatatagaactcactggaagcatcccaagttagctgttaaaactttgttgccattttattgcttaagttcttccaagctaacccttgtaagcagggatcatattatcaacatattaccagcaaggatcaagttct

SEQ ID NO: 18146 - DNA, 247 bp, Sorghum bicolor
  Clone ID: LIB3478-009-P1-K1-C4
gactcagaagatgattcaggtgaagaagctcaggctaagccttcagacaaagctatatacaacaaggaggctattcttgaaaaacttgaagacatagcctggcccaagaatgtggactggatgcacaagctcactattgagcatgatcagggggagaaagttgatgtgaatgatgatcttgctcgcgaacttgcgttttacacccaggctttggatggcacaaggcaagcctttgagaagctgcagt

SEQ ID NO: 18147 - DNA, 326 bp, Sorghum bicolor
  Clone ID: LIB3478-009-P1-K1-C5
agcgacagcgcgtccgtgtcgagcgtggcttgtagccgcgccgggaggcaggcaatgacctttggtacctctccgccgtctacatattgggctttgtgagccacacgttgtgctttgggatgtctgaaacaatgacaatgcttaacctagaataggaacctgttatttgttagctgcatccacaaattactgattgatttgaactctcatcctgtgctacaactccaacccaatgagatgcagtagcagcaacggactctgcttgctgattttaataagacacatggatgacatatacactgcttttgaactttatgtttctttat

SEQ ID NO: 18148 - DNA, 359 bp, Sorghum bicolor
  Clone ID: LIB3478-009-P1-K1-D11
gtcaccaccgggcgtcgagatgcaacagcgtatgaagcagcctgcggaccatttcagcttcgcgcctttcaggaaaaccttcgatcaggacgctggtataagtggtgatcatgtgccatctaatcagcttggacgatcagagccgcatcatgccggtcatgggcagctgccacaccgtccaatgctatcgacgacgacaggcgtgcctgctacatctgtactgatcagtatgccatcgaaccccgtatcgactatagtgccacctgtaatgcatgacgcatgggtagttctcgatcatgatcagctgcatgtgccagctatgcttatggatcaccatgacaaatttgagtctgagcacc

SEQ ID NO: 18149 - DNA, 370 bp, Sorghum bicolor
  Clone ID: LIB3478-009-P1-K1-D12
ataacaaaaccatgtagtttaggctacagtgtctatgcagcacttgatttctttacggactcgcgacacataaagacagacatactaaaagtagatttggcatctaaattagacatgcaggaaactagcagaaaggcatgtgctttctcttttgtaaattattgacaaagatttaggaaattatggccggagagcctgtagcgacaccccccagggctggccctgtatcctatgggtatgatctgagatctgataaatgagatccctgcctctatttctctgctcatagtgacttgtttgtcctattgattgccatttggttatatcagtattcagtctgatctaattacatctatgttaatgtattatg

SEQ ID NO: 18150 - DNA, 325 bp, Sorghum bicolor
  Clone ID: LIB3478-009-P1-K1-F8
ctctgttgaaaaaggcatatggcgaagagggaggtgatgatattgactatgatcgacgcttgctaacatcttccgatgaatctgtttcagagggatcaggaaatggatcagctaacggtatggtgtcagaatttggtgatgacaattttgtcattggaaattgggagttgaaggagataattagccgcgatggccatatgaagctttcatcccaggtgttctttgcatcaatagaccagagaagtgagcgagcatctggggagagcgcatgtacagcacttgtggctgttattgcagactggttccaagcaaatcaaaatatgat

SEQ ID NO: 18151 - DNA, 118 bp, Sorghum bicolor
  Clone ID: LIB3478-009-P1-K1-G3
gtggcgcggtcctcggacaggtactctcacgggtcctctctggcgtcctttctgcatctcatgccacagcggatgcctgactgtggaggcgttgctgtaagcacactgttcagcacac

SEQ ID NO: 18152 - DNA, 386 bp, Sorghum bicolor
  Clone ID: LIB3478-009-P1-K1-G5
cacgccatgaagacgctgtcgtttgatgtgggcatcgtgatgatcttcggcggcgggcggctggacgagcggcgcaaggcggagctgaggaagaactactccatcgtggagaaggggtacaactccttccccaacagcctaccggggacgctctattacaaggcgatgcaggcgcggcggcggctgcagggcgtgctgagcgacatcatgcgcgagcggcggaagcgcggcgagccgggcaccgacctgctgggctgcctgatgcagtcccagggcgacgacggcgcgccgctcctgagcgacgagcaggtcgcggacaacatcatcggcgtgctgttcgcggcgcaggacacgacggccagcgtgctcacctggatcgtcaagta

SEQ ID NO: 18153 - DNA, 283 bp, Sorghum bicolor
  unsure (1)..(283): unsure at all n locations
  Clone ID: LIB3478-009-P1-K1-H5
atcgatcccagctcgactgccacacacactactacttaccaagctgctgatcttcagcgagtctgcaatggacacaccctcgccgtcgccgacgtcgtccgcggggcacgacgagtacaggacggtgtggtcggcgccgcccaagaagccggcgggacggaccaagttccgggagacgcggcacccggtgtaccgcggcgtccggcgccgcggcacgctgtggcggtgtgtgtgcgaggtgcgcgtncccgggggccgcgggtcaaggctctggctcggcacc

SEQ ID NO: 18154 - DNA, 332 bp, Sorghum bicolor
  unsure (1)..(332): unsure at all n locations
  Clone ID: LIB3478-010-P1-K1-B8
agagaccgcttgaggcattgaatgtattttacagcatgcagaaccaattgtcatcttatcctgacatggcagcttatcattgtattgctgttactcttgggcaagctggtcttgtgaaagaactatttgatgtgattgattgcatgcgttctcctcctaagaagaagttcaaattgagccctcttcagaattgggatcctcgcttggaaccagacctcattgtatacaatgcggttttgaatgcttgtgtgcaacaaaagcaatgggaaggggcattntgggtactgcaacagttgaaagagaagaacatccgtccaacaaattcaacatat

SEQ ID NO: 18155 - DNA, 414 bp, Sorghum bicolor
  unsure (1)..(414): unsure at all n locations
  Clone ID: LIB3478-010-P1-K1-C8
cccacgcgtccgggataaactgcacgtgcaactcaagagaccaagaattgtgcctggggaggaggtcgatgagaaatcaaagaagttcaggcatatgctccggtctgttgttgtcgacggcagtgacatagttgtttctgcaaagaaagcatctgagagatcattggctagattggaagcgagagaagctgcagcaaaggcaaaagccaagagagaggaagaaagggtgcaggaactgaagaagattaggggagagaaatggcttccttctgttgctagacaaatgaaggaggaaaaagcttgngagctgcgaaggcaatgagctgatgatgcaccagatcaatggagctgcgtacgcttatcttcaaagtcagttatcctggtgccctgttctgagcgcccactaaccatgag

SEQ ID NO: 18156 - DNA, 321 bp, Sorghum bicolor
  unsure (1)..(321): unsure at all n locations
  Clone ID: LIB3478-010-P1-K1-E3
gaatgcttagagtgggtcatccattgtgatgttaaacctgagaacatactgttagaccaaacttttgagcccaagatcactgactttgggttggcaaagttactaaacagaggaggttccacccagaatgtatcccatgtaagaggaacactaggttacattgcacctgagtgggtttccagtctccccatcacagcaaaagttgatgtatacaantattgggttgtgcttcttgagctagtgacaggcactagagttttggagttggtggaaagtccagatgaggtgcataatatgcttagaaagcttgtcaggatgctt

SEQ ID NO: 18157 - DNA, 323 bp, Sorghum bicolor
  unsure (1)..(323): unsure at all n locations
  Clone ID: LIB3478-010-P1-K1-E5
gtttcgacagcggagagcctaatccaactgtaaatatcctgtgagaggcctgtatttgagggaggaacacactggangacctgcaaatgtggttcaagcttgcattgctgcagacacatgtcctacaacggctattttgactggaaaagggcttctgtccccagtgtatcaagagcagcttggtgaggagcagactgtgacactaggaccagcggtggaataatgcaatgtctgagcgagacacttagagcttgaacttgctgactctgtgagctctttagacctcagaggagctcattacctgtgctgttgtacagaagaga

SEQ ID NO: 18158 - DNA, 339 bp, Sorghum bicolor
  unsure (1)..(339): unsure at all n locations
  Clone ID: LIB3478-010-P1-K1-F3
atttcccttcatccgtggtatgtgattataggttaacctagtcaggggtttactcttccatatcatggcagtgttcatatacttgaaaaccaataggtcaagtatttttgcgtttacctggtattgagctagtgagataagaaataactttttatgctttgtcctatttgcccccatgaatttttaccaactttgcatttataaggtttaaatatttagttgtaaaaggaccttttgctttgcagttagaataatgtatgacaaaaactctggaaggtcaagaggctntggatttgttcatttctcaaatgatcatgaagctaagtgtgccaaggatgc

SEQ ID NO: 18159 - DNA, 193 bp, Sorghum bicolor
  Clone ID: LIB3478-010-P1-K1-F4
aagacaggtcgaggttgacataaacgaatggcctgagcaaatagacactgccacctacatgccatcataacgaagagaccatcaatgctgcaatgcattctcactgagcttcaactgaggataattgagctagatacgggagtcggcagcttggagtactgacatcgttactttaagaccgatgcatctggag

SEQ ID NO: 18160 - DNA, 397 bp, Sorghum bicolor
  unsure (1)..(397): unsure at all n locations
  Clone ID: LIB3478-010-P1-K1-F6
agggcaccacggcctcatctccgacgagaccctggagagcggcctcaagatttgcccggggagctccttcatccacatcgagccggagtgccagaagatctgggacaaggccgtcgaggagcaaggcaacatcgacggctacagcatctacacgccgccgtgcgacaagggaaccccgtacgcgcgcagacgactgaggaggagccgccgcccattgatgctgccagcatacgatccgtgcaccgccttctactcgaccaagtacctgaacctccccgaagttcagacggccatgcatgccaacgtcagcggtatcatagactacccatgggttttatgcagcgatcctctgtattacaactggacagacacacctgcttncatgctacccatctac

SEQ ID NO: 18161 - DNA, 408 bp, Sorghum bicolor
  Clone ID: LIB3478-010-P1-K1-F9
agaagctgcacaaaggagcaggaggtgcccgtggggaaggaaggaaggagcaattaaattaaactatatatagtatcatcaatggcggatgcagcaagagagatcgggtctcttcctgtggctaacgtacaggcgcttgcagagacttgcaataacggcggccatgtccaggtgccccagagatacctcaccaaggatcctggttctgaggaggtcgttgctgcggacgatagctctcacgcaattccggtcatcgatctccagaagttgcttgaatcccagtcatcggaggaggagtgcgccaagctggcttctgcctgcctcaactggggcttcttccagcttatcaaccatggagtgccagacaaagtgattggaaacctgaagaatgacatagccgagttcttg

SEQ ID NO: 18162 - DNA, 387 bp, Sorghum bicolor
  Clone ID: LIB3478-010-P1-K1-G6
cccacgcgtccgcccacgcgtccgataaaacatcagcactagttctgtttctgagaaagacaatccaaaccaaagatgtctgggtccaggaactcttcccgcaacgttaacattgattccaactggagcaaaaaggagaacaagctgttcgaggaggccctagcctgctatggtgagggcacacctgaccgctggcacaaggtggcccgtgccatgggtggcatcaagacagccgatgaagttcgccgccattatgagatccttaatgatgatgtcacgctcattgaatccggcggagttccattccccaactacaacacacagggagcttggaactaaggagtcaaggatgcatgtgaagaaccaccagacaggaactactgctac

SEQ ID NO: 18163 - DNA, 135 bp, Sorghum bicolor
  Clone ID: LIB3478-011-P1-K1-A4
gacaagcgagcgaggaggatgatcgggtggtgcgacgtgtgcaaagtggagggtgagacagggccgtctactatggctgttactggactgcagatccgagcggaggtggagcatcatcacgcaggagcattacga

SEQ ID NO: 18164 - DNA, 261 bp, Sorghum bicolor
  Clone ID: LIB3478-011-P1-K1-A8
atacaggttgtccttaatgctaacagccagatcgttccagcatatgaaattgctgcaggtagcatggggctggatatggacccagatgctgttacttcattcaacgcatccatggatacatgccatacagtgatttggaacggcaccatgaatgatctccaatttgacacgtactatgtaagaactgatgctcgtgcaaagaagtcggctcaacttagcaccaatggtgttacagctatcattgaaggtggagactctgtt

SEQ ID NO: 18165 - DNA, 419 bp, Sorghum bicolor
  unsure (1)..(419): unsure at all n locations
  Clone ID: LIB3478-011-P1-K1-A9
cggacgcgtgggcggacgcgtgggcggacgcgtgggcgttcgtgccctttggctgccgtgctggacccgtcgacgacgcgccgtccgcggaccacgccgtcgttgccggagacgccgccgtcgccgcgaggaggcgccggaggaggattgctagccgcaacaggtccgccgtctgtgccgtcgccgccgcgcagtggcgccccttgctcggngacatctacgaggagtacagcaccgacgcggccaagttcggcgggcgcgccagcgtcgggccggtgagggtcaagaaggcggcgttctgggacgtcactcgggtgctgccccgcgcgcgcagcgattaattcaggtacaggacactggaccatgcattttctatgagttttattttttctgttcagtacatcagtcaattacacaat

SEQ ID NO: 18166 - DNA, 317 bp, Sorghum bicolor
  Clone ID: LIB3478-011-P1-K1-B10
tgcaacttcagtgaatttaaagttccaacagtgtcccggctatgttctattgaatggtgaaaaggttaaggcaaaatttcgacggtacttgtgccaatggaacaagcaaggtccttcagttgaagctatggatgaagaaaaaaagcattattccgtgtgttattcagtgatcgtcgtactagatccacaagttcaggtccagtgactgttccaagttcaggtccaagttcaggtccaatgggtgttagatcaggttcaatggatctgtcggtgatgtcaaaagatgccgataaagaaaaggatgattagagaggaca

SEQ ID NO: 18167 - DNA, 310 bp, Sorghum bicolor
  Clone ID: LIB3478-011-P1-K1-B11
cgcaaaaggaacaccacagcatccccattgcggcatggccatgcccaattgctcgccgccgccgggcggcggctttctcttgttgcggtgggctggtggcggcctgggatggttctggaacgaatcggaagaggagggcctctgggctcatctggccgccgcccaaagcccaacccctctccctctgaggtctagttttccgccctctgatttggttcctgcagtgctagtgattgactcgcttgatcctgtcctaagtcctaaccctgacatgcctgatgaggtttggtgaaacaagcgtcaatcacac

SEQ ID NO: 18168 - DNA, 218 bp, Sorghum bicolor
  Clone ID: LIB3478-011-P1-K1-B7
attctatacacgccagggccgctctctcctattatttcctaacggctaccattttatggtatatattgatacaccctacctcacacgtgttaccaagccatttaggctcaccgagcgaccccattagcgtacaccagtgcgtccctaagaaccgacatgttgtgcgcgctagtgtgagaggtgcacctccggacaaaactgatgacgctatcagacat

SEQ ID NO: 18169 - DNA, 400 bp, Sorghum bicolor
  unsure (1)..(400): unsure at all n locations
  Clone ID: LIB3478-011-P1-K1-C10
gggagcatgaagaaacattcactgacgatgatgaggccgtagatattgatccagaggaacgggcagatttagctcctgaaattcctgctccacctgaaatcaagcaggatgatgaagagaacgaagaagaaggtggcctgagcaagtctggcaaggaactaaaaaagttgcttgggcgcgctgctggactaaatgagtcagatgcggatgaggatgaagacgacgacgatcaggaagatgagtcatctccagtgcttgctccaaaacagaaggaccaagttaaagatgaacctgtggataacagcccagctaaaccagcaccgttaggacatgctcgtggcacacctnctgcatccaaatccaagcaaaaaaaaaaaataggtgttgatgatgcaaaaac

SEQ ID NO: 18170 - DNA, 448 bp, Sorghum bicolor
  Clone ID: LIB3478-011-P1-K1-D2
gaacatgatggcattcgtgaagattttgaagaagttcgagaagattactgggaaacaggtcctgtccgtatatctcaaggtggtcgagaccggctacttcaacagctccgacgaggcgctgaagctgatggacgaggtcgaggacatcttcgtccggcacttcgccggcgacaaccggcgcaaggccatgaagtacctgaggcccgcgcagcggatggactcgcacgccgccaccttcttcacggggctcacggccggctgcttcgccgcgctgttcgtgggctactgcgtcatggcgcacatggccgggatgtactactactactccaccccggcgccacggccacggtcaccgcgcgcgcgcggtgtcaccgccggcggcggctttggcgactccgtgtcggtgtacatggagaccgcgtacccggtgctgagcatgttcgcgctg

SEQ ID NO: 18171 - DNA, 109 bp, Sorghum bicolor
  Clone ID: LIB3478-011-P1-K1-D4
gagcgagatatactgatgaaagattataacgacggtcggagagattaatgtgtaacaggatcggtcctactatcatacactggtatacacgcttgtactttagcatgct

SEQ ID NO: 18172 - DNA, 404 bp, Sorghum bicolor
  Clone ID: LIB3478-011-P1-K1-E12
gtcgaaaagtatatccattcctaaagtgatcttttctgatctggaaaaagggacagagaaccttgactctgaggtcttatgcacacctggatcttatcaggacacataacaaccacactcggtcatggtggacaccttcagtcagaaaacatcggggagactttctgtctgtcttcactggccccttctgatcatggtctcactagtcagtgaacgtgtgcgaaacccatatacttggatgacaaaaagatgcgcacatatcccgcgtgttcttggaaagcatatggatgatgatccatccattgatgctttgctgccatgtatgctatccactggcatctgaaagcagagatgtgacctctacgaaatggctcatgcacacaccaatctgtctctatatatag

SEQ ID NO: 18173 - DNA, 402 bp, Sorghum bicolor
  Clone ID: LIB3478-011-P1-K1-E3
attaactttttgtgtactagcaatatctctacgtgtgattcgttaaaataggatctttttcctctaaaatacattgaatgcttatcttcctttgcttattctgtattcgcgttggtaagttaaactcgatagctatatgagtgaaacaaaacagcttattaatttgtagtaaaaataaaaaatctcatttcctacgtacaagacaaaagttaaagtaaacataagcagtgtaaactctttaccccaaggttgagattgtttaattagtcatcatatcttgaagcgggcaagaataaaggattcgcgatatggaattccattactagaatattctgagttattactataatttaaacttataaccataaggcaatccatcaaaagttagtgagggattaggaa

SEQ ID NO: 18174 - DNA, 214 bp, Sorghum bicolor
  Clone ID: LIB3478-011-P1-K1-E8
tgtctccgtgatgcttcggtcatacgatgaggcactcgctcttcctgtcctgcttgtgatgtgacacccttctgttcctactgctgacgccatcgacagttgaccgatggatggcgatcaacagcatgacgacggcaccgaccacgactccctcgctggactcggacatgacagtggactacttcaacgagtggcctacgcggttcgacacgga

SEQ ID NO: 18175 - DNA, 223 bp, Sorghum bicolor
  Clone ID: LIB3478-011-P1-K1-E9
gccacgcgttcgccagcttgcattatgatcgaatgcaattacccgtaagactgatgtatatgatgtaagtagcccctgactatcattatataaaggatgtcgctattctactaactagacacactgaagaaagtgctacaaatgggagcaaaggagaaggatgtgcctacgacggagagatctgtgctatacaaatggagggcatagcagtacaaagggctat

SEQ ID NO: 18176 - DNA, 417 bp, Sorghum bicolor
  Clone ID: LIB3478-011-P1-K1-F10
cagagacctatggttgggggccatgaggtggggccctatcggcagtgctcctatacccaaggggtcatgaacggagtgaatgtcttatgtggtgtggggatcctgtcaacaccttatgctgtcaagcaaggtggctggcttggactagtgatactggcagtgttgggtgcactggcatggtacactggcatacttctgcggcgttgcctggacagcaaggatggcctcgagacctaccctgatattggacatgctgcctttggcactgctggccgtatcatcatctcgataatcctgtatatggaactatatgcatgttgtgtcgagtatttgatactagagagcgacaacttatcaaagttgttcccagatgcacacctaaccataggtggcttgactctagattcacatgtgcta

SEQ ID NO: 18177 - DNA, 480 bp, Sorghum bicolor
  unsure (1)..(480): unsure at all n locations
  Clone ID: LIB3478-011-P1-K1-F5
ctttccctagattttcttattccccccttctctctccttctattctctctccttcctccgtccgtcccctcgcctcgcctctcgtctcctctcccacccccaccacggtcaccatctctccccatccccctttgccgcacttggtcttctccctcctcagggcaggggaggggaagcggaagaaggaggcgagagcacggaagcctgatttgatttgcttttggttgccgagaggaggggagttggtgcagtttgtaggcgtgcctctgtgtctctgtgtgtgtggagatggaccccaagttccccacacccccaccgctaaacaaaacggagcccaccaccgngacgaccaccaccacctngaccgcgcagcagcagcagcagcagctggatcctaaggactaccagcagccggcgcagcagcaccacctgcaaatncaaatccaccagccgccgncgcagcagcagcagcagcaggac

SEQ ID NO: 18178 - DNA, 450 bp, Sorghum bicolor
  Clone ID: LIB3478-011-P1-K1-F8
cccacgcgtccgctccctccccctcgccgcctccctctaatctcgaacctagtagtggacgacaagaatcgtcggcgcggcgcctcggcagattcgtccgctccaagcagggggatggcgtcggcgatggcgacgtcgtcggcgcgggcgcgcaggaactccttcactcacgccaccgccgccatgacgccaactcctttactcatgcccctgactctcctacagctggcttcgctcctgggcacctcctccgtcgccatccccccaggctcctccgctcctgtccccagctcctctgccgctggtgacgctgatgagcacctccactgttgcccccactccggcctaggctcctctacggccagcgtcgctcgccatcggcccaaggttcctccactctctactgcctccattttttttcaattaactgacatgcgaatagatctcacc

SEQ ID NO: 18179 - DNA, 110 bp, Sorghum bicolor
  Clone ID: LIB3478-011-P1-K1-G3
cttatgaatgacctcattcagcaatacttgtttcgttctaaggagcgtatgaagcgccatgctgacaagaaacgtactgaacggcagttccagggtggggatatgggttt

SEQ ID NO: 18180 - DNA, 313 bp, Sorghum bicolor
  unsure (1)..(313): unsure at all n locations
  Clone ID: LIB3478-011-P1-K1-G7
gaccgtcatcgccacggaagagaacagctccatgcctatcaaggaggcgcgaactgctaagtacttgatagctgatacacatggaacggactacagaaagatcaacataggtggcaggccaactaagatgacactggactgctgcgtaactacaactgcgtgccatgngcttgtataatttgacgagacacagacaatgtttcagctctatgtgtagatggacaataaagccgcctataagttggccatgagcgatgacatgaataacttccagaagctcaaggtgatgtacaacgagtggccattcttcagg

SEQ ID NO: 18181 - DNA, 296 bp, Sorghum bicolor
  Clone ID: LIB3478-011-P1-K1-H10
ctgagggtcaacttgaagctctgactgcacaagctgcagaccaagctgaggctgtccaaaatgaagttgaagctagggatttgcaatccttgggtacttctttgacagagaagaaaatgactgagagtcaacaggaagctctgactgcacaagctgcagaccaagctggggctgtgcaaaatgaagttgaagctacggatttgcaatccttgggtacacctttgacagagaaaaaaggccgcgggcgtcctagaaagaggccgtggaaccgaacttagagcagggtgctgatacag

SEQ ID NO: 18182 - DNA, 109 bp, Sorghum bicolor
  Clone ID: LIB3478-011-P1-K1-H6
acgctggcgcgccttcgagagccttatgtgcttgacggactcgcgagcgagctaggcttccatgagccgtcggcgccatgttggtctaccaggatctgctgttggcgac

SEQ ID NO: 18183 - DNA, 322 bp, Sorghum bicolor
  Clone ID: LIB3478-011-P1-K1-H8
cgtcactgatgcaagggagcttgagaagattcgacagagagaatgtgacataatgaaggagcgaatcgagaaaattctcaaggctggagctaatgttgtgttgaccaccaagggaattgatgatatgtcctcgaagtacttcgctgaagctggagcgattgcagtaaggcgtgtgcgcacggaagatatgtgccatgttgccaaagccactggtgcagctatggtgagtacatttgcagacatggagggtgaagaaacatttgatgcatcatttcttggacatgctgatgaagttgtggagcataagaatcgctgattgatt

SEQ ID NO: 18184 - DNA, 309 bp, Sorghum bicolor
  unsure (1)..(309): unsure at all n locations
  Clone ID: LIB3478-012-P1-K1-A12
cccacgcgtccgactccccaggtcgagcaaggccagcagatcttccccaaaacaccccaccgccgccgcgaccgcgagcaccttcgaccgagcccgcaccatggaggacgtcatcaccgtggaggcggtggcgggtacggccgccgtgatggaggtggtggtggctacggcggtggcggcggcggctacggcggtggccgtggaggctacngcggtggcggtggcggctatggcggtggcggcggcggctacagtggtggcagccgcggcggcggtggctacggcaactccgatgggaactggaggaac

SEQ ID NO: 18185 - DNA, 356 bp, Sorghum bicolor
  unsure (1)..(356): unsure at all n locations
  Clone ID: LIB3478-012-P1-K1-A7
aaaaaattggaatatgtgaaggttcctgaaatttactgggagtacactacacctcaagttttaacaatggaatatgttccaggaattaaaattaacagaataaagcagtttgataagtgaggagtcgatagaaaatgattaggccgatatgctgttgagtcgtacctagagcagatcttgtcccatggattatgccatgctgacccgcatccaggaaacattgctggtgatgatgtcaatggagggagacttatcttctatgactttgggatgatgggaagtatcagccaaaatattcggggaggattgcttgaagtattctatggagtntatgaaaaggatcctgacgaagtgct

SEQ ID NO: 18186 - DNA, 481 bp, Sorghum bicolor
  unsure (1)..(481): unsure at all n locations
  Clone ID: LIB3478-012-P1-K1-C5
aaccaatataattttttgtcagcaatctttggcaagacagccatgcaacaccagttgccatagcaaatgtactgttaatatctgtgatttatttatcagtgttgtcaaccatattatcctcgcgaaagctgtctgcctttaactaagtcttaggacatatatgatgttgcatttactttggccatgaaacatgtagacattttagctttaatgaattaaattaccaggctaagaaaatgatgctgatctttgcctctagcacttcagtttttccttcagcagtgaatgagttatcatacttgcatacgtttttttttgaaatatcagtatcgattgaaattttggcatccctttnttctgtttttttagccatgcaactcttgggctattcaaaaaactccaacagagagctccgaaatcactaagaaggtattatttcaaaacaataagcttcatccaaatgttcgacttcatattccat

SEQ ID NO: 18187 - DNA, 466 bp, Sorghum bicolor
  Clone ID: LIB3478-012-P1-K1-E5
ctcgaatcagtaatccttttcgtggcttgatgggctgcattgccatatttaatttgtagatagaatcccaagatcgaggagccaaacatttcaggttatgcaattgaacacccggtaatatgagttaactgaacatgattcagccggtaataggagtattaatcaaatagaaacagagtaaattgtgaaaaatttcacactaggtctaactgtatcgtgagccttttttaggataaacaatggaatttctttgtacagcgaaaggtaattgaatagcaaaattacctgttcaacacatttggagaaactaaacttttttgcttcttcatctgaagactacagtctgcagagttgcgatcccatgaggggcgcaacgaggtttctgtgcgagtgcaaccaaaaccaaggaataaacatgcaatggctagaagatggaactcttctcaaatttgatgagcctgatgct

SEQ ID NO: 18188 - DNA, 432 bp, Sorghum bicolor
  unsure (1)..(432): unsure at all n locations
  Clone ID: LIB3478-012-P1-K1-E9
tgagaatcaagatatcccaatgagtgagaccaacagtgtctgtgaagcacaagaggatacagagcaccagccttcagagaaggatgcacctgttgcatgggaggaggatgagaacaatgtaggttggatgcctgctgttagccgcagcacacacagaagatatttgcggaggaaggcaaggcgtgatgcactcaaggaatctggagaaagttttgagacaagttctgttgctccatcagtcgatgatgataaagatctctctgaaaatagtggattggagcatggtctgacttcaacagattctatccctgagaaaatcagtgcaagttctgatggtcttgaacatcaagtagaggatgatactgaaattgctggaggacattngcattctgaccagcaagcttacggtgatgatactgatgtgtgcaccaa

SEQ ID NO: 18189 - DNA, 446 bp, Sorghum bicolor
  Clone ID: LIB3478-012-P1-K1-F4
gacgctggataagttctccaactctttggtatacgatgactgcagcacccatccctcattcagtgagagctattacagcagtgtagatcccagcatatccttcgacacacaagatcttggagctgcactgaaaggcttcattgctaccatctcaaagcctaaggcggcatatagaggatggagaacattgtcttatgttctaggatggattttctataccaagagaatcgttgcaaagagaaagaaacatgggaaataagtgtacacatgtatgtgtagttaaattgcaaaataagtggagagatcatgtacattagtttgtttcttgtcacagctggtaagctctgctggtttcttcagctgtacatgagagcattttatcagctagggttccctatgcggctgtaaataatcagatgaagttttgtacagggtgagggatgcgc

SEQ ID NO: 18190 - DNA, 469 bp, Sorghum bicolor
  Clone ID: LIB3478-012-P1-K1-H11
cttaattgatgtcagtaagtaaaatttaaaggtgtggcacaaaattgcaagaaaaaaaaatactataattggattcccatttagctaaaccgtgttctaaaaccacttcaaggtgtaagttgacctggttttgatagtttgatgagttaaaatgtttgatgttgcggtggatgttttacaagttcagatatgtaaaatggacttgttccttaaggaaaatgattggatatttggttttgggacacctcatcattctttggctttttttttggctgagtccatttctcaacaccttttcaatagccttatattcctacaaggaataggagcgagagatcagctcattcctttcctgaagtgaaattagaagtaaaaaaaagatctagtcatagtgtcatactaggacaaacccaatcctcaaacaatgtgccccataacataagtgagaattgtatgttaagaatgtctg

SEQ ID NO: 18191 - DNA, 419 bp, Sorghum bicolor
  Clone ID: LIB3478-012-P1-K1-H5
ctggatgtgactgctcccatggtgcccctgctcaggctgtgctcgcacacaagcttcaatagaatctttgcgccaccaacattaacgattgcagtgctaagttttagctgcccaaatcgatgacaccaatattttattcaatcaaatgtggtttaccatatgcctgcctttcaggttcgagtagctgaaatctgtctgagattaaatgtgtacgcacatgtgcatgacacaaagctgatataatagcatgcccttattcgaatgcttgcttcatatgccgttactatgatgtatactcacttggtactgctaccagagctatgtcaatccattgatctatgctattgatccatgattatgatataggtatctgcgttgccatgcatgtgtatgttccaccatccatgacagatggatgt

SEQ ID NO: 18192 - DNA, 434 bp, Sorghum bicolor
  Clone ID: LIB3478-012-P1-K1-H8
aatggtggctgtcatcatgagtgcaagccataatccaggtggacctgacaatgactggtgtattaagtttaactacagcagtggacagcctgcatcggagacgattactgatcaaatttatgggaacacactttcaatttctgaaataaaaacagcagggattcctgatactgatctatcctctgttggagttgtaagctatggagatctcaccatagaagtgatagattctgtttcagattacctggaactaatggagaatgtgttcgacttacaacttatttaggatttgctttttccgcctgatttcaggttcatattcaatgcgatgcatgcagttactggtgcgtatgcacgacctatttttgttgagaaactaggagctgatccggactgcatattataatggagtgccctctggagattttggaaat

SEQ ID NO: 18193 - DNA, 259 bp, Sorghum bicolor
  unsure (1)..(259): unsure at all n locations
  Clone ID: LIB3478-012-P1-K1-H9
gaccagcgcacccgcaccggcccgccgacgaagaccatggcgaccaaggaccccgcggccaccggcggcgagcccgccatcggcatcccctaccacccggcgccgggggcccaggggcactactactacgcgccgncgccgaacccctacgcggcggggatgccgccgcccaacgcgatctacgccggcgcgcccaagggggtgccgctccagcagaccatgttccgcgacacgcccgcgccctttcactgccaggcct

SEQ ID NO: 18194 - DNA, 563 bp, Sorghum bicolor
  unsure (1)..(563): unsure at all n locations
  Clone ID: LIB3478-013-P1-K1-B4
ctctcctgtccaccaccgttttccttttttgcccccctccccaatcccaatccccagcgcgggccggagcctcgcgaacgcgagcgagaaggggatctgggtcccatggattcgtcggcgacgggatttaggggacgcatagagtgggcggcgccggcgttgaaggatttgctgccggatctgtcccgcgacgagcagctacggctggagaacggcggccaggcagacgggcgcaggcacaagcacaagggacgacaacgcatcatcaagcaggacgaacaactgatgtccatggcgttgcgcacagaaggagagcgtgacgccttgctcatcaggagagtccaacatgctctctgtcactacaatgccaggcacaagggtggtgagtttgatgctgtgaagcccctgatggaagcccgagttggtttcagggaccaggtgtggntccacctcaacttctgggctcgaagccgcagcaccaacaaaatcaagcgcttcttcgccgggtgcactacaagccatcctctgacacctncaaatacccacgtgcaacgactcccatc

SEQ ID NO: 18195 - DNA, 506 bp, Sorghum bicolor
  Clone ID: LIB3478-013-P1-K1-B9
cactatcaacaatggcatgtgtgacattggcgagaattgctgaatttcttgtagtctttcttctatgatcaacgtgttgcacgtgcagcgggttgcgtgcgttaatattagtgactatgttgttactttgagtatacaaatttcttcttttttggtaacctttgtgaatataactgtattgcatttatctttatggattttcaggtgaagaatttgttatcagttagtgctgatgatgaggttcctataaaaagtgtaactattcgcaaaattcctcgtgttctagaagatatgcccctctatgacatcctaaacgaatttcagaaaggtcacagccacatggcagtggtcataaggaaaaacaattcaagttacccaccagctgaacaagctgccaatgatggtggaactttcgaggtgtctgttgcgattgatgataagaacagcgaaaaggtcgtgaaaaaccttccatcaccactgctaagatggaagagctaccctaacac

SEQ ID NO: 18196 - DNA, 555 bp, Sorghum bicolor
  unsure (1)..(555): unsure at all n locations
  Clone ID: LIB3478-013-P1-K1-C5
accggctgcgcagtgccgccaccgcgctaccgcgacgacgagcgggcggggcggcggcgcccttccctcgcattgcgcactacggactgctcccccctcggcaccggcgccggcgccggggatcggtgagggccgtgccgcctgagcagagcagcttgccagcggcggcggctgtgtacgggagtgctggcgacgtcaaggcggcgctgtacggagcgctggaaggcgccaaccgagggatattcgggatgacgtccgccaagcgctcggagatccatgccctggtggagctgctcgagtccagcaaccccacgccggagcccaccgccaagctccaggacaaggtggatggatgctggaagctcatctacagcacgatctcaatactggggaagaagagaaccaagctaggactgcgagatttcatcagcctaggggacttcctccagataatngacgtcaaagaggaaaaaggggtgaatgtgatagagtcagcgcgagagcaatgaagatactgtcgnggaagctaccatcgaagcttcgtacagtgtacta

SEQ ID NO: 18197 - DNA, 407 bp, Sorghum bicolor
  Clone ID: LIB3478-013-P1-K1-E12
cgtgctccgccattggtgctactaggaaggaagaagcaagatgctcacaggcctgcaacgcgtactgaagccacgctcgttgggcgatggcaatggacgctcatcctgctgctacttcattgtcgattgtaaacggatagctaggatggtggcactgatcactgacggctcgagcatcatcagtatggtcacagccggctagtacggcacgaacggagcgaggctcatcatcgaaaatcgacactactaccgtgcgccatcagattactatgaccttggccaccattccttgcgctccgatcacatgtacgtctaatgcgaggatgaagaccacgatgtatttgttcttatagctgccacgttatttttaccccggcgcgtgagggcgcgcgctttctactagtagt

SEQ ID NO: 18198 - DNA, 521 bp, Sorghum bicolor
  Clone ID: LIB3478-013-P1-K1-G11
ccctctcagcatcttatttgttcctcattctcaacttaatctgcatccttccattattacttgtattgcagatttgggttcagccagagtgtccgaaacttttgtcgccggttctccagaatctgcaatttttgaatctggaagaactccctgaaggatgtgatatagcttggacaagattcttccttgaggctgcacctaacctaaaggaggtatgcatcacagtttgggaccattggtgtgatatggagacagacaaggtggagcgggaagaacagggttactgtgacaaaagaaacgtggagtgggagtcatctgcccctgatggtttcaggcattacaacctgactaagctcaccatttatggttttcaaccaaatgagaactttatgggatacacaaggcacgtcatggaagccgcagttaacctagaggagatatccttatacgacaggaaggtcctccagtgctgtgaagacttggatccaaagatcgagggtgctccatcaagatatccccag

SEQ ID NO: 18199 - DNA, 404 bp, Sorghum bicolor
  Clone ID: LIB3478-013-P1-K1-G9
agaacacctcgcatacaatctcctccaggagagtcgagccgtattggccaaaaatagttgcgtgctactttggagaaccaacggcaagaagccgccaactcgacgccaaaatcattgtgatcttcctcatcgtgccgctgccatcgacgtcaagtgcacactcatcggccaggttttgtgggacatgtggcttctgtccaaggtacatggagacatgatgaagagggtctgcattcaatttcagctatttggttcaactgtttggacgccctgactcgcgttagcgagatggggtggcatcgtccttcgtggctctgcatccaaggatcctagctgctatggtcgagacatcggggaggacatgagacatgatgttgttggatctaacagttacccggtcctcc

SEQ ID NO: 18200 - DNA, 553 bp, Sorghum bicolor
  Clone ID: LIB3478-013-P1-K1-H10
gcgaacggcggcggcggcggcggcggcggctgtagcccggctgccggagtgcggctccaccggtggactgctcatcagtggcaggaggggggcactagtgccccgccgccggctctcgcagaagatggcgttcgcgggttgtgccgcgagcttttgcacggcagcctcgttgaagcgaccaccgagaattcaaggccatgctaaccaggtttgtgcagcacggaggagacgagcggacatccagtcggacacgtacgtgctgatggagcccggcatggacgaggagttcgtgtccagggaggagctggaagagaggctcaagcgctggctggagaactggcccggtgacgccctgcctccggacctcgccaggttcgacacggtcgacgccgccgtctcgtacctcgttaggtccgtgtgcgtgctcgagatcgacggagaggttggatccgtggagtggtaccaggttgaactggaataagttggcgtaccttgatatggcttatcacccgaaatttcacagaacaacaaatcaaccttggaatggaggctt

SEQ ID NO: 18201 - DNA, 536 bp, Sorghum bicolor
  Clone ID: LIB3478-013-P1-K1-H7
tgaaaattgattatctgaagaacacatgttcctcatttgtcacataagtagacttatgtccaaatttattctaatcataacgaatcatttttaaaacccatattggttcttgtcttcggcccacaaatacttgttaccaagtttacgcctagcgcctagctgaattttgattttcacatttgaaaatttacctaatcagtgtggtgtgtcattatgcgcaatagctgataggaattgcctcttgtgctacctacatcaagtttctggtgaacaagcataaattatttttcttaactacagttccctacaactaaactcaatcttcttagtttaaggaatatatcagttttttatcttagaagagctaaaatgtttgttcctaagacctaatcagctacaaaatgcactattgaaatgtcatatcatgacaattttatatgacaatttgctttcacgtaaactctcagcttacaaataataattgtctggatgtaatctcagaagctatattggaatatatattattcttcatctca

SEQ ID NO: 18202 - DNA, 475 bp, Sorghum bicolor
  Clone ID: LIB3478-014-P1-K1-A12
attttctatttggtgttgtcatgtttcttagtgtttgctaattggaaggctaaataatcaagcccacctatcaaatgcctgaattatgaaaatttgttaaagattaggatatttgagccatgtagtttgtaaacatactgggtatgtaaataaattgacataaggatcagtcatacaatgtaggtagcacaagagctgaaatcatcagaactatattatggcaccaaatattgcagtgcttatgttgtctttttcctaactgtcaaatcctggttaccataaaatgattgttgctcacttttattccacatctgaggcggtgaggcctgatgaccgtccgacgtccacgtgagggggagtgctgaaatataaagtgaatttgcccaccctttccatcatgttagcttttaggttgaattggtttgtggtttggtgcatgcaactcaagactatgcattacttcagaaaccaatga

SEQ ID NO: 18203 - DNA, 488 bp, Sorghum bicolor
  Clone ID: LIB3478-014-P1-K1-B5
gtttgtttcatttacagacctgatgataccccgtgggatggaggttagttcatctgatttctgttgcagatgtttgcttcctagacccaactcatcgtgtgcttatccaaacaataataaatttcatctgcatatgctgctgctggctttgccaggtgccagcaacacaccactgacgtgatacaagcggtacagaatacgacaatcgcttagtaggtagtagtctacttgcaggtggcaagcagaagttttcagttatctgagtttgttggccttactgtccaatgcatagctgctctagagtacaaattccaagtcaagatttatagaggaaactgacccccaaattcaatggaactttgtaacgtaccatgctaacgctaatgtcagtcttgggtaagagatgatatctaattaacttctaaaacaaatagtaatagttataaacaataaaactattgtaaacctagtgagaattctttttcttc

SEQ ID NO: 18204 - DNA, 385 bp, Sorghum bicolor
  Clone ID: LIB3478-014-P1-K1-B7
ataaccgtcacacggatgacgctcaccatcacacatatggaatggacatgaagcatgaggttaagattgccaagtacggagcgcggatattggcgcaccaaacgagggctctccatccatctattgactatgacaatgcttatggagcaaataggaagaagactggactgaacaagacaaaatctttacatataggacagaaccacagcctacgtgtgccaacatgcccgagataagtatgtatggattatcattctgacgtgaaaagccaagtatggcatagcatgcacacagatgcgcgagcccaatgggccctgcatcgcgcggtcaatgcagctcattaacagcccggattagtggtttacacgcgaggcgctactatact

SEQ ID NO: 18205 - DNA, 136 bp, Sorghum bicolor
  Clone ID: LIB3478-014-P1-K1-C11
ctccgtcgctttgcaagcgaggacagatggacggatacatgagggagacaagcgccgccagggatgagggcggccccgccgtgtgcaaggctgtgtcgggcggtaacgtggaccggaagggcggtgcgtccacttg

SEQ ID NO: 18206 - DNA, 481 bp, Sorghum bicolor
  Clone ID: LIB3478-014-P1-K1-D12
aagcaagtgccataagcacgtggttatcacaaaggtccttgtattgtctctgttcaaacattctacaactttagtcacacatactggtcatacattgatactttaatcttttaaccaagcatagcccttgtaccctggattccgttcaatagatcaggagctatatttggcaatggagtggcattataaatttgcattccttttctatgggcgcctgggcatgagaatattggtacgttgtcatcatagagcatagaggcttaagagtttaagactactccctaggttcaggcttcagcatcctaatgaacatagaaaatcagagttctgctttgtactatcgtcacttcttgatcaagcaaactgtatagcatgcatctctaaaaatagaattagcaccgtgcgagctgtaaagtaatgtttgtttctattttcaaaatcagtaccattgcattattcctcggtagaaactggtgctagc

SEQ ID NO: 18207 - DNA, 401 bp, Sorghum bicolor
  Clone ID: LIB3478-014-P1-K1-D3
cgcctcgtgtcctcttccacctcccgccccaatccccccgctcctcctcctccctatccaccatcaccatggccacagccaccaccgcctatcatcattgcaacgccatcctccacctccccagacctccgcacttccgccagcctctccccgctctcgtcactcgcagagccgcgggcgtcgggctgggtgccgcccgtctcggcccgaggacgagggcaagctcagtacctccaccgccaccgttttttgaaaccgtggaagaggaggaggaggaggaggagcgtgggttgtcggatgcggaggcgggcttcagtgacgaggcggaggatgagcaagagtgggcgggcggcaacggcgcggcgcgcggggaggacctgggcgcggacgccggcgaggac

SEQ ID NO: 18208 - DNA, 481 bp, Sorghum bicolor
  Clone ID: LIB3478-014-P1-K1-D4
cccacgcgtccgaagggcccctgcgtcgtcctcggctacaccggcggtggcttccggttcgggggttcagtccggaggggtaccgcagcacggacgactactacgacacgctggacgcgttcctcttctactggcccgacgagcttgctgcgccggcggaagccgccacggagacttcaccgctgccgccgcccgtggtgctgccgaaggtgggcgggagcggcgcggcgctgttcgactactcccgcggcgggccacatgtcggtgccgacggcctgctcatcggcccgccgctcaccgccgtgatgggcgtgttcactggacccgactccagcgccggcgtcggcgacctccgcagcgcgcgctcgcggctcgggctgtcgtacgccaggcggccggacgggaaggagagcctgttcggcgacgagggcagggcccaagtcgcggaggtgctcgtcttctgtaacccgcggatcgcgag

SEQ ID NO: 18209 - DNA, 472 bp, Sorghum bicolor
  Clone ID: LIB3478-014-P1-K1-D9
cgccgtgcggtgccgcctcgacgacgtcgactacctcgagtacccgctccagatccccaaggacgacctgctcccgcacccgctgccccggcccagccacgacgaggagtccaagctcatcctgctcgtccaggtgacggcgttcgcgtgcggcggcttcgtggtggggttccggttcagccacgcggtggcggacggtctgggcgcggccaagttcatggccgcggtgggggagctcgcgcgcggggcggagcaggtctccgtgccccccgtctgggcgcgcgacgccatccctgacccgcccggcgcgctggtgggcagcctcccggacccgacgggcgcgaagcggctggagtacctagccatcgacatctccgccgactacatcgaccacttcaagtcgcagttcgcggcggcgacgggcggtggccggtgctcgtcccttcgggtgcttcgccatgaacgcgcgccc

SEQ ID NO: 18210 - DNA, 483 bp, Sorghum bicolor
  Clone ID: LIB3478-014-P1-K1-E11
cattattaccagaaagtacttcaaaaaaaaatctgagatccttttatgggatcaaattgcttatctcagctttagaataaactagtgacctgtcaaactgaaggtagtccagcaaatgtttaatcatttattttttgttcgccttcagcaacagataatttattgctatgttgggggttaatgagctccttaggtgtgatatgaatgtgtcatcttcacaatcgcttcagctttgtggcacattagagtcaaaactagcttttgtttatgcagtgacttggtttactaaaaaaatatgtgtaggtattaagcacttgtcgtatgatcatatagtggatgttttcagttttgggatagttctttggagctgctgaccggaagcttccatgccaagacattacacgtgttcagggcttcagacaatagttgccattgttcaaaagggttatggttgcaaaaaatatggatccaataggactcgct

SEQ ID NO: 18211 - DNA, 486 bp, Sorghum bicolor
  Clone ID: LIB3478-014-P1-K1-E4
gagaacactaaaaggtagtatgataacataacaaaattttgattgggatgcacaaatgaattggaacaaattccctgcccaaatgcatggttttcctttttccttcacacgatcagtatcgctatctttttgacaacatgataaccacaactccacaagaccttgccaaacgcaattttctttcttttctttctttcttgctatcgctatctgtctatcaacaagctcacgacgggtcgtgaagataaccctggccaacacgcagctcaattctcatttcatgtggttctacgatattgatcccaacttctcattatttctgttgagtagtgttagattaattactaaatgctgacatagtgtatccgatttccgaacgtaaatccgaagcaatgttatgcatcgcacctagctcttgtccaatagaagttttttacaacatgtaaggttaattacatttaccgggccgacacgtatatatatata

SEQ ID NO: 18212 - DNA, 481 bp, Sorghum bicolor
  Clone ID: LIB3478-014-P1-K1-E7
cccacgcgtccgaattaatctacatactttctgtttatatttatttattattaataacatatattagtaacattacagcaagtagtttccttttccttgaccccacatcttatcatcattttgcaggatgaacttgtcaaataacagttaccgagtgattaaatgccccacagtgagccaaatggctggtgttggtgttctttccttggggaaatcggagagaggggtgtactctggagtaccttggaacgatggatggccccgatttcaggtgtggtttcttaacgaatcaagcgagcagatggagtggatactgaagagcaacatcagcctccaagcagtgctacaaaatttccccttattaagtaatcacaacattatttacggcagctgggccgttacctctaataaatctataaatgagcatgtggagcgagcaggggctcaagaggaatttgaatgggactcggacgatgtgttc

SEQ ID NO: 18213 - DNA, 430 bp, Sorghum bicolor
  Clone ID: LIB3478-014-P1-K1-F10
atttacttataatttgctagataaatcttttaagactaattaatttacagttagacaataattatcaaatacaaataaaaatggtatattaaaaagtttttcactcaggaaactaaacaaggcctgacatgatttttatatgttgtgttgtgtctggatctgtgcagccgttcggtcaagttccagctttccaagatggcgatctccacctatggggtacgtacgcaacgcatatgatcctatatctcttggtgtctctctgtaaatatgacagtatagtagtattcacccctgccatcatatatatatatatatatatgcatcacaaaaatggtatgttttttttgccagaatcgcgtgcgatttgcaagtacgttgcccgcaagaacaaggcagcagagctgctgagggaaggcaacctccaggagtc

SEQ ID NO: 18214 - DNA, 376 bp, Sorghum bicolor
  Clone ID: LIB3478-014-P1-K1-F3
gttctgatcgcgagcgccgccctttctactttgccgattcgtgtatcacacgatcacacttctagaacgttgggaaggaagtattcacctcctattataatatggactgcaatgattacaattgaatcaacttgaatcttgagagcgacataaagctctgacggccactacttttgcctatgcatctgtctttaaatgctctgacatgctgtcaaagtaagagctaaactggtggttccttatgagacccatccaaccttttcaacgacatgacggggatttgttgggagccgtaggaacacaatgaccgttcaagccagtaaccatggtgggaaggtcacggcgcccagcttacgatgactgtagccactctggc

SEQ ID NO: 18215 - DNA, 469 bp, Sorghum bicolor
  Clone ID: LIB3478-014-P1-K1-G3
cgcctcttcttcttcttcttcttgccttggtccaagaaagagagagaagagctaacagcagtcaggcagagcagcatgtgtccaggatccgtggaggcggcgggtgcggcggtgaagagcgtgtgcgtgatggacgcggcggggccgctgggccacgcgctcgtcgaccgtctcctccgccgcgggtacaccgtccacgccgccacgtacgccgtctgcggtgacggcggggacgacgaggaggaggaggaggccaccaccgcggcgctgctcagccacctgtcgtcgtcgtgcggcgtggacgcgtacaggcaacggctggagctgttccgcgccgacccgttcgactaccacgccatcgccgacgccgtgcggggctgcgccggcgtcttatgcatgttcaacacgcccgacgaccatgcccagtgcgactagtcgacggtggatacggaaggtcgggcggcgcaca

SEQ ID NO: 18216 - DNA, 368 bp, Sorghum bicolor
  Clone ID: LIB3478-014-P1-K1-H1
cgctcgctggttcaagaaaccaccgagctaccaagcgcgcaaggcaggagagagaggagcggaaatggaggggaaagaggaagacgcgcgcctgggcgccatcatgttctagcagcggcaggctatcgggacggtggagcatggcgccgtagacgactaggactacagggagccaccaccggctcctctggtcgagcccggggtgctcaagttatgttccttataccacgcgggcatcggcgagctagtggccacattgctatatgtctacatcaccatgctaaaccgaatgggcgtctgcaagtgcaacataaagtgcgccaccgtgctgatgcagagcatcagctggtgcttcggaaggatgatct

SEQ ID NO: 18217 - DNA, 377 bp, Sorghum bicolor
  Clone ID: LIB3478-014-P1-K1-H2
cactcacatgcacacggacgcggaccatgctgaggcacatgccaaggatggtgccatgaatgccgcaagctatgacgcacgcatagatgcagccatggtcaatgatgacatgaacaccgacaacatcaacatggacatcaacactggctgcaacgctaactgcaccactaactgtgttgatgccattgatgacgacattcatgacatcgagggcatgatggcaaccgtgcatacaactactgacgccatgactaccagcgataggactgtagacagagactgaagcaatgactggaccggcagcttgaacatcattttcaacatcactggcagcagcaatgctgctggcaaggctgttgctgatgtgaatgccgagc

SEQ ID NO: 18218 - DNA, 387 bp, Sorghum bicolor
  Clone ID: LIB3478-014-P1-K1-H3
aactaagttaggcaaagtattcagtaggagctgcaactgtatctggctgcacatggatcatagcttgtatgcatagatatttatgcttctctaggctgataacatagctagtatgagatcatctgtctaatactactaacagcttttgttttggctctgaaatattttctgcacttaactgaattatgactttattctgtgatatccatagcttgtaagagatcatttctataatactactaacagggaatgtttcggttctgaaatactttctgtagtgaactgatttatgactttattttctgacatccattcaggtggacaggtggctacagccatgagaatacggcatcatgcacattttattcgtaaaaatattagggcaca

SEQ ID NO: 18219 - DNA, 305 bp, Sorghum bicolor
  Clone ID: LIB3478-015-P1-K1-B2
aaaaaaaaaaatataaaaaaacatataaattactaataatacaataataactatacaatgaacaaaattaaaaatcataatgggccgtccgttaaggaattggagcccgttagttttctaaaatttttgatagctcaaatgggggtcgccgaacagaaagggaagaccttgtcgtttcggattacctagccgattaggaaaaccgcgacttcaattaaaggggcttttccgcctttggagaccgccccggcttcggcaaagccaaaggggaaggcgatcctacaggggaaggccctctttacttt

SEQ ID NO: 18220 - DNA, 267 bp, Sorghum bicolor
  unsure (1)..(267): unsure at all n locations
  Clone ID: LIB3478-015-P1-K1-C1
ccgtctgcgtctccgactgctcccaaaatttcaccaccggcgcaaagcgaagatcccttcctctccctcctcggctcgctcccgtacccgcagtcagcagctcatctgccgctgaggagagaagaaactcacgagctccccaccgcgacccagcccaggcgggcaaaggccacggccactgcccgtcgcggtgcggctccccaccgncttccaaccccccccccccccctacccccacgcgtgcgatgctgccgctgagtctacctc

SEQ ID NO: 18221 - DNA, 344 bp, Sorghum bicolor
  Clone ID: LIB3478-015-P1-K1-C2
cggacgcgtgggtccaaatccacgccaccagccagcagccatggcaccacccatctcctccctgtcgtctctcgtggcgtccagccagaatccgcgacgccgctgctcccgaggcccagcagcagagcgctcgccgtcgcgccctgcagctccgcgtcctccgcctcctcctcttcctcctcggcgtcgccgtccacttgctcggctcctactcgccacgccgccgccgcgccggcggattcggcgggcaggagagggctgctggcgctgggcgcggagttcctggcctcggccgcgctgctgatcccggcgggggacgccggcgccacgcgcgttgagtgcta

SEQ ID NO: 18222 - DNA, 335 bp, Sorghum bicolor
  unsure (1)..(335): unsure at all n locations
  Clone ID: LIB3478-015-P1-K1-C4
cccacgcgtccggcgcgctgtactggaccatccccggcgagatataccccgtggaggtgcggtcggcggggcagggcgcggcggtggcgctcaacctggggctcaacttcctgcaggcgcagttcttcctggcgatgctgtgctgcttcaagtacggcaccttcctcttctacgcgtcatggctggtggtgatgaccgccttcgccgtggcgttcgtgccggagaccaagggcgtgccgctcgagtccatggcgcacgtcttcgcgcgccactggtactggngcaggttcgtcaaggaccaccagaagtttgcgaagagtcacctagttaagata

SEQ ID NO: 18223 - DNA, 483 bp, Sorghum bicolor
  unsure (1)..(483): unsure at all n locations
  Clone ID: LIB3478-015-P1-K1-C7
caagaacgtacgcttctctcggcgccggctttctccccccgaactcgaccgtcccccctcaccgccggcgaagaagatgcacctgtggccatcgctccggatccgcgactcgttcaagcacggctacctccagaagctggagctcaacctcgggcacatgaagcgcgcgcagcggcagcgccaggggcggcagggtgagggccaggaggaccaggacggcgagcccggcggcagcgggaaggcgccgctgctcgaggaccgctctccgtcgcggtccgtgctggccggcgcgctcgagctcgcctgggacgccgtcttgctcctcacctgttgctgctgttgcttctgctgcggagcttgtagcgatgaggaggatcacccaactgcccgctaagaagcgccttcagggggctgataattcatcagatcaggaaaaccagataatttgtgggcataatgaatngcagtcaaataggttaaata

SEQ ID NO: 18224 - DNA, 476 bp, Sorghum bicolor
  Clone ID: LIB3478-015-P1-K1-E12
aacggttcaagggtgaacaaacaccacctgcacacataggagctagcagagactacaatgtcgatatggttccaaagtttatgatggcaaatggtgcattggttcgtgtgctcattcatactggcgtcaccaagtacatgtccttcaaagctgtggatggaagctatgttttcaacaagggaaagatccacaaggttccttctaatgatatggaagctctcaaatctccactgatggggttatttgagaagcgaagagctgggaaattcttcctttatgtccaagattacaaggaagatgaccgaagtactcataagggttatgaccttactaaactaacgacaaaagaactcatatcaaaatatggtttggatgataacacgatagacttcattggacatgcagtggctcttcataaagatgatagctatttgacagaacctgcaattgacacttgtaaagcggatgaagcttta

SEQ ID NO: 18225 - DNA, 238 bp, Sorghum bicolor
  Clone ID: LIB3478-015-P1-K1-F11
caccaagcctcaccagcggcagctgcagctccaccgctccatcgtcatccagcagctcccactccgtaatggtcactggcggcgcggctggcattatccacctgctccagctccataccacctacacgtctccaactctgcttcatattctcaacttccgtttcctatccacagcaaaccgcctaacgttgctctcttactgcgttccaacttaccattctaccttaatccgcctgct

SEQ ID NO: 18226 - DNA, 352 bp, Sorghum bicolor
  Clone ID: LIB3478-015-P1-K1-H4
cacaaagtgtccaaagtcctagaccattcagagtttgaacaagtcaaccgggcaatttttgataagtgtgaaaagatcatcaaccagtgcttggttgatgcgaagttagtaccagaggacatcaatgatgtcatattggttggtggttgttcgaagatccccagaatcagaagccttgtcctgggtctatgcaagaaggagatctcttacaagaacatagatgctctagaagccgctgtttctggtgctgcgctggaaggagccatcgcttcaggagtgaatgatccttcagggagcttggatcttctcacaatccaggcaacttctatgaacctgggaatccgtgccaatg

SEQ ID NO: 18227 - DNA, 339 bp, Sorghum bicolor
  Clone ID: LIB3478-016-P1-K1-A5
gccgcactcactcccgcatcattacatggcgcagaactgcgctttacgctaagattgagacagtactcaaacaatcaggatagacgttgactgccatctggatgttccactgtcaaatgacctcatgttccatggcagcatgctcatgctgccgcctatacacctctatgatagggcagcagcggcggactccatgctattggatgcgatcggatacatatgcgacggcaccaacgacacaacgggcatgctatcgttttagggcgagctgggcatcgaggagacatagctggtggctgatgctgcacgcgcgtagcgagtctgccgtctatgcgcaga

SEQ ID NO: 18228 - DNA, 224 bp, Sorghum bicolor
  Clone ID: LIB3478-016-P1-K1-A6
gagggctgctcgcttgaacatcatccacagcagctctggagctgccaaggctgtgggtatggttcggcctgctgtgattggcatgctcactgctatgcactgtcggcttcccaccgaggatgtgtcagttgctgaccttactgtcagaatcgcctacgcagcctcctatgtggatatcatgacagctcttctggctgcgtgtgagggcccactctagggtatca

SEQ ID NO: 18229 - DNA, 400 bp, Sorghum bicolor
  Clone ID: LIB3478-016-P1-K1-A9
cccacgcgtccgcagagaagcacacgttttctctacccatgatggctactctcttgatgtttttgtagctgatggctggcccattgaggacactgatggtttgcacatagcactggaagcatccattttaagaaatgagggttcatggtctggttcatctcattcctcagcagctgaaagaacactgcccttccaagttaaaggtggcgaatgggaaatcgacaaacgacttctgaagatgggagggatgattgcttctggttcttagggagacttgtatcatgggacttaccttggtgaggatgtagctgttaaagttctaagagctgagcatttgaataagaatgtttggaacgagtttacgcaagacgtatatatactaagaagaggtcaccataca

SEQ ID NO: 18230 - DNA, 396 bp, Sorghum bicolor
  Clone ID: LIB3478-016-P1-K1-B4
catacctactgtgctcatatcatcatgtctgacggtatcggtatcgcaaatctgcccaaccagaggcataaaataatcagtcagagaggagctcatctgactatcatggtggtcggcccctctggatcaggaaagaccacattcatcaacacgctttttgcttcagaaatatgcaccccacgtaattaccgaaatagatcgatcaaacagatggacaagacgaccgagattgagattttgaaagcagagttggaggagaagcaattcagtatcaagctcaccgtgattgataccccaggattcggtgattatgtcaacaaccgtgacagctggacgcccatcatcgactttattgacgatcaacatgaatcctacatgcgacaagaacaacaacca

SEQ ID NO: 18231 - DNA, 315 bp, Sorghum bicolor
  Clone ID: LIB3478-016-P1-K1-B5
cctcgcgtcgcgtgtaaactgtgaaaaagaggagagggagcggtaaagaaaaaagcagagagagggggcgcgtcctccgccgttcgccggtaatggtcgtcagctcactgcgaaccgacgacgttcgatcagcagcacgctgagagatgacctctcattaaagctagattgctagctgcagctggattgcctggggactcaagcatccaacttataatctttgctagccatattgaaaaacagaaaggatctgacatactcattgcattcattccaaaacttagcggcaagaatgctcaaatagttattcttggc

SEQ ID NO: 18232 - DNA, 185 bp, Sorghum bicolor
  Clone ID: LIB3478-016-P1-K1-B7
gccaagcaaagttcaaaagatattaaaagcatgagcctctgtgcttcgtctaggagctgcacacaggatgataatcaaggtgttacgcttgacagatctaggggccgttaaacattcagtgtctactgttaacttaacacatgatgagacacgaggtgtgaattgatggccaattaaatctgaca

SEQ ID NO: 18233 - DNA, 436 bp, Sorghum bicolor
  Clone ID: LIB3478-016-P1-K1-B9
ctcccaccaccacatcgtctccctcacctcctccacctacggcatcctcaccagtccgcgagcctactcctcctcctcctcgtcgtcgtcttttaccgccaagcccgttgcccttggcccagagccgttcgctccgccgccgaccactcgttgcgcgccgcctcctccccctcctcctccgctgccgcctccagcaagacaacaagcacccccaccaccgaaacccgaatcccagccccaggcggaggtcatcaactcctgggagctcatggccggcctcgtcgacccctccacgccggccaagcccaccacgccctcctccggcagggaccaccagcgccgtcgccggatccctctccgcgccatcgacggcaactcctccgctttcaaggcaagcccctgttcgtcctccccgtccgcggttgtgctctacacc

SEQ ID NO: 18234 - DNA, 491 bp, Sorghum bicolor
  Clone ID: LIB3478-016-P1-K1-C2
aaacaaataactgggattgacctatccttcacaacaaagtgggatagtcatgccccaaaaactagggatgggtcccatcccacctcatcttgaaatcaaatggatgctagtttggaagtgattgcccttctaacaaatgtcatctgacaggtgaatgtattatcgacactcctcagaaactaaaagctaagctggagatggctgaagcccttggtgagattgaaactgcaactaaacttctggaggatgattccagtgaccaggatgatccgctatatgctcgatacaagcaacttcattgtgatctcgcacctcttgaagctgattcggatgagtactctatgataaaaacatatttgaggaatacacatggaaaaacacactctggctatacggcggacatagcgcaaatatttaatgtttcgaggcatggtgaaacagagcgatttcagaaatttgctagtacaagaaataggatgcttctgcggcat

SEQ ID NO: 18235 - DNA, 373 bp, Sorghum bicolor
  Clone ID: LIB3478-016-P1-K1-C5
gactctcaatacactttgtgactgatatgcatggagaggagggcggctctgccattattgcgatggctgacactaaccgaactgacatatagagtgcggctgtactcagacctgagcgctatgacagacaggcgtatggcgatgttcctgatgtccagagcaggacagagatcctaaagatgcatggtatcagcacgaaggatgaatctgaggatcatttagatgtcctagcaatgagaacacctgggttcagtggagcagacttggcggaccttctagatgaagcaagcatactgcctggacgaccagggaggtcagcattgtattgagaagagaatgatgattctattgacagaattgtgactacgtatgg

SEQ ID NO: 18236 - DNA, 266 bp, Sorghum bicolor
  Clone ID: LIB3478-016-P1-K1-C6
gcctcccgcatagcttctgctgcactgcgggagagagacgatggcgctcgctccaagaaataccatgcacacccaactcaactcagcctggtattactggttcgcgaccaaaacgtgcaccggcttgactgacaagatcgagtccatacacagctgaagcctgaccagtaaccaagaaccgcatctgaagcgtccgatgacacagacatcagcaacgtgctcgacacgtggtacggagcagacaggaggagctacctgacagatgg

SEQ ID NO: 18237 - DNA, 371 bp, Sorghum bicolor
  Clone ID: LIB3478-016-P1-K1-D10
agcacacgttgaggttccctctgtgcaagacatgcctatgacagtcgcattcggctaagtgaaaatcattgatgatgtcctgcacgaataatgctcttaatgaccaagcttacctaattctagttacctggaggaatgcatggagcgggagcatatgcctaatatgatgaactaacggatctcagcatgaagcaagccgtgacaattacatagtacggagctatatatgcctcccatgcgaatgctttcgtaccacatcggactgctataaagtaaatatacgctcacatactatcctgctgttggacacatacttgcctaccacatcgaatgcgacaacagagccgtcgaagctggctacctaaccacga

SEQ ID NO: 18238 - DNA, 305 bp, Sorghum bicolor
  Clone ID: LIB3478-016-P1-K1-D6
agtactcgtggcacagcgtatatagaacctattgatgtaaacatgtatattaatgcgtaattcggcatgtgcgacttaatgatcatagtaatctttacatgggatgcgttcattaaaaaccacaaggcaaaaggccggccagacgcactctacacctagtgcgcaagtgatgcactatgtggagctcgttctgctgccccacacggagaatggctgactctacggctgcctctcaactactctacacctatcatgatgccacgatacctgagattgctggctggaccacgtctgactttgctggc

SEQ ID NO: 18239 - DNA, 458 bp, Sorghum bicolor
  Clone ID: LIB3478-016-P1-K1-E10
agcggagaccggctagcgttgttcctgaaatctgttgattgatggggagtcagacaatggcatcacaggctgggggaggtggtggaggcgtgggtggcagtggcggtgccggcgcagcgcaacgtgggcagatgcagagcctggcaagacaagggtctctgtataatctcacccttgatgaggtgcagagtcatttgggagaaccccttcacagcatgaaccttgaggagctgctgaagagtgtctttcctgatggcttggaccctgatggtggcaccaccagccagtatgagcagagttcgggcctctatcgacaggggagcatcacaatgccgcctgagctcagcaagaggactgtggacgaggtgtggaagggcatccaggatgcaccaaagagaaatgttgggtgagggtggtcggcggatgcgggagcggcagccgacgctcgtagagatgac

SEQ ID NO: 18240 - DNA, 286 bp, Sorghum bicolor
  Clone ID: LIB3478-016-P1-K1-F6
acagcctgaactaacgccgccggcaccaccgccgacaggcgcgccgactgaaactgcctgaagaacgacgtcagtggcataagaggcgtcaacgccgccgacgccgtcagcgtgccctacaagtgcggcgtgggcgtgacgtacaccatgagcagctgcaccgactgctccagggagagctaaacctaaacgaggttgatcgatcgatgatccatatcggcgccgccgacgtccacctctatcgccaccgatcatagcatctaccatgcatcgagtttgtgtacta

SEQ ID NO: 18241 - DNA, 460 bp, Sorghum bicolor
  Clone ID: LIB3478-016-P1-K1-G10
ttatagctacagcatctgtgcctagatcacagtctgcactatttcagactgattgcaccagagatccagacggatctggcgatgcagagatactagggtctcgttgcacatctgacgatggcttatgttcactgattgacgagaagcttgactacctgagcggaggtgaaatgcatcgcagtaaaccgagtttggatgttcattgtgcaccttcttctccaaatgtgtaccgggcatcaaacattgacgaccgtggttcagtatgttgctctgatactgctgcagagggtcaacgggccactgaaagcacagatgaaacttttgtcagggatgggatcctagtatgtcatgaatactgcggtggcaaatacatttgtggcgatcactcactggatccagttggcactttctgtgcacattcaggggatgtttatcaccatactgtgattgcggtgtcctc

SEQ ID NO: 18242 - DNA, 155 bp, Sorghum bicolor
  Clone ID: LIB3478-016-P1-K1-G2
atttacaagatgaagttgcttccgaacatttagaacaagagagtaatcatctaccagttgcagtcccggcggagtaccccggcgcaccctgtgagcgcaactctccagatgctcgtgatgatgaactatcgattgagagggctactcggcaatat

SEQ ID NO: 18243 - DNA, 355 bp, Sorghum bicolor
  Clone ID: LIB3478-016-P1-K1-G5
ccacgcgttcgagaatgtctgatgactgcacagactagtccattaataagggcttgcagcacaggcgctacaagaatagagagctgggaatcatgcgatccatggatcactggattgttgtaagcttgatgcattgcttgttgtatacctcaagcagagatgaacgtgtccttaacttagtgatggagagagttccagagtcattatatagagcgatgaaacatcacagcaatgtgcaccataggatgccgcttattaatgtgacatgatatacataccaaatatctcgaggctgagcctatatccacaccagacctggggtgggccacacgggtaggccaccacgagagctgtt

SEQ ID NO: 18244 - DNA, 447 bp, Sorghum bicolor
  Clone ID: LIB3478-016-P1-K1-G6
agctatgtgaggtgtgttgctgagctaaccgcaccgccggtggatgcgtcacgagagatgcttacagaaacatacaagtctcatgcaccatgaagatctatgctgacctcgactgctgttgacctgattagggctcttgctgaagaataccctaatgatctcaacgacagggttatgtcagatgccgagaagagtgaggtggccgagaaaactgacctgtacgacaagctctgcaaggtgttcgacaagtacatcaagcttgttataatcgaagacacagctaacaggatcggcctggctaagcttgttagatatgagaggtccaaggatgatggcgaccttgcctacgttgatgagtacatttcacgtgtgaagcctgggcagattgcgtcttctacatcacgcgaagcatcaaagaacacgctggagaagtctccattccttgag

SEQ ID NO: 18245 - DNA, 340 bp, Sorghum bicolor
  Clone ID: LIB3478-016-P1-K1-G7
cccgaggaaaaatctgttccaatggaaactgatgcaaaggttgagccgtcaaaaaggatagttaagaaaacttcaagtccggtgcatgatttggtctatggggccttggctgctgttgacctgctgaaggctgttgagaaagagtatgagatggctctccaggacagagttatggcagataccaaagagatgaaggatgccgagtaagcttatgtctatgacatgcgttacaagctgtacgacaagtacagcgatcttgtcacacccgaagagaaagataggctgatcgcacatctacaggatgttaaagattggacgtacgaagatggtgaggacctta

SEQ ID NO: 18246 - DNA, 431 bp, Sorghum bicolor
  Clone ID: LIB3478-016-P1-K1-H10
gtcagaagataacgaggaaaacggccagcccatggatgaggattatgaagagcatgttccagattactcagtgggttattctagtagatccaggcaccatggaacgatgtccatgatggatcatgagaccgacgaggaggatgacgatgctgaaggtgatgagaatgttgaagaagatgatgcagatcaagcagttgatgatgccgatgttgagatggatgaagatgatgagattggtgatgatggagaggacggcaatctcggaggggagatgaatgcggatgaggatccagatgctacttcatattcatctgactacagcgaataagaaatcataaataaggaccttatcacagatccttccttggcatgaagcagcgatagatgcggtactgaagaactgatgttcgatgggtgggatgtccattact

SEQ ID NO: 18247 - DNA, 312 bp, Sorghum bicolor
  Clone ID: LIB3478-016-P1-K1-H7
gacagactgagagcggttcttcgaatctatgggtggagatgcatatccgctcgatagactgtgactggcaagaccatgaccctcgacgttgactaacgagacacaatcgtgattgctagggctgcgatgccatacatggagagattgctgccgaaacagactatcctgatctatgctggcatgcataattgaggacaggcgatcgctatggtgactataacatgcagacaggagtgcgccctctgccttgtgctctgactgacggagggcatacatacatccgtgcacaccctaactgcaaaagccactaca

SEQ ID NO: 18248 - DNA, 475 bp, Sorghum bicolor
  Clone ID: LIB3478-016-P1-K1-H9
gtggcagcatctccttgctggtgacaaacaagaccgtgaataagcaggtcaagcaatttaggggtctcttttcaaccgatacaagtgtcgtaaggtttgaagcatcatcttttttctcatggctgcaatcgattatttttccctcttgttgtgttccaacacatgatgtatggaagcattatttattccctgaatttgttcagtatgaattattgatacatgctttaatattgctttaattgtacctagatccacctggcatagatctgcttgctttaatatatgtacattgtttttcccttatccaatggaatttttgcctgcttgatgtcatggattgtagtaatcttttttttgcacgcatcttggttactagcagcttggttgctgtagttttggaagtgaagtgtttttttttctgtaataacatgactggtgaaatgttcctggtatttctagcctccgatgaaatgac

SEQ ID NO: 18249 - DNA, 339 bp, Sorghum bicolor
  Clone ID: LIB3478-017-P1-K1-A2
cctggagctgctgcgctccatatagagtatactgctgatgatgctgaagcatggcatgccctatggaaagctgctattacggtgagggcggataccaaccctgaagatgttgatggcatgcacgcactttctgtgatccttacataccggggcgggatgacttacgatgctgctgtggtatcccgtcgctggggaaaatactgtgtctcgaaatgctcagacattcctgttaatgatgctgacaagactgctgccattggagaccatgtgctgagcgaaggtaagacgctatcgctgaatggatcaactgctgaaccgatccttgtaaagcatgcgttt

SEQ ID NO: 18250 - DNA, 168 bp, Sorghum bicolor
  Clone ID: LIB3478-017-P1-K1-A6
cggacgcgtgggtgcaagccctacatgcctagcaaaaatcttgcggatctatcaagatactattaagcatgtaaagcgtggcaaggagccaaatatgcattagcttgagacggagactcttccgtttggacggaatatcaccagactctatgatctaaagggatcttc

SEQ ID NO: 18251 - DNA, 118 bp, Sorghum bicolor
  Clone ID: LIB3478-017-P1-K1-B4
ccgatcctattgtgtaagactttccaatcggagtaatgattaatccggacagtacgcggcattcgaatctaataatcatacaggggagggttagatatatgaaagagaacaactgaga

SEQ ID NO: 18252 - DNA, 342 bp, Sorghum bicolor
  unsure (1)..(342): unsure at all n locations
  Clone ID: LIB3478-017-P1-K1-B5
cgttgagtgtgttgggcggcgcagcaggaggttccaactgatgcggctctctccttggctttctgtcggcatggcaggcacaagtgtgctgcgtgcaacatcagggacgagcgaggtgccacggtgagcaagcggacggcttggccaggtgagcggcttgtaagtcagtggccctcgacgccgacacggcgcgcttcatcccgacttcgcctcgatcgagcactgcgcctcatgctgagtctncggagacatacgcgatnctctccgcgcgtgaggcaagtcgctctgaccagcgtgaagctgcccacaccagagacgcgagcagcctcctaccacgtcttc

SEQ ID NO: 18253 - DNA, 450 bp, Sorghum bicolor
  unsure (1)..(450): unsure at all n locations
  Clone ID: LIB3478-017-P1-K1-B7
tggcttcgctcctctgccgctccgctcgctacccgctttgtctgcggagaagcctccggcgaacagccgcgccggccgagatgtctgctccctccgcggaaccacccccaccccgcaccgtgatctgtgtgggcgacgtccacggctacttcacgaagctggagagcctctggtccaacctcgaggccgtgctacccgccgacgccttcgtcaccgcgctggtcatcttcctcggcgactacaacgaccgcggcccggacacccgcagggtcctcgnacttctcctcgcgctcccgacgcgccaccccgcgcagagccacgtttttctctgcggcaaccacgacctcgccttcgcggcgttcgtcggggcgctgacgtcgccgcccgacagcttcacgttcttggccacctgggacgagtgcatctactacgaggagcacgaaggggtgg

SEQ ID NO: 18254 - DNA, 410 bp, Sorghum bicolor
  Clone ID: LIB3478-017-P1-K1-C1
aaaagatgctcagagtgaatctccagagaactatgggtttgccgccatagatgaagatcccaagttttcattgtcaaaacggtacaacacattataccggaatttgtataaaattgcagcaaaagcttcagaaagcgttgaagcttatgcattcttggaaagccaatatgaacagcttgttgaacaagtggaggtacttttgcaagcgaagttgcatgataaatcttccttaagtactgtcctgaaaggcaatcagccaaatctgcttaatagtgaggtaagcagcagtgaacatcgcagagcaactggtaagaagattaaaaatatagaggtgcgccgtcagcaacaaagtcctcttgatccaaacaagaagaaaaagggtagacaaggtctgctggaacctgaggaga

SEQ ID NO: 18255 - DNA, 502 bp, Sorghum bicolor
  Clone ID: LIB3478-017-P1-K1-D11
gaatcatcagggacacgagttaattaacggtttttctgtagtaaactttggtagtgataatccgcaaacttgtgaggcgtgtgagcagtatgtacgaggagcgaggccagattttcgttgcgcgacgcgacatctgacactgatctgatgcgcgcaagcatgacaccgaccgcagtaccggaccacggcgctctgtggtacagactgtacagtacagtacagtacaaaacccgtagctgccatcagataacgcactagataattagatgtgcggaaaagggaagaaatagtaaaaggagctagcacatcattaaatcgaaataagaaacaaatactgtactccaaaagggtcgttccggcatccatcgatggttcaagtagcagcaaccatactgtacatgtatattcatatttatatataggagtgcatgattaagccgcgcgcggttcctcattagcacaccaacatgatggggtaagcaacaaattaagcacggcagcg

SEQ ID NO: 18256 - DNA, 396 bp, Sorghum bicolor
  unsure (1)..(396): unsure at all n locations
  Clone ID: LIB3478-017-P1-K1-D4
cccacgcgtccggctgagagccttctcccacggcgacatacttagcatggccggcttcgacccctgcatgtcgtcggcctcgtggggcgcgtacgagcaagggcaccaccaccaccaccaccaccagagcagcaagcagtggcatgtctagacatcatcgtcagtacaaatatatacgatcccatagctcgctcgctcgccatatcctgaatgagctgcagcacgtacgcatgcaaggaccttgctcgatcatattggtaagtcggatcatcgatcgaatccagttcactgtnttgcttggcacttactctgatacgagatgttcatttggngggtatgggcatttcaattcttatatataaactttagtcaaggtgcaatatatatatggagaac

SEQ ID NO: 18257 - DNA, 257 bp, Sorghum bicolor
  Clone ID: LIB3478-017-P1-K1-D9
acggtaataggctcacggcactgtcagatagcatctccaagtgcaggtccctagttgagcttgatgtgagctacaatggccgcacggatctgccgacaaacattggttatgagctggtaaatctgccaaaactctggatccacatgaacaaatggcgttctcttccatcatctgtctgtgagatgacatcactctacctgctggatgcccattctaatgaattatgaggggttacatctgccgttatgaagcttagc

SEQ ID NO: 18258 - DNA, 420 bp, Sorghum bicolor
  Clone ID: LIB3478-017-P1-K1-E10
gttgtgctgaacttcttgggaaacttctgttatttattcttgtcaagcaccttacttggagtgttttctggattgctgagtgcgtacataattaagaagttatatataggaaggcattccactgaccgtgaggttgcacttatgatgctcatggcttacctctcatatatgttggccgagttgctagatctgagtggtattcttactgtattcttctgcggtattgtgatgtcccactacacttggcataatgtgacagagagctcaagagttacaaccaagcatgcctttgcaactttgtccttcattgctgagacttttctcttcctttatgttgggatggatgccctcgatattgagaagtgggaatttgccagtgacattccgggcaaatccaatggcataaggctcgattttgtt

SEQ ID NO: 18259 - DNA, 339 bp, Sorghum bicolor
  Clone ID: LIB3478-017-P1-K1-E11
gcgagcggacttaactacatccacaaccggcgcgatctactcttgcttactacactcacctaagacgcttccactgaccgcgcgccagcttcataactaagaagtgatatatccgaagccataccactaactcgagacttgcacttataatgctcatggcttacctctcatatatgttcaccgagttgctagatctgagtggtattcttactatattcttctgcggaattgtaataacccactacacttggcataatgtgacatacaactcaatacttacaaccaagcatgctctatgcaacttatgtccttcattgctgagacatatctctttcttta

SEQ ID NO: 18260 - DNA, 365 bp, Sorghum bicolor
  Clone ID: LIB3478-017-P1-K1-E3
ctggtaatgaacatgagaattgcaatgacaatgattccgagaggagtagcattacttcaaattcctgcgctggcgatgatgatagagatgaaattttgccagatgagtcgtccagctgcaactgtgagggcaaaactgtctcagaagcaacaacgtctgaaacgaatgtagatccagttggatcctctgagagagctacagtatctaatgaaagaaagccatttatcaataagctacagtggttcttgaggtttggcagaccttcaactgaaggcaatgcagagaagggcattgctcaggcatcgaatgataaacatgatgcagttattccctgcccttcacctgctgatgtgagttcagataac

SEQ ID NO: 18261 - DNA, 348 bp, Sorghum bicolor
  unsure (1)..(348): unsure at all n locations
  Clone ID: LIB3478-017-P1-K1-F3
gttcacaatctggaaggttgttgagctgtcaagtccggttgatatctcatccatgaaaagggctcgtcctggggttacaagcatctcagctgcagggacaatttcaaacgtgaatgagttagatcatagagaagtattacctgagaggctgagaatctgaatcttagttctcaaggttcattaccttagttacccgttttttttggcctccggatatgcctctcaacatattgtttccaacgattgtgtcagcacagatatccaaccccaagacctggaanttattggatgtaaaataagcattacgatgtattacgtttttaatcttctgaaaccatttaagaacat

SEQ ID NO: 18262 - DNA, 339 bp, Sorghum bicolor
  unsure (1)..(339): unsure at all n locations
  Clone ID: LIB3478-017-P1-K1-F5
atggaattggagttgttatatatcaaaagccggcatcgaattcttgctatgctgaaaggaagaccaatgaaccccctctgtgcgtgcgagagagatggatcacgttttccttggtatgctcctcttgatagttgcctttttcacaactaccattaccagtacagatgaaagatacagctggcctgtttcatggcccgaaagacttngatgtagatatgcaagtgtacctgatgattctgcttctaacanagagaagttgaagctgatcaaagtattggaacagctcgttcagaagtatatcagtgactccactaattgtcagcatcgtatgaatgacat

SEQ ID NO: 18263 - DNA, 214 bp, Sorghum bicolor
  unsure (1)..(214): unsure at all n locations
  Clone ID: LIB3478-017-P1-K1-F7
gcgcgagagaagcttcacagagctttgcttggttggggttggagccctgggggcgtgccagccgagctgtccgtctctctgtctgcagacgatcatccaacagctactactacctcnttacggcaaagcgaaaatctgcggcctcctttcccgagcccgattagatgtaaaaggactacctgactcacaccgtctttagatactgctaccccta

SEQ ID NO: 18264 - DNA, 280 bp, Sorghum bicolor
  unsure (1)..(280): unsure at all n locations
  Clone ID: LIB3478-017-P1-K1-G5
gtcaagacagtgatggacctggcgctttgcaagatggtcaacactggggagacacggctgcttagtgcgggcattgatgggtatgtgaagagctttgattttgggaagcttaagatgacacactcattgcgatcccctcagccgctcctatctgtggctagctcgccctgtggctctgtggtggtggcaggggtctgcgaaagggaagattatatggaaatatgaagaagaggctgtggttgangaagangaaggagggaatctgttgtggtgagataga

SEQ ID NO: 18265 - DNA, 400 bp, Sorghum bicolor
  Clone ID: LIB3478-017-P1-K1-H11
cggcactcctatccagaggcggcggcggccccctcggctcgcacggtcggccctctggcggcggtagccatcctggcggtgcttgtccccgcacacggcggcccccgaaggctggggagacgacgacgcagccatggcgttggcgccttcttcagacccgcagaggtaggaaaattcatttttactcccggtattatttactcctaccaggtagtcgcacggcgtcgctgctaacggccgttcctccgtcgacgactgtctccacaacccaccgcacgctgcggcccctcactccgacagcggccggaacggcggcgagccccctccccacccctgacacggcagatctagatcattcggacggtgaccttgggctattgatggattacgacgtgtggat

SEQ ID NO: 18266 - DNA, 351 bp, Sorghum bicolor
  Clone ID: LIB3478-017-P1-K1-H2
cactgacacttgtatcgagaagggcgctagagctcatgcaccgactggtgcactcgaagcctgggattgtcagcttacatgcattcctgtatctgcatagaatcttttctagacccttactaactgagtgacaaagagagacacatgtgctgtgacctatgagatctagcgtaatgcactggtatcaccaagaactgactgtccagagaagctgcccgacgtgacgaagtcactgctgccatctggtcccaaggaagattcatctctctcggaatttcaagtggagttgattcaacttgcctcacagcttaacggtgatcatgtactgaacacgtacccagatattggcag

SEQ ID NO: 18267 - DNA, 343 bp, Sorghum bicolor
  Clone ID: LIB3478-018-P1-K1-B10
taaattttcagttcagtctgtgtaatgaaggcacatcaaaattgcacgaatgcttttaatgctaggagagctttggagaagcagcctgtgatggaccttaagttatctttgacagtcggaccttctgaatctgttgttactgatgtggaccttaatatggccacccaagataacacagtattgctacaatcatgcaatgtggcttcagttccatctgttgatgaaggatcaacatctgcacgcaggaaatctggtggtaagctacttacttacctggtaccagttggttgcaatgaattccacagtcctattccgctgcatcccgcgatacaactgccaaaaa

SEQ ID NO: 18268 - DNA, 395 bp, Sorghum bicolor
  Clone ID: LIB3478-018-P1-K1-B11
agaaaaggtgatgactgccaacccagattgtgccacgttagaacaacaattctcgatgcattacatataatgcatgatggcaaattcttgcatattcctgttattgacaaagatggacagattgctgcttgcctggatgtcctgcaacttacccatgcaactattcaattggttgaaggagggaatggaactgtaaatgatgtcgcaaactcggtaatgcagaggttctgggactctgctcttgcattggagcctccagatgaggaatttgatagccgtagtgaggtatccttactcctgcagtcagaggctggagatgggaagagtagtgtttatccccctgtgattggcaatatattttcctttaagcttcatgatcgaaaaagccgtgtgca

SEQ ID NO: 18269 - DNA, 236 bp, Sorghum bicolor
  Clone ID: LIB3478-018-P1-K1-B7
cgagaatctctaaaaggcgccgctgcctggccgctcccgtcacgccgcggcgggcagctagcagcgaagcgtcggcttccagaggccggccgcccggtcgtcgagagccagccagtggtggaggtggagggaggctaggtatatagctaccggagagccggtgggcgcgggcggctctttggccggcacggtctctaccgcaacttggtgtggctgttcctggtcggcgcggtgct

SEQ ID NO: 18270 - DNA, 173 bp, Sorghum bicolor
  Clone ID: LIB3478-018-P1-K1-C10
cggacgcgtgggcgcgcagtggacggcggcgggaaggccgtggagcgctcagggtgcgcgggtgcggccggttcggtgcctagtgctcgctgtagcacacgaggtgcctgctgcactcaacagaagtaaagtttgtctactacactcacaccctgttgctgtacctgaacctc

SEQ ID NO: 18271 - DNA, 397 bp, Sorghum bicolor
  Clone ID: LIB3478-018-P1-K1-C7
ctagttcctagtttgcttctgattttactaactttggtatacccctagtccacctactcgttcagtaagcgcattcgttattaaatttgtcatattgcacagttctttttagtaagcatataagtattatatatattatatattatatattattattatgagcaaaggcaacttactaactaactatactccttttagttcctggtttgctttcgattttacttcctttggtataacccccagttcaagtatttgttattaaattcgtcatattgtacagttccttttagtaatttaattaggtcttattgtgagcaaatttaacttactaactatactcttttttgagctgtaataactggaatagaaagaggatctcatgtgatactgttattta

SEQ ID NO: 18272 - DNA, 391 bp, Sorghum bicolor
  Clone ID: LIB3478-018-P1-K1-D9
cccacgcgtccgatcaacatgggcggcaccagtgattgggcagatgatctcctctgcggtacatgcaatgggctcctttgctgtacacacacctacatcaactctcaagatagccaacctagcaactggtgaatgtctgcatctaaagaagcctacaaaaagcttaaaggatgaccacttttcgttctacagatttggatttcacccagtcactaaagaatacaaggttatacatttttgtcaggaaattggtccatttactgaagacagatttaatgtcattcaagtttacacacttggtgatgagaaaaggaaagatatcgtaacttcagaagctctaagttgtgactgggtgaaaaaatccggagtagttatggttgatggtacaatg

SEQ ID NO: 18273 - DNA, 411 bp, Sorghum bicolor
  Clone ID: LIB3478-018-P1-K1-E1
cctctctatcagcgccgctgctgctcgccggcgccgcctgccaccagccccggaatccgcggggcgcgggggaccggaaacgctcgctcgctccccctgttttcctcggccgtcggagcgcgtcgtctccgggcagcagcagctgcagcccccctagttcctggtggttcttgcctcctcgtctgggtgtgagtgtggtggaatagcgtcgtcgtcggcgctggaatccgcctgcctgctccgcctccgctcgcgctggagccaaagctactgattggcttctaccgaccagcgaagccaaagagggattcttgggaggcaatcagaggtgtttgttttggtcaaacaaagctcagctcccttctctgtcttgcccatgggatgcttgctgtgaagctgctgtgttcatac

SEQ ID NO: 18274 - DNA, 422 bp, Sorghum bicolor
  Clone ID: LIB3478-018-P1-K1-E12
catattggcaacttgagtcttaattacatgaattgttcatttgaactatccatatccttgggtttaattgtcgggcctttaagagtctgctccattgatagtggtacgcgcatactatatctgctcctggctctaggcaatgaatgtgacttttactgtcataacatgtagcagaataactcataagctataactgaacttaaatagataatatggtgaacaatagcggaaccatgtgtactgatagcactccatttagtaaccctccattgttctatgcctgtgcttgtactaccctccctcacatcattatttatggaggttttcaactgaatacacagcaaggcgtaacaatagcatacctgtctcttgatgatgtggtgcaaatatttgtgtaccactactagctattttattgcata

SEQ ID NO: 18275 - DNA, 402 bp, Sorghum bicolor
  unsure (1)..(402): unsure at all n locations
  Clone ID: LIB3478-018-P1-K1-G10
gcacgagcaatcgatcaccatggccgctggtccccggagtccnccctccttgtgccgccgctcgtgctcctgctcgtcgccgccgccggcgtgctcctcctgccgcagcgcgggtccgcggaggaggagtggaaggtctcgctggagctctactacgagtcgctgtgcccgtactgctcgaggttcatcgtgaaccacctcgcggggatcttcgagggcgggctcatagacgccgtccacctccgaatcatcccctacggcaacgcctgggtctggtccaacagcgagatctagttctagcatggtacgtaccaatgccttcataacaccggggaagtctgcgccaattacacctgagcngnnnngagtgggcattgcagtttcatctactgcgtgagggac

SEQ ID NO: 18276 - DNA, 181 bp, Sorghum bicolor
  Clone ID: LIB3478-018-P1-K1-G11
cgactagcaactcatcaccatgtcgcttgctaacgccagtgcaccctgcttgtgccgtcggtcgagctcatgctcggcgcgcggcgccggcatgctcctcctgccgcagcacggctccttggaggaggactgtaaggcgtcactctagcactactatgaccttatgtaacccaactgctcc

SEQ ID NO: 18277 - DNA, 127 bp, Sorghum bicolor
  unsure (1)..(127): unsure at all n locations
  Clone ID: LIB3478-018-P1-K1-G12
gcacgagcaaaccatcaccatggccgatggtactctgagtcacccgttcttgtgccgtcgctcgtgatcatgcttgggggtggggccgacatgctcctcctgccgcagcacanctccttgaaggagg

SEQ ID NO: 18278 - DNA, 292 bp, Sorghum bicolor
  unsure (1)..(292): unsure at all n locations
  Clone ID: LIB3478-018-P1-K1-G4
atgaggagcaggttattgaagggcttgacataacggtggttaatatgnaaaaggagaggttgcattggtcagagtaccacctgaacatgcatttggatctgttgaaacaaagcaagatcttgctattgttcctcctaattctactgtcttttatgaagtggagcttgtttcctttgagaaggagagagaatcttgggacttgaagaccaatactgagaagattgaagctgctgccaagaagaaagatgaagggaatgtgtggtttaagataggcaagtacgccaaggcctct

SEQ ID NO: 18279 - DNA, 409 bp, Sorghum bicolor
  Clone ID: LIB3478-018-P1-K1-G8
gggagtttaaagcatcagccattgctgattttgtgtctgctaaagcttcctttggttaccacactaactcaagaaacttccgcttccatttttggcaatccaatcaagaagcagattttactatttgctattgcaagcgagtcctccaaatttctgcccatctttaaggaagcagcaaagccatttaagggaaagctattatttgtctttgtggagcgagacaatgaggaagttggtgaaccagttgctgtctactttggtattactggacaagagaccacagttcttgcttacactggcaatgaatatgctaagaaattttttcttgatggggaggtgtcacttgtaggtattgaggactttgctgaaggtttcttggaagacaagcttacaccattctacaagtctg

SEQ ID NO: 18280 - DNA, 491 bp, Sorghum bicolor
  Clone ID: LIB3478-018-P1-K1-H3
gataatcgttgcaatcaggggaactcaagagaacagtgtacagaattgtaaaagacttgatatggaagcagcttgatctaagttatccaggcatgccaaatgcaaaggtgcacagtggatttttctcctcatataacaatacaattttgcgtctagctatcacaagtgctgtgaacaaggcaagaaaatcatatggagacatcaatgtcatagtgacaggccactcgatgggaggagctatggcttctttttgcgcgctcgatcttgctatgaagctttgaagtgacagtgttcaactcatgactttcgggcagcctcgtgttggcaatgctgcattcgcctcatgctttggcaaatatgtacccaacacaattcgagtgacacacggacatgatatcgtgccacatttgccaccttattttttctttcttcccatctgacataccaccacttccccagagaggtatggtccaggattctgatggcaacat

SEQ ID NO: 18281 - DNA, 325 bp, Sorghum bicolor
  unsure (1)..(325): unsure at all n locations
  Clone ID: LIB3478-019-P1-K1-A2
cattattcatggagatgatccttgtntacaccngatggcactgatgctatgactgatgctaaaccgttcgacgcaagcagcattacttgactacaactgatgtttagagcacttgtataccagggaagtactgaccccaacataaactgaaggtgcatgggagcttcctttttcgagtattagagcatacataaacgagccgatcactccaaggattgttcatgtgagttctgcaggagtgacaagacctgaaagaccagggctagatttaagcgaacagccacctgctgttcgattgaacaaagagcttggctccattttaact

SEQ ID NO: 18282 - DNA, 461 bp, Sorghum bicolor
  Clone ID: LIB3478-019-P1-K1-C9
gccaagaaagtttggtcatgaaattgagtacttggaaagctaagcaattccaatgtcatggtgccattagcttatgtgttaacagaggacaatgcataccttctctatgagcatgtacacaagggcacagtctttgacttcctccatggtgcaaagtcagatattctggactggccttcacgatatagcattgctttgggggtggcccaagggcttacctttcttcatgggtgcactcagccggttctacttcttgacctgtcaaccaggactatccacttgaagacagtgaatgaacctcagattggtgatattgagctttacaaaattattgatccttctaagagcactgggagcctttcaaccattgctgggacagttggttatattccaccagagtatgcatacacttataggttaacgatggctggcaatgtttatagcttttgaagcattttact

SEQ ID NO: 18283 - DNA, 323 bp, Sorghum bicolor
  Clone ID: LIB3478-019-P1-K1-D9
cgatagcaaattcatacttttttccatgaaacataaccccagctctgatcagtttctattattttattttccttgcatccatggtacctttttgttatggattttttttcttccaaagagtaaccgttgactcataggtaggagagttagtggtggttggctcaaacttagggaggcaaagcagtagcagttaactcagaaaaagaaagcgggttattattttgatcactggtcaactaatgtttatgtggttaggtatgtactgccaattagattctgcagtggtaggtatggttacaaataagctgcagcactatctttta

SEQ ID NO: 18284 - DNA, 317 bp, Sorghum bicolor
  Clone ID: LIB3478-019-P1-K1-E2
tccgccttccccttccccctccacctccgcagcgcccgcggtaacctcaccacgccacgccacatcgcgtgcgagcgagcccccaaccgtcgccggccctcccacccccaattaagccgcccccgcggcgcgatccggtgtgtcctccaccgctgccctgccgccggagggaagggaggtgggggagcacaggcccggggggatgctagaggcgaagccgccgtcgccgggctccggcgcggccggggcggcggcggcgcacattcacagtcaccggcggtgggcggcgccgctgctggcctcggtcctgctctcgt

SEQ ID NO: 18285 - DNA, 416 bp, Sorghum bicolor
  Clone ID: LIB3478-019-P1-K1-F12
gtgagtttcatagacaatagctaacaaccagaaaaaaaaattgtagtttaactttgcaaaaaaaaaaaaaaaaaaaaaaaaaaaagaaaaaaaataaaaaaaaaaaaaaaaaaaaaaaaaaaaaaaaaaaaaaaaaaaaaaaaaaaaaaaaaaaaaaaaaaagggggggccgttttaaagaaacaaagtttacgaacacgggcatgcaacataatattttttttatagggaaacctaaattaaatatattggccgccgtttaaaaaaatcgtgattggaaaaaccctggtttaaccaaattaaatccttttgaagaaaatccccttttacccagttgggataataccaaaaaggcccgaacggatcgcctttcaaaaaaattgcgaaacttaaatgggaaatggaaccccccttta

SEQ ID NO: 18286 - DNA, 503 bp, Sorghum bicolor
  Clone ID: LIB3478-020-P1-K1-A4
cttccagatcccggcctcgaccgctgcacctcggcgacgccgtcgtcctccctcggcggctgcctcctagcgccgtggccgcatctcaggccctgagccggcacatgggtggtcctctctctcctgttccacctctctctctgttcctctcctaacgcgggtggagcggcggcggcctcggcatgcggcgtagcccgacggcgtgcggcccgctggcctcctccaggtgttccctgtgccatccacgaaaccctagcagcctcttcctcgctgccgacggtggccgcggcttagctcagggctctatctagcggtatgtgaccatcctcgtctcctacttcccctcctgacagttgtgcatgttgtgagatccaccacagctcctcagtccttctgctcctgaatcaaggcgacgatggttggctatcctgcgttgccgcggtcggcgagatacagcgggttgacttaatgctgcattaaattgatcagcccttgcatgatgc

SEQ ID NO: 18287 - DNA, 295 bp, Sorghum bicolor
  Clone ID: LIB3478-020-P1-K1-A6
gaaaaagtcttcgcgcatcgtattcagagcaattattcaaagttaacatatgatggagttgacttgatgggtgaaaggctagctgaggaggttcgacaaattgttcagagaagaagaaacttgaggaaaatatcttttgttgctcattcgcttggcggtttagtaacaagatatgcattaggaaaattttacgaacctgccatggatgaaacatcttcttgtgacaatgataagccttctgatgaacaaaatgtacctggggggggtaaaatagctggttaaaaaccaatcaatt

SEQ ID NO: 18288 - DNA, 392 bp, Sorghum bicolor
  Clone ID: LIB3478-020-P1-K1-A7
cactggtcagacatttaaatgtttaatcaatacatcctgactcgtactaactctagtccacttttgaattatagttccttatgtgtgccaacttggtgttatagaaggggaagggcaagacaagatcttgcaagttttatgtacttttctttattaattctgattagcctcacattcaatgtataggatagcatatgcatattcaagggcgtcacccaagacaaatctttcttccaaaagtgtatttgaagaaccagaagcagcatctgggccatatgctctacctgtagttgaagatactctacaacagccacctaccacggatgatgacgatgttgaaaagttctttctaaccccttcgaaggggggcacatgtgtacatacaaatgggg

SEQ ID NO: 18289 - DNA, 253 bp, Sorghum bicolor
  Clone ID: LIB3478-020-P1-K1-B9
cttcgcgcgcctcgcggacaggtacggccccatcttctccatccgcctgggctccaagctgggcgtggtggtcagctccccgtccctggcgcgcgaggtgctccgcgagcaggacctcgtcttctccggccgcgacgtccccgacgcggcgcgctccatcttctacggcggcgggcagaacatcgtgtggaaccccgtgggccccacgtggcggctgctccggcgggtgtgcgttcgggagatgcttaacccc

SEQ ID NO: 18290 - DNA, 166 bp, Sorghum bicolor
  Clone ID: LIB3478-020-P1-K1-C2
cccacgcgtccggcaggacctgctcctgctcgacgtctcgccgctctcgctcggcctggagacggccggaggcgtcatgacggtgctcatgcccaagaacaccaccatccccacgaaaaaagagcaagtcttctccacttactccgacaaccaacccggcgtgctc

SEQ ID NO: 18291 - DNA, 213 bp, Sorghum bicolor
  Clone ID: LIB3478-020-P1-K1-C7
aggtaactagctgaagaataccctgatgagtacatgatcacgggtaacacatatgaatagaaaagtgaggtggaagagaagaagagtcagtacgctaagttctggaacgagtttggcaaatcaatcaagctgagtatcattgtagacgcaactaacaggtaccgtcttgcaaagcttattagatttgagagttccaagtcagatggcaaactt

SEQ ID NO: 18292 - DNA, 214 bp, Sorghum bicolor
  unsure (1)..(214): unsure at all n locations
  Clone ID: LIB3478-020-P1-K1-C8
gaacaatcactggagaaacctngnctgtaccaatcactatagaataacatcctttctcttttgagtgttcgggttcaaggacacaagacatgtaaaaagacaatgggcaccaaccctttggcgggggggccggcccgccgggggaaatggattctccgggcctgggggtggtttgaaaccggaagccggctacccctggaaaggcccacgaatc

SEQ ID NO: 18293 - DNA, 217 bp, Sorghum bicolor
  unsure (1)..(217): unsure at all n locations
  Clone ID: LIB3478-020-P1-K1-D2
cccacgcgtncgttatttttttttttttaactttacaaaatagggttggaattaccaactaacgttacaatgaatacaatagaagtgggaatgccatgtacctcatatccacaaattaatacggggtaataggttacattacctctaaccagagacccaacgtgatttagttgacttctacgaaccaaatgccggccttaccgtaggtcacatacat

SEQ ID NO: 18294 - DNA, 138 bp, Sorghum bicolor
  Clone ID: LIB3478-020-P1-K1-D7
gcagcagccagcagagcaaccaataaaactaaccaacgcgcgggcgcggcggttgcaacctcccgttccgttctgcttccggaagccaagctctgctttagcccgatcggagttcatcccatcaaaatccaatcgatt

SEQ ID NO: 18295 - DNA, 493 bp, Sorghum bicolor
  Clone ID: LIB3478-020-P1-K1-F11
caagtagtgggcgtaagttattttctcgcctgactcatggctttgatatggttgtcattgatgaggctgctcaggctagtgaagtaggagtcctccctccactggctcttggtgcagctagatgtgtcctggttggtgatccacagcagctccctgctactgttattagcaaagcagctggaactttgctttacagtaggagtcttttcgagaggtttcagcaggctggttgtcctaccattttgttgtcagtgcaatacaggatgcatccccagatccgagaatttccatcgaaatacttctatcaaggtcgccttacagatagtgagagtgttgttcaattacctgatgaagcatattacagagatgcacttatggcaccttatatcttttatgacatgtcacatggccgtgagtctcataggggtgggtcatcttcatatcagaatattcatgaagcgcagtttgcattgcgtttgtatgagcaccttca

SEQ ID NO: 18296 - DNA, 243 bp, Sorghum bicolor
  Clone ID: LIB3478-020-P1-K1-F8
cggacgcgtgggcgcgggcgccaccgccaccgccaccctactcctcctcctactcccggctctcgccctccgtggggcccgggggaccccgccgagcgcatccgccgccatggcctccgacacgaggctctccttaccgtgccgcctgccctcgctcctacctccgccggtgctgctgcgccgaatgacccgcgcccccgacagcaaagcaccatcaacactctcataaagattgtacagggc

SEQ ID NO: 18297 - DNA, 437 bp, Sorghum bicolor
  Clone ID: LIB3478-020-P1-K1-G12
cttgtctataaatgaatagatgagatagtctcatggtgacctcacctacgttacttataccaaaattgataatggttaaatagataactagatcattgatctttgttcttttgaaatgccaagttaggttacactccctattgtcgattttcttcgattacgtgtttgttgagggagacactcaaattgctccttgtataatgcattcctgctccttttaggactattctcgtaatcatattattattctgtctttatgctgaacatatagtgggagattctatgtaaaggtgtgaggccattggtctttgctacataaatttgcacaggcatcagaaaaaaaagttgtttctttagaatacaacgatttaaggtctgttcacctctcagaattaacctatttgaaatcattacaatagattttgattattcaaaat

SEQ ID NO: 18298 - DNA, 229 bp, Sorghum bicolor
  Clone ID: LIB3478-020-P1-K1-H5
acaccaccaggtgagatatccagcaactgcagcaagagcatacaaagcgagatagatactaccacaagagtctgttaagggcggctgacaggagcaggatcactccaagggctcgatagaggattgagaagcaagcctatacaagaactatagagatgtgatggggctaagcagaaacacacgcagggtgagcactcgatactgcagaacccgttcatgatcaagcgca

SEQ ID NO: 18299 - DNA, 379 bp, Sorghum bicolor
  Clone ID: LIB3478-020-P1-K1-H7
accagatacatggatccattcgtgtgccacataccgcagctactagctagccgacagcacttctcttctccgagcgaccacgaccggccggacggccacctatactagttcacccaccctacgtacgtgcacgctcctatggcgaccacggggatggccaccacggaccgggagctccctcgccttattaggacccggcgcgcgcgccagcgccggcagcttgcccagtaccactaccacccatcttaccgcggcggacggacgtgtcaacgtgccgagccagcgcgcgctgctcgtcagggccggccagcagaccgaggacgggaagcccgcggatgctgctactgcttcgaaggcgctagggctctgggacgcgctg

SEQ ID NO: 18300 - DNA, 210 bp, Sorghum bicolor
  Clone ID: LIB3478-021-P1-K1-A11
ggcggaagctccaagccatacgccgtcgtgtacgtcagggcgggctaccagcggctgctctaggagcccgacccgcagctcgtcgacatcatgccgttcaaggatgcacgggaggacggtacgcctgatctcaatgaggccaagaataatgatgctgccgtgccgtacaacgatgaggacaagaacggagtcttgaataatctgacactg

SEQ ID NO: 18301 - DNA, 366 bp, Sorghum bicolor
  unsure (1)..(366): unsure at all n locations
  Clone ID: LIB3478-021-P1-K1-A6
gttgaatggatgccacccaagggtggaataacagaaggacaaatgcttaaattcatgggcgcaaacatacacttatctccaacacaagccaagatactgttggaggatgagactactggttttgcatatttgaatcttcaagaagcttgtcccccattatattcgattattgggctcagggagcatattaagaaacggccaccattggctacctctgagaaagttcaacaatttgtgagggcacggnggagagaatcaatgattgcaggattttatcatgaacgctatgaagatcccttgcttatgccgatgagaagaagaactgtncatgctggactagttgtaaagggtgaagaaggtgcgctt

SEQ ID NO: 18302 - DNA, 234 bp, Sorghum bicolor
  Clone ID: LIB3478-021-P1-K1-B6
tactagtcctttcctagctagctcaacagaaacagcagtgcaaagacaggttacaacaacctaccctaacaggccattcgttcgttccagtgcactgtattcgtgagctagctacctctgagctccaactccaagtgtacctagtgtggctacctagctactggctagacacttgagaagcttgcagtgtcgccggccggtgatgtgtgccgatgtggacgagtgcggtggatg

SEQ ID NO: 18303 - DNA, 226 bp, Sorghum bicolor
  Clone ID: LIB3478-021-P1-K1-C6
cttgtccgacgtacttggcgcacagctcgacgccaagggcactggagagaacgcggtgagggcactcgctgaggcgacactgaaggtcgacatcaacggattccgtcgcataggtcggaacttcctgcggagctggcacaagcgcgaggactatacagtcgacgtcgtcagagtcaacgacactacatgcgtcaaggacgctgatgactttctgaaggacgacttt

SEQ ID NO: 18304 - DNA, 461 bp, Sorghum bicolor
  Clone ID: LIB3478-021-P1-K1-D7
agaattggtacccacaacccaccagcatgccccccgatgtgtagatgcagggcaatggtggatcatcaagaaactgcgtctccaccatccccgcggcgtcctcgcagctggatctcccatccatcttcggtacattcctatccctgctcccatcaaatctacaacaacaagtacaacaacaagcacaagcaagtgggcttggagctgtgattctggacttggcacgactggatcccaactcccagatggatgccttacgtcactggatggcggtcaagccccaggcggcctcgcccgggccttggcggtctgcccccaggcggcggtctgcccctaggcgctctggcccggccaggcggagagcgctaacttcgttgcaggtagatcacttcctccccttcgcatcgtggacggagaaagggtctgtggagtagggggcgcccgacccccaactgttggtg

SEQ ID NO: 18305 - DNA, 194 bp, Sorghum bicolor
  unsure (1)..(194): unsure at all n locations
  Clone ID: LIB3478-021-P1-K1-E3
ggctcagatacacccagcagctagctagcacagatagcgacgacgacgccgncgacgacgacgacatggcggggttggggaagaacgggacggggggcgccggcgaccacggcagcgcctacgacatcacgggggcgccgcagcggctggagagcatctccctcgttacggcagacatcgacagcattctttct

SEQ ID NO: 18306 - DNA, 360 bp, Sorghum bicolor
  unsure (1)..(360): unsure at all n locations
  Clone ID: LIB3478-021-P1-K1-E6
cggacgcgtgggattntgagaaactaggttcaaaatcttttgcagtttattctatcgcagagactgatgcagataacacggcctggatcgtgaaaagaacataccggaattttgaacgtcatcatcgacagctgaaggagatacctaattattcattacatcatcctccaaagagttctttttcatctagtgttgataaacaccttgtgcaccacctatgcattcttcttgacatatatatttataatctcttgtctatagctaatattgcagaacagcatgaagtttatgatttactgagtgcatactgaaagaattactccgctagaaagatcacctctgttataaaaacctcagctg

SEQ ID NO: 18307 - DNA, 199 bp, Sorghum bicolor
  Clone ID: LIB3478-021-P1-K1-F2
cggtgaaccgctccaccaacgcgcgcgcagaggcacgtaccaccactaccgcagcaggcagtagcaccagcgcgggagcagggaccaccaccacccggctgtagcagaggtaggcgagcatggtcgttcttctgagctcgctttagttttatgttgtggctgtttaggttctcgcttttgtttgcttttttttattttt

SEQ ID NO: 18308 - DNA, 228 bp, Sorghum bicolor
  Clone ID: LIB3478-021-P1-K1-F6
cttatactaccaatgctcaattctggagctacctagcgcttaacagagcactaagttgtatgccatccatggattcacgatcagtggagtaggttctgaccggccactggatccagctaacttatcatgcatgaagcaatcctctgcaatgaataagtcgaagaaaatggctctacgagtaatacctgagagcctattacaagaggaatttgtggggtttaaggacat

SEQ ID NO: 18309 - DNA, 392 bp, Sorghum bicolor
  Clone ID: LIB3478-021-P1-K1-G3
acggtatcttctaaaggcaaagaattctgggtctcaaaagtgggcagatatgtgcaagcttgaagcaatgccatcacagagtttcatcttcctgcaattatatgaactgaaggatgactttattcaagcagaaattcggaaaccttgttatcaatcagtttgttcacattctacaggttggttttcgaagccaatgatcaaaaccctgacggtgcaagtgagcataaggctcctctctttattgcataatgaagaagctaaaaacttgtcgaggaatgcccatgaacttattgaaaggtccaagaagcaggaagccctttcgagatctgagtggtcaaaagaagataatgatgctggtgaagttcctgccacacaaactggaactgaggatc

SEQ ID NO: 18310 - DNA, 173 bp, Sorghum bicolor
  Clone ID: LIB3478-021-P1-K1-G9
cactccttgagattagagaaccacacgggccaccctccacccaccctccaaggacatggcggacgccgtccaccgcttgagagaccgtgttcaacaagttgaagaccgacgtctatgacaagaagccggagctagaagagcctctcaaggctcgccagtcccccaagtacatg

SEQ ID NO: 18311 - DNA, 179 bp, Sorghum bicolor
  Clone ID: LIB3478-021-P1-K1-H10
ctcgtattctagctcagagagttcactggcaaggccggcgacaccatttatttctagaacaactgcgggaacaccgcacagcgtcacattatacgaggactaggcgcaccatgtattggactctcaactatgatcatacgcgaggaccacattatttcaccgagcgagacctaatacag

SEQ ID NO: 18312 - DNA, 225 bp, Sorghum bicolor
  Clone ID: LIB3478-021-P1-K1-H6
agttctagatcgcgagcggccgaccttgttcttttccttattgatgcgcgatgggacgatgatggcagagatggagcttcggatgatggaccgttttctcgacggggaccgcgccatgaccgcggacgagctcacgggaaggacgccatgtcctgctgctgctactgcagacgctatggtcgaccgcatgctgccgcttctagctttgtacggcgtggtcaggtg

SEQ ID NO: 18313 - DNA, 234 bp, Sorghum bicolor
  Clone ID: LIB3478-022-P1-K1-A10
ccggaattcccggtcgccacgcgtcggtgcacaacggcgaggaactgttcatatgctatacttgtctgtaacacaatcacacagctggctctctggtcgttgaaaggaaatcctatactgttaaagtcaccagcaataaattggcattgagactcctttgaatagacagagacctgtggtggatgcaattgtgacagtgccactgagccaacacagatctgagaaaagagttca

SEQ ID NO: 18314 - DNA, 240 bp, Sorghum bicolor
  Clone ID: LIB3478-022-P1-K1-B9
tgcacgcgtacgcgcttccggacgttcgtgctcgtgcccaaagcatctgctggtgggttttactcctccccctcgtctcggacggtcgtgtgcgtgtttccgtccacgcatatgtagtgcgctccgcaccgacccccactgttcggggggcgatcaccgaccgaccccattcaccttttttcctcgttcgcatggcgatgctgcttcgtaaggtgtggggctccttgctcgcgcgcgctc

SEQ ID NO: 18315 - DNA, 404 bp, Sorghum bicolor
  unsure (1)..(404): unsure at all n locations
  Clone ID: LIB3478-022-P1-K1-C3
aacaaacagaaacnttttacagctgcggactacaacggctgtggccattccttttcttgtaaacacctctgttctggtctcgatgcgcggtcatgctgccttttttgttattctaaccggatgcactcagtaacgctagagttaccatttgaggtcactctcatgcgtcacacagccatggcttcgggcagcacagtaaatcagaaggtgcgactccgcccatatctggtcgtagcggtgctcctgctgcttgcagctgatgatccaagcgcgccgtgagcatagttcatgcgttgtggagtaacaaccaggggcacagactaagaaacgcatttccacatcacgggagagtgctgctttttttttacaaatttcctgattggttttttacctcacaaagggta

SEQ ID NO: 18316 - DNA, 300 bp, Sorghum bicolor
  Clone ID: LIB3478-022-P1-K1-D11
aacatatgccctagtccaagtcgaatctccgcgcagaccataaaggccgctgcctacgcggttcagaactggccgcggagcggcgaaatatccccacatgatccaggacacatctatatcttagctcatgcaacggctgttcaaccaccatctcaacgggtccggaacgccggtggacatggcattggactactttatctacgactacgagttcacggagccgacgcgcgtgacgagcctgctaaacacgcagtcgacgcccaccaacgccgacttcgtcgaggacaactacttcttcgc

SEQ ID NO: 18317 - DNA, 348 bp, Sorghum bicolor
  unsure (1)..(348): unsure at all n locations
  Clone ID: LIB3478-022-P1-K1-D3
tgggaactatggtggccacagtttcctatcttggtttacttcaaggagacccagacaaagcccgaaggacaaatccacttcttccctgtgatattcaatggtcgacaattatatgatgtaatggtggagcgtgctggaccctcgaagacgagtggccctaaatagtgccaccttgcttcttccctcgtggcaatgacatgactntccatgtcttctatggctcgaatccctggacaaatattccttcctgatgtggagcgtgcgcttcccttcaagtagaaggtcgtatatatatagcgtctatacttgcatcttcagtagggataatagaaactaatgtcatgcaac

SEQ ID NO: 18318 - DNA, 279 bp, Sorghum bicolor
  Clone ID: LIB3478-022-P1-K1-E3
attccttctcggctcagttgtaatgatcatggaggacgctgatgcaccacaccacctactgcttcttcggtgcttcatgtctcagggtgttgtgcacaaacagcccctgctcttttcaggagctatgataggagccgcggtgttccttggtacactacctgctccaggttcatcttcaaaggaggatggacgacacagagcaatgggggctgcggcaagtagtgatggacgagcaaaatattagggtttgaggatagcttggcagtacaagaaatactt

SEQ ID NO: 18319 - DNA, 143 bp, Sorghum bicolor
  Clone ID: LIB3478-022-P1-K1-F10
ttatctctctatctcttacgctgcttgctcccttcctcctacagccccctttattcctccatccgctcgcgccaagggcttcagggtgcggacagggatcagtgcccgacggccgcacgacatgatctcctggcggcgcatca

SEQ ID NO: 18320 - DNA, 139 bp, Sorghum bicolor
  Clone ID: LIB3478-022-P1-K1-G5
gacgcgctgggcctcatctttcgcaacctgccgctgcaggagatgctcaccgtcgtgccgcgggtgtgcaagtcctgggggcgggtggtcgcccgcccctactgctggcatgggatccacatctacgagtggagccagc

SEQ ID NO: 18321 - DNA, 351 bp, Sorghum bicolor
  Clone ID: LIB3478-022-P1-K1-G9
aaaagatgccgctatttgttatagcccacattttaaaccttgaggttaaacacaactatttttcaacagtcaacactccttttgtttactgaatgtgccatcacagcatagattcatggattcagcattgcctatgtattttgatgaatttcaaattccttctcctttgtgagtagttttatatccaatttcaaatactttttccttaacaacagtggtttattactcaaggaacagcttaccgtgttagcctatccacaaattactttgcttctgggtcctaagctttggttcttttattgcgccacaagagttgcatctgaacaaaaatgcaagtatttttaatctttg

SEQ ID NO: 18322 - DNA, 339 bp, Sorghum bicolor
  Clone ID: LIB3478-022-P1-K1-H4
attatgtgttggatgcgagaatgtcgtggcatttcctttctttgtggacattgttgttagtttcagtggaccgtggaacctatgaatagtaggcattgctagcaagcttttggtagaatgtgccaaagtttggtctttttaccaggaatgaaattagactactgctctatgtatttcttctgtctttttcctgcaaatgtcatttaattagaaatagtaaaatattctgctaagagtggcaaagagacagactgatcacttctgctgaatcggtctaacaaagagtagtattctgtttactctgttctggatggatactttaggtttatacattggact

SEQ ID NO: 18323 - DNA, 302 bp, Sorghum bicolor
  unsure (1)..(302): unsure at all n locations
  Clone ID: LIB3478-022-P1-K1-H9
ncaccacatcacaccacggtggctgaaccacgtcgggcataatcttgtattggattcagacattctactcctacatgttgaggagcgtaaatacgccacggtagggcttgatcactggcagaaagctagctatgtgcccacatcgtcagacagcatgctggctcgcttcatgaactgtttcaaacaattctccaagaatcagatcggacgggcaaccccacacatcgatcagctgtcaccaacacctaccaaggatcagctcatggagaggtactggtcacacgcggcgcagtgcacgagct

SEQ ID NO: 18324 - DNA, 438 bp, Sorghum bicolor
  Clone ID: LIB3478-023-P1-K1-A1
gtccttgatgcctgtcgcaggagcgagcgactgaagggcacacgactatccatgtactcactgcactatgggcagactacaacgaccaggttcatgcagtgactttctagatggaggagagcgctactcgtacgatcacaccttttcaccagtagctgaacaactacatgaagcagcaatctgtgaaccagatctctgatgcttccagaacacaaggctaaccccatgaggatgtgactacacctaccctctaggtggttaagattgccgagacaatcaaagcacacttgcacaagtccaggggcagcaacggactgagttattcattcaacataatacataacgaggttccatgaggccgccaagcttgcgaggggaccgctcctgacacagagctccaacgagaagatctggttatctagcccccaggaacctatg

SEQ ID NO: 18325 - DNA, 412 bp, Sorghum bicolor
  Clone ID: LIB3478-023-P1-K1-A6
atcagtctctatacataggccgtctataaatgggagaataagcgcgctagactggagagctgcgcatgctggacctgagcagctcacgacgccaactatgtatatgaactgtagcgaagctagacataagtccagctggcccgttagaagcaagaagcctgaagactgacggatcatacctgcaaggaactctacctcaacacgctaaagagatggtactgatgcgacacgtcattgacatgacaacagtccagcagctacacaacggagggagctatatcggcaacgctgcgtaagcgacgaactgatgtgcgctctaacctgagaataagatcgttcatgcggtcttatcagaagataccctgtggaaaacggaggacatgaatgacgtcttctcaccatacgactgtat

SEQ ID NO: 18326 - DNA, 451 bp, Sorghum bicolor
  Clone ID: LIB3478-023-P1-K1-B3
ggacgtcggcaacaacaactacctccagggggcaaccgtcggcagggccaacagcccctacaacggcgtcgacttcccgggctccgtccccaccggaaggttcagcaacggctacaacatcgccgactacgtcgcaaagaacatgggattcgcgtgtagccctcctccttatctgtcgatggtgcagagctcatccggccctctggtccagaccgctctcaccagtggtatcaactatgcttctggaggagctgggatccttgactccaccaacgccggaagcaccatcccgttgtcgaaggaggtgaagtacttcggcgccaccaaggccaagatggtcgccgcagtgggacccaacacggcgaacccagcaatctctcagtccatcttcctcatcggcatgggcaacaacgacccttacgtcttcgcggcatcggagcgggcgcggaac

SEQ ID NO: 18327 - DNA, 231 bp, Sorghum bicolor
  Clone ID: LIB3478-023-P1-K1-B5
agtctcggcagtcgcccttgccagcgaccaaccgcgccatcgctctcccgcctccgtctgaacctgccaccaagcatcaagccatggagacggcagcggcacctaccacggcgccgcacgtgctagtggtccccttccccgcgcagggccacacgctgccgctcctcgacttcgccggcctgctcgccacgcggggcctccgcctcaccgtcgtcacctcgcccgccaacc

SEQ ID NO: 18328 - DNA, 386 bp, Sorghum bicolor
  Clone ID: LIB3478-023-P1-K1-C1
gcgacccaaaccctcctcttgcctcccacgccaccgccgccgccgccggatcacgcgatggccgacccgcggctgtaccctacggggtccgggtccgacgaccgccgcgacgccgcctaccccggctccgagcgccgcctctacaacccgtaccaggacctcaacctcccctaccggcagctctacgaccttcccacctccccggagttcctcttccaggaggaggccgtcgcgcagcgccggtcctggggcgagaacctcacctactacacgggcgtcggctacctcggcggcgccgtggccggcgccgcgatggggctctgcgacgccgcctcgctagctgaggcgggggagcccgccatgagtcgtgccaacggtgtactcaa

SEQ ID NO: 18329 - DNA, 557 bp, Sorghum bicolor
  Clone ID: LIB3478-023-P1-K1-D2
gcccaaactcccacaccgccgcgaaccacgcatggccgccacagccgccgccacggccgccgccgcgacgacctccacgccatccacccccctcctccgccgcgccgctgcggcgccgaccacaagccaccactaccagctcaggtgctccaccaagccctcgcagttcgtgctgcggcaccgcgccgcgcgagtcgctcccgcgcgagctctgctccctgaccgcgtcacgccgttttccttcgacgcggacggcgacgaccatccccgagaggagtgcggcgtgttcggagtcattggcgacccggacgcgtcgtcgctgtgctacctcggcctgcagaagctgcagcaccgcggggaggagggcgctggcatcgttgcgtcggacgccgacggcaagctcaattcagtgacggacctgggtctctgtcgggacgttttccgcgacccggcgcgcctcgccaagctccccggaaacgccgccatcgggcacgtgcgctactcaacggccggcgcctctttcaggcgcaacgtgcagccgttccttgccgcgtaca

SEQ ID NO: 18330 - DNA, 175 bp, Sorghum bicolor
  Clone ID: LIB3478-023-P1-K1-D4
gctggctgaaaggccgacgctcatttgatcgaagatgtgcgtcaactaattcatcctgaataactcaccatgtatacagacttgcccaaacgtgatgtgctatacaagtatatatatgcagtactcaggcttacccaagaagaggaagcaccagcaccctgacacacgattaagt

SEQ ID NO: 18331 - DNA, 281 bp, Sorghum bicolor
  Clone ID: LIB3478-023-P1-K1-F4
cacgacagcaaatctgttaattgattgaaaaattacttactcaaagcacactacaaatacaggggagacaaactactagagcaacaacaactacagcacgcacgcacgcacgcacgaggccactgcactgaaagggaccaaacggcgactgctagccgatgcacgcgcagcgcagtcaaaaagcgaaacaccaagcaacacatgggaaagatgtgtcgccaagtacaaggacccactcaggacaattagatgaacataagaagggcgggcggtcgcgatct

SEQ ID NO: 18332 - DNA, 508 bp, Sorghum bicolor
  Clone ID: LIB3478-023-P1-K1-G3
cacagatcacgcgcgactgaccggccgagagcgcacggcgagctagaactagaatggtcatcacagccggcgccgtatgcgccgtaaagctgaaactactagccgcgtggccgagcccataggtgaaccacgtgcacgtagcgctgcacctaaagggcctcgagtaccagaacgtgcaggaggacctcacaaacaagagcgaccagctactaccctgcaaccgcgcacacacgaaggagcccgggctccttcacggctacacgaccgtctccgagttactcgtgatcacggagaacctcgacaacgcctttgccgaggcccgccaagccttcctcgccgcggactcctatgaacactctgtcggtctcttctgggccggctacgtggatagtaagttgtacaaggatgatggtgaaggcgatcctggaggcaacagaggaagagagggcggcggctacagctgacgcgttggcagctatggaaacgctgaaaggagcgtttgccgagt

SEQ ID NO: 18333 - DNA, 429 bp, Sorghum bicolor
  Clone ID: LIB3478-023-P1-K1-H4
ctaccctcggtaccaggtttcttgctactttctctggtgctttttgggcttaagcagaggacacaaggaaagcttgctgcacccattggcctgcgttctggaatcatgactgccagttacttaatacaaagcagcggtgttttaacaccgaaacccgaaactccgttttggatgattagcacttgccgtctgcatccttttgatggtgttatcggcttaagtatctgctccttgcttgttatctttttcttccctcaaaagcctgttcagaaggatacatctgtgtgatgagggtcagtcggtcagaagagtaaaacactaatgctggagtgagcttccaacaaggatgaatcaccatgcacatatttgtgcgatgaagagtttttcctatgtaccatgttaaaatgcaactgattattctgatgcact

SEQ ID NO: 18334 - DNA, 479 bp, Sorghum bicolor
  Clone ID: LIB3478-024-P1-K1-A12
gtgcgactcaagtgaagaggagcattcactgttgcctaggctggcttgacgcggacaacagtatcaccgaccacacgattatatgaacaagacctttcgagctttgggtagagtcatgagcgcaaaatcaccttttacgattgacgtgacgtccgatataagatgtccattctgtctattgggcgtgaaacaattgaagaatgcgattggaatttacaattccaaacacgcttctacccctatccaacctgaaatcaagatcttaccttatcagctcgaccctaccgtcggccttgaaccaaaagataaagctcaagtcatcaggcagaaatttggggatcgggcagaggggttgagtgagatgatgaggggtaagattgttgctgctgggtatcctgagccaaagaaagacgccacgaccagctcgagtcatctcggtcaaagactacaagcttatactctttcgaaattcccagaaa

SEQ ID NO: 18335 - DNA, 217 bp, Sorghum bicolor
  unsure (1)..(217): unsure at all n locations
  Clone ID: LIB3478-024-P1-K1-B12
gttggcgacgctgaaaaccgaagcaccgaacacactgcgcacacaggacacgcacactctgcagctagcccgtatcgcaatgcnccatgcttgcctatctactccacggcccatccgccgccgtcgccgcggcgccaagcgccttccccctccgttgcttcccaccggcgaataccccgtttcttccctcgctcccgcacccggtttagtcgaggct

SEQ ID NO: 18336 - DNA, 106 bp, Sorghum bicolor
  Clone ID: LIB3478-024-P1-K1-C4
cccacccgaccagtcactgacaaagaccctgggaccgttcttcgtgcgctcgtacactgagacctcattattcagcccgaagcatgtgcgcgcccgtttcaatggc

SEQ ID NO: 18337 - DNA, 460 bp, Sorghum bicolor
  Clone ID: LIB3478-024-P1-K1-D1
gcaggaatagaaggagccatgggctcatggttccttttttggagggatagttaccttctcaggatcacgaggagaaacatcaattgttgcaagaatcaggcctactgaaccatgtggcattggtccctataacatctatagaaccaaaatggcatattgttttatacacagatgatgaagcagactctgcgcttcaatccccagatgatactgcatactgggcaagaagcaactcaactgaatacgaacttggctgcgaatccgaccacaacatgaaccactaatcagtcttaagtacagtacaagaataaaaatacaaggcagctcctcctaaccttttccaccattccatgtgcacttaccacatcctcgtttctactttatttagtgcactacccagttataaacctccttgtattatataatatttcgacccatccttatcactatagcatctacc

SEQ ID NO: 18338 - DNA, 108 bp, Sorghum bicolor
  Clone ID: LIB3478-024-P1-K1-D12
agccgatgccaccaggaacctctaccaacagtgctcgaatgcacttgctactgatgcgcctgcacttattgtaagtagagctggtcttacactcacaaacatgaccct

SEQ ID NO: 18339 - DNA, 184 bp, Sorghum bicolor
  Clone ID: LIB3478-024-P1-K1-E4
cttcctcgcacggtcgcgccgccaagcaatggcgactacggggccgctgctctcgccccagcgtgctcgccctgcgcatctgcgcggccgcctcccgcccctacatctcgcatcccccctatacccaccagcgaggcggctactccttcgccgagcgctgtcaaaacacacagctaagtcctca

SEQ ID NO: 18340 - DNA, 385 bp, Sorghum bicolor
  unsure (1)..(385): unsure at all n locations
  Clone ID: LIB3478-024-P1-K1-H12
gtctaatttcactttgtatgcatcgtctcaggattatggagttagagtttgtttttttaagtgacattatgatttccttcctatagcaatactttggccatacctagaaaaaaagaaattaggcaaatacatgctaaatattagtacccttcatttattatgttatatagctnttacctttcaaaaatatgtcagtgccatatgatcaaaccttctgttagaaaccttggactttaaaagggaaacttactaaatcagaaaatcacgatgtcctaccacatagagatagatattagttaccttatagtttcataaactattccaaagcttaaccttcgaccccatcaccctttcagcccacaaagctactttttcatattgatag

SEQ ID NO: 18341 - DNA, 353 bp, Sorghum bicolor
  Clone ID: LIB3478-026-P1-K1-A2
gcgacgcgtccatccacgcgtacgattgagagtgcatgtactaagaatagtgtcgtgacctctatcagagcgtctttttttcttggcagaattactataatgacagttgcttcattagttgatgaaccataagcactacatgccaaataggctagatatttctgcagtttattagaaaatatgctatacagccctactgctaaccacttcagattcaaatgtgaggtggccaacaatctgaactgtaaatgtttgttcccgaaaattgcctggtaaccatgtgtgcagcatgctgtatcttactgaagttcatcattgcgtctgttccatggaattcagatacaaagaagttt

SEQ ID NO: 18342 - DNA, 256 bp, Sorghum bicolor
  Clone ID: LIB3478-026-P1-K1-B6
cccacgcgtccgcgacgacgacatggcggcgttggtgaagatcgggacgtggggcgccggcgaccacggcagcgcctacgacatcacggtggcgccgcggcgggtggagagcatctccgtccgccatggcatgatcgtcgactgcatctccttctcctaccgggaccgggacggcaagctgcacaccgcggggccctggggcggcacctgaggcctgaaagaggagaccatcaccctgggccccgacgagttcgtg

SEQ ID NO: 18343 - DNA, 458 bp, Sorghum bicolor
  unsure (1)..(458): unsure at all n locations
  Clone ID: LIB3478-026-P1-K1-D5
gcgcggacgcgtgggtcctgtggaggtaaaagcgccgaccattgaatgcgtctatctgactgaggccactaggggaacattcctagcgatcggcgaaagcatcagatgggggtgggctgatattgtatatanattanantangacctgggtggtttgctttggatgtaagatgggcttgttctatgctggaagttgaggctatttctttctctctataacacaaaactcatgataaaccgtaagcaatttatcacgcaacatggcttttaaccttctaatcttttaaaccctgcaagctcacaatatctacctttctgacttctttcatcatagttctatcatatttctatcattattgaataactatttccaaaatatttttctcttgatttacagtcataactttaacttagttatttcctatttatatctaatgtttcattcatttgttctattt

SEQ ID NO: 18344 - DNA, 378 bp, Sorghum bicolor
  Clone ID: LIB3478-026-P1-K1-D7
gacacgggcgaggattacccggctgctctgctcggacggagcggtctccctgcccacccggatcacacacatcgggacgccggacgaggaggaggtgccacgccgttactcatcagccgatcaacagacgtgggcgctgtgaggtccactaccgacagcgaaagcgcagttgatgctttggattcccggatgctgtgccataggtctttacggagagcgtaatgcagcgagcagtagagttcaaagctgttaaagtgcggatgagtactatgaagaaatccgacacgaaagctgtcctccacttcgtagagtgtgaggttaatgtcaccacatcggctggagttatcatggttgacacggcactgatggcttcatatg

SEQ ID NO: 18345 - DNA, 501 bp, Sorghum bicolor
  unsure (1)..(501): unsure at all n locations
  Clone ID: LIB3478-026-P1-K1-E1
gagttctacgaccggacctacgaccgcgtcacccccagggcggagcgtcgcctcgagcgcttcaagtcgcggaacttcttcaaggtcaccaccaccgacgaccccgtcatccgccgccttgccgagaatgacacggccacggtattcgccactgacaccatcctggccgcactcatgtgtgcgcctcgaagcgtccagtcctgggacatcgtcattcagcgtgttggcaacaagttgttcttcgacaagcgtgatggttctcagcttgatcttctcactgtcaatgaaaccgcccaggagccactccctgaggccaaggaagacatcaactctgcgcattcactagcagttgaggccacatacgtcaatcagaacttctcgcagcaggtgctgctccgcaatggtgagaaggtcactttcgatgagcctaacccgtttgccactgaaggggaggaagctgcttccgttgcttatcgctaccgcgctggaagctngatgatg

SEQ ID NO: 18346 - DNA, 430 bp, Sorghum bicolor
  Clone ID: LIB3478-026-P1-K1-E9
ggaaaaaagagccaacaatggacaccgccgcctcatggcgcctcctctccccggcgtccttctccccgcctccctgcccggagcagctactacccaagcggctagcagcgttctctttctttcctcattctcacctatatatctttttccactccaaatctactctgttctaccacctcactaatatctggtggcctcacaaagtcctgctttatttttttctttgtccgttctaaaaaatttattgttcctttctatgcttttactctcactcatacaatttacgacttccatattattcttttccactactttatcatttattaatgttttcttatgctttctatttttcttttccccatctttctctatcatttcgctctgctttttttctacattatcttttattgttcctactttttcatatttc

SEQ ID NO: 18347 - DNA, 446 bp, Sorghum bicolor
  Clone ID: LIB3478-026-P1-K1-F1
gccgacacagggaactccgctaagtcggatctgagtgaagtgactcgtcaatggttcaaaccgtatggctactgccatggttttctccgagatccaaccggccgcttcttcaacagcttggttcactctgattttatcgcagagattcttgggcgctacgaagctcctctgacctacaagcgcacgaatgtcgggtacccacacaagttcggcggtaacttcgccgtgggcggcgccggcgtatctgaggttcctcgccaggctcctacactcgccagacagatcgacgacttccagatgatgctcgaccacgacaggagcgttccggtaatgcagctcaggcagtccgtcgcgctggtcgccatctgcggcaacgactaccgcccgcgtggcgccaacacgagcagcgacggcgccgacatcaccggattcgtcgggaacgtgac

SEQ ID NO: 18348 - DNA, 406 bp, Sorghum bicolor
  Clone ID: LIB3478-026-P1-K1-F12
caagtttataaagcacggttgaaatactctgggaagctggtagctgtgaaggtgcagaggcccggtattgaggatgccattgggcttgatttttatctacttagaggacttggctttcttataaataagtatattgacattgtaaccagcgatgttgttgctctaatggatgaatttgctcgaagagttttccaagagcttaattatgttcaggaaggccaaaatgcaagaaggtttaaaaaattatatgccgataagcaagatgtattagtgcctgatatattttgggattacacaagtgcaaaggttctaacaatggagtggattgagggtgtaaaattaaaccaacaagcagttattgaaagtcaaggaattgaaggttcctggatttggtcaaccattggta

SEQ ID NO: 18349 - DNA, 144 bp, Sorghum bicolor
  unsure (1)..(144): unsure at all n locations
  Clone ID: LIB3478-026-P1-K1-F4
gcggggtcacatctgctacaccantccccgctcaaatttaaacacatcatgtcgtgccacctttgctgtggctacgtcggtcacctcgggcccatccctatcccagagtggagtcaacacttccacccatacattacttgcatt

SEQ ID NO: 18350 - DNA, 161 bp, Sorghum bicolor
  unsure (1)..(161): unsure at all n locations
  Clone ID: LIB3478-026-P1-K1-G1
gcgagcgcaaataacttgctccactccaacgctcgccccctaccgagagcgagagccatccgccgcctgtcgcagacagagccgccaaccagattcccaccgnccaggcaccaaccgcgcgcaatggaggacgacgcccgccaccttcagggcccgacacc

SEQ ID NO: 18351 - DNA, 176 bp, Sorghum bicolor
  Clone ID: LIB3478-026-P1-K1-G10
gccgcaaacgcatatgcaataattcccaattcagcgccacccttcaagcctcctcctactccagaccggccacactctccatgatctgatactcttaacagagagaagggatagtctctcaaaaccaccaaaactatcaaatctccaaaactattcattctacctatcaaccaatt

SEQ ID NO: 18352 - DNA, 485 bp, Sorghum bicolor
  Clone ID: LIB3478-026-P1-K1-G3
gcgatggttagtatggagcctcagatacccagagtttggttacagacaaggaatgcatgaactcttagctcctcttctctatgtacttcacggtgatgtgcagcacttcagacaagtcagggaccttcatgaagagcttttgggtgatgattttgatggccaaacttttccagatcgttcaaagctgaacagaagtgacagaaaaaacaatgttgagggtagaacagctaaatttagaagtttgtctgaccttgatcctgatactagagatcttttcttgatcaatgatgcatatggagcagagggtgagttgggtattattttatcagaaaagtttatggagcatgatgcttactctatgtttgagaatttgatgaacggtgcgcaaggagtggttgctatcactgacttctattctctgagtcctgccccaaaatcaagcacgggtttaacaccttgtagagaggcattatttgcaatatatc

SEQ ID NO: 18353 - DNA, 264 bp, Sorghum bicolor
  Clone ID: LIB3478-026-P1-K1-H4
gtgaaaccaccgccgcagcgcgcgcagtcctcctcttcttcccttcttccttgcgcttccgccgccggccgatctgcctcccggctcccgccgcctacgagctacgtacgatccgactcgatcgtctccgatcgaaggcctgccagagccggacaaggatgacggccgccgcttgctcaagccaaagccacccgttcgctgctccaactttcgccgtcgttggcgaagatgaacgctaccgcgttgtagactcttcttcgcaac

SEQ ID NO: 18354 - DNA, 126 bp, Sorghum bicolor
  Clone ID: LIB3478-027-P1-K1-A5
cggacgcgtgggtgcagcctctgttgcatggagaccgatcaaattgaaggtgtttcagggtgcaggttcttccagctgataggtcatgacgggaatatgcatatatggtcaccacgtggtagcgtt

SEQ ID NO: 18355 - DNA, 312 bp, Sorghum bicolor
  Clone ID: LIB3478-027-P1-K1-B11
tgataaacgtgccattcatacgtaaaatcgttcgtagatgggttggtagcttacatgctggacaacatccttgacatcaacgaaagcgcggaggggaacgacagatgcaaccactgatgggaaaacgtttggagcttgaagaaagactctaggagccacgcgttgtactcggtgccgtacaatctgaacaaatacttgcattaagtctgatcttaatggcgctgctaaatgaattcttgaaccaaaccggggatcatatgtgaacataaatgtgctcgtcttgccagtggaaagctcttggcaacaatgttg

SEQ ID NO: 18356 - DNA, 242 bp, Sorghum bicolor
  Clone ID: LIB3478-027-P1-K1-B4
cgcaggtgcatgagacagagggatccggcttcgaacacctcaatatcacccacgaattcaccatgcaggctgagaactatccagactactcagatggtgtgaacactgagcgagatgggtatttcagcaggaggcagatctaccagcatgtgcagctatggttagagaatgtcggatggttggcactagaactacatatgatacagtatgtcttgctcaagctcgaggaagagcacgagtac

SEQ ID NO: 18357 - DNA, 291 bp, Sorghum bicolor
  Clone ID: LIB3478-027-P1-K1-B5
ggtggcctgcagcccacaccacgcatcgcgtagttggctcgcgggacccacgcgttagcatcgcgcctccctctcccgaagctagcgtctcggcgtgtggtactccacctgggtgcccggacccgagcggcctgagcccgcgacaaaccaggctcgcggcggcggaccgcaccctcccacggttgctcggcctcgtatgcgctagcatctctaagaggttcagtgccccgtaagatgctttgggtcagagcacgaactacgtctctgtgtgtattccttagtagtataggg

SEQ ID NO: 18358 - DNA, 162 bp, Sorghum bicolor
  unsure (1)..(162): unsure at all n locations
  Clone ID: LIB3478-027-P1-K1-C1
tcggngaaaggatcgattgacaggttgtgattgtgttgattgtgttggctttccttgtagggcgtcgactcgcaggaagaaggaagccgcggttgcagtggaggaatcgatcgagtgctatgttgatgaaatnttatatcangaatcctttattttttttat

SEQ ID NO: 18359 - DNA, 243 bp, Sorghum bicolor
  Clone ID: LIB3478-027-P1-K1-D11
agcaaatctacatttttctttgagtagaagtggaattattgctcttgatagagcagaagcagtaattgagataactgaatgggtggaagtggcaaagaagatattgactctagagagtaacaccaccaatcagaattcatcttccgaagtacgagcagctaatagcacaacaaatagtcaggaaaatatgagttctggcagttatactaattccaacactttcgctgattgagagttatgctg

SEQ ID NO: 18360 - DNA, 114 bp, Sorghum bicolor
  Clone ID: LIB3478-027-P1-K1-D2
ctcatgcgcattagacataggatgatggttatctacagcaggatatcgacatcaaattgctcattcctgctgcgaccggtaatgtcttgcgggataatgtagacactgaccgag

SEQ ID NO: 18361 - DNA, 308 bp, Sorghum bicolor
  unsure (1)..(308): unsure at all n locations
  Clone ID: LIB3478-027-P1-K1-H8
cgcaacaatatctgctcctcacatgcatgcaacctgcttagagctattgaaggatcatttgcaaccaggaatgcatgctctggatgttggatcaggtagcggctacctgacagctngttttgccatgatggttggaccaaaaggccgtgctgtgggaattgaacacattcctgagcttgttgcttcttctattgaaaatgtgcaaagaagtgctgcagctccactactgagggatggatcactctcttttcatgttacagatggcaggcttggcttttcagacgcagcaccctatgatgctatccatg

SEQ ID NO: 18362 - DNA, 376 bp, Sorghum bicolor
  Clone ID: LIB3478-028-P1-K1-A3
ttggtttttttttttttttttttttttcccacgcgtccgaccacgcgtccgcccactcgtccaaccacgcgtccggaaggctcggaatgtgacgcgtcgcgctgacaacaggttcgacccgtaagactggccggatgcgtacaccaacgccagcgtccaccccaagctcgtcgagtacagcgccgtgtttcaccagcgccatggggacgacaaggaccccaccacggagcccttggacccagagcttcttataagtgtgggaggaggtaaacaccacggttcctactggatgggcaacaacgccattaacccgaccactacttccactctgagagagattctaaaattcaactttagcagtctccttcggcattct

SEQ ID NO: 18363 - DNA, 208 bp, Sorghum bicolor
  Clone ID: LIB3478-028-P1-K1-A4
ctgacggcacgggcccacgcttctgcaccaagacaacttcatagacccgtacctgctctgtatcaagatcatgcacactatcacaacagagaaggacttagctgggatgcaacatttcaacatcttaaccctggccaccgggctagcccaaatgaatctgctgaggctcacgatccggttaatgctgatggtaaccacacttgctact

SEQ ID NO: 18364 - DNA, 197 bp, Sorghum bicolor
  unsure (1)..(197): unsure at all n locations
  Clone ID: LIB3478-028-P1-K1-A6
agaggatcattccggattcccaacgaatccggacacctntcgcaccggcgcctcacggtcacggcttaccgtctaacacgcacgcgcggcgggcccggcaacggaacgaagccccgatggcgagcttcttcgagggcgcgcgcctcccgcaacaacgggtcgtcgagggccttccctttcccgcggtgcttgtaccg

SEQ ID NO: 18365 - DNA, 165 bp, Sorghum bicolor
  Clone ID: LIB3478-028-P1-K1-B1
catgagagacactagtaccaacaagcatacggataacaaaagaaataccaaaccggagacggccatgtttgcagtgatacgtcgcaagatgagtggttgaactggtcgtcgtcgataaggtcacagcctgccatatgtagatgaacggcgcgaataacgatctga

SEQ ID NO: 18366 - DNA, 263 bp, Sorghum bicolor
  Clone ID: LIB3478-028-P1-K1-B10
ctcgcaccagagtactctacccgcgccgcgcgccatggccacgaccacgaaccaccgccgcattgtggccctcctgctggtggcggccagactgctcgcgcaggccgcggcgtgcccctactggccgacgccgacgccgtccccgtcgtcgtcgtcggcgaaggtgaagccgccgccgtcgtccacgccgtgcccttccccgccgtactcgccgtcgaccccgacgggcaagtgccccgtgaacacactgaaactgcttgcgt

SEQ ID NO: 18367 - DNA, 298 bp, Sorghum bicolor
  Clone ID: LIB3478-028-P1-K1-C11
ctctctgatcaagactgacatggccaccgacgaggagcacctcaagctcgtcgagctcgacgctcacgagcggctcagcaactacgagtaccaccgctaccgacgtgcccatcatcgatggctaacacctcaaagcactcgaggccctcatggtcaagccagtcctaaatctccgagacaatgagctgcaggtctacataattaacccggatgaggaagtcgatgactatatgaccaacgcacaacagctgactcgaggtagggaacctgctcgattgagacgatgtggacttcatga

SEQ ID NO: 18368 - DNA, 403 bp, Sorghum bicolor
  Clone ID: LIB3478-028-P1-K1-C5
cacacgcgtgcatccgcacatgaaccatgtgaagagagcatgacatgaccctaatcagtgatcacaacatatcatacgaagacgtaaccatgcgggctgtgttttataaatgcatgccaccatatgcacacagctctgatcacatctgcatggctttctatatacatcaacatgccacgcgtaggtcgaccgatcagagcatgtgatgccagggccatgaccaattaacattctaaggcagctgaaagacacaccatcagccttgacctgtgcgtaggcatgaatcctaaccacagcgatgcaacataccaaatgcagtcctcagctgcagaacctatgcaagatcaaatgcaacacatggcctctgtttatggtagcatgtgacttccacgaatgcctgtgg

SEQ ID NO: 18369 - DNA, 327 bp, Sorghum bicolor
  Clone ID: LIB3478-028-P1-K1-C6
actgatcccatccggccggcgacggccatcgtgactcccctgaccttttcccccgaccttctccagagaagagatcaatcaaatcagaggaaccaattagcagggagggaggggaggcaaggcaaggcaaggcaatggccacgacgactgaggtgagggcccgccgccgccgccggcgaagcgcggcctactgcggtacaactcgccgctggcgcaggtgtccctgctggggctcatctgcttctgctagcccagaatgttcaacgcgctgtctggcctcggcggcggctggcaggtggactccagcaccgtcgacaactccaacac

SEQ ID NO: 18370 - DNA, 246 bp, Sorghum bicolor
  Clone ID: LIB3478-028-P1-K1-D7
actagaatacgcggccgttccctctcgagcgtgaccatggcctcccaggggtccctcgtcacgtggagggcagtcttcgctgctctggggtggctcatggcgaccacgctgcattacaccatagccaccgacagctcgtcgttccgaccggagcttctgacgcagtggacggtggcaacactgattgaatttatggaatgacaggcgactcggttgcgtttctacaagagcaactggatagtctgc

SEQ ID NO: 18371 - DNA, 117 bp, Sorghum bicolor
  Clone ID: LIB3478-028-P1-K1-E8
gcgactcatcaccagagagagatcgagagtgacgtgaggtgagtttgcagcttgcaagtcgtcggcgtcatggcatacaacgggcgtgaccgcttacggggctcatcctacccgggt

SEQ ID NO: 18372 - DNA, 454 bp, Sorghum bicolor
  Clone ID: LIB3478-028-P1-K1-F3
ggccaaggaaatcggaaaggcttccttcaagtacgcctgggtgctcgacaagctgaaggctgagcgtgaacgtggaatcaccatcgacgtgggtctctggaagttcgagaccaccaagtactacttcaccattatcgatgccccaggtcaccgtgacttcatcaagaacatgattaccggtacatctcaggctgactgtgctatcctcgttattgcctcccccaccggagagttcgaggctggtatcgacaagaacggacagaccagagagcacgccctccttgcctacacccttggtgtcaagcaattgatcgtcctcgtcaacaagatggacgagaaggtcaccaactacttcgaggctcgtttcaacgagatcagaactgaggttcattctttcattaagaagatcggatcaaccccaggagggttccttcttcccatctctggatggaac

SEQ ID NO: 18373 - DNA, 238 bp, Sorghum bicolor
  Clone ID: LIB3478-028-P1-K1-F4
gcacagacggcggctcggctcggcctcgcgtcctcgcgcggcgcgcgcgctcgcccaggcggtggccgcccgaaggcacgcaccgcgggcgtgttcggcgtgggtgggctcggcttggccggcgtggaggcgcgagcggaggcggcccgcctgcgcgcgactaccccggggcgacggcgcgcgcctgaggccgggtggtcggcagacgcctgaccctgcccacgcggtcttggcgggg

SEQ ID NO: 18374 - DNA, 233 bp, Sorghum bicolor
  Clone ID: LIB3478-028-P1-K1-F8
gtgcgcggtggcaccttcggcttgtgcagtggcccgacccacctcttcatgctgtcccagccggccgacaccatcaacgaatgcatgcgtgtgacgtatcatggcaaggtcatcgaattcatgttcctctaggagaacctaggcttccagcccctgcatgcgatcacggtcgcctctcttgatcacagcttgcatccgtcagtgtctcccaagccccagcggcgcaagctcat

SEQ ID NO: 18375 - DNA, 192 bp, Sorghum bicolor
  Clone ID: LIB3478-028-P1-K1-G10
gacacatcttctttatcacagacatcatcacacatctcctgtgacaccagacctagctcagattatactacatcctggtactgaggctgggacacatgatgcactccttgctggcacttgctactctggatgaccaatacctgacaagcatcatccatctgacaaatgatcacttatattcccatatcacaa

SEQ ID NO: 18376 - DNA, 220 bp, Sorghum bicolor
  Clone ID: LIB3478-028-P1-K1-G11
gcggttcggcaacagcagcacaagaggtacccgagcgagtcgttagagacgtgcctgcgttcctgtgtgtgtgctaatgctacagcgtacgaccgcaacatcaacaactgcaggcattagcacccggcgcgagagcaccaccagcagcaggtggtcccagctttcgacaccttcgggcgctttcgcgcgacacctctgagcaatttcaaatttcgcgcgt

SEQ ID NO: 18377 - DNA, 401 bp, Sorghum bicolor
  Clone ID: LIB3478-028-P1-K1-H11
gcgcaacacacacgatgtgcgacttcctactgcgcggctccacgtgcagaaatagcataatacgcaacgattgacaacccatagtgatgaggaggcacctggatgctgcgagtgtgaagacgccaatgaatcataatgctgtttacaaggtcaagtagcatgcacctattattgacaaccccaactacaaggggatctggaagcctcatgagatccccaacccttagtactatgagcttgacaagcctcattctgatccaattgatggtattggcatcgagatctggacaatgcaagattgcatcctgcttgacaatatattgattgctgatgatgaaaacgatgccacctacattctggagaagacactgaagcccaagtgtcatgttaagatgaaaaag

SEQ ID NO: 18378 - DNA, 430 bp, Sorghum bicolor
  Clone ID: LIB3478-028-P1-K1-H6
attaagtaataataagactgtaaaatagtttttagccttatacaataaaagaagtttcatttttcctagtcctagttcctttctctacgctaaaactagaactccttccttttaaattataagttattctaaatgttcaagtgccacaatcttttgaagtagtgccttttgacataaaacccctcattaattgcagtaggacgcatgtagtttttctctaatgtggacaatttgccattatatatcttgccatgatatacagtgacttattatatctatatggaacacagcactaattacattttacttacatagaacaagtcaatgactggaaattgtgttatgacaatttctttattctacttgtacattctaaacaatctcatatattttgcagctctgaatgatgcactaaagcaggagctggaga

SEQ ID NO: 18379 - DNA, 433 bp, Sorghum bicolor
  unsure (1)..(433): unsure at all n locations
  Clone ID: LIB3478-029-P1-K1-B4
acaacccctcggcccctggcctcgatctgcttctgctctccgctgcttcgttcgcgttctccactcctcttgctcctcgatctctccccctccggccggcaaccgcagcgatacgagctgcagcgcgaccacggaccaccgccggcgacacaccttgtgttgtacaaatacattgatatctgggagaagcgggagtcgatccagctaacgccgctggaccctgattgctacatttggagatggacaccgaatggcgcctactatgcttcgtcagcatattgtttgttcttcctgagcatgtcgtccctgctagggcctaaggaaccttggtgagccacaactccgtcgaaggagtctactacatgntgtgcttgcggtgaggaggatgagatggttgatcatctgctggcttgctatgtctacatgagagaac

SEQ ID NO: 18380 - DNA, 403 bp, Sorghum bicolor
  Clone ID: LIB3478-029-P1-K1-B7
agcacacgtacgagccaagctcgatgacattctcaaagctgatgtgcatgcacatgtgatactggattttatcaatgctgcacatgctcacctgcatgcacgggagcacatgaatgccaatcggacataccagaatatcccactgaacatggactttgtaccacacatcgagaaggcatgcacgatcgatatggcatcttatggagtcgccaggaagcaagcaagtgtacaggtgaataccactcagattacaactcaccctggcactctggctgcactactggcaaataacatgacaagtcacatgacaagacacatggttgttgcttatagaccgagttaataaccacatggttcctcacagggacatgacaagacacatgacatgacacatgattgttgc

SEQ ID NO: 18381 - DNA, 275 bp, Sorghum bicolor
  Clone ID: LIB3478-029-P1-K1-C10
tgacagcatgcacattgtgctccttgcagtagcagctcatgctgctgcaacaaacagccgcttcacaatcatctatgatcctacggcatggccatcagaattagttatacccctttcgaaatacatcaaggctgcatttcacacgcggatatcaggtgggatgcgattcatgatgtagactgagactgaggaatctagtgttcgcatgtacatggagacaatcacagaagtgagtgatgctgacccagtgcgtcggcctagctcctattggagat

SEQ ID NO: 18382 - DNA, 572 bp, Sorghum bicolor
  unsure (1)..(572): unsure at all n locations
  Clone ID: LIB3478-029-P1-K1-C3
aacgtctttgcaactggagagaaagttctcgaataaactgtggacattcccatatgccactatatggaaattgtctgattttgctgatgtcattttggcctacaaattaagttttggaagagatacagctggaaggaaactccattttatgcaagagatatacctgtgcatctaatgtttgggctatcggaagaaccaaatcaaactagagtactgtgtgaggtcaagaaggtacacttggaactggagataattcttgtacacaaagcaactgcaccaagggcacgcctagatttgcagttgtttcttgagtagtccaggcttctgccaagatcaccaccaatccacagctttntngttaaaataatnggcagttaagtcgtgtttcaccttgctcttgataaggcgctacagctactngcgtcatngctactatnngttcgtgtaagctgcataatgatattatatggtgatggtgtcaatttttttttggcatatagtccttgagacagagattaatcgcatataattcatggccaaactgtgaaaacactcataatatgtgctcagtg

SEQ ID NO: 18383 - DNA, 425 bp, Sorghum bicolor
  unsure (1)..(425): unsure at all n locations
  Clone ID: LIB3478-029-P1-K1-C5
cccacgcgtccgcttcaaactacccccagcagttacccggccgagcaagcagagagcacaaacccaagaaacagacgaggcggagaggtagctagcttcctgaactaatcggccgggggtgtcgcaatggctgcagcgagtatgatcaaggcgccggtcggccagaatccgaggctcgcgtgccacgccccggcgaggggcggaggcgtggtcaggtgttcgttgcagggcgcggtcgtcggcggccgggcggactggcagagcagctgcgccgtgctgtccagcaaggtggccgcgctcgggacgcactccatcaacggccacgtcgcgccggcgccggccccggagccgagccagaacggngcggtgttgganttggtccccgtgactagtatcaccggcggcgccatcaccaaggcgaacct

SEQ ID NO: 18384 - DNA, 160 bp, Sorghum bicolor
  Clone ID: LIB3478-029-P1-K1-D10
cgaagttctcgccatcacctccagctccacttcaacctccagagccgctgccaaccgcctgcgggctgctgccagcgctgatatggtgaagaggcataatgtctaggtctgcttccagacacctgccctggcagttgcacaccatcgcgtctgctcaccg

SEQ ID NO: 18385 - DNA, 325 bp, Sorghum bicolor
  Clone ID: LIB3478-029-P1-K1-D11
ggtttatggcagtacaagctgggcaacatcatcggcacatgatttaattctgggaatttgtttgttgggtggagattgcttttctagattgcagaaatatgatgaggcaaccaatttgaggtctaatatgagatatatgttttttttctgaaagttatccatcatagaatttttcttcatgtgattggtatttatcttttcctaactctactaatctcgcatggcttctgtgtcatccaggaaacttggaatcactatgtattcaatgaggataacattctgaaaattctgaacagtgctattctgagatcattgatctactctg

SEQ ID NO: 18386 - DNA, 230 bp, Sorghum bicolor
  Clone ID: LIB3478-029-P1-K1-D9
ctacattttgttaatggagataagttattgattcaacatcgtgataataacttgtattcttatgaattgcttgggatgaacttcaagattgaatttagcaagatggttaagctgttaggtttgagaccctggggagacgatgacttgcaattatatacctgtgtgaaatcacttgtgcgtttagatttatatgcaaatgctgctgtggcgtacccaaagatgcgggcgat

SEQ ID NO: 18387 - DNA, 513 bp, Sorghum bicolor
  Clone ID: LIB3478-029-P1-K1-E12
ggagagcatggataatggctccaaagttcatatccttctgagctttgggcagcatggcagagaacttattacctctgaagttgcattacatcttctctatattttaacggagaagcctaagatcgctggtgtggatctttcatcctttgagaaactgttggagaaccttgtgatcaaagttgtgccaatggaaaatttgaatggtcgcaaacgtgtcgaagaaggggacatttgtgataggagaaatggaagaggagttgatcttaacagaaattggagtgttgattggggaaagaaagaaaaggactatgatccatatgaggagaatcctggtatggctccttttagcgaacctgaagcccagatcatgagggaactatccaggtcgtttaaacctcatatttgggtgaacgtgcattctggaatggaggccttatttatgccatatgatcacaagaataccacaccaaatggagcccttgcgcatttgatgcgggcaggtctggagaattt

SEQ ID NO: 18388 - DNA, 208 bp, Sorghum bicolor
  unsure (1)..(208): unsure at all n locations
  Clone ID: LIB3478-029-P1-K1-E6
gcacgcggcggcccccccacccaccagggggccaaccaggcgccacgcgagacgaagcaaacgcacgagcgcgacagacggcgcaccagnaancggggccggcggacagggccccgncaccacggaggcccagaggcgancaagcaggaaccaggagaacaaccagaggaacgcaacggcncgcagagaaagcgcaggccaggaagca

SEQ ID NO: 18389 - DNA, 239 bp, Sorghum bicolor
  Clone ID: LIB3478-029-P1-K1-F8
tttgagttttgagttgcttttgctagatgtgttgagcctttgcctcttctggagggtctagttgttttctagcttttcaagttttgctagcggtgttgagcctgtttgcctcttcttgagggctagctgtgttttacttggttgtgtcgagccgttgcccatgtctttggggaccaagttgtggcttgctttactcattggaggctcgttgactacactaagtggttttgcttggtggg

SEQ ID NO: 18390 - DNA, 488 bp, Sorghum bicolor
  Clone ID: LIB3478-029-P1-K1-F9
catcattgtccaaccagagagggtggggatcgggcatggccctgcgtttgggtgtgttctgatgaaggatttcctggatgccctcgcaactcgtctgaagaagaacactgctgcgtatgagaacttccgtcgcatttatgtacctcctggcgagccactcgcgtctgaacctggagagccattgagagtgaacatactcttcaagcatattcaggcaatgctgtctggcaacacggctgtcattgcagagactggggactcgtggtttaactgccagaagctgaagctaccagaaggctgtgggtacgaattccagatgcagtatggatcaattggctgtgcagtgggtgcaactctaggatacgcacaggctgctaaggataaacgtgtcattgcctgcattggagatggcagcttccaggtaacggcacatgaagtggcaacgatgcttccatgggagcagaacaccatcatattttcggttaaac

SEQ ID NO: 18391 - DNA, 521 bp, Sorghum bicolor
  unsure (1)..(521): unsure at all n locations
  Clone ID: LIB3478-029-P1-K1-G11
ataattcagagccttatttcagcaagcttgttgcagaccagtagctcattgtcatcaaaggtaaaaatgcaccatgtaatcaggcatatggggatttggttggttaacaagacaggtcaaaagtttctcgttcaagcagggatggctttggatagtgctccaccagcagaagagtggaaggaagctacaaggatctccatcatgtctaatgatatcaaagagcttcttttctcaccggaatgtgaaatcctcactacattattgatccagaataacccaaatttgaacaagctgagttcaggttttttcaagtttatgccgtccttgaaagtgctggatctttctcacactgcaataacatcacttccagaatgcgagacattggttgcattacagcatctcaactggtcacacacacgtattangatattacctgagcggctgtggttattgaaagagttgaggcatttggatctcagtgtgactgctgaactcgaagattccctggaataactgctcaa

SEQ ID NO: 18392 - DNA, 384 bp, Sorghum bicolor
  Clone ID: LIB3478-030-P1-K1-A6
ggctaccgcaaggatgagatagaaaattgtgttaaaaatgcaacaaagtttattgaaaataaacagcaaccggatggctcatggttcggtacttggggtatctgtttcatctatgggacactgtttgcagtgaaaggactagtggcagctggaaaaacatacaaaaatagttactcaatccgaaaagcatgcaattttcttttatcgaagcagttaagtagtggtggatggggagaaacatatctttcaagtgaaactgggatttatgcagaggcaagcagtcctcatgctgtcagcactgcttgggcaatgttggctttactttatgctgggcaggttgaaagagatccaacaccattatatcatgctgcaaaagaattaatc

SEQ ID NO: 18393 - DNA, 367 bp, Sorghum bicolor
  Clone ID: LIB3478-030-P1-K1-B10
gaaaacatagcatctaggggaattctgctgaatgatttctttttatgcccattgattaggcacctctgcaagcacaagaaagctcttgaagcacatcaactcttcaataagtttaaaggtcttggagtttcactaaaaactggttcatataattctcttatccgtggccttgtggatgaaaacctgattgatatcgctgaagacttgttcactgaaatgaaaagactaggatgtggcccagatgagttcacttacaatttgattcttgatgccatggggaaatcgatgcggattgaggaaatgttaagagtccaagcggagatgcatcgtaagggatatgaatcaacttatgttacttataacacta

SEQ ID NO: 18394 - DNA, 410 bp, Sorghum bicolor
  Clone ID: LIB3478-030-P1-K1-B5
tgacgaaggcatcgaagaggtcaccgaggtgtaccctacacaagtactacctcgcactgtgagtctcgcagccactccagctacaccaaaaactgctccaataacgtcaacatccgtcggtgtaccagaatcttgtcctgtcgtacaagcttctccaaatatgcttttgcggtcatctctgagcaatagagcaaagctcccgcttccaaccttcacagaagagtaaggtggttgcctggttgtgacgggaacacatatttttacactgccactgtgcaatgtaaccaaggatcggttgccatgcctgtgcgctgtcgcgactgaggtgtggccaaatgctaaggaatgtgttcatgcttcggatgcttgcactttctgtgtaacttgtacgagttaatggtactggtact

SEQ ID NO: 18395 - DNA, 258 bp, Sorghum bicolor
  Clone ID: LIB3478-030-P1-K1-B8
gcgatgagatgaggaggaaggcggtggcgatcgcgcgcatcatggaggctgcgtgggaagcgccgggcgggtcggcggcgcagagcctggaagggttcctgagatgcgttgagacgtccatccatgggtgcgcgaggaatcaagagttttgtaacacatgtagccgtggaacctgcaataagtatgcgcgggaaatctgaaggcaaccgatgaaaaagctgtgagaaattcaaaaagggcatcagctgcttaccatcc

SEQ ID NO: 18396 - DNA, 382 bp, Sorghum bicolor
  Clone ID: LIB3478-030-P1-K1-C8
gactagttctagatcgcgacggccgccctttttttttttttttgtttaaaacatcgataggatcgcatgccagaagaaaatggctcatttgggtttatatacaaaggttggaaaaacatcaccgtttcaacacgtgtcttgctccaaagaatgcattgctccgctcatattgtgtacaaatctacctctttcttttcattcttattaggcgtggttggcatgccatgaacaggctacaccccactcaaacctcgagatcgataaatacaaaatcatagaggacatgggagtatgggaccctgccaaatgggaacaagtaaaacaatgacaacaccagaaatacagacattcggtggaattgatctcttttctttactttcac

SEQ ID NO: 18397 - DNA, 176 bp, Sorghum bicolor
  Clone ID: LIB3478-030-P1-K1-D3
gaggtctcgtgcatggttgatgccatcgatgcgcctgctgtcggtcagctcaaggagtttgagggccagaagcttgtcttttgcaccaacgtgggtcttgagctcgactagaccgaggacgtgaagaccaggaatgaggcactgtacgaaaagtttgagggttgtgcaaagtcatc

SEQ ID NO: 18398 - DNA, 303 bp, Sorghum bicolor
  Clone ID: LIB3478-030-P1-K1-F8
ggtgagcttaacactttcattgtatacaatgaacggaaaagagtcacttcatcagctaaaaggaagctgaaatcagaagacagatcattgcaccagactccagagggttcactccttgacattatgcgtaatgctcatgacctcctttctagttgcagcatagatattcccatggttaaagacaacagcgagtatttgcattctggaccgccatttctcatatttcttcatcctgctttaagcccattttgggatatcatacgacaaaagttcgtaggtggctctatttctaaaggttcagag

SEQ ID NO: 18399 - DNA, 327 bp, Sorghum bicolor
  Clone ID: LIB3478-030-P1-K1-G11
cccgaagttttcaatcagttcatgtggtcgctaggcgtccccgaggacgacgtggagttccatgatgtgtacggactcgacgacgacgcgttggatatggttccccagcctgtgctcgccgttgttctctgcttccccgatccaccacaggatgcaagttacccttcagaacaactcttattttctggagaaaaggaaacacaggaccaggtttactttataaaacagatcaaatcattgggaaatgcttgtggaactattgctctactccatgctgttggaaatgcatcttcagaagtcaatttagtgggaaattcatgcttggac

SEQ ID NO: 18400 - DNA, 231 bp, Sorghum bicolor
  Clone ID: LIB3478-030-P1-K1-G12
gagcgatgtgccacctgcagacagtcaaggagactgtgtaggagacttgtactaattatccaatacatgctcacaggaaacgcacataaacagcactaagaagctcatgcatgggacctgcaccatatgtgcatggaagtataatctatctaacagatggctcccgccctcatgaaggcgcgcggcgggtgtcaatcctacagaatctgatataagctgggcgcctcctat

SEQ ID NO: 18401 - DNA, 341 bp, Sorghum bicolor
  unsure (1)..(341): unsure at all n locations
  Clone ID: LIB3478-030-P1-K1-G2
gngccacttaccaaggaggggtttatatcaggcactggctattgcagcaatgtgtttgcaggagaaagctaaaaaccggcctcccattagggaagttgccgcagctctctcttacttagcatcacaaacatatgacaggaacaacactgctccccgccgtaaccgtgctggggcttcaacatcaagagttctggacgatcagattggccaggacaccacactggctaatcaacaaggagctcagatgtccatgcatggccagacaaatcacgtcatgcctgaagtgaaggaaacttcctggagtgggaaggncacatcgcggaggaaggggcagagtactc

SEQ ID NO: 18402 - DNA, 317 bp, Sorghum bicolor
  Clone ID: LIB3478-030-P1-K1-G5
gagaactttgagaaggctaaggacactggtaatatctcagcaacttacaacaccgggcacaatcacttcgagagttcattatttgcacgagcagaccttatcaggttaaagtcatcgactctcaatgcaaattctggacatgatacttcacctatatcactcgttcaactggactctatactgaacgcacgagactccacgctatttttgcccgtacatctatcaaagcagcaccaaacatatgtatggatatgatcgcaagaatatactgcactccctatgcccaactatgtgatcaaagcatagacaatggatgc

SEQ ID NO: 18403 - DNA, 449 bp, Sorghum bicolor
  Clone ID: LIB3478-030-P1-K1-H11
ctcacagcagatctccttctgggtccaggtctcggtccccacatgattgggcacctaggaacagaagcaagatcatggcaaatgtaggttcaactttaaggaggcatagtagatctccaccgaatcacatggctaaaggtagaattgtgagaatggcttcacctcagagacaacctggatatgatgatcgagctatgcgttacagtccactatcaagaaacaacacttactcccagcatgcttcaacatgggttgagggaaggaacggttcagcagtagatatttctgatgatcataataaaagatattcaaggagaagcccacctctgagaattacctcacggaatgacagatttgatgtaatggactcccaaggacgaccacggtctggagaattctaccgtccaacacaaggaagacttctttatggttatgatagggaaaataag

SEQ ID NO: 18404 - DNA, 359 bp, Sorghum bicolor
  Clone ID: LIB3478-030-P1-K1-H2
cctccgccaggcatgggccgcgggcgacggcaagggggaggaggaggaggcggaggaggatgttgtggtggcggaggtgaggcggaaggtggacgaggacgcgcacgtcatgatgggccgggacgtcttcgtgctctgggtgcgcgctggcttcgacgccgccttcgccatggggatcgtgctcgtgctcgaccggatcaccggggacgacgtcgacggcgacctgggagaggaactccttgaggccgtcacctcgtcggcgtaagcacgcgggatcggctttccgctcgtgggatcctcgtgatgtagtaaaatccacaaacagtttttctgatggttcttcttcgtcggcagagttt

SEQ ID NO: 18405 - DNA, 371 bp, Sorghum bicolor
  Clone ID: LIB3478-030-P1-K1-H7
gcaaagttgctctgcgtccctctggtaatgtcataccacacccacgttccaatttatatacccagatatacattcagctggcttgtcaagcccatgtggctaattataaaattcttgcaccgagctgcggacctcacgctggtaccatccgttgctatcggcagggatcttcaagctgcccatgttacagcagccaataaaatacgcctttggaacaagggtgttgactcagaaagcttccatcctcgttttcgcgatatggaaatgcgttcaaggctaacaaatggcgaaccagaaaagccacttatattttatgttgggcgcttaggagttgagaaaaagcttgattttcttaaagagtcatggccgac

SEQ ID NO: 18406 - DNA, 289 bp, Sorghum bicolor
  Clone ID: LIB3478-031-P1-K1-A10
gccgagtggcactgtaatccgcctcgtgacagtggaccaacgtcgtcttggggctacatcaagaaatggctgcagcgcgcgtggtcagcttcctggctcgcaagctagacgctggtgaggcacatcaccgaggtgcgccgcacgacgatcgccttgcgctcatgaacggccgcttactggcagatcagtttaccttgcattacatgttctgcgtagctcgacggcacactgtcacgagactctgagtttgattactggagccttttatctgacccggaaagcctgctgt

SEQ ID NO: 18407 - DNA, 329 bp, Sorghum bicolor
  Clone ID: LIB3478-031-P1-K1-A7
gaagccgcaacccgcaggacaggtcggcagaaagctcgacctctcgccgacggcgacatccggcggcggcggcggcggaggaggaggacaggatggtggccgagggaaagaggtggcggttcgcaatggtgtgctcctcgaacatgaaccggagcatggaggcgcactcgcagctgggccgcgcggggctcgacgtcgagtcctacggcacgggcacccacgtcaagctccccggtccctccctccatgagcccaacgtctacgacttcggcaccccctacggcgccatctacgacgacctccggcgcaaggaccccgacctgtacaag

SEQ ID NO: 18408 - DNA, 406 bp, Sorghum bicolor
  Clone ID: LIB3478-031-P1-K1-B1
tcgacccatgcgttcgactacgaggagctgatcgagcgagtcgagctggagaggctcgagcgggttagcagctacgagtaccacggagacgacgcgcccataatccatgactcccaccttaaggagcttgaggcattaaacgacaatcatgatgtaaagcaccatgacaatgagtgggaggactacatttgacatcagcatgatgcacaggatcactctaatgcacctggacagtgttatagcaacattgcgtgctagctcgctattgatgatgtaaaggccatacatcgggcgtgggcacctactactggaacacattgaggatatatacaggatgaaggggacactgtctgtatgtgggaagtcacagacacccggacctgagcagtgcatgtcgttgagaagg

SEQ ID NO: 18409 - DNA, 366 bp, Sorghum bicolor
  Clone ID: LIB3478-031-P1-K1-B12
tgaagtaacagaggacctaacgtgtctgaagctctcatcttcagaaaccgacgaccaccggaacaaggtctacttatgcgagctcacagatcttgcttacgggctggtccgaatgacaaaacagagctcgcatggaaatgcgatggttcccttggctaagctcgtggacaaactcgcggcctactacggacttatcgcaaacgaactgccacagatcacgttgctgacaaacaaggtctcttcaaagtacaaactggcgagggtctacttagactactacacaacacgattgtcgacaaatgtcattctcgtagtcgacatggcggagctcgtatcgtcttacaccatccatggtcacaaggtgct

SEQ ID NO: 18410 - DNA, 443 bp, Sorghum bicolor
  Clone ID: LIB3478-031-P1-K1-B2
gctgttcgccttcgtcgagaagtgggcgcagcagaggtggcccaagtcgagctacatcaccggcgaggtcgacgtcccgctctccctcgccggagccgccggccggtgctacaagctcaacctgttcaggctcacgtggcggacggcgttcgtggtggccacgacggtggtgtccatgctgctgccattcttcaacgacgtggtggggctcctgggcgcgctgggattctggccgctcaccgtctacttccccgtggagatgtacatcgtgcagaagaaggtgcccaggtggagcacgctgtgggtgtgcctgcagctgctcagcctcggctgcctcatcatcaccgtcgcctccgccgcgggctccgtcgccggaatcatctctgacctcaaagtgtacaaacccttcgtcaccacctactgaagtgtactgatgactgatc

SEQ ID NO: 18411 - DNA, 465 bp, Sorghum bicolor
  Clone ID: LIB3478-031-P1-K1-B8
gtgagtactacgactaccgcaagtccatctacggcgacgtcacgcaccgcgccctcctcgtcgacgccgtcggcaccctcgtcgtccccgcccagcccaccgcgcaggtgtataagagcattggtgagaagtatggagtgaagtactcagaagatgagatcttgatgagataccggcgggcatacgagaaaccatggggtggatcacggctcaggtatgtggatgatgggagacccttttggcagcacatagtcacttcttctacaggctgttcagatgcacaatactttgaggaactttatcagtactttatgacagaaaaggcctggaagttttgtgatcctgatgctgaaaatgtatttaaagctttaaggaaagctggtgttaaaactgccgctgtctgcaattttgatacccgtctacgaccacttatgcaagggttgaaatgtgaccactgtgttgatg

SEQ ID NO: 18412 - DNA, 476 bp, Sorghum bicolor
  Clone ID: LIB3478-031-P1-K1-C4
ggaagaactgaggtggagcaacttcacaaaattttcaagctctgtggatcaccttctggtgactattggagtaaactggaagtaccacaaacagggatgttcaagcccagccgccagtatagggtgtgcattgctgagacatttaaagattttccacaatcagctgtagttcttctagataacttgcttgcactacaaccagatgctcgtggaacagctgctgaggctctccgaagtgattttttcaggaaaaaaccacttgcttgcagcccctcaagcttaccaaagtgtcccccaagtaaagagtatgatgttagacttggaagggaagaagctaggaggaaaagaaaggcagctgagagtgtaagtggatttcgatctgtcgaaacagaagatggaaattcttttgcaagcgagataacaaaggttgctatgattagacctgaatctgctgttgtaaggaatgaagtacttgg

SEQ ID NO: 18413 - DNA, 255 bp, Sorghum bicolor
  Clone ID: LIB3478-031-P1-K1-D10
cgctgaacatgctgacccatctacctgatcgggccgttggcgaccgcgtgcgtctgcaccgggaatcccacgaaggcgactatggggaggcgcgcgtgctcgatctacgccagctgtaatcgcttcatctgataccaatcggacgccacgccgatcgtgtctaactaggagccatctgagaacagcctattctacaggtcagagctacgcgttgctctggaactacatgaagacgatcaccaacacctaaatcca

SEQ ID NO: 18414 - DNA, 539 bp, Sorghum bicolor
  Clone ID: LIB3478-031-P1-K1-D4
gccacagttcaatggagctgcacatgtatatgagcattttgtgaggccaatgattgtaaatcagcaagttgtaaacatctggtatattccaaagaaggatgaatcaggcaggcctgatgatgtaatttcagctgcacagagatacattgagcaaaatggatcaaaagcgtttgagaatcttgttaacaagtttaagagttcaaacccaaagcgctcaattctggaggaggtagaggttgaaaggagagccaggattcaacgagaatctgaagcaagggaggtgaatcctttcttcaatccagaatatcaatactaggcaacctgttttctttcactctccaggaatgtgctaggatcagtttggaggaagatgtctggatattagcactgcattttgcacctaccgagtcgataatattgtgtagctgtaaaaccatgcatgattgttgtaaatatgttgtagcgatggaactccttcatataatggcatgtcatgaatatttcatgttgctcaaaattatgtattcgtgacactggac

SEQ ID NO: 18415 - DNA, 477 bp, Sorghum bicolor
  Clone ID: LIB3478-031-P1-K1-E1
gacagcccaatgtcaccgaggctgccaggccggtctccatctccatgccgtggaagcaggggtgccgcgagtccatcaagagggcgcagtggggaggtgtcgccaaatgggcatatggtgcaggctccagcaaatgcgccgtctatcatcagctttgcagcagaggtgagaagggcgaaaaagggcgagaacagaattgaggaggcacacagattgcggctgctggacaatcggcatttgcagtggcgatgcatcaacgctcggacagatgcaacgcttctggtgcagagcttcactgctgagaaaacccttcacagtgcatggaaagaaatatcaagattgcgtgacatcgtcagcaccagaaggagcagactccagcttcaaaagcaaaaactcaagctgtttgctattcttaggggacagatgtcatatctagaggactggtctcacattgaaaaacatcattcaagtgcttta

SEQ ID NO: 18416 - DNA, 422 bp, Sorghum bicolor
  Clone ID: LIB3478-031-P1-K1-E11
ggaaagacgcgatggccatctggagctacctatgagggtgagtattctggtggctacgtattcggtgaaggcacctatacgggtccagataaaatcatctataagggacggtggaagttgaatcgcaagcatgggcttggacatcagacatatccaaatggagacatatttgaaggttcgtggattcagggagaaatagtaggtcatgggaagtacacatgggcgaatggggacacttacgttggcaacatgaaaagtggcaagatgtcagggaaaggaactcttacatggaaaaatggggactcatatgagggtaactggatggatggcatgatgcatgggtatggaatctatacatggaatgaatgcgggtattttattggtacatggacaagaggtctgtatgattggtaaggtaattt

SEQ ID NO: 18417 - DNA, 455 bp, Sorghum bicolor
  Clone ID: LIB3478-031-P1-K1-F10
gttaccatcggtaatgaatcaggttacagaaggcgtgtctgaattcaaaccaacaccacctgaaaaccgtgaattctgcaagaatgcctacagcgtacccaatacattattggtcaaattcagcgtagatgctattgatgatacagacatagttgaagatgtcctgagaccccgcattgactcaatcggtggacaaataaagaaagtaatactatcaggaacacatctaactccatgtatacaggatgtcaaatggcaagttggttcagaatacactccagcagatgccattgcacaaggattgaaatcattggctctcagtgaaacatgagtcctttcaagaactattgctgattggtttacatccctctaaattttgagttactcaatacatctgttggagttcagagtttcaaaggaatgcctttatcagctcttaactttccatttttgtt

SEQ ID NO: 18418 - DNA, 336 bp, Sorghum bicolor
  Clone ID: LIB3478-031-P1-K1-G6
cgagaacgttgccaggaacagctggatagtgatgctgagcacggatgtgaggaagatgtctgcatccttgctcaagtgcgctgacttatcaaccggctgtacaccatacgatgtactatccaagagtatagcctcaggcgtggatgtggactctatgatctgatgcgttggacataagggtgcagcaaggagcactgccttgctgctgatgactggtcatcgccgaagattggatggctcgagctgaagccataagcacctgggcatgacacatgccgagctgcttctcctactgaaactggatctgtacatggcatccctggcatacatgatgac

SEQ ID NO: 18419 - DNA, 355 bp, Sorghum bicolor
  Clone ID: LIB3478-031-P1-K1-G7
atcaggcagaacggtgcatgtaatcgagctaaatggccacttaaacagatacattaggccattgtgtagtgtttaaacaggctaaattgccatttaggaaaaaaaggattggagtttgaactttgaagtaattactgataaatgcatgtgactgctagcacattgccttctacttgaactgaaagaggcaacaaagttctaagaaccatcaccgcgtgagtgcttgaccccctaacctatttgcactttctttgtgttacacggcatatctgtaggtattggtggtgaccatgcctatgcacgtttttcattaacaggggcatatatgtaggtatgaatatagattgtctagaat

SEQ ID NO: 18420 - DNA, 174 bp, Sorghum bicolor
  Clone ID: LIB3478-031-P1-K1-H7
accacatagtctgcacgatggtgatccatatccgagaactgtcaaggaaagggaaggcgtccaatctgaccgacacgtttggctggggcgcattcatgctcgaggtggtatgtctccagataccctcttagctgaacatgtacaccagacggctaatgctttataactggttgc

SEQ ID NO: 18421 - DNA, 378 bp, Sorghum bicolor
  Clone ID: LIB3478-032-P1-K1-A5
gttagaccgccgatatcagacaccagagagcggcgaatatacaactcacttgtgggtgctgggacatatatgttcaggatagatgatgaacgtgttatagatgctactcgggctggaagtatagctcatttgatcaatcactcatgtgagcctaattgctattcacgtgccataaccattcttggggatgaacacattatcattttcgcgaagcgggacatagatccatgggaagagctgacatatgattataggtttttttcgagtgatcaacgacttccgtgttattgtggattccccaaatgccgtggtgtagttaatgatgttgaggcagaggaacatgcagctaaaatcagggttaaagaagtgaatttgttt

SEQ ID NO: 18422 - DNA, 371 bp, Sorghum bicolor
  Clone ID: LIB3478-032-P1-K1-A6
aaactgttgatgactatgacgagtattgtcactatgtggccgggctagttggttatggactttccagactcttttatgctactgggacggaagatcttgctccattcactgtcaaattcaatgggtctatttttacagaaaactaatataatcagggactatttggaggacataaatgagataccaaggtcccgcatgttctggcctcgagagatatggagtaaatatgcagataaacttgaggatttcaaatatgaggaaaattctgaaaaggcggtacagtgcttgaatgatctggtgactaatgcattgattcatgctgaagagtgccttcaatacatgtcagctttgaaggggtatgccattttccg

SEQ ID NO: 18423 - DNA, 495 bp, Sorghum bicolor
  Clone ID: LIB3478-032-P1-K1-C10
ctggccccacgaggagctgctgtcgagccgatggaagagggctccaagttcgtgccgctgaatgccgaggatcccatgtgcgggccgagcggcgctattgcttattggattcgagaaaggcgaaactgtcaccattcaggccttcttgaaagagcttgaaggtgaattcctcaaggtgattcattgtacagaggagatgacgaagcaaaccttatgggatgccatgcacactgagcagcctgatttggaagctgtcaagattgcaagatcactgcccaggatatgcatattttctggtctgactggtgaggagatgatgatgttcatcaatggcttgccagaaactggattggaatctcctgcttttgctgcgcttgttcctaacagtgcagaaaaaggtctcggccaggtgatcgaggaaataatgggcgaccatgagatgctgcacgaaaggattccaaataagaagaatctgtagttaaatttaagcagaat

SEQ ID NO: 18424 - DNA, 517 bp, Sorghum bicolor
  Clone ID: LIB3478-032-P1-K1-C12
ctcaccacatacagaaacgatagcacgtggtcgatcaaaagctcgagtgaccgattataaatagactcactacacacccggagtacgaaaccaacgatactgataacttgtcagcattccaagtaactactcaagtcatggttcggagtgatgaagcaggagctgcagtacctgcggagtcttctactggtacatggacaactgttgggactgatggacttaccagtcacgatcgttacaaagagacgatgctatgacatagagatcgttcctggcgacccagatctatatatctgggatgtggcttatccattagacctattcgaagagggttctgctactaacatgttgacttgcactgagggtaacgtatctgggtctaaagccttacgcgctttacgtatggaggatctacgaaatccccctgcttatgtaaaaacttttcaaggtgcgaatcaccgtgtccaagttgtaagggataagttgtaccaggtctgtcgtcctttattgggatgta

SEQ ID NO: 18425 - DNA, 511 bp, Sorghum bicolor
  Clone ID: LIB3478-032-P1-K1-C9
ctctcgcatcggcatcgcatgccatgccctcgtcgacctcgagatcccacaccgcgtgccacgtcatcttcttcctcctgcgcgcaagaaggagaaggagactatactagtataagtagcctggagctggtggagcaggggggccgggccttgttgagtgagtgaggtgcatgcatcgctgcttgcttcgaggttcgtcgggggaggaggatgaactggattcaatgcacgggatgttgagggaggtgaggtgagagcacggcgacttttgcttgcttcaagtgccgtgccgggcagcagtgtagcagaagaagaggatgatgggagctctgcaagtgcagaggaagagcaacaatggcgaccgcgctgctgctggtgctgctgctgacgagctctttccggacccgggctacgtcgaggttgatcctaccgggaggtatggcaagtacgacgagattcttggcaagggattctcaaagactgtgtaccgggccttcgacgagcaccgggg

SEQ ID NO: 18426 - DNA, 518 bp, Sorghum bicolor
  Clone ID: LIB3478-032-P1-K1-D12
gaggattttggtctatgaatatatgccaaatggaagccttgactccttcatctttggtgcaaggacaagcaggttgcatctggactggcctacgcgctttcagataattaaaggaatagctgaagggatgctttatcttcataagctttgtggactacatattatacatggagatttaaagccaagtaacattctcttggataccaacatgaagcccaagatttctgattttggcttatctagaacatataatccgggagtagatgaagagtttgctgaccgcatagtgggctcaattggttttactgctcccgaatgtcaggaaagacgtgttttctccgtcaagtctgatgtgtatggctttggagcattgcttctcgagataataagtggtcacaggtgcttttctcttgcaagtggagaatctggagatgatcatggatttctgaataagaagggcgtgaagttatggagagcaagcggattgattaagtttgtcgattctcccccaggcgatg

SEQ ID NO: 18427 - DNA, 243 bp, Sorghum bicolor
  Clone ID: LIB3478-032-P1-K1-D7
cgccgcccttatttttctacccctatattgatacccacaggctgaaacacatctacgaacatcacacaactccagaccatcgatgccgcgggaggttatactgcatcgactgttcctcttctctgacaagcacgaattctaaattacacctacttcacaaacaccagcggctgcccacactaacataatctatttcgaaaactacaatacatctataactcatgccaaccgaccgatgctaac

SEQ ID NO: 18428 - DNA, 475 bp, Sorghum bicolor
  Clone ID: LIB3478-032-P1-K1-E10
gcacagtatagcttcaaagaatgtagactactgacttttacagtctagggcaccctatgacctaagatactagcatgtccgggggctcacacatactaaatcaacgtgagaggaaccgaatcttattcactgatctggataacttatggcaggatccctatcgtagctcatgatgcatatctgttgacagctgaattgcacaagccttgcatatcatagcatgcaaggactgagctctacttgttcactgtgggacgttatataacgggtgatgatacaaacaatcatacagcatttgaaagatgacatgaggtttgatcacccaatgtgctttatgtcgatattcctttgagaccttccagatgagttttggtctgagcacgatattctgtaatgttaaccaagaatcccctgtatttgatacctgcacgtctaacaaagcattatatgtttatcatacagccaacatgactgg

SEQ ID NO: 18429 - DNA, 549 bp, Sorghum bicolor
  Clone ID: LIB3478-032-P1-K1-E12
cacgaagaacattcagtcttttgtttcctcgtttttttatttttatgggtatagctattttaaaagactctacttagagaagagtggagcaaagtctattggaacatctgccaacttgttagttgcagctgctgctggtgcttgcactgttatcgttacacagccattagatacagcagcttctaggatgcagacaagtgcctttggaaagtctaaagggctgagggaaactctttcagaaggcacttggatggaagcattcgatggcttgggcatttccatcatattgacttgcaatccttctattcagtacaccgtatttgatcagctcaagcaaaggataattcagaggcagcgacgcaaaaatgcaggatcagcagaggataattcccgagttgctctttctgctttctcagcttttctgcttggtgccgtctccaaaagtattgctacagtattaacttatccattaatcaggtgcaaggtgatgattcaggctgcagacccagatgaagatgatgacaatgaatctgaaaggccaagcaaatt

SEQ ID NO: 18430 - DNA, 323 bp, Sorghum bicolor
  Clone ID: LIB3478-032-P1-K1-E7
gagatggaattcctcactttggacggtggcaacaacgaggcctggacctggacggagacgatggaagattcggtgttcactttgggcagtggcgacgacgacgaggcctggacagagacgagggaagatccgccgcgccctctgctgagatggcagactggtgtgacactgaaagggttcattttctggcgtgttgacacggctcagtactgtcagtcaagtgcggggattcttctccgccttaccctagagcttgagggattcaatatcatccccctgccggggtcaatgcgcgtttgtgatgacttcatgttggatgcact

SEQ ID NO: 18431 - DNA, 454 bp, Sorghum bicolor
  Clone ID: LIB3478-032-P1-K1-E8
gcgctctgcaccgagtaccctaagattatgcagcagggcttcgcatacctccccggcggcgtgtgtgtatcgagtatgggtcgggcggtgtcctacgagcaggcggtggcgtggaaggtcctgagcgacgacgacaccccgcactgcctcgccttcatgttcgtgaactggtccttcgtgtgagaaccggcccctacttagtagagccagtcagtcgcctagcatttgcagctgttatttgaactctgtgcccatgtactactgtcgcttttgcctgcctgtgtccaggccacctatatgaaacgcacctccccccagttcatcccgtggaacaaacagctttgtagttcgtctttgcttgcttgcttgctatcttatgatgatggaacctggtttgctgcattttctcctgaaaattggttggaccacttaaaaataagggctttctgtagtc

SEQ ID NO: 18432 - DNA, 449 bp, Sorghum bicolor
  Clone ID: LIB3478-032-P1-K1-F1
atacacgatcaaattcaagtccatataataattaaaaagtgcatgatccttggtcttaggtatttaatacaatagcccacacataaagacaagtctagaataagcaataatagctagggaacgcaactagccactagtagaaagaacgtagatgcatgattagtagtttgtaattgggctgtgtgaccctacagttaactaaattcggtttaaacgaaattttgaattcgaaatatttcaaattaaaagtagaaaagcagaaaacggtcgaaaaatatcaaaaccattttctacttttacatttaaaatataaaacatctaaaatacgaaaacgaaaacgataaagtcggacaagaaaatacgaattcgatcggatcaaatatagaaagcgggtcagttcggttcgagatatttccggtccgttttcatccttatagccatgtatactt

SEQ ID NO: 18433 - DNA, 427 bp, Sorghum bicolor
  Clone ID: LIB3478-032-P1-K1-F2
aaatatggccatggatgaaaataatcaaataaatgctgcagcacacaacactgaaggccctgctaagactggaagaaaagttacaattaaccatcaacttcgtaagagaagagcaaaaggaaagcatattgatataaagttccctaaagaatttgcaaaagtgtgtggagaacatgctagtttatttaaaagtgagatcacagttcttgtaagaactataccactgcaagtgaagaagtggagggacatggataaggttcatgctggtactactgcagctgtttggagaaaactaaagcaaaagtttcctgagctttctgaagaagataaagattgtgccatgaggcaagtagagagtcaatataataatcggcgttaccgtttgcttcaagcttaccgaaacaacaagccaaggccacaacatgtc

SEQ ID NO: 18434 - DNA, 303 bp, Sorghum bicolor
  Clone ID: LIB3478-032-P1-K1-F3
cgggcgcgtgttcggacgcgtgggctatctatcagcaaagcacctacaccaacaaaaaagcaaggctcgatggcggcctgcatgatgcgcgccgtcagctctaagggcaccgccgtccagggcacaagcaactgccgttcctcaggacgccgtgcattataatgaggagccgtatgcgggacccgcaacgaagatcaagactcgacaagcccgtatcgaatggacgtggacagaccgtcgatcaggatgcctgacggaggaaggtcaagggcaagggcttgtaccatactcctcgacaagacc

SEQ ID NO: 18435 - DNA, 520 bp, Sorghum bicolor
  Clone ID: LIB3478-032-P1-K1-G4
ccccgccgctgctccagctggtggttctccaacggcaacgcccatggaagagacacagacaccaccaccaccaccacgatcagcagggcgacgacgaggaggtggtggtccgaccccgacggcagccacccttcctcttctctagaggaggacgactacgattacgattacgaggatgaggctgcgttctccggatttggctggaccggggagatattcgacgaagtcctggttctccaaagtatctaaaacgtacgggttccgtctaacagggatgcttacgttcatgtttgctggaacggggcttaagggctttttaatggccatggggatcccgctcaagcaggcgggcatattatctttgcttaagagaaaaggcaaccgcgacgactggtgggggcttttcttcaaaaaaaggtacatgtgggggaggagaccattccaagggcaagaacaccccgatgacaccactgactttgcgactggtggtcgacgcaatggatacagcaagagcagcagc

SEQ ID NO: 18436 - DNA, 201 bp, Sorghum bicolor
  Clone ID: LIB3478-032-P1-K1-H11
atggcgcatgtatacactgtgctatcaccgctgagtaccgctatgccttcgttaaggagtacctattacgccagtacttgagatcggaggcacctgagactgaatacggtcagatgaacatgtggaggacgccatccactacgtagtcgcgctgtggtatgaacaatctgcgtgccatcatctgaatcttgtagtggacac

SEQ ID NO: 18437 - DNA, 462 bp, Sorghum bicolor
  Clone ID: LIB3478-032-P1-K1-H5
caagcgccaccggccaccggcctccccctcggttgtcagattctggagcagccgacctcactcgtgcggtcgattcgggatcccctgcacggacgccaccgccggatgctcctccccgcacgggcgccgccactggctgctcctcaccgcgtgcacccccggcgccgctgcctgctgagctcttctcctcagcgccctccttctccttttgcaccgcctgggtgcacaagccaaaaaagcactgggggcatggacacatggacatggtagttctcttctcaatgcacaattcacacctctcacctcttcgttcggccaagaacttctctcgccttttcatgcataattctttctacctggatgagaatttgaagcggttccgtctggatttccacatgggcctaattaggttctggtttttttcaagggaggatttcctatgatattcatcttcggagaagc

SEQ ID NO: 18438 - DNA, 212 bp, Sorghum bicolor
  unsure (1)..(212): unsure at all n locations
  Clone ID: LIB3478-032-P1-K1-H9
agagcgcgcctcggcgacgtggtacgtaccagggcatacgctactcatgctagccacagacgctggccgtgcggggctcgacctgcgcgcccnggacgatcctgtgaggccgactttactccccggcaggcaccttcccggggagactaacagcagtcatgacaccaagcctcgctctgatagctaagggcctcaataagaccccgacagcc

SEQ ID NO: 18439 - DNA, 465 bp, Sorghum bicolor
  Clone ID: LIB3478-033-P1-K1-A2
gctctcgcaactggacaagatgagagggatgcttgaatttattgcttccagttctatcgcacagattctatcaaaacatggcagaattacaagttacctacagaagttccatcctgatgaggatggtccttttggtataacagctcaatgtttggagacattcataaaaagctgcgccggttactctgtcatcacatatatattgggggttggagacaggcatctggataatcttcttctaactgatgatggacgcctttttcatgttgactttgcttttatcctgggtcgagacccaaagccatttccaccaccgatgaaactgtgtaaagaaatggttgaggccatgggtggtgcagaaagccaatattatacaagattcaagtcctactgttgtgaagcatacaacattctaagaaagttcagcagtctcatcttgaatctattcaagctgatggaacgatc

SEQ ID NO: 18440 - DNA, 385 bp, Sorghum bicolor
  Clone ID: LIB3478-033-P1-K1-A4
ctccttcgcccgccgcgccgtgacctccatcacctcgcgctcgcggtcatcgtcgccctcgccgctggggagcggggcgaaccggctgataacgcgttcgacggagggggcgcccactgcggacggcttccccgtggcggagaagacgacggcggcgacgcgcgcgccgcagaggagggagagctccgaggccttctttaaaagccccgacttgcgcttggagaaggtcaccaggcggctcttggggtcctcgataaggaccagctccctgcgcctccgcccctggctagcctttcctgtcccgcgcggcgacaccatcgcatggcccgcggcgttttcttggtcccgtacgtactgctctctccctctctcgctcttaatagcg

SEQ ID NO: 18441 - DNA, 338 bp, Sorghum bicolor
  Clone ID: LIB3478-033-P1-K1-B2
gacgaacgtctggaacaagtcgtagagctagtagaaaagcttgcaaagctagattccatgctgggcatgcttgggttctcgctcggtgtattaacccatgtgttaacacatacgctctctcaagctattatagaagctgctatccaaatggtcaaccagggtgtagaaatcatgccagatatcatgggaacactagatgaatcaccacatgaagtgaatcatatcaagcatgctgttaaacaaactgttgacaatgcggttgacactgtgggttacactattggctctataattgaaactatgatggcaattctaatggctgatctagtggctgatca

SEQ ID NO: 18442 - DNA, 338 bp, Sorghum bicolor
  Clone ID: LIB3478-033-P1-K1-C11
cccacgcgtcactggacccgacctctaaaacgtcatgcatgcagctcccatctgtgctgcatcaagacaatcttagaggaaatcgggttcggatgaggatctgtgaagctgctggacatcaatcatctgctatacctggtagactgactaattgctgaatgtgaactcgtaggacaccgaagagagctcgtatgcttacacagtgaggctacaacatcgctccatacatgcgcgctctcatgcgactaatatcgatccagaagacgagaattgcatcatgtccatgctgcacgactgaagcactcacattctactcactatgcgaataacggctagaa

SEQ ID NO: 18443 - DNA, 369 bp, Sorghum bicolor
  Clone ID: LIB3478-033-P1-K1-C9
cttccagaatggtataagttcactctttttaatgagctttactttctggtagctggggggaccgtttggacagatggtcaacccccagcaatcgatgagaaaaacagtcctggttctattcagcagaagtcctcaaagaggggcactaaagacactaaacagggatctgttaaagataaccatgtcaacctgacagtggagcaagtacctcatggtggtcaaatgactaatagtgatgatcacagtgtatcagttcgcagcagttcatgggtcacaaatgcaagaacaagtcaatggactcaagtcagaagagccaattccttacttgatctcaaaggatggccctgaacatgttggcaagtttttgta

SEQ ID NO: 18444 - DNA, 488 bp, Sorghum bicolor
  unsure (1)..(488): unsure at all n locations
  Clone ID: LIB3478-033-P1-K1-D1
acttctggaccatctacttgccgtagaacctgggaataggggtaccgctgcatctgcccttgacagtgaattctttacaacaaagccgtatgcctgcgatccatcaagtctccccaaatatcccccaagcaaggaatacgatgctaagcttcgagatgaagaagctaggaggcaaagagcagctgctaaaggacaggaagctgaagctggacggaggaagcaacttcctgcacccgatggcaataatggattgcagcaccgccgagttcaggtgaatcccaaaagcagcagttacaagttcactccaaaggaggatgctgtttctggatttccaattgatccgcccgcaagagctgcagacaatggttacccttagcgtgttcctttgatgcaagctggccgttcttcctccactctgggcagatcaagtggaatggatccaaaggcccanaagatttcacacctnccaaattattactgctggagat

SEQ ID NO: 18445 - DNA, 136 bp, Sorghum bicolor
  Clone ID: LIB3478-033-P1-K1-D2
aacggttgctaataccccgttcgacgcggacgcggacacggcgctgagcgtggccaccgagatggtggcggagctggacataccgacacagtaccacatgcagagatcagccgggtgctgcgtgccaatcacggcg

SEQ ID NO: 18446 - DNA, 283 bp, Sorghum bicolor
  Clone ID: LIB3478-033-P1-K1-D6
gagaaaaaaaaaccaaagtagacggaatccaaaaacaccatgatacgggcccaaaccgataaaagtacctaagccctttatacggcgggccggcgggctacctgaccggtgagtccccccgcttctacccatggaactcctctttgctgtcggccaacccaaagacctgcgccaagaactcgaaactgaaggtgttccactcccgttgggccatgctggtaactctagggtgcgtattccccgacctcgttgaccatggatgtgacacaaaagctaaccccga

SEQ ID NO: 18447 - DNA, 202 bp, Sorghum bicolor
  Clone ID: LIB3478-033-P1-K1-D9
gagagagagagagagagagagaggtgcccagggctgcctaccgtgagaccgatgaataagtgcccatcacagatggagctggaggacttactccatggacgataggacacaactgcggagacaacggctgcacgtgccgatcacaaacctgtacacgacgtttataggctgctgccggtctgaacaagtggtatgttatctc

SEQ ID NO: 18448 - DNA, 181 bp, Sorghum bicolor
  Clone ID: LIB3478-033-P1-K1-E4
ggtaacggaggcgtgcaaagactcctggacgcaaaggtcatcagagaagtcatgtacccggaatggttggcaaatgtggtcttggtccccaagaaaaatggcaaaatgagaatgtgcatagattttacggatctcaacaaggcttgtggtcaaaagacatcaactataatccttttttcat

SEQ ID NO: 18449 - DNA, 475 bp, Sorghum bicolor
  Clone ID: LIB3478-033-P1-K1-F10
tgcttgcctacctgtttggcatgtttgttccctggagaattcttgctgttctaggcattttaccttgttcaatcctgattcctggactgttctttgtccctgaatccccaaggtggctggcaaaaatggggaagatggaggattttgaatattcactgcaagttctgcgaggatttcagacggacattacagcagaagtaaatgaaataaagagatcagtagcatcatcaaggaggaggacaaccgccataaggtttgctgatatcaagcagaagagatacagtgttccccttgcgataggaatcggtctccttgtcctgcagcagctaagtggtgtcaatggcattctattttatgctgggagcatcttcaaagctgctggtattacaaacagtaatctagcaacctttggtttgggggctgttcaggtgattgctacatgagtgacaacctggttgactgacaaagctggtcg

SEQ ID NO: 18450 - DNA, 377 bp, Sorghum bicolor
  Clone ID: LIB3478-033-P1-K1-F4
cccacgcgtacgctttgtacaacgcccttcgatagatattagttcttgagcttcttggtttttgcaccaaaggacaagcaggatgtcttgcagctgcggatcaagctgcaactgcggctcaagctgcaagtgcggcaagaagtaccccgacctggaggagaagagcaccgcggcgcacgccaccgtcgtcctgagtgtcgccccggagaagaaagctgctgccaagttcgaggccgcggcggagttcggcgccgagacctcccacggctgcagctgcagtgacagctgcaagtgcaacctatgtacctgctgatcgcccgaacaccaacacgccgaggccgaaggcgcggagaagaatagcatcaacgcgttggcgg

SEQ ID NO: 18451 - DNA, 372 bp, Sorghum bicolor
  Clone ID: LIB3478-033-P1-K1-G7
ccagagcaagaagtattttgctcggatgactacaaaagtaggcttttgtagggtaagagtgccattttcatcttttcggccagtaaacccacaagatcctcccctcgacccttttcttgtgcatacactaaccattaggtttgaaccaaaaaggcagagacctggtgatggatctcaaaatgctagcgatcctcgaaactttgagctaaaattggaatacatcaaagctttacctactggtcaagaaacagacttcatattggtgtcatgttcaggttctggaattgaatctaacagaagagaacaagttctcaaagccaagaaggctggagaagatgcacttgcggggtcaggccttggatatacaatcgt

SEQ ID NO: 18452 - DNA, 433 bp, Sorghum bicolor
  Clone ID: LIB3478-033-P1-K1-H7
ccggatctctcttcgcgcgcggcgtcttccccatcggcggcggcggcttcttcaccattctctacggcgacgcgtccacctccaccagcgtcgtcgtcggcgtctcttcatcgactggggtctgcatcgacactagggggcggcggcgtgaaccactgtgagcttattcctcttcgctcactactttctgtgatactagcgtcgatttcgacctatggttgcgtagcaattgtctgcgtgtaaaattccgtaagtcggcttccatttgctagtggtggcgtgtggtgaggaacggtccgtcgacccatgttgcggagcaagtctccgtgtgaaatcccgaccccccaaccgccgtcttgatgcagatcttcgtgaacaccctgacggggaagaccatcacgttggaggtggagttctcggacaccatcgacaa

SEQ ID NO: 18453 - DNA, 221 bp, Sorghum bicolor
  Clone ID: LIB3478-034-P1-K1-B11
gtctcaaactacaaaatctcagatattattgctatctggttggatgactcatgggatgacagtgacagtcctcggcaagaagatcacgttctgagccacctttcatgtcgctgaattttacggtgctcaggagttggggctgaagagcgtaagagttcagggttgatggaaaatatacctcccagcgatttcatggtggggctgagagcatgtagtgaaat

SEQ ID NO: 18454 - DNA, 216 bp, Sorghum bicolor
  Clone ID: LIB3478-034-P1-K1-C2
cgagttagtaatcacctcactactcttcaagttatgttaccaaacataacagacggtgggtctctgtccaacattcttgaacagtgcatgtattgtgcaatgggtcttggcttagttggataggatttccgtggcctccttccaccaatcttagaaatgcggatctaacttattctcaagaattgagtcgcggtgaaatttcacgtgctgatcaca

SEQ ID NO: 18455 - DNA, 346 bp, Sorghum bicolor
  unsure (1)..(346): unsure at all n locations
  Clone ID: LIB3478-034-P1-K1-G4
gcggtgcctcgctgtctccacacacacctcatccccaaccatggcgaacgccgccgacgacctggacctcctgctctcgctgngcgaggccgtcccggagacccctgccgcctccccccgcgccgctgccgatggccccgtgtgcgacggcgccttcacaccaccaaggacggcgcgccccggcggcaccgacatgtccgttttccgcgacgtcgtcaaggatnacctcgaggcaacccccgaaaccacatccncgctggccaatcgccccaagcggcccaaggccaccgaaaccctcgtcgacatatactccggcctccgcatcaagcacctcacgctctctccc

SEQ ID NO: 18456 - DNA, 177 bp, Sorghum bicolor
  Clone ID: LIB3478-035-P1-K1-A12
gctaaccacaccaaaccccccggtcatggcgctcgcgtccacctgcgccaccgcgcccgctgccgagctcaagaccccgtcgttcctcggtgccaggcggcgctcgccaatgccgccgcgtgcaagcccgcgccgcgccgtcgtcgtgcgcgcgggcgcccagagtgggtccgctaa

SEQ ID NO: 18457 - DNA, 505 bp, Sorghum bicolor
  unsure (1)..(505): unsure at all n locations
  Clone ID: LIB3478-035-P1-K1-C11
caaatggtgaagtctcaattaaagagaagattttggatgagggtgacaggattttgtcagtaaatggccttgtgaagtcacatgttttgaatggactttgcacagctgtgtataatgacaatgcgatgaacattaaatatcgctacaaggatgatgaaatatcatttgtccccagcatctcgttaccatccaatactctgtcatttgcattcaagcgccaattaacgcctttggacaagttgagctattggtacaattttgacacaaactactggagcgccatctacaaacacaaggctaacaagcatctcaagtggaaagctggctatgagtcagacaacaggcttggatgggcatcgctttgggttggagatgctggtggcagtacaaaggaggtgccattcaaagccaaagttcgcctcacgcttaaagttccccaggacaatatgcggaattcaacctgagtgtttcatgtgaagaaaagatgggattnttagtttctatg

SEQ ID NO: 18458 - DNA, 294 bp, Sorghum bicolor
  unsure (1)..(294): unsure at all n locations
  Clone ID: LIB3478-035-P1-K1-D3
gaccgcgaggagcacgagtaccggaaggtgcccaacggcctgccggcggtcaacactatgacgacgtcgtctcttcgagagctgtggaccttcgattactagcagtagctgtccaaactaagagtgtgtgtgtctacggtgtaccaggagtactgttgcgtgcaactgtgcgtgctaatccaattccaacgtgtatatatatctgcagagctgtgtttgtgccttacatgcatatacggacgctgagacagtgtaaaactgaagatcaagtcattgagccactgtcncgcnnna

SEQ ID NO: 18459 - DNA, 372 bp, Sorghum bicolor
  unsure (1)..(372): unsure at all n locations
  Clone ID: LIB3478-035-P1-K1-D4
gatcatgcagagcatccagagaggcagagatcctggagtgatgatctacatgctgccccagggccctgggagatcaaaggcaaagagctaccatggttggggaactcagaatgaatcattctggtgttgctatggcactgngatagaatccttctccaagctgggggattccatttactttgaggagaaaggtcaaaaaccagcactatatattgttcagttcataccgagcacgttcaactggaggactacaggccttactgtcacacaaaaactgatgcccctcaactcaatgggatcagtatcttcaggtctcattctccatatctgcaaaagacagacgggcagtttgcgacattgaacgtgagaata

SEQ ID NO: 18460 - DNA, 404 bp, Sorghum bicolor
  Clone ID: LIB3478-035-P1-K1-D5
ggagccttgtacccaacaaggcacaagggcccgtcagcgacgacaacctgcgcgacatggcctacctgagagcggtggtaaaggagtcgctccggctgcacccgccgacgccgatcctgacggcacacttcaccatggccagctgcagcgtcgacgggttcgcggtcccggccggcgtgggcgtcctggtcaactcctgggccatcgccacggacgcgcgcttctgggaggacccggaggccttcgcccccgagaggttcgtcctcgacggcggcagcgcggcgggcatcgacttcagggggggccgacttccggctcctgcccttcggttccgggcgcaggatgtgccccgggatgaactttggcgtcgcgtccgtggaggcgatgctggcgaacctcgtgca

SEQ ID NO: 18461 - DNA, 455 bp, Sorghum bicolor
  Clone ID: LIB3478-035-P1-K1-D9
ggctttccccccctagattctctctcgcgcgaccgctttcccttctcctggccatggcccacgagcgggagccgctcctgcagcaacgacagaccggcgtcgggcaatgccgccgccggtgctaagggctcgtcctcggcgccggcgccggcggcctctgccgcgctgccgtcgctggctaggaccgtgctcaagttcctgatgtgggcggtgttcctcacctgggccgcggggatcttcctgtacccgaccaagcccgtgcaggcagtgttcacgaagtgggtcaggctcagcaaggagtccatgttcggcatcgccgggggtattttcctggccttcagcgcgcccattctgatcattgcgcttctcgcatatgtctacatctcattcttcccgagtgagcgtgtggtggaaaaaaagaagctgcggtcactgagtttcaagcctctgacttt

SEQ ID NO: 18462 - DNA, 399 bp, Sorghum bicolor
  Clone ID: LIB3478-035-P1-K1-E2
ggcttcttcttcgaggccgtgcggcgcgagtactaccacccgatccgggtgaacttcttcttcgcgccgtggatcgcctgcgcggatgctagtcatcggcgtgccgccggtcgttgccagggagcccctgccgcagtggctctggtacgcgctcatggcgcccgtgctcaccctggagctcaagatctacgggcagtggatgtccggcgggcagcggcgcctgtccaaggtggccaacccttccaaccacctgtccgtggtgggcaacttcgtgggcgcgctgctgggcgctagcatgggtctcaaggagggccccggcttcttcttctccgtcggtctggcgcactacaccgtgctggtcgtgacgctgtaccaacggctccccaccaaacgagacgc

SEQ ID NO: 18463 - DNA, 419 bp, Sorghum bicolor
  Clone ID: LIB3478-035-P1-K1-E4
aactctatatgggatctttattcaatataagcgttcagctcttatcaactgaacatttcaattcaccgtgaacagggggaaagaaatgagagggtcctcaccgctcaccggcttggagtaactgagcaggaatgaagcccatggcatccctccgactcaactcaaggtccggattcgaatattaagcatccatggacgccgatgatggtggggagttatctcagtctatactacagttgatactttccattattttcatccgctataatatagtcacatttggaatatgtgccaacttgttcttatcctctccagatttgcatctcttctcaagcactggtccacagtttaaaagggtcaaggtctgcaatccggtgagctgttggatgcatgcaagtaaagttgtcataaaagaagtc

SEQ ID NO: 18464 - DNA, 419 bp, Sorghum bicolor
  unsure (1)..(419): unsure at all n locations
  Clone ID: LIB3478-035-P1-K1-E5
cgtgagtggagtcattcaatacgctcatgctgtcgttaaggacccatcccgaggtggcaacatcatgatttagtatctgcagatccctacgcgccacatagtgaacgatcagctactgacaatcatgacatgacttgccatactgtcagtgacctagaggtggttgacagggtcactgaatattcatagagctggaactcactgaatttcanaaagatttgacttggtctgttaattatcctgttgaaagataccctggcacacagggtccctactactgtgctgactgagcagacagaatcattgggcgggacatatgatattgctactacagcgttgagggaagatgtggacttaccattaggcaaacaaacatgtaggtaacgcctagtcaatcccagaaccgataggcacctaat

SEQ ID NO: 18465 - DNA, 431 bp, Sorghum bicolor
  Clone ID: LIB3478-035-P1-K1-F10
atcgactacctgaagcagctgcaggcgcaggtgcaggtgatgagccggatgagcagcatgatgatgcccatgggcatggccatgccgcagctccaccagatgtccgtgatggcccagatggcgcagatggcccagatggcgcagacgatggcccagggcatgatgaacatgggctccctcgcgcagcccgggtacgcgggcctcacgccgcccatgatgcacccgccgccaccgttcgtccccatgtcctgggcggaccctgccgctgcagccaccacctccggcgccggcgccggccccggtccagcagccgccgccgcctcctccctcgcccagcatacccggcggcggcggcgccgccgtgccggacgccttctccgccttcctggcctgccaagcgcagcaaagcggacagcagcagcagccgggta

SEQ ID NO: 18466 - DNA, 152 bp, Sorghum bicolor
  Clone ID: LIB3478-035-P1-K1-G5
aaattatgtataagcttatagacatatagcagctggattatggcttttagtgactctgtgtgtatgtggtgtggtgtgaatccttgagtgtgcatgtgtatttatttaagataaagctccgatgccattcatgcacggtaccatgcgagatc

SEQ ID NO: 18467 - DNA, 184 bp, Sorghum bicolor
  Clone ID: LIB3478-035-P1-K1-G6
cacgtgtgtgaagcctatagacatatcaaaactctattatggcttttacagactctgactgaatgtagtgtgcactgacactgtgtgggggcatctccaatcagtcgggactaatctccctccccattcaatcactattccaccctagatcaatcatctcatataacaacccgccgttacaaac

SEQ ID NO: 18468 - DNA, 325 bp, Sorghum bicolor
  Clone ID: LIB3478-035-P1-K1-G7
gccacgtgtaccgcatggtaacactgacgagcgcactgtgaagctcgcgtctacggcgtggtatagggcatgcgatggttcacgcgacccataccagatgccatacgatatgcctcttgatacgactatgcttgcaaggtagatctgaagctgcaactgacacatccaatgatagatctattgctgtgtctctgttactgtcactggtattcttacttgactacttaccacaaatttaatcagcaatatcctatgctgcacagcatggtgtataaccttgtgtatgaccgaatgccaggcataatgagacatgcactggatcatg

SEQ ID NO: 18469 - DNA, 423 bp, Sorghum bicolor
  Clone ID: LIB3478-035-P1-K1-H10
gtcctaacgtgctatctactgcactgaagggaggcatgaatagctctaactaacaaggcattgactaaaggatcagcgctatatatatgtactaaaggatgagcataacttcatacaacagtatgggcaggctagagcaccaaatcacgggggttgtgagatcctgaaataatgcatccaatacaagctcaccatcgcataccttgtattgtgtatatcatccaagggcccaatgataccaagcatctgacagaccaagctactaccatgatgcaccagaataaacgccgagagggaagggctatgaccaccaatcgctgagcatgagagaggcatcaactgtgtactgactaatgaccctgaccgccatagctgaagggtactactggacaaaacctgcagggaaggatgttatcaaggtca

SEQ ID NO: 18470 - DNA, 185 bp, Sorghum bicolor
  Clone ID: LIB3478-035-P1-K1-H2
gcgcgagtgtggcattcgccagacgctccccgtggtgccgctgttcgagaggctggccgacctgcaggcggcgccggcgttcgtggagaagctcttttccactgactggtacattactaccctgcgtgccatcctttggatcttttcgtggacacagactaggttccacctccccgtgtggctgg

SEQ ID NO: 18471 - DNA, 401 bp, Sorghum bicolor
  unsure (1)..(401): unsure at all n locations
  Clone ID: LIB3478-035-P1-K1-H4
gtaagaaatgggaagaacacactctcctggaaggatgtttggctgtatgagaaacctccttgtgttttattgcctgatctcttcaaattctgtgaacaacaaaatattctggtgaatcaagttagagatgacttacagagtatttcatttactagatggttaatggatgctttgctcacagattggcaaacggttcttgatgatatgagaaaactgaatttcacttctgaggaggatttggtttcctggaaatctgggactcttggtcgatttagtgtgaaatctgtatacaatgctatgactgcaaattattctggtccctatcataggaaagtctggaaaggaaaagttccttgacaaattaatntttttttctctgggtattgatgaataatgcaatc

SEQ ID NO: 18472 - DNA, 363 bp, Sorghum bicolor
  unsure (1)..(363): unsure at all n locations
  Clone ID: LIB3478-035-P1-K1-H6
gctctacgcgatggcgtacgggaccgtgcccgtggtgcacgccgtgggcgggctccgggacacggtggcgccgttcgacccgttcaacgacaccgggctcgggtggacgttcgaccgcgccgaggcgaatcggatgatcgacgcgctccatcactgcctcaacacgtaccggaacttcaaggagagctggcgcggcctgcangagcgcggcatggcgcaagacctgagctgggaccacgccgccgtgctgtatgaggacgtgctcgtcaaggccaagtaccagtggtgactggtgagtgggtttaactggcgacgccgacgccctcctgtcgcgggacctggacgcgttggggcatgtatttc

SEQ ID NO: 18473 - DNA, 407 bp, Sorghum bicolor
  Clone ID: LIB3478-035-P1-K1-H7
ggaattcattgtctctgtcttggttgttattggatggatattggttactgggacgtttatcctgtgcggtgtctttcttcttctgcacaatgttgtttcagatacttgtgttgcgatggaagagtgggttgctcatccaacagaacacaccgccctggatgaggttatcccctgtgtcgagcctgccacagcaaacgaatccctgtacagaagcaggcaggtcaccttcgagctggtgaacgtggtgaaccaggtgatcaccaacgtgtcgaatagaaacttccctccacagttgacacctttctactacaatcagtcagggccattgatgcctctgctctgcaatccattcacacctaatctgagggaccgcaactgcaccccgagggaggttaccttgtacaatg

SEQ ID NO: 18474 - DNA, 434 bp, Sorghum bicolor
  Clone ID: LIB3478-035-P1-K1-H9
gggtaggagctgctatagatgcatagtgcatgctatgcactaagacatatactacacatacacacataatgaagagaggtgatcttgaaaagctcaaacgcctcatgatgaatcaatgcactatcacaaagtatctcgtcatgggtgctacgcactggacaacgtatacaaactgtgcagtgattcattgctagatacaggagagagccgccttaaccaataggtggatcctgtgaatgaaatatagcgtgggatctcgcaaagagctatatgagactataccactcacactaacttgttgatcttgaagaaatactacacgaatgatgcatcgggccagaagtatctaacactgatgctcaggcagctggagggcagcacatgagaatatgcatatagctcagcgtgcggcctatgcagacactgtatagaat

SEQ ID NO: 18475 - DNA, 426 bp, Sorghum bicolor
  Clone ID: LIB3478-036-P1-K1-A11
ctccgctcccctctccggcatcgcgccccgctgctgctgttgccgttccctccccgtgcggcctactccggcgaggacaccgcagcagccgaccaggagccggccccggcggccaccaagacggccaccgtggacgacgacttctagcagcgcgtgctacagatcaagtcccgcgtcgggcccaagaagcgcggcgcgcgcaagaagaaggccgtgacgttgtccgcgtccgtcaacgccgagacgctcccgcccgtgccgctgcgggagccccggtcggcgctcggcgcgcccgtcgagttcggcttgaccgcgtacagcgagcggttcaacggcgcgctggccgtggtggagctcgccgaagtgctgctatgtgagctgggatccgggcaggtcctgttgaagtgctaccagtcggtcacgctg

SEQ ID NO: 18476 - DNA, 376 bp, Sorghum bicolor
  Clone ID: LIB3478-036-P1-K1-C10
agccctcacaccgcgccgtacgcgcccggatgcacatgcaggggctaatactggaatcgaagcgtatactgaccgaagggaatgacctgcgtaaggaccctccgacatcatgcatcgcaggtcctgcttgcgaggatatgtgccactgccaagcgaccgtcatggatacttcagatagtacatatgctgcaagtgttatagtagcgaacattcatttatggacagactaccggttcaagtcttctaaggcctgttgcacgacgaatgtgttagatcctaacatcaataggaatgaaagcatctgtctcgacattcttacagtgcatacaagccttgctctgacaagccataaggatctgctttatatttgatgaat

SEQ ID NO: 18477 - DNA, 247 bp, Sorghum bicolor
  Clone ID: LIB3478-036-P1-K1-C5
actagttctagatcgctagcggccgcccaagacaacactgccgacttcttcggctagccaccggacaggaagaacacagtgccagcggcgaggagatagctatgaagggtacggccaccactacagcaggtcgttcatgcttgactgggcataaagcgtcatcctgactacgcatccttttcaagacaggttcatggagctggcgccaactaacccacccacagcttggcacgctcttgactagtac

SEQ ID NO: 18478 - DNA, 134 bp, Sorghum bicolor
  Clone ID: LIB3478-036-P1-K1-C8
ctctcgacgaggactatctatccattaatactatcagcgaggattacagatatgacgatccagacgaacgtgctgacaaaaagaagggtgactatacagctcgcgcatatatcgcaaaggacaacttatcagac

SEQ ID NO: 18479 - DNA, 484 bp, Sorghum bicolor
  unsure (1)..(484): unsure at all n locations
  Clone ID: LIB3478-036-P1-K1-D10
tgcagatatggctgctaagttagcctcagagcttatgccgtctgatgttgccaaggcattgtggggtacaaccaagagttcttcaaagataaataaagaagttcaggagcttttaaggcttacgttaagcaaggcccgagtcaagctgaccgagaataccatttttaatcggatcattatggacactaacagcacggatccatttaatggtctctatgtgggagcatttagtccatatggaccagaaattgtgcagctccgtcggaagttcggccactggaatagtactgatgacgttgagtttttcgagtatgtcgaagcagtaaagttgactggtgatctgagtgtccctgctggccagataacgttccgtgcgaagattgggaagggcaagcgacttgagaatcggngcgcgtatcctgaggaattcggtgtggtgctagttattaaggtcagggtagaatagctcagcctggattcaaaa

SEQ ID NO: 18480 - DNA, 451 bp, Sorghum bicolor
  Clone ID: LIB3478-036-P1-K1-D2
ggtttctgaacctgttcgccctggaatatcaagtggaagaaatgccaaggggaaagtaatctgcttgaacaacacaggctttgctctgaggattggttggctcaatgcaatccgtgagtggcaggaagagtttgttggtaatatgagttctagggaatttgtcttacctgaaaaaagttctgcacatgtatcccgactgcagtttagtgaggaaccaacttggatccctgctgctgtggagtggagattggatggcttctcataaagcaataagggttaccactctgttgtcacatggacacgcatccagtatgggcctaagatcaccacatcatgttcaagcctgtgcaatggtttcttgctatgctacctgcccaaattacgcaaagttctctttcgcaacatgtgaacaccaatacctaagtggacctgatgcaatacaccacctgca

SEQ ID NO: 18481 - DNA, 193 bp, Sorghum bicolor
  Clone ID: LIB3478-036-P1-K1-E2
ctgaaactggtccataatcaggtcgaagacctgatgtttgagctctctatgtggcgctgcaatgatgagcttcgtgctcgagccgaagaagtccaaagtcctccagcttcaaagaaagttaccaagttttccatagaattttggaagcaaattcccccaaacgagccttaccgggtgatccttgttgctgtag

SEQ ID NO: 18482 - DNA, 190 bp, Sorghum bicolor
  Clone ID: LIB3478-036-P1-K1-E4
gaattaattcatcactggttcatatattacacatcaccaagtccctacagcgaggtgtttggactgcagcggttcctccagtgcgagctcatgcacgtgcgctaggccatgctcgccacgctctgtgccctttccgtggagtggctcaccggcgtgacctgacacgacgccggcaaagttgatctactgg

SEQ ID NO: 18483 - DNA, 362 bp, Sorghum bicolor
  Clone ID: LIB3478-036-P1-K1-F11
tgcacagatcatagatagagggaaggcctagaacatggacactgtatctctcggtgcatgaccagctgtatatatggttcgaggatgactacgctctgctacaagctataggcggagaatgttacactccatcgaacaagtgaatgatacaccaatagattgcactccatttgtctaattaggcacgagcacatgtcactctgtggtgcaagccatgcaaatcctaatgacacagatacttccctatcattggcgcctgcacagatatcaaaaaggtatgctacaatcacatgcacgaataaggatctctatctgactgatcatgggagttaacatcgtacatggattaccgacaactaagg

SEQ ID NO: 18484 - DNA, 269 bp, Sorghum bicolor
  Clone ID: LIB3478-036-P1-K1-F3
atagcgcgtctacgccttcagagtacatgaggactggcggggcttactttattaatgacctaaaccaaagaggttagtagcaatctaaagtgagtaacatttaagaatgagtggtgaactcacaaggcactacattgtattatgcaccctggtatgaactgatacatgtggaacactagaatcaagttatttatagatgctgacgtacctccgcaaagatggtgtggatctgtcattcaacgcgtgcatctggatacagtgcagatata

SEQ ID NO: 18485 - DNA, 213 bp, Sorghum bicolor
  Clone ID: LIB3478-036-P1-K1-G12
gctattgtatcgggggtccaagagaggaggatcagctcatgctcacagcatcatctaccctgtcccccctggcctcaagggactcgaacttatgggcgagcaaaacacgctgccaatggctctgctcggaaaactttcatctattaccatgctgaaactagtcagttgtaaagatacaacaggggatggatgtgatccattcatcacattcaa

SEQ ID NO: 18486 - DNA, 576 bp, Sorghum bicolor
  unsure (1)..(576): unsure at all n locations
  Clone ID: LIB3478-036-P1-K1-G9
cgctgacatnggnnatagcaccnnnacgtgtatgnncttacannnctcaataannttgctcttcatntnggtttgcattttccacncnntgcaatanannttgtagagtgtggatgngnnaattaccanncaagtgagtagaaaaatagngnaatccatgnntgtcatacgnnntaattgtatnnntcttgatattanncttccatanannttgtgcagtttggatagggtgccccagcttatatgtcgcnnatggatttcagtgnnatgccattgcataaagtanggatgtgactaaagnntttgttagtgaacctaaagtcttggttgggaccttgttctttaccatctgtatttaaccaggnntaaccagttcgtcattatttcatgcgaatcaaatgaaaacacntnntttatatgaatcaaacctgtttagnaaattttagctgtgcttgccactaataaaagtcatggtatttatttagtagaacaaatggctgcacatagtattttctttccccaatgcagtagttttactgaagtctaccatttaagttttttcatgaggtcgaaaaa

SEQ ID NO: 18487 - DNA, 369 bp, Sorghum bicolor
  Clone ID: LIB3478-036-P1-K1-H5
cgcctgaggtcatcgcgcccatgttcgcggaggataacctgtgtttccactatctgtagctttacacgaacgaaacactacaagcacggtgtgcactccgacgtgtcaccaaagccctactgactcatgatcatgcatgagatactcgataattacacacgactattaccgttccttcaattccaatgatccagcattaaattagtccttgacatcgtatacccatgaaactgactacagcaagacgatcatgacacgctgcacacccaagacatagctttgcgcgtggatgacagatctacgagcactggcctgcatcttctccagcacacagacgacgaccaacatcacgccatctgtgccagtccg

SEQ ID NO: 18488 - DNA, 348 bp, Sorghum bicolor
  Clone ID: LIB3478-036-P1-K1-H8
gcgcacgatcgggtaccaccttgactatgatgaggacgacacacactatcccaaggtccagagcctgctgactgaggacgatgcaacactctaactgcccggatcagaagtcattgaggacagtattgttatatacgatcattcgacttcccagcagcgtgactaagatcggaacagggagccatcgctcacataatgcattaacatgaatttgacagatagtggggcgagggcattaatcatgaagctactgcgaaagcgcctgatagagtgcttgtcgaaggatgtgaccaaagctctgttgccagactatgccagggagctatgatgaagtttgtgacgatagat

SEQ ID NO: 18489 - DNA, 347 bp, Sorghum bicolor
  unsure (1)..(347): unsure at all n locations
  Clone ID: LIB3478-037-P1-K1-A11
gctgcaaggaccccgcggcgctgggagggtccagcggcagctccagcaacggcgtcagcagcttcacgtcgagcaataataccagcatgtcgaggtagtacgcacggcacgatacggcgatgcctcaccaacagctagtacggtacatgtacatgtacgcgcgccaaggccgtagatgcatgcagcagccgtgtacgtagatggtcgtagcgacattgattccgttttcaccatctggtgtcggtgcaccaacgggtccgtcctggcctnctgggtgtagtgaatttggatctccgtgtgccgcggaattgtatagatgcgtaaaggagcgcacatgggggggtagg

SEQ ID NO: 18490 - DNA, 207 bp, Sorghum bicolor
  unsure (1)..(207): unsure at all n locations
  Clone ID: LIB3478-037-P1-K1-A12
gcgggcaaagtttacaggctagaattgagcaagggaaggggaactttggctgtgaaggagttgtggaagcgtgatgatacaagaggtgtgtaggcttatataaggacccttggnaagatactccatctgtacattttgaaacttaatgcatgtttgactggagcattanactntctggtctatgagtatgtggtgaaaggcaatctg

SEQ ID NO: 18491 - DNA, 358 bp, Sorghum bicolor
  Clone ID: LIB3478-037-P1-K1-A3
cactacgtcgccaaagatgtgcgcgcgctgctgggggacgacgcggtgtacgaggccgtcgacgcggaggcctttccggagtacaacaaggcccgcctcgtctacttcgagctccccgaccgcagtggcgacataatcatcttaacttatggggagattgacaagaataattatctggaccccaggactgcacaagttgctactatagatcatttgaaacagacctgtacaaaactgaggcctgctgaagatgaggagcttccatcagcttacattgaagagtttaggtgtgctttagatgttgaattgtcaaaatacgttgttgaagcttagtccaaaggggcgctgtgccatttat

SEQ ID NO: 18492 - DNA, 387 bp, Sorghum bicolor
  Clone ID: LIB3478-037-P1-K1-A4
cccacgcgtccgcatcacccaagcttccaaactcactctctcatctcgagcattctactcgtccaacctcggcccatttgccaaaaaagtcaccgagttgtttggtttcgacatggtcttacctatgaacactggcgcagaagccgtcgagacggcaatcaaattggcacgtaaatggggatacgaaaagaagaagattccagaaggaagggcaaaggtgctcagcgtcgaaggtaatttccacggtaggactattggaatcatctcaatgtctacggatgaagagagtcgacgtgggtttggcccgtttttggaaaacgtctgtccgcaatggggcgagactttgatccggtacaattatgtcgaggatcttgagaggggtttgga

SEQ ID NO: 18493 - DNA, 281 bp, Sorghum bicolor
  unsure (1)..(281): unsure at all n locations
  Clone ID: LIB3478-037-P1-K1-A5
gcgcaacgccctccgaaggatcaaacttttacccaaatgcattaagagcagttgtgctgacatctgcagtctcacaatctttgcatgaacttgcagtgaaggttgttgcagctaatatggttagaacggacacattgctgtctggcacgcatcttctctgtgctgttggaagatatcangaagcatgttcacagcttcaagatgctgtgtgctggaatgatgctgctactctggccgcatgccatctacatggatctgactatgcaaggatactgtacagg

SEQ ID NO: 18494 - DNA, 199 bp, Sorghum bicolor
  Clone ID: LIB3478-037-P1-K1-A8
gccgtcgtccacctcccacatgacggcgctgcggtcgctggacgcgcgcctcaactgcctgcgggcgctgcccgacgggctggagaacctgggcgggctggagacgctgaacgtgagccagaacttccagtacctgcgggagctgccctacggcatcggcctcctcgtctcgctcagggagctggacgtgagctacaac

SEQ ID NO: 18495 - DNA, 210 bp, Sorghum bicolor
  unsure (1)..(210): unsure at all n locations
  Clone ID: LIB3478-037-P1-K1-C10
gcgcaacagcaccgtcctgtacggcctcgccgccgacaagctcgactcacgccgtcgnaggcaccatcacgcgctacacctactgcggctacacgtccgggtgcgtggagcacgctacactaacgaacctgcatcacngcaccaggtaccactacgccgtctgtgtgggtgtgtacgacacgttgcgcgcggggtggttcacgactccgt

SEQ ID NO: 18496 - DNA, 315 bp, Sorghum bicolor
  Clone ID: LIB3478-037-P1-K1-C11
gcgtctactgtttgtatcctgtacttcatagatgtttgctagatttctgttaatggacagttttattggttcagaggaaacaagcagttcttgctgacaatatgttttcttttctccagtttgtgatgtttcttttgattgtgcatttgtgctgactgtcacactgaactttgtaactttgtcatatttctccaatctaaaatccatcagtcattttgttgtttccgcaccttgagctgctcagcttccttccgtgtttggcagcctaatctattattatggggtcactacgttgccagaggctcaaaactgact

SEQ ID NO: 18497 - DNA, 424 bp, Sorghum bicolor
  Clone ID: LIB3478-037-P1-K1-C6
gttgttatgaattccttagtgagattccacagataacatatatagtgcatttgtgcttgattgactattttagagaaagggttggggcattcatgcacaaaaagtttacttgtttacaagggcttcatcactatttgaacttattaacttaacatgtcaaagaatgttattgtatacatatatgatagcaacattaattctgtgctccaatgcatgtgactgtatatagtgacctaaagaatatggaattcattcagtgttttgggtggtattggtattaggagctgcagaaattggtaaaatgctactgttctattgtttgtccacctcaagggttagttttgtggttctagtatcacaatgcttagtgttcatcaggcttttatgggtgttggattacaacattggcatgcttacacttttt

SEQ ID NO: 18498 - DNA, 308 bp, Sorghum bicolor
  Clone ID: LIB3478-037-P1-K1-D4
gcggacccacgcgtccgctctcagggtccggtcaggtgcatatataccttgatcgatcagatagatatatagatagatagctaggagcggattgtgttccaccaccgagagccaaaagccagccacagcatcgacatgatgcacgacttgttctcggtcccttcgtgtttctcggcgggggagaagctcccggacgtcccggcgtccgcggcggccaccaggtcctggcagagcgcggcgacgctggtctaccgcgcggggatcgccggacaggaccggctggtgactgtgacgtggtgcaagaacct

SEQ ID NO: 18499 - DNA, 414 bp, Sorghum bicolor
  Clone ID: LIB3478-037-P1-K1-E12
gcgcgctaggccactcccgcgcgagccatctcccgcgtgatgcttccctgccgaatcgccgcgcgcgcgagctgctgcgggagccaacttccccgccaaatcgctgccgctgccttcatctcacaaacgggaatacaaatcgagcgcccccagactccacaccacaccagtagggaaggactaggaacagagaagaagacgcccggtgatctctgtgccaggttcgtcagctagctatacaaagggatcccaggtccgaattgaggatgaacagattaaagaagtctagtttccggcgaggcagtggtggccgtggaacctgacctccgtctgtccatggtcctatgacctctgttccggctgtaggtgcacctgcaactcaaagtcatgccactgacggtgctgcagcaatag

SEQ ID NO: 18500 - DNA, 313 bp, Sorghum bicolor
  Clone ID: LIB3478-037-P1-K1-E5
ggcggcacgcatgctagccatttctgcgaaggaattcgcataacctgtcgcaagttatgtccaccttagaacactatactcgtgtgtgaggcctttaaggtgcggcgttagattctgagcctatcatagatatggcccaacacctctacatgatacaaccctctggagttctatataaacactcacctgctccattgcggaagcgacgacaggctgaccaaactcaaatagaaaaatatatactttaacagcttacctcgcgggtaggcattcttgtagctccacacatactttatcgagatcctcatcaaac

SEQ ID NO: 18501 - DNA, 198 bp, Sorghum bicolor
  unsure (1)..(198): unsure at all n locations
  Clone ID: LIB3478-037-P1-K1-E7
gcgcaggatcaaggttcagctcatcgctttgcggatccatacttatatatggcccaacaacctgctctgactgttgaatcaagcacgagggacacaaacagcaagcgacgacttncttttcttgggccaccataattccatctattgtaatccaggtgatcaacagcagcacggtttcagctttggacaaaacccatc

SEQ ID NO: 18502 - DNA, 395 bp, Sorghum bicolor
  Clone ID: LIB3478-037-P1-K1-G1
ctttggtgcatcaagatcagtcccatttgatcaaactcatataaccactcttattcaggggactattgggtacctagatcccgaatatttccaaagcagtcagctcactgagaagagtgacgtttatagttttggggtcgttcttgcagagctgttaactaggcagaaacctatttccgcagcaaggcctgaagaatcatgcaatttggctatgcacctggtggttctatttaatgaagggcgcctacttcaggagatagagccacacattgtggccgaagcaggtgaagaccaatgttatgccgttgcagagctttcagtaaggggcttaaacgtggagggagaagaacgacctaccaatggtggtggtggctgttggtagacatgggctcata

SEQ ID NO: 18503 - DNA, 251 bp, Sorghum bicolor
  unsure (1)..(251): unsure at all n locations
  Clone ID: LIB3478-037-P1-K1-G2
ctggggtgcatcaagatcagccccatttgatcaaactcatataaccactgttattcaagngactactgggtgcctagatcccgagtagtggcaaagcagtcagcggtcggggaagagtgacttttatagctttatcgtccatcttacagagctgttaactaggcagaaactcatttccgcagcacggcctgaagaatcatgcaacttggctatgcaccgagnggctctatttaatgaagggcgcccactcc

SEQ ID NO: 18504 - DNA, 275 bp, Sorghum bicolor
  Clone ID: LIB3478-038-P1-K1-A10
tcgctcaatcctagcatctaagtgtggtgttgctgccctcttcattgcttctgtgcccttgcaatcgaatgcgcttcaatccagtgctgcttatcttgcaagtactttgtggattacacgtctaattcgcatagaattgatgtcagcaatgttttctttcttgcacatgtatagcaaaatcttaggattaaaacctagtgtataaaaacggcattacttatctctattatctagattatgtggtgccataatgctcatcattcacaagctgcatg

SEQ ID NO: 18505 - DNA, 455 bp, Sorghum bicolor
  unsure (1)..(455): unsure at all n locations
  Clone ID: LIB3478-038-P1-K1-B10
catttaaagaacaacaaaactgaagagtgattcttatagaaatggcagtagtgcatgtgttttttcagtttctagtgtgtgctctaggagctagttcaacatgttttggctcagcaactgtcttctgattctcaaatgtcatgtacatattatcaagacttattgatctacaggttgctagtcatccgaatatatatgtgttggacactcctggtgtgctgtcaccaagatttgcaaatgatggttctggccccagactagctntgacaggagctatgaaggactccttgttagaggagtatgatatcgtacagtttcttcttgcaattgtgaactcagggaaagaatataggaagtgggagaagttgaataaagcaagagatacattttcttgtggcaacacaattacgttcaggggccacaacaatgaagggcaatatgcttcaaatcacact

SEQ ID NO: 18506 - DNA, 536 bp, Sorghum bicolor
  Clone ID: LIB3478-038-P1-K1-B9
gcgcggccactcgcactcgcacggtccgggcacccgcaccgcaacaaaaacgtgcccccgccttgcgttgccttctcgaactctcccgccgtccccgtcgcggatcgccatggccgccggcctcgccttgcccgtccccgccgcctactctccactcgcccgcgtctcctcacctgcccacaccgcgcaccgcatctgctgcgcgatcccgtcgtcgtcctcgccccgcaccgtcaaatacccgccgctccgcgcggctaccgtcctctccgggaacagacggggcacgggccgtggcgcgtccgtagtgtgcgccgtccaaggccaggacgcgaacgcgaccattcaagtcccagatgtgacaaagtcaacatggcaatcacttgtgattgagagcgagcttcctgtccttggtgagttctgggcttcatggggcgggccatgcaaaatgatagatccaggtgttggcgagctctcaaaggactaccagggaaagctgagatgctacaagctcaacacagatgagaacccacaca

SEQ ID NO: 18507 - DNA, 212 bp, Sorghum bicolor
  Clone ID: LIB3478-038-P1-K1-C2
cgtgagcaggattaggctccggcatatttcacggttcgtgcttacactcgttctcgaagaagaaatggctgatttcatcgaggaacggatgggggagacgcagcaaccttgacgctcaaatttatctatccaggctgctctttaagagaagttcactttgagttatttgttgaagtcctacctgttagacagtaagaggacattatccgttg

SEQ ID NO: 18508 - DNA, 119 bp, Sorghum bicolor
  Clone ID: LIB3478-038-P1-K1-C4
cgtacacgcgcgctctcgcgcgggacacatctgaacccaaacacgaggagaggcatggcgggcgacaaatcgcacctggcattcgaatataggactatattctgcaataccgagataga

SEQ ID NO: 18509 - DNA, 415 bp, Sorghum bicolor
  Clone ID: LIB3478-038-P1-K1-D5
gttcgagcacctcatgcagccgtccaccggctcccccgcgttccgcggcgcgcaaccgacatcgtcgtcttcctcgccgttctacctcggcggcgccgaggacggccaccagagccaacctagccactcctctctgctccacggcaacaagcaggtctaccacggtctgatgcagctgccggagcagcatcagccggggagtaacaacggcctcctcaacctggggttcttctcgggcgggagcggcggacaggacgccccgctcgtgtttccagaccagttcaacggcgccatgggccggaaccttccgcgcgactgcagaaagcaccggaacagcggggcccacactgggtcaagggccatcttctcccggaacctaatgggaaaccaaatggcaagcagcgccggctttttt

SEQ ID NO: 18510 - DNA, 530 bp, Sorghum bicolor
  Clone ID: LIB3478-038-P1-K1-D9
tttacattcttaccaatgctcctgtaaatgataccgaaatgacaactgaaggctactatctggccaggtgtagggctgagaagtcactggtggatagatggcagattgtgacgttacctgcgccggactgcaccattcaggatatggacatttttcatgataatttagttctctatcttcaaaagaatgggactcctcttttttgctccatcaatatgccaattgatgttgatgttcaggagccaaaggaacttgatgatctcaatccatggtttttccccataccgtcagagttatgcagcattgttgctggatccaacaatgattttatgtcatctacttatcggctagttgtttcatcacctgtggtacagcttttgcttatctatgtcaaacgtgattttgtgtaatatatttatttcagattatcattagacctccttttcttgagttccagcatctgatgggtcatttaacacttttagagcatatagcttagggaattccattgtaccactcacgctgctact

SEQ ID NO: 18511 - DNA, 374 bp, Sorghum bicolor
  Clone ID: LIB3478-038-P1-K1-E1
ggcactgaccggcccaagtacctaggcccgctctgcgagcacacgcgcacgtacctaaccggcaagttccccaggcactaccggtggaacacgacaaggctgtcagagacaccaagacgttctcgcagaaccgagagctggaggtgatccacttacggtgggcgatgcttggcgcacattgggagcagctgccacgaatcctgaccaaagacggggtacatgttcttcaggaccgagtggctcaaggccctacacacagatgttttccgatggcaggctggactacctgggcagaccagaacctggtgcacgcccagaggatgctgtacatcttggcctgccacgtcctgctaaatggcttcgactacggatac

SEQ ID NO: 18512 - DNA, 153 bp, Sorghum bicolor
  Clone ID: LIB3478-038-P1-K1-E4
gactaactggctagcaatcgatgtactagatccaagatctctttcgctatcttgcaactaactacttgttatatggcgtcagctattttcaggtccacgaccgtggtgctacaactactggtctgtgaaaacccggtggtgctcaacttaatc

SEQ ID NO: 18513 - DNA, 338 bp, Sorghum bicolor
  Clone ID: LIB3478-038-P1-K1-E5
ccctcactccccgcgtcggcgatggccaaggcgctgctctcctcctccctcctccccgcgctgccccgcgccgccgggggcagcgcgagcaggccgctgctgctcccgccgctccgactgcggcgcggcggccggcgcgccgcctacgggtgcacggtgagggcaggactgcacgggctcgactccataggcggacacgacctccaggccaagctggagcgcgacgaggcagctatatacaagctagacgacacgtgcaataggaccatcaaccaacaaaaagacgagccttataacaacaaccggaatgagtactgaaggtgaccacgggcacatac

SEQ ID NO: 18514 - DNA, 340 bp, Sorghum bicolor
  Clone ID: LIB3478-038-P1-K1-E7
gggaaatctcagtaatgttggaggcaagtagagctcagtactcaacctcaaatgatctttctgtgaagatgctgaacccagttgcacttttgcgctctgcgtcatcgcgttcatcatcttctcgtttccttcttgctccctctagctcaatagatgatctctatgataatgagactagcagctgttactctgaagaatcttgtagtaccatgtctggaagtcaccactctaccttagacagactctatacatgggagaagaaattatacaaagaagtaaaggcaggtgagcggttaagaatcgattatgagaagaggttgacacatttgaggaaccaaga

SEQ ID NO: 18515 - DNA, 472 bp, Sorghum bicolor
  Clone ID: LIB3478-038-P1-K1-F1
catccctccatctcgggcgcaacgatagttacaaagatatggttgtggagaaaaacttgagaggagttcttagatcagaagttgacaggtctgtgtcacgtgacagcataattatcgtcgactctttgaacaatattaaggggtaccgttatgagttgtggtgtcttgcgcgtgcatctggtgtaagatattgtgtgcttttttgtgatacagaagtggaccattgtagggaatggaacagcaaccgccaggagaaaggagagccagcatatgatagtaatatatttgaagatcttgtaaggagatttgagaagccagataggcgtaatcgttgggattcccctctttttgaattggttccatctagagatgaaatagtagaaacggctcctgttattgctgaagctgtgtcgtatttgacaaagaaagtggattccaaaacaagagacgtaaaagttctccagcctacaat

SEQ ID NO: 18516 - DNA, 297 bp, Sorghum bicolor
  Clone ID: LIB3478-038-P1-K1-F11
ataatggcaggcatatttgccgatgggcctgaaattgtgtccgatgggtgtagagaagtcatcggaagcttgtgcatggcaaaagagagtactgacctagcatgcgtaggacggatctaccatgttgattgccaagtgactgcatacaactacacagcgagtggctctttatacacatcctgtcggcaatggattgaatctggtcgctgcaagagaaccatcaatcgttgctggcatactgaagcattccacagccactgtgatgaacgcaatcattggcatgctctgtgcaggcta

SEQ ID NO: 18517 - DNA, 429 bp, Sorghum bicolor
  Clone ID: LIB3478-038-P1-K1-F3
cggacgcgtggggcgtcttgccgaccccagcgacgtcgaggaggccgacaagctccggtcggcgctccagtcctggggcctcttcaaggtgaccgggcacggcataccggtggcgctgctggacggcgtccgggacgccgggctggagttcttccacctgccggcggaggagaagctgaggcacgcgaaccgggacgacgccggcgagttccagcccgaggggtacggcatcgaccgcgtggacacggacgagcaggtgctggactggtgcgaccgcctgtacctgacggtgcagccggaggaagcgcggcgggcgcggttctggccggcgaacccgccgtcgctcgcggggctcctgcacgagtacgccctgggcaagcagcatgtggcgaggcccgtgatcatgggcatgggacggcttctcgggtt

SEQ ID NO: 18518 - DNA, 457 bp, Sorghum bicolor
  Clone ID: LIB3478-038-P1-K1-F7
ctcttcctcgcccaattccgggacgacaagacgcacagcatctacatagtagatctgtcaggtaacgtggtgaagcggatcgccggcgcagctggtggcccttaccaccggctgcaatgcacgcgcctggaccgtgcctgtctgactactgactggaacagatgccatgtgctcaatccggctaccggagctgtccaggccctgccggagagccccgcggcggagcatgtgaatcgggtcaacttgcgtgacccttacaccttctttgctcttgggcgggtctcctccacgggagactacaaggtgcttaggatgttcaacaggcttggctttgccaaaggcggtcaccagctctttgaggtgtttaccatcaacggtggcgacgcacatgcacggtggagagggcagcagagccctggcctctttgttgatgagtgcaatggtgttgtagttgatg

SEQ ID NO: 18519 - DNA, 416 bp, Sorghum bicolor
  Clone ID: LIB3478-038-P1-K1-G1
ggcaggagcaatgcttggagattcatttcttcatcagctgccacatgcttttggtggaggacactctcactcacatgatcatgagggtcatgatcatgctcacgagcatgcacatgcacactcactggaagatctttctgtggggttgtctatactatttggcattgtattgttttttatcgttgagaagattgtgaggtatgttgaagacaattctcaaaatgggactcatagcatgggtcacgggcaccatcatcataatcataaacggcatgattctagtgataaagctaaattgaatcaccaaaagagtgataccgatggtaaagacattgaccatactgaagaggaacctttggttgatggcgccactggaaaaataagtgatggccatgaatcaaaagctactatacgca

SEQ ID NO: 18520 - DNA, 362 bp, Sorghum bicolor
  Clone ID: LIB3478-038-P1-K1-G10
gcgggaggcatgcgagagactcggcatggagctggccactctggctgactcctcgtggtgggaaaatggggcgcatgttatgcaacggcgggggggctatatcagatgtgcagggacatttgatcgcgcacaagtgccacactggcaagtgatccaacacccgccggatctgtaatctgaatggccagcaacacatcaccgtgcgaacggaaggctcaaagccgggtggggtatgtgcagccattaagaagcgtgatggctgcttacctagagcaggcgagcactgggatatctagcaagactccactgggtcctgccgacgcgcacagctcgagatcacttgtctgacgctagctagcatc

SEQ ID NO: 18521 - DNA, 461 bp, Sorghum bicolor
  Clone ID: LIB3478-038-P1-K1-G12
cggacgcgtgggggagtcaggtttttgttgagatgagggagcatgagcgacgtgtgtggtcggtggacttctcaattgtggacccaacaaaattggtcagtgggagtgatgatggatctgtgaagctgtgggatatgaatcaggctgggagtattggtactattaggacaagggcaaacgtgtgttctgtgcaatttcaacctgatacttctcgctccattgccatcggctctgcagaccacaaaatttactgctatgatcttcgtaacatacgagctccttattgtacactagttgggcacacaaagactgtaagctatgttaagtatttggatgcatcaacaatagtatctgcgtctactgacaactcattgaagctttgggacctgtcgatgagtcgaggaaggataattgacagtccaattcaaacatttacggggcacacaaacacaaagaacttt

SEQ ID NO: 18522 - DNA, 413 bp, Sorghum bicolor
  Clone ID: LIB3478-038-P1-K1-G2
aagactgatatgctcctactgataatccttaagatcttgctcatgacactttgaaggtgcatccacagcctgatcatgctatccaggtggagacagcatctgggatatcaatgtcaggacctcctactatcacatactctgagccggatactcttgacgtggataagcaggacacgcaccggtttgatcggtgcctccggcctgaacctgataggccctcagatgctaaaaatctgcaccaacatctgatgtttgatggatgaccccatagccaacaggatcctgaggctaactctaaaggcattatgtcggtatctgtacagcaaatcgaaatggatctttgactgacacacaggagtacattcttctagtatgcacctggccgtggggattcctcaaatgctatggaccaa

SEQ ID NO: 18523 - DNA, 311 bp, Sorghum bicolor
  Clone ID: LIB3478-038-P1-K1-G5
atagaagccagtcaagactcaacagcgagttccagtagctgtagccgctcctgttgggatagccatctgtgtcggccatcatggacgatgtgaggagcaccctgcagcaccagggcggtcaggtccactataacgtcgccgcagatcaggtgtgagtgaaggacatgggacttctccacagcctcctatagccgtacactcacgcggaccaggacaagaagcaggatgaggagctggccaccggcatggagaatgccactgtggtcgtgccccactagtgatagaggaggagcacgtggacagctgcaaga

SEQ ID NO: 18524 - DNA, 403 bp, Sorghum bicolor
  Clone ID: LIB3478-038-P1-K1-H2
gcccacggagcataaccaccgtaccgaggaagctgagctcggcccgcaggattcagaatcttcgaggcgcggcgacaggcggtcggggacataggaggcccaggagctcacccaactggggctctacgtgacatagccggctaactaatcggcacgctgtggcacgtgatagatctttcgctgacaaagcaagaatccagaatctggtagtccctatggcacgggcagcacttgcaccctcgaagggggtgcgcttgatacgacagccaacaaaactacttctgggctagagactcaatgttacgtggacaaatcccggtgacaggggcatccatacctggtctttttgtataatggccaaagctaaaagaccagagaccaacgctatggactggtccaaggg

SEQ ID NO: 18525 - DNA, 470 bp, Sorghum bicolor
  Clone ID: LIB3478-038-P1-K1-H4
gagggtcagtcagtatggtggctcgaagcaatcctagcatggccatggtagacaaggaacagaccacagccttctcatgatggcgagccacaaagaattcattgctgtggacacacttacacagctacaaatattaatctaggccctaaatgctgacgatcgggcgaatgctgagaagctcaaaagcattctgtaagccagtagttactctaacatgcacatttgcgacgtgtgcccatacaaggtgatagactacaacgctgacagtaacaatgtgtttgaacaacactagcgtactgatgaagagatacgatattgctttgacggtaggggctactctgatgcgagggaccaaaatgatcaggggatccctttagcagcgaataaagggggcatgattgctctgcctgcaggaatgtatcacccctttacattggataccgtcgactacctcaaggcaatgccgctct

SEQ ID NO: 18526 - DNA, 391 bp, Sorghum bicolor
  Clone ID: LIB3478-039-P1-K1-A11
caggaattggccccttttattgcagcttttatacagacagcatggttcggctcttgaatttgttgtacacaagaattaacagttgcctatccagtttccaccaaactacaattgggctatatttgacaggtgctagtttacagaaagtggccaataatagtcatctgaattttcactcagccagcaaaatgaagtctgaagtttctgaacaatgatgtggtgatgaagaatagaacatcattagaacctaacccaacagcgggtgcactgggccatgcaatcccctctgcagtcaatattgtatcccaaaacctttggattcctcaggagaaggctcctcagagttttcccatttatcccccagtcactgtccagcttgctcacattcagc

SEQ ID NO: 18527 - DNA, 278 bp, Sorghum bicolor
  Clone ID: LIB3478-039-P1-K1-A7
gatcgcgagcggccgtcctttttttttttttttttggatgtttgtttttttttaccacctaacggacacactgcacaattactatgactggttgcagtgtaacacaccagggacattaccacatcacatagaatgatgaacgctaagccaaataccgactgagcaagacgaccgtttttaatagtttactcgatatatccaacattcaaagggtttgtactagaccaattccaaggccacaattcttgatgtaggctgctggagggctcaccattcac

SEQ ID NO: 18528 - DNA, 372 bp, Sorghum bicolor
  Clone ID: LIB3478-039-P1-K1-A8
accaccaccaggagcgagtacggacaagaccaataatggcgctgagcatacccaccatcttctagtaccacgggctggcctcctcgacggcgccgacatgccggccggctgggttcttggcggttggcaccagcagcagctgggccgcgggagcccagcacaagaggagcctgatgctggcgactacgacaactacagccttctagacgaggggagctggagtcctatcgccggcgaggtccagcgggatcgagacttagacctccgtgggagctgaggccgcaaccgagcacgtcacggaggccagacaggacaccttgtggcccatatgtgaggcctactgcgacaaggtcgttgcactagtcatgtaca

SEQ ID NO: 18529 - DNA, 464 bp, Sorghum bicolor
  Clone ID: LIB3478-039-P1-K1-A9
ctttttgcgttcacctttctttatttgtctcttttttggcagaaaccacttgagatatattcatatatcatgttcacaaactatggactcctagagcacaaggccgaatgcataacttccttgtctattccattattatccactacctggatgcactaagtataattatatacatcggcatcgtgtaactggatcatgaacgtgcatgttgttattaagtacagctattcgagcaaattagaacaacatcgatcattgcgtactgaaacataagggaggcttttagactttagagagggaagatagtgtcgccatcctcgtttctgtcaaggtagttgaatggagcatccccttcgtaacggaagtctggaccagcctagcacttcatcggatgcaacaggctcatgttatttagctacctgctgaacacattgcaaccacagcactgaacaaacacagttcca

SEQ ID NO: 18530 - DNA, 496 bp, Sorghum bicolor
  Clone ID: LIB3478-039-P1-K1-B1
atcgttgccaaatccagctattgtgagaaccaatatgacgaccaggatggataaaagcatttgtagttggtgggatggccctggtatctctgaagttatggaccgtatcgaactttctttacgcgaccggaaaggtacaagaaggatgccgatgatcgataaatataaggatatgggcactagatgaatgggcaaaatagagtctgacactatcagagagggtgacagattgctgcttatgccaaacacgttccatgtgaaagacagacacttgaactcggatgaaagcaaaatacaccgtgctggacctgctgagaatgtacgcgttaaattgtgcgaactcgaagaggaagatgctatggctggataacgactctcaagaagtgctaatgctgcaggtgcagctagacaatacattgatgcactacagattcttgagtagttgacaatgctatcctcactgatagctacaaagctgtgatacatatccactctg

SEQ ID NO: 18531 - DNA, 528 bp, Sorghum bicolor
  Clone ID: LIB3478-039-P1-K1-B10
cactagtcccctctactccgctgctgtcaaggatcacttggatgtggtaaatgctatactggacactgatgatagctgcataaggattgtgcggaaaaatgggaagacatcactacatactgccgcaagaattggataccatcgtattgtcaaagcactcatagagagggatccaggaatcgttccgatcaaggataggaagggacaaactgcccttcacatggctgtgaaggggaaaaatacagatgtagtggaagagttactgatggctgatgtttccattctcaatgtgcgtgacaagaaaggaaatactgccttgcacatagctacacggaaatggaggccccagatggtacagcttcttcttagctatgatgaaacacttgaagttaatgctatcaatagtcaaaatgaaacagctatggatttggctgacaaagttccttatggtgagtccaaaacggaaataatagagtggctgacagaggctggtgcaaagaatgccagaaatgtggggaaaattgatga

SEQ ID NO: 18532 - DNA, 333 bp, Sorghum bicolor
  Clone ID: LIB3478-039-P1-K1-B2
gccacgcctaccgtgacgcatggtgagatcgagtcacgatatccggatgagtgcacggatcggggtgttatggtatgccaccgagatccctaaagagagcagcacgtttagagatgtcgacaccgaaggggtctgtagggcgatcatgcagtataaccccttgctcaaccctcgttcctaccacttcaacagggacctgtatggtcggtgccttcctgaatcatggcaggaccgctacttatgtctattccgatttcgagggaacataagacgcttacaatctgggggatctgggagccatagtgacggagctggccaatatcgacgatattc

SEQ ID NO: 18533 - DNA, 217 bp, Sorghum bicolor
  Clone ID: LIB3478-039-P1-K1-B4
cactagtcccatctacgattgagcgtttcggcatcgacaccacctgcaccttcatcggcctccgatccctgcacgagcctattgtggaattccaggatctgcggcggccagcagtggtccgtcggcgatggctcacctgctggacaactggtacagactacctattcaagagcgcgctcattggtgacttcagcgattgcgagggacacatctgcct

SEQ ID NO: 18534 - DNA, 327 bp, Sorghum bicolor
  Clone ID: LIB3478-039-P1-K1-B7
ggcgggccttgccaactccagccattgccagaaccaatcggactaccaggaccactaaaagcacttctacgtcatggcgatgcgagcggggccactccaattactcgcacgtatggaacctcctacccgccacggcaaacgagcagctcagacaccatgactccctgatcgtagaccgattgctacacatcctacaggacactacatgatcccagccctatcaaatatggtcacaagtgctacgaggtgccaaacaactaccatggcaaaaaagacacgttcaaactgggggagatcagagcccaacttactgggcttgcccccaac

SEQ ID NO: 18535 - DNA, 439 bp, Sorghum bicolor
  Clone ID: LIB3478-039-P1-K1-C11
gttctagatcgcagcggcgcccttttttttttttttttttctttttttttttttgatgctattttttttttttttttttgggtagtgttttttattttattgttccgggcgggattcccccttgtttgaaagggttccgggcttcccttttaagctccaatccgagaaaccttttgtttttacaaaacaacttaaccccacccccttccttttgggggttttttaccctttctaaatcccaaaaaaacacttccccccaccccctgggagaccctcttgtccatcaacacaggtcatgttacccacgcgcacagttttccttattaatcataaggttggaggaccggaccattaccctactttttttcctccccaataataaaccttccgttcccagggttgttgggggccaccaacaaaaagaggtcctttaaaataa

SEQ ID NO: 18536 - DNA, 433 bp, Sorghum bicolor
  Clone ID: LIB3478-039-P1-K1-C6
ggacaatgtgactcgacaggacaatgcttcaactgagactgcgcagtcactgtgttaaatgaatcttgcagagctgaacaagagagggctgatgcctgctcaagacctgcgtgcgacacatctactgatccatctgtttctggagttaatagggccatgcctgatttttccatatttagaggagatgtctgttcggatgatcttactattatagaactttaggaggcatgtacagccacatttggccggcaaactactgtcaaagacaagagatggatgaaacgaccgctgacaatgggcttgactaactcatacgatgttgctagctcacgttgtgtccgtaaagactacaaagttgctggcacggatgcctaaaaagacatatcatacatggatgaaagatctaagatggtgctcccagctacctctatag

SEQ ID NO: 18537 - DNA, 517 bp, Sorghum bicolor
  Clone ID: LIB3478-039-P1-K1-C9
gcagatatttgtggaagaaacaaatacataaactcttgtatggtggtaaaaagacatcgattcaagaagtactgtgcctagataaagagggatcacatttagaaatatgcgatcaggatttcttcaagttggagattagtaaaataaaggaaaccaccctgcagtggctggctaaagcagagaaggttgcatgtgattctggtgagcttgcactggatcttgtgtatggacttatagctgaaggggaaaatctctctgtacattttgagaaggaactaaagttactgagagatcgctgtgtcctctactgcatttgccgtaagccctatgataacaaggccatgattgcatgcgaccaatgtgatgagtggtaccattttgattgcatcaacttgcttggaccccctccagaaaccttcttctgtcctgcttgccatccaaataatgaagaatctgtattgcttgcacgctcagagcacgatgaggatagatcaagcactggagccagagctcacac

SEQ ID NO: 18538 - DNA, 475 bp, Sorghum bicolor
  Clone ID: LIB3478-039-P1-K1-D8
gtctcgttctatacctcgagcgcgacccacggttctaacgaccgttcgcacacataagacgactgcgtttgtctacattactatgggtggagaccttccaagacgatcttgagttgagcaccataacataataacactgacgatcactgcccatgacaaagtcactacccctcacaagatttagtacaagaccacgacatgggcactagcaccatatccagcccatggatgaccgccaacttattccattttcccgagcccgggctatctatagtttagccctcatcatgatcattattatcctggggctgaacgccgacctgacatgcctagcgttccgatgagtgtactcataaacaggcacccactctttcggctccgctggcatacactcgacctacggctgcgcgaacccatgggcgactcgctatgggaggatcgcggttaggtcttggcctccaggctagacccgatt

SEQ ID NO: 18539 - DNA, 300 bp, Sorghum bicolor
  Clone ID: LIB3478-039-P1-K1-F11
cgatcccccaaatgtcctcccaaaccctctgccgacccagatcgaaacccagggactcgattcgtcgtcggaggcggtcatggcgctggagtgggtggtgctgggctacgctgcgggcgcggaggccattatgctgctgctgctgacgctgcctgacctcgactgcctgctccggcgcatgatctgcgtggtgcggagcgcgctcaagcccatgatgtgggcggcgctcctttgcctatgtctgctgatggacatctactggaagtgccagacgcgccctacctgcgacgacgagcacgc

SEQ ID NO: 18540 - DNA, 416 bp, Sorghum bicolor
  Clone ID: LIB3478-039-P1-K1-F12
gtgactcgtgtgacaggtttggaccacaacatggctcttgggcggattattgagagaatgaaaggtacaaaactgcggtgataggaacgatatcatgtggggtcacacactcatccaccctggacggtgacatgaatcatgccacagtaaacacttccacaggggggagaggccgacgccgagccttgagggtgatgatgagcggattaacggcgaatgaagctctagtgggatgaagcggggtgctgtactcatcaaagtgagaaagctgtcacacggctctctgagctgctaccgatgctagtgacacatattttgattgggtgctgggaaccgacggggaacataagactacatagtcgggcactgatgtggttgatacgatgggaaagagggactgagaggctgactgcaag

SEQ ID NO: 18541 - DNA, 303 bp, Sorghum bicolor
  Clone ID: LIB3478-039-P1-K1-G2
ctgctggcagagagtaggatctgcggatggacttataaatgtcaaggactacgaaggcgatccggttctgaccataccggacgctaaagctctgctacacgacatctcctccagcgcggtggacaacccgtagcacgccctacaaagggcgctggcatatatgctgaacaacccgaaggtgacggccaaagcgacagatgagctggaccgtgtctatagacggcaaaggcttgtgctggagactgacattgctaagctatactacgtcaatgccttcattcctgaggctgtacgactgcaccc

SEQ ID NO: 18542 - DNA, 480 bp, Sorghum bicolor
  Clone ID: LIB3478-039-P1-K1-H10
cccacgcgtccggtccatcacatggttgggaagctggcatctgtttaccaaaggttctaggtgacgtaattgagtctatcgctggtgcaatctacatcgataccaagaacgacaaaaaggtcgtttggagaaagatgaaacggctactagaacctcttgccacccgcgacactctcgaaattgatcctgtcaaagagctgcatgaattctgcgatcctaaaacgtgcagtatcaagtacacagtagctcgtgaggaccgggtaaccttcgtggctcgagaaatacagaccaaagggactacatacaaggccactctgacaggcctcaccaagcgtgacgccaaaaagttagcagccaaatccgtgctcaaagatatgaaggccgcgaatagcacgcagcattttgcaaatggtatcagctgcacttaaaacttatagatctgacggtgtacttctggatataagatatagatggcatact

SEQ ID NO: 18543 - DNA, 254 bp, Sorghum bicolor
  Clone ID: LIB3478-039-P1-K1-H11
gttggaagtacatcagaacaagttgaacgatttacaactcgcacttgctgctgcagtagcagaaaaggaggaggcatctgaagagattcattcactgcgtaaaacgctcgatcgaatgatcggacgcaaagcataattagaaatacaggtatcttgtactatacaagagcacgaataactgaagagcaagtgccaaaatacaatggtagacaagcagatgtcgagtgataaatatgtaaccacatagaaagagc

SEQ ID NO: 18544 - DNA, 120 bp, Sorghum bicolor
  Clone ID: LIB3478-039-P1-K1-H2
ggcctgcatcaagtattatcaggccttctcaacgaagctgagctacgaacgtacttatgtttctagtctcgataccacgctggcggcgttacggacgtctcctggctgaaggagcttgaa

SEQ ID NO: 18545 - DNA, 458 bp, Sorghum bicolor
  Clone ID: LIB3478-039-P1-K1-H8
aatcaatcttcacagaggcctaacgatgtgtgggtaactgtttctgatattgctctagtgacactacctacaagtgcgccggctgctttacggcctgcacctgcacttgctgctaagaaaccacctactgaatgtgcaactagtgaagcatatgctcatcatcataactaaggctgccatcactccggatgttcaaacacttctaaaacatcccacattgatgaatcggaagattttttcatggcaaagcctgctaatttcggcagtggtcatacacaagttctgaagcgtgcaagaaatgggcattatccatctgcagctactgcaaggttcatggactggactgagatgggacactctaaagggggaaaccacagggcatttgattctatgttcactagcaatcaagatcgacagccggaaatagattagaaagctgaagcctgtgctcatgaaat

SEQ ID NO: 18546 - DNA, 172 bp, Sorghum bicolor
  Clone ID: LIB3478-040-P1-K1-A9
cacgcgtgcggcatggctggatcagcttatttatagtctggaccatagagatcaccagctacgttaactatgaaacccactgcactagcatgaggtcgatcgatcctgctaacacactaaaagagaagactctactagagcaagcgcacgcacggtacacacccatgctaga

SEQ ID NO: 18547 - DNA, 304 bp, Sorghum bicolor
  unsure (1)..(304): unsure at all n locations
  Clone ID: LIB3478-040-P1-K1-B2
gacggacaaggcgtcgatgctggacgaggtgatcgactacctgaagcagctgcaggcgcaggtgcaggtgatgagccggatgagcagcatgatgatgcccatgggcatggccatgccgcagctccaccagatgtccgtgatggcccagatggcgcagatggcccagatggcgcaacatggccaggcatgatgaacatggctcctgccagccggtcgcggctacccgccatatgaccgcgcacgtcgccatgtcggcgactgcgtgagcaccactccgcgcggcggcngnagagcgcgcgctctc

SEQ ID NO: 18548 - DNA, 235 bp, Sorghum bicolor
  Clone ID: LIB3478-040-P1-K1-B7
aacatctctacgctcgcagagatggctcactactggtcgtctctactcatggtgatctcttgcacggcgattgacgatagccagattaaggagggctcattcggtgagggccgcataaccatgcgcaagagctccgacaatcccaatgtggtggagctctgcagcccctgatacggtcccgaccgcttgaaggacctcggccccttgtgctgcgagccgtctagctacgcttacc

SEQ ID NO: 18549 - DNA, 238 bp, Sorghum bicolor
  Clone ID: LIB3478-040-P1-K1-C9
ctctatgtcatcaaggaaaagattcaccagaacacacacacacttccactattggagatacggcatgcacctacgtcatagaactccaggcttctacgtaaaacacgagggcgtcaagaaggacatacacgccaaggtccaaatggaactcattatagacaccggagagcactacatattcacctactattagaagcataataaaagcctgcacgaccaaatatagcttataaattaa

SEQ ID NO: 18550 - DNA, 378 bp, Sorghum bicolor
  Clone ID: LIB3478-040-P1-K1-D12
gtagatagtcattttgatgtatctgtatgactgacattgtaaagctcaaccatacattggtgggcacataatttgcatgttaatttttcacagtttcgtccacacaaattactactattcttttgatgcaacagcacggctccttgcctagattatcatagtggatatcaatatcataaagaaatagccagacattgttatgaatagctgaaacaataataggacattttctgaatgacttcttcacatgtagtggtgagacgaagtatttatagggaagcttcttcgcatgaaggataggcacaatcatattgctaatgcaatagcttgcactgggagtctgagattatgcattatcagaagatgggatgatatcta

SEQ ID NO: 18551 - DNA, 275 bp, Sorghum bicolor
  Clone ID: LIB3478-040-P1-K1-D6
gccaccggcccatccgcctcgtcgacgacgccaacgtcggcaccgccaagcacttcgagtacatgttctacgtcgacttccaggcgtgggtcgcggagccccgcgcgcagaacgcgctggccgaggtccaggagtacacgtccttcctccgggtgctcgggagctaccccatggacatgacccccatgaccggcgggctcatccaccaccatttcctcgtccgatggtccctcgtcgtcgtcgtcgtcgtcgtcgtcatgattactccttctgga

SEQ ID NO: 18552 - DNA, 415 bp, Sorghum bicolor
  Clone ID: LIB3478-040-P1-K1-E10
gttggtgacaaccgggcacacgcggctagtgctcgagtgccgcatctaacggcactcctagtggacttcaggcaagctcgtcctgtggctggtactgaccgatgtgaccttcctcgggccgatgtccattgtacagctctactggaaagacatacattacggagcaagggcgcatatggtgatccagatgatatcgataccaggtacatcatgtggctcaactacttgctccagaatgagatcagtcaccttagatgcctaacactgatcctggaggcggacatggaaacgcacattgtgtacctgatgactgtcgttctcaagtacgagctgaaaccgcccggactgaacatcaaggttaacgtggaaacaatacacgaatctgtggagcttgtgccggtacatatactgacca

SEQ ID NO: 18553 - DNA, 349 bp, Sorghum bicolor
  Clone ID: LIB3478-040-P1-K1-E5
cggacgcgtgggtgcaagtctcactattttgcataaacccagtgcatcaagcagcgcaatggctagcagcaccatgggtttcttctagacggacttggcctgcaaggaccagaacgtgccataatcccttttacgcgaggcccgcgtgactatgcgcaagactgcagcgaaggccaatcctgacgacgcatacggcagcccttggtacgggcccgaccgcgtgctgtacctgggcccgctcttcggcgagccccccagctacctgactggcgaggttcgcggagactaccgctgggacactgcccgggtgtcaggtgaccccgagacgttcgccaagaaccgggagcta

SEQ ID NO: 18554 - DNA, 341 bp, Sorghum bicolor
  Clone ID: LIB3478-040-P1-K1-E9
gcggagaatggggaaacattagctgatcatccaaaaaaagaggaaggtgacctccaaaaggacactggcaccatagttcaacattgtgatgcccttgcttgtgatagggagtctgtgtgttcaagttgtgaagaaccgagatatggattaaatggcgagccatcagacttgagctcggaatcatactcaggactgaccccaacacttaatacgggtggcaaattgccgatggtttccgaagaccctgtgaataatctagagccaaatatgactgatggggtgacaagtgatagcacgtaccgggagctgaatcctgaagtcagcactaggaatgaaatgga

SEQ ID NO: 18555 - DNA, 173 bp, Sorghum bicolor
  Clone ID: LIB3478-040-P1-K1-F2
agggaggaggacgagacgctggtcatgactggcttcgtgagtggccggcgcatctagcacattcttgggcacccggctgtccgacccggcgccggagaacaggcgcatagtggcccggttctgcttctgaaagccgaaataggcttctgtccccaagaaggtgtccaagatct

SEQ ID NO: 18556 - DNA, 256 bp, Sorghum bicolor
  unsure (1)..(256): unsure at all n locations
  Clone ID: LIB3478-040-P1-K1-F6
acggctacaagccgggggacctttcctgtctgaaactggaagcgagcacatcaggaaaaatggcagcgccacctctcggcctcgcctgcgagggtcgccggggccttcaccacaccggcggtggcgcattccggtttccgcccccgacgtctcggccctggtctcctcccttcaaagagatggagcggggtggtgaggatgggggcggtggtcngaggaaggcatgagggtgtggaggtcttggagcttatgcata

SEQ ID NO: 18557 - DNA, 280 bp, Sorghum bicolor
  Clone ID: LIB3478-040-P1-K1-G12
cgctcagctaggcggccgtacatggcgttcttgacgccttttttcgtcctcgcgaccggcgacagggacgttcatctcgtcgcgacgtcgtcttccttcgaggtactggtgacgcatcgccaagcgcgtgtgagttgaggcacacattaagtggtgcgtgcagaacgtaagcgacgttcgaatctcacttgtaggtcactacaacaaactataggccatatagcttacgcgcatgaccatcaacaaacacaacagcatgaccaacgcgacgctggagttc

SEQ ID NO: 18558 - DNA, 128 bp, Sorghum bicolor
  Clone ID: LIB3478-040-P1-K1-H4
aaacaagtctcatatctgtcacttctactattgctacaatccaacactttccttcattctgcatgttttatcaagcatgtttaaacaagtcttcgcgttcaatctattaaaaatcatatcattatttt

SEQ ID NO: 18559 - DNA, 190 bp, Sorghum bicolor
  unsure (1)..(190): unsure at all n locations
  Clone ID: LIB3478-041-P1-K1-A5
gccgacggcaacttcgtggcgccattcgacgtcgacgacatcgacatctactccggcgagagctactccgtgctgctgacgacggaccagcgagcgtcgtcgtcgtcgtactggatctccgtcagtgtgagagggcngccgcccaagacacctgcggcgctggccatactaaactacaccaacagcaagc

SEQ ID NO: 18560 - DNA, 260 bp, Sorghum bicolor
  Clone ID: LIB3478-041-P1-K1-B6
ttctctacttcctctccctcctctcatcggaagcaggcaggcaggcagccagcaatggccatggcgtcgtcgagcgggctgaggagctgcagcgccgtgggcgtgcccacctcctggcccgtcgccggggggtcagccgctgcgtctgcccacgccacactcggcggtaccattcgcagtgatgccgcagccgctgcactacgtctgcggctcgtcacttgcgccggcgaatacgtaggcaggcatcggcacggccgacg

SEQ ID NO: 18561 - DNA, 355 bp, Sorghum bicolor
  unsure (1)..(355): unsure at all n locations
  Clone ID: LIB3478-041-P1-K1-B7
ggaggcgtacaataggatggtggcgctgtaccagaagatgaaccagctgcagcagagcgagcccagcagcaacccgtccaagcagtgagcatgacattttttttcttcttctcgacgactgatgagcacggaatcgtgtaactaatggaggttgaaatccgtcgacgcggtacctgtagcatcatgtatttatcttgtgtttgaccggtctatagccttgtataaggggtgtttggttggtgatatggcgtactttcgtcttatttgacaattactgtcctatcatggactaattaagcttgaaagaattatctcgttaaaaaaaaaaannaaaaaaaaaaaaaaaatataaaaa

SEQ ID NO: 18562 - DNA, 447 bp, Sorghum bicolor
  unsure (1)..(447): unsure at all n locations
  Clone ID: LIB3478-041-P1-K1-C1
gacgaatccaagcacacgccccgactctgcttggcttgaaactgcagcggagcccccaaaggcccccgactgaaactgcccccgcgacgcacgagcgcacctaaaccccgcccgcccgcccgcccgcgttttctcgtcgccgggaagaatcttcgccttcgcgaagtctctccagtctccagtctccactccccatcgccggcgcttnctcgcggggacctcggagcaatgcagctataccaccacccctattcgctggacagtcagaaagtgcgaatggcactggaagagaagggcattgactacacctcatatcacgtcaatccactcacgggcaaaaacatgaatgtggacttcttccgcatgaacccttcagcgaagctcccagtctttcagaatggagcgcacgtaatctatcgcgccatcgatattattcaagacatagac

SEQ ID NO: 18563 - DNA, 117 bp, Sorghum bicolor
  unsure (1)..(117): unsure at all n locations
  Clone ID: LIB3478-041-P1-K1-C12
ggcctataccttcctgtattggcttcccttttatatcagccacacagctatcggtggacaatacttgtcagactcggaagccggggtactgtcaactctgttcgnacgtgggtggcg

SEQ ID NO: 18564 - DNA, 327 bp, Sorghum bicolor
  Clone ID: LIB3478-041-P1-K1-C2
ggtgtctgcacagcacaccttcatctttgaggattctccttctggtatacgggcaggcgtcgcagcaggaatgcctgttgttggtttagtgacaaggaacccagagaactcattgctggaagcaggagccgcgttgctcatcaaggattacgaagatccaaagctctgggcagcacttgatgagatcgacagagaggaagcgaagctgaaggctagcgcatgatatgatctgatgataaacaattgataaattagatttattgccgatcgaagtggctcaaatacatttctgtttctagttatgctgcagctgtgaccgtgagtaac

SEQ ID NO: 18565 - DNA, 313 bp, Sorghum bicolor
  unsure (1)..(313): unsure at all n locations
  Clone ID: LIB3478-041-P1-K1-D1
gcagtggtcttgatgaatgatgatacgtttaacctatttgctgttaactcattcttaattgttctgcttacgaaggctctgtttgtgagcgtgtggcatggccttctttgcttcagccttcagctagagtctagagattgtggattctagctcttctaacacgtaatagcnttttaacctacaataaattgcacaatccagcttgcacagattctagaatccaacaatctgctcaaatatagagtttatatgattntggcacactatananagagagagagagagagagagagagagagagagggagattcat

SEQ ID NO: 18566 - DNA, 303 bp, Sorghum bicolor
  unsure (1)..(303): unsure at all n locations
  Clone ID: LIB3478-041-P1-K1-E5
gccgccctcgactatggtcttgtctttgctcgaaggtccattataaccacggaccagtaatgattccttttcccgtggataatagaatgatgtcgcagttattatgaaatcatgttcagaaaaaaaaatcgggttcttactcgctattggtgctttcataatgactgtgnctgtaacaactacgagttattgttatctgactgtgacaatgcctcgagccttgtatgatagcggagcttagacaccagtctggcctctgacacacagaacccctcaaaagatatttagttcacaatacaaaat

SEQ ID NO: 18567 - DNA, 367 bp, Sorghum bicolor
  Clone ID: LIB3478-041-P1-K1-F11
tcgaacaactccattttaacttacactttcaatgcttataacaaattcttgttttacacatgctaatccatacagtacgcacagggtacgaggggtactatattaaaactcaccaaacatactagtatataatcttaaacggctctattttattgtgccacttcatatctactaaaaaactatcataccgagttgctttaccactaaaacttaaacttactaacacatcctatcatatgtactcttaatactcctttttgactgagttaaatcatgtataacagtgaccaaaccatagccactatatcagcttagctataactatcaaccattccctattcttcgatgaccaaaacctttagaaact

SEQ ID NO: 18568 - DNA, 301 bp, Sorghum bicolor
  Clone ID: LIB3478-041-P1-K1-F7
gtcttatgcactgactgttacatcaaccacatcaacggcaagctgcaggtgatggtccagctactctgactccgctaaggacgaccgccgtgtgtccatggtgtggcatgttgacgtcgcgctcgatgagatatgcaacgtggacaataagtacagggtgcatctgaccttagtccactgacgcagacgcatccttggcccgtgctgtggcccgacccacctctgcataatgtctcaggccgcggacaccagtaacaggtctatccgtatgaccgtgcacatcgaggtcatcgagctcatg

SEQ ID NO: 18569 - DNA, 338 bp, Sorghum bicolor
  Clone ID: LIB3478-041-P1-K1-F8
atgatggctcacactgtttccagtttggaaatgctgctttcttctagtcattactcggtagcaacctttgctatcttccgctgctcctgttgttctgaatgtatattcaatcagctctaggaatttgtcattctaggtcaggtagtcagtctttattgagtactcgtgatagatgaatatgttgtatttaggctcatattgttttcgacgagcagtttagtgggtacaagtttagaggtagaacaagctgaaagttctattcctgtagaaaaggaaaagttcaccattctactttgtctaatatttcaaaatcaattttgttcaccattctggaagac

SEQ ID NO: 18570 - DNA, 214 bp, Sorghum bicolor
  Clone ID: LIB3478-042-P1-K1-A1
acggcgatcgtcaacgacgcgctcaagctcatgacctcctactccgactatgacagcggcaccggctgtgtctacatagagaacagcagtggtctgtacgacaaggagtacgcgcagcagacaatggaccgcacctacgaggtgcaagaactgcatggcaaccttaccaaagagatgcacgctaatggccaggacaacatctacatcttagcca

SEQ ID NO: 18571 - DNA, 427 bp, Sorghum bicolor
  Clone ID: LIB3478-042-P1-K1-B11
ctgaaggtaacctttctctttgttgcaaaaaggaagagacaaactgataggttagcattactaagcagcttattacttactagtggaggtatccaggagaccaggacagaagcgtcttgttgtgtagcacagggaagggaaccttgaaagagtagtcaatcctgcattccgacaggattcgtcattaggccctctgttgtcaaaatagaatgaaaagtagataataaataggctacgaactcacgaaatgggactactttgcatatccatccatgtccaccataaatacaccagggttttccaatgggacaagcaaaaatcagtcatccacatgaccacatccatctatccacagctactcaaactcaacatgtctggattttgcatgatcctccttcttgcactggtgatatgattgatgcactat

SEQ ID NO: 18572 - DNA, 149 bp, Sorghum bicolor
  Clone ID: LIB3478-042-P1-K1-B7
gtgcccatgactgcacaggagaggtgactgaagggaacatgagtcctatgtatgggagagggaattcacggttagatactgggaagagggttgaagatgatggcaacgcattttgccccaagatttcagcaaaggcaatgggaatcggc

SEQ ID NO: 18573 - DNA, 197 bp, Sorghum bicolor
  unsure (1)..(197): unsure at all n locations
  Clone ID: LIB3478-042-P1-K1-B8
gcgctcggcgctcgccagcagcgccttcaccacccagcggcgcggaagctccgccccgcgctcgggcctcgtggagntgcncggaggggggagggccagaatgacatagactacatcactggcgagagcaagaaggctgtggagaacgggccgagcgagaagagcagaagaagaagggctatgaagtcctgtcatgg

SEQ ID NO: 18574 - DNA, 246 bp, Sorghum bicolor
  unsure (1)..(246): unsure at all n locations
  Clone ID: LIB3478-042-P1-K1-C8
naaaaaaaaaaaaaaaaaaaaaaaaaacccacgcagccagacaatgtaaaagcaaaccaaaactaagggggaagaaaaccgagggggggaaccaacacaagggacacgagcacccaacaaaccacaagccacggagaacaagaaacananaacacagacaacagaaagacancanagngcccaaaaanccacccggcagggggcgaacagccaggggaagggggccanacggaaagcaggaaccaa

SEQ ID NO: 18575 - DNA, 258 bp, Sorghum bicolor
  Clone ID: LIB3478-042-P1-K1-D9
agacggttctcctaagaaaccgcctgtaaaaatcttatttctacaggcggtttgttaagaaagccgcctctatgaaataatttgagaatggaatttttttagttttttaaatgaccttgtttgaaaaaactgtcaaaaggaaagttgtatatctcgaaaagttatgaaactttgtagttgataatttttttcatttaaaaaaaaaaaaaataaataaaaaataacaaaagtaaaataaatgatgtcagtaataaagac

SEQ ID NO: 18576 - DNA, 384 bp, Sorghum bicolor
  Clone ID: LIB3478-042-P1-K1-E11
catacgttggtgatcaagaccaagcttttgaagaccagcagcaggctcagaagagctttgatcaagatgccaccaggtacccggagtgctgcatgtatgactattgaggagtgccctattcaacccacgggggcagcatgtggagggtgttcctgagctagcagatgaggaatcaacggtggaagctcaggaggatgtgcctgaagatgaggagatgcaggatccacctccatcacagcctgctcagttagctaatgcaaggttggggtggactacagtgctatggtttccagaatcagaccccaaggctttcttccatgagcatttggtgttgacattgaaccactactacccggatctacaagccactctggagtattgctg

SEQ ID NO: 18577 - DNA, 381 bp, Sorghum bicolor
  Clone ID: LIB3478-042-P1-K1-E2
agttagatgcttttatatggttgtatgtacctttttattatgccggcatagttagattagctgaaagactgtggtcactggatttactgctgggtacataataccaatgagcgtcgctttatttattttacttattatggtccttaaaaaaagttggcagcctcatattattttttccatggtattctttactattttgttcccttctagcttttattagtcattggccttttattgatattcttttgtttggtttcctgcaccggttctcaccacataaacatgaaattagcagctggcatgatcttagggctttcataaaaaacttagtagtcatcttaccgaaaatacttacatgctaataaattttgagtttaaaag

SEQ ID NO: 18578 - DNA, 263 bp, Sorghum bicolor
  Clone ID: LIB3478-042-P1-K1-E3
caaatgttcaatcgtcaaatgcccaagtttcatgtgtagttagtgcggagcgtgctatagatttgggggccgtttggttcttttgctgagggtgtgtagactcaaattctagaagacattatgtttcttttggtatctatatgcttcttttgttctgtcagcttttaaaggtagccgctgtataagctcagaccaagcaaattccgtgcagcaattgaggcagcttttctcactgaacgtgattttttatcaaaaaatggatg

SEQ ID NO: 18579 - DNA, 264 bp, Sorghum bicolor
  unsure (1)..(264): unsure at all n locations
  Clone ID: LIB3478-042-P1-K1-E4
aacgagggaaaaaaaggggagaaaaaaaggagagggacagggagagagagggaggcggaggccatcatcccattcgccggctggtcctgaccgggtccgtgtctatttgggctgcgccttacgcancangaggtagagatcagcgcgttgttatatcttctatctttncatctgcgcgggaactactggcatttacgatggtggacaagaatgatgggtcagagggtcttaaattcaacacgttaaacctcattcaaacaacct

SEQ ID NO: 18580 - DNA, 213 bp, Sorghum bicolor
  Clone ID: LIB3478-042-P1-K1-F3
gctattacatatcttcatacctattcagggacatcaaatcctcaaacattcttctaatgaacaattgtcgagccaaggttgctgactgcggatgcgccaaactggccccaactgatgctagtcatatttctactcaagtcaaaggaacagcaggttatcttgatccagaatatctcagaacataccagctcaatgagaagagtgatgtctact

SEQ ID NO: 18581 - DNA, 431 bp, Sorghum bicolor
  Clone ID: LIB3478-042-P1-K1-F6
cactcgcactcgctcaaccacaccatactccgacacaatatgatgcgaagtatacaacctggggacaggacaggggacatcaaagggggcaatggtggctgcattcgagaaggtatctgagaagaaaatcccactgaagattgctgtgctaatacctggacacacacatatcgactctgccataactgacaacgcagataacgatctcaaatgggaggcaaaatacaagatcaaggacatgtgcaaagatctgtgcaattgtgcaagcaataacccatacaggtatgcttgctcacatgacaactgacaatgcatcaccgaaccatgcatcctgccatacgtgcgagcatcatactgagcagcaacctgctctaccaccagtcttaacaacttattatatgaactatgaactcaaacagtcactcatttaa

SEQ ID NO: 18582 - DNA, 379 bp, Sorghum bicolor
  unsure (1)..(379): unsure at all n locations
  Clone ID: LIB3478-042-P1-K1-F8
ggcatttgggacatgccaagacacatttcgaagaagccttatctgtacgagatagaacaatcgaggctacaaagttggtattgcggtgtgctcggaataagagcgcacctggaaaaatgaccagggaaacgataatgaaatattccactcgggtttcttatcagatggatgtggtgaaggccctcaatagtatagatggtcctcagtggaaaacttccctttttgggaatccaactgaccctgaaactctgaggcgaaggtgcatcgtgngtgaaacgctggctgaaaagcatattgatttagctttcagaatgcttcatgaggtngatctgccagctgttgatatttatgctggtgtagctgcatccctcgcagaaag

SEQ ID NO: 18583 - DNA, 272 bp, Sorghum bicolor
  unsure (1)..(272): unsure at all n locations
  Clone ID: LIB3478-042-P1-K1-G4
cacatgctagactgatagcagacttccgtcctgggggtgaatgatcagcactacttgatatgcaacctatgaaacttttcagagaagagtctgcagggttatatgctgccgaggttgtaattggtcttgagtctatgcatctccttggaataatataccgngacctaaaaccagataatatcttgctccaagaggatggccacaattgtctgactgattgtgacctctcgtttttgacttattcaaaacctgatgtcataaagcattctaca

SEQ ID NO: 18584 - DNA, 368 bp, Sorghum bicolor
  Clone ID: LIB3478-042-P1-K1-G8
aaaatttcttgatctagcatacaataaattttctgggagcataccatcatggattggggaaatttcatcggatttgtcgtttgtacgggtacgctcaaatatgttttctggtggcattcccatccaaatcactaggatgaaggggcttcaatatctagaccttgcatgtaacaacttcacagggaacataccactgtcacttggaaacctggaagctatggctcatactcccaataacaatagtgcacttttcagtgttaccaacactggattttgtggtgttttcctgtacagacctgtacgaactgatagtttattagtggtcaccaaaggtcaacagcttgaatttgcaagtggaattgcttaca

SEQ ID NO: 18585 - DNA, 390 bp, Sorghum bicolor
  unsure (1)..(390): unsure at all n locations
  Clone ID: LIB3478-043-P1-K1-A1
gcgcggaagctccggnggatggagatccgcgctcttcgtcgtgggcgttgagatcgccgggagcttcgcctacttcggcatctcggcgaacctgatcacgtacctgacgggcccgttggggcagtcgaacgcgtccgccgcggcctccgtcaacgcctggtcgggcacggcctgcctcatgcccctgctcggcgccttcctcgccgacgcctacctgngccgataccgatccgtcatcatcgcctgcaccctctacgtcctggggtatggcatgctgacgctgtcngcgacggtgccggtgctgcggccgtcgcacgtgccctgcagggaggaggatgatggtgatggcggcgtctcgtggtcgtggtcgtcggctcattcatgccatca

SEQ ID NO: 18586 - DNA, 454 bp, Sorghum bicolor
  unsure (1)..(454): unsure at all n locations
  Clone ID: LIB3478-043-P1-K1-A8
atcaattttggttgcccacagcgtattgcaagacggggtaactatggagcatttctcatggacaaccttcccctcgtaaagagcccgtgtgcagaatctagcagctaatcttcatgttccagtctcagttaagattcgtgtatttccacgactggaagacacattagcctacgcgaagatgcttgaggaagctggtgcttctcttgtggctgtccatggtcggacaagagatgaaaaagatgggaagaaatttcgagctgactgggatgccatcaaggctgtgaaggatgcacttagagtccccgttcttgcaaatggaaacatncgccacatggaggatgtgaagaatngcctggaacatacntgtgctgatggtgtgctttcagctgaaactcttctagaaaatccacactttttgctggtttaggacaaaggatgggaagaagatggtgat

SEQ ID NO: 18587 - DNA, 364 bp, Sorghum bicolor
  Clone ID: LIB3478-043-P1-K1-C11
cccacgcgtccgcccacgcgtccgcccacgcgtccggcagccagcgacggcgcgagtccttgcgtgcgtctcccgttcccggcccgcgctccctcgccttgctttcctcggcgccttcgtcgtctcttcctctcgccactagtagccagccattggaggcgcgtagggctgggcggttgcagtgagcagcggtagcatggggatcaggaggcagcacggtgctgctacgatcgtcttggggatcatcctggagctcgtcctcttccgcttggcgacgtcgcagtcgttcatcggggtcaactacgggacgatcgcggacaacctgccgccgccggcgtcgacggccagcctgctcatgtccacg

SEQ ID NO: 18588 - DNA, 351 bp, Sorghum bicolor
  Clone ID: LIB3478-043-P1-K1-C6
cggacgcgtgggtctgaaaataatgtagtaaaatgagtatttactgttcctcttcttttgtttttctctctgttccatgattttacaggcacaaggactgtgcacacagctggttcctactttggctctttgtggcatactggtacagaaattgcaataattgaaattcctatgatcttgtaattttaaatgtaaattcgtttggatatgccatgactataagctaaatttgttattagtctcttgaaggctgattgagatcaacatgatacattgtgaaatgcacgcttaccgacaatgacaccactgaacttttggagaatttattacattgtgatcctacttactaaa

SEQ ID NO: 18589 - DNA, 410 bp, Sorghum bicolor
  Clone ID: LIB3478-043-P1-K1-C7
gcggtccttggtgcgcagctcgtcgccaaggtcactggagagaacactgtgaggacccccgctaaggcgaaccttaaggtcgagatcaagggcttcatccacattggccggaacttcctccggagctggcaccggcgctaggactgcccgctcgacttcctcgtcgagaacgacagcggaagcgacaggaacgcctttaaccttctcaagtatgacttgatgcttgacaccttgaaggctgacgtcaagatcgacgacaacaccaccatcaacgtcaatggcaagcccattagcatggtcttcagcatggaccctatcaagctcccatgggctgagctatggattgacatcggcatcgacggcaccatagtcttcatcgacggccccggcgacggcaagcacatccaggc

SEQ ID NO: 18590 - DNA, 349 bp, Sorghum bicolor
  Clone ID: LIB3478-043-P1-K1-C8
cgcgcgcctgtctgcactggtgttcttcctagcacagaaaaagcataagacatacaaagatgcacaagatggcgcaacagagggcgggggccgtatacggactcggaggacccggagcgagagacgctgcgccggcaggggaggctcaacgcgcacgtgtgctgcccattgagacgctactgctcgcggctcacgtgatgctgcgcgtggacaccatgaccgctatgctgcgtgaccagcagagcaacgatgtcggcaccgtcatctacttctaccttgagggctgtaaacacctatggtacctcaacggtctctgcagatgctacttgctggagtgcgcgttgtacac

SEQ ID NO: 18591 - DNA, 337 bp, Sorghum bicolor
  Clone ID: LIB3478-043-P1-K1-D10
gcgacttctaccgcctcaaggcctacttcagacgccctacgcgcggaccacgacgtcatcctccatgacaaccaccgctctggtgtgcagaggtggtgtacgtgaccgagaatctccaagataaggaggcgaccgaggtcggtgccagcgctgtcaccgacgccgaggaagatttgacggcagtggacgacgtcaatgcttccttggccgatgacgtctaagagccaacacagccggcagctgaagaggaagaggctgctctcgatgtgcaacaagtgaagtcctaagacaggctgatcccgggcaatgtacgaagcgcaggagtggacaccgaccc

SEQ ID NO: 18592 - DNA, 452 bp, Sorghum bicolor
  unsure (1)..(452): unsure at all n locations
  Clone ID: LIB3478-043-P1-K1-D11
ttggcatttggtgcagcatttgcagttttcttgacattggagatgatacgaatttgggaaatataccctcttggacatgtggtgcatcagtttatgaacgcctttactgatcatcgtgattctgagattcttattgtcagccatttttcactcttactgggctgtgcacttcccaaatggatgtcatctggattaaatgatcgaccacttgccccttttgctggaattctcagcttggggataggtgataccatggcatcgatgatagggtacaagtatggtgtgttaagatggagcaagacaggaaagaaaacaatcgaaggcacggcagcaggcataacttcagtgctagcagcctgctcgatccttgtgtcactcttagcttccagtgggtacattctttcgcagaaatggttatcacttctgatagctgtcacatngagcgggttatt

SEQ ID NO: 18593 - DNA, 298 bp, Sorghum bicolor
  Clone ID: LIB3478-043-P1-K1-F1
cgagctaggagcatagcacccacaccaacgaataagcatagcgccgatggctgcctatatgatctcgacgctatatatactaacgccgtgcggcagggcacaaggactgacagccgtcggtcgctgcacctactgcttgcgcatactctgcatcaccggcaagtagaacaagaccgacaagcactgcgggattggaggcggcctgaccgacgacaacgatgcctgaccgaggaatgtaaagggcaagggcgcacaccacatagtcaacaagcaccgaactgacgtcgaccgatacagc

SEQ ID NO: 18594 - DNA, 260 bp, Sorghum bicolor
  Clone ID: LIB3478-043-P1-K1-F10
aacgacggtgcgatgatccatccctgtgctcacatgaccacaggtccatacttagcgccgcagcactgaccttataccaacgacggcatacgcggccagccggccacctatactagttcacccaccctacgtacgtgcacctacgatggcgaccacggagatggcgaccacgaccgcgagcttgctggtgttgttggggcacagcacgcgcgccagcgacggcaggttccgcagtaccactaccacccatattgccgcgg

SEQ ID NO: 18595 - DNA, 226 bp, Sorghum bicolor
  Clone ID: LIB3478-043-P1-K1-F11
attgccccgatccgtacctgctgttgcaatcatggcgaccaccgaggcgctcttcacaggcatcaaccacacccagatttgccggtggcgcgctacactgggcaagccaatgcaggggcatggcctggggatggacagggagcgcgcccagagcatcacgtgccaggcggccagcatgatcatagccggccgcgtcccaaacatggcgaagcagacgctgatgaac

SEQ ID NO: 18596 - DNA, 348 bp, Sorghum bicolor
  unsure (1)..(348): unsure at all n locations
  Clone ID: LIB3478-043-P1-K1-F5
attgcagtcacgatctgtgtttgtcaagaacttaaatttcaagacaacagatgaatcactgaagcagcatttcagtgcaaaactaaggagtggcagtcttaaaagtgcaacggtgaagaagcatgttaagaagggcaagactgtttcaatgggatttggtttcgttgagtttgactctgttgaaactgcaaccggngtgtgcaaggatctacagggaacggttttggacgggcatgctttgatcttgcaactgtgtcatgggaagaaagatggtcaagctgcaaagaagaatggcaaggataaaagttcaacaaaactgcttgtgcgtaatgtagcatttgaagcaac

SEQ ID NO: 18597 - DNA, 305 bp, Sorghum bicolor
  Clone ID: LIB3478-043-P1-K1-F9
gcgggaggcgtatgaacaatcaacgatgggtacctattgacctaatcttggcggtcaaccggatgagggcatttactgtcttggtggagcggcgactacatattatatgctgtccagggatctacatgtattggaaaggcagggagataatgtgaccaccgcgcaatgatacgacagaatggcatactcaattaatgctgtgcactagcaaatcatgatcgtattatgctcagactggtacttaagatgcacatggacagcgtcaactattctatattacattatgaaactgtgatttaacctgc

SEQ ID NO: 18598 - DNA, 286 bp, Sorghum bicolor
  Clone ID: LIB3478-043-P1-K1-G4
cttctattctaccttccatgtctcgagcaagccttaactgcatctatgatagcattggtgttcaaagaatatccaaagcagtcaccgagaatgatgccttcaccttagacaattaccatttcagaacagttgatccaagtaaggtgatcaaggttggtctactcaaaataattctctcattccttgctgatcctgctctggacattcctgctgaaaagaggcacaggatggtttcttgccttctgaatgtgactgtccaagagagtgatgaaccaatcacagtggg

SEQ ID NO: 18599 - DNA, 413 bp, Sorghum bicolor
  Clone ID: LIB3478-043-P1-K1-G7
atggccatggcacgagatggtctgttgccatccttcttctctgatgttaacaaacaaactcaagtacctgttaagagcacaattgtgactggcatttttgcagctgctctggcttttgcaatggatgtttcacagttagcaggaatggtcagtgtaggcacacttcttgcattcactatagttgctgtctcaatcttgatactcagatatgtccctccagatgaggtccctttgccaccctctatgcaagaatcattccatttgaaccaggaatgcgatgaggaaacggacaggggccttcttggcgttgggaactgtaacttgtctcagacaaagaatgtgattgtggtagtagaatcagtgaaggaccctctcattgataaaagactgcataaaggcaagatggatgagac

SEQ ID NO: 18600 - DNA, 193 bp, Sorghum bicolor
  Clone ID: LIB3478-043-P1-K1-G8
ggaggggaggggaggggaggggagtgcaccttcttccaacatcacctactccttctgccccaactgcttgaatctaacggaggtgggggtacactactctatgttggacactgtcttcaccaagtccatccttatcctcaaggcgcactaatttttctacacctcctagtacatcattttcggcaacattcca

SEQ ID NO: 18601 - DNA, 425 bp, Sorghum bicolor
  Clone ID: LIB3478-043-P1-K1-H1
gaaattcctcgccgatggaaggggccatcgcccgcggggcgcggtgcccaaagatcagccgcgccacgttcggctgcccggcagtacgcgtccgtgtgccgagaagcctctgcggcggccacctgggtgcacggtgcagcagcgcccgtgccatgggcgagagcgcgcgtgacgaccccaggccaagagtggcgcgcgcgaatggccaaggccatggggaggtccgcgctgcggccgggtccgggtgctcccgctcccgcgtcgccgtcccgtggcgagaagagggggagcgtggccggcgccgtggcgctgatcgttgggaccagcatcgggtccggcatcctcgccgtgccgcagcgcactgcgcccgcgggcttcgtcccgagcgcggcgtgcatggtcacctgcttggcgttcctggtcgc

SEQ ID NO: 18602 - DNA, 348 bp, Sorghum bicolor
  Clone ID: LIB3478-043-P1-K1-H8
ctcactcgtacggtccctaccagcgaagtcatccaaaaagctgaacaaagagctatttgacaaaccatgtgatggaccgcgtgctgagatcgttatgcacagtgctgggaccgatgcctcagcctctaactgcatatacgaaggcaagaccattatcgagagcacgaacggaggtgcaaccagggctgatgcagcgcttgaagatacagatgatcaaatagacgaacattcagatgaatctctagatcattatcgagcagatgatcttgacaacgaactatacagcttggaggactggtatgagggatcttatcagaagcctagcattacactggagagtggcatcgg

SEQ ID NO: 18603 - DNA, 223 bp, Sorghum bicolor
  unsure (1)..(223): unsure at all n locations
  Clone ID: LIB3478-044-P1-K1-A11
cggggagccactctcggcgcaatcctcttcgcacgacagggttataatcaagctcaatcgaccgatatggctgaaactacaagcacggtggcgcttgatgtggttgtgacttangactattatctttactctcttttgttttgccgagaacctcctgccatcctctgttgccgctactgacgtttctgagaatagaacagagcgtttcatgttctttctgatg

SEQ ID NO: 18604 - DNA, 431 bp, Sorghum bicolor
  Clone ID: LIB3478-044-P1-K1-A6
aaagggctctggtagatccaaatggacttgacaatgaaggggagaaactcaccatataggcactcgatggcttacacaccagtgctgctgccaaggctactgaagaggaaatcagagaagacgctaatggaacatatgcagggctacggtatacgcaaggactgtcagctgacatgttgacatccgcaatgtcaactactctggagagaacttcatgctcttgcgctttgatcatctggcggcacatctgttctatcaagttgccctggtctacacgagcctgcaattcaggaagttgacaaagctgaccatgaactctcgagaaaagtagatgaatctatgcaaaaagatattttacacagtgctcatgacacaatgcggtatgctgaggtcatcagcccaccttaccaggaagcatgccagcttaaaat

SEQ ID NO: 18605 - DNA, 452 bp, Sorghum bicolor
  Clone ID: LIB3478-044-P1-K1-B9
gcgagaatacgtaagcacccacttacttaatgaccaccataactcgcttgttcctgctaggcatcacacgtcacctagacaagcgttacgtggaggctggatgtgatgcatgtgatatgtgacagtgacctctgagtccttggctagctatgctcaacagacgcattgtgtcacacacaccagaatgctggacacctatcaaacatataaagggtagggagacctttaccatagcatatgacacattacgcacactattctgctcacatatacattaactgagcaacacgcttaaatcgctctgatcgtgctgcatgaagacaacgcctcagagcagatctgaaactaggtcgactcaaggacttggtatccaggtacgctgaccatacataggcagcgctagacgacttgctatataagctcctacgcattgagccatccatacgtgttac

SEQ ID NO: 18606 - DNA, 189 bp, Sorghum bicolor
  unsure (1)..(189): unsure at all n locations
  Clone ID: LIB3478-044-P1-K1-C11
ggcggaaactaaaagatcactcttccatgacctcgtcaaataatactgntcatacacatctatattaaatattataactcgcgcgtcggtattactattcatactcatcaattacaaatacatattcaatctcttaaaaatatatacaataatactttctctctcacaacattaataagtctctctatc

SEQ ID NO: 18607 - DNA, 295 bp, Sorghum bicolor
  unsure (1)..(295): unsure at all n locations
  Clone ID: LIB3478-044-P1-K1-C5
cgggcagcatgggatcctgacaccgngaggtagtgacattcaataacactaccgagcgcgagagcagcatgggatgaagatgcagtcacagctcatggccttaacgaggatacattgagaggaactgtctggcgccagcctcctgggcaatatcaactccaatagcgggtctctaaaacgaggcagttgaagagctatcatctggaccatgggacgcctgatgaccttcgtataacatttagaaaatacctactcgacaattacatctatgttgcaatggattactacactggac

SEQ ID NO: 18608 - DNA, 508 bp, Sorghum bicolor
  unsure (1)..(508): unsure at all n locations
  Clone ID: LIB3478-044-P1-K1-C7
cccacgcgtccggattcctgttacgaacatactttcccggttctgcaaaggctcaggatttgcttcctctaagaatggtgagtcctggtcatctgcaactttccaggttctactgagggagacatgtattcatgaacaagagctgttcttttcctttctcaatcgacttttcaatacactcagctggacaatgactgagttctctatgtccatccgggagatgcacgataaaaaccaggttgctgatttgcagcagaggaagtgcagtgtcatttttgatatatcatgctgtcttgcgcgaatcttggaattctgtacccgagagattccatgtgcatttctcatgggaccagatatgnaattgcggggttggctgaattggtgtctttattctcaaccacatcatatcagcagctgatgcgagttctttgcatgacactgaacggcagggagcatcaagagaaacaaatcgactatgacttgctcctttngcgcatatcctcagcta

SEQ ID NO: 18609 - DNA, 447 bp, Sorghum bicolor
  Clone ID: LIB3478-044-P1-K1-C8
agaagaagctctcgcaaacagtggcttatatctcgtccccgcgcaaggctagtcaccatctcccccgttacttacttaccgaggacgcagaggaataagctccccgatgcctctcgaaccacctccttccgccgggaaaagtatctgccggggaccacctgagtcctaatccccttccggcacgcagcaaaacgaccgagcgcccttctccattcccgccggcacggctcttgcggccagattcgatcacatgaagcgaagcgaaagtactcgatcgtatgcttcgaggctctaaccaactgctattggggggctcaagcgcgcgcgctcgtctctcggcgctggcctctccagctataataaaagtggcagcagcagcagcacctgcacaagggactgggcgaaccttgtggacaggccagctggactgatcgccgagattgccct

SEQ ID NO: 18610 - DNA, 349 bp, Sorghum bicolor
  Clone ID: LIB3478-044-P1-K1-D4
gcggctattgatgcaaatgtatcatccccacctctcttatcaaagaaggatagctgtgattatgatagggtttacagtaatcttgctactggaacccctccaaggactccgttgcatccattagctgagagttactgggaaaagcagtggagaaacctacacaatggtggaactgtttctaatgacggaactactcctaaggagagtgataagggtctttcttataaaagatcactaaagcaatctttgagccagaagcttggtttatctaggacagagtcagatccttctccagttaagatagtcagcgtgaagagtgacaccaaagaattcagtgagacggtgtctt

SEQ ID NO: 18611 - DNA, 331 bp, Sorghum bicolor
  Clone ID: LIB3478-044-P1-K1-E10
gcggaggatgcacatagtgacagtacacacgtgcttagcactgctagcggtacgcacataacctgtgggctatttctttcaaggagtgcctggcacacatgcccgcgtgccgtaaccttacgtacagattgtgtcatatatctcaaggtgtcttagaatcgaacatcgtgctattctaactgctataatcatctgtcgtgagtataggtcatgggttcgacgccaatgacgattcttatctgtgcatcacatactactactcttaagagaactggctaagatgtctcttatgctagagggacgtagtgcaggaacagacacacttcaccga

SEQ ID NO: 18612 - DNA, 331 bp, Sorghum bicolor
  Clone ID: LIB3478-044-P1-K1-E12
gcggctcggctaggtcgctctacctcatctctcagctctctgggccactcattgccggttggcattcaatcgttcctgctgccggggagtgggcgcctacgaggtctcgccgtctccagagtgctctatctctatctcaagataaaaaactggccaagaacgagagatacacgatacgaaagagaggcaagagagagaggcgatcggaggcgcctccggccagggggaacataaacggaagcgtgcacaggaagctgataaggctactgtcgatcgtgccctttagctgccgtactggacccgtctactactcgccgaccgcgaaccacgc

SEQ ID NO: 18613 - DNA, 305 bp, Sorghum bicolor
  Clone ID: LIB3478-044-P1-K1-G11
ccttactttgcgaaaaggctactcactgatcccaatccatatctcagagatgctttaattgagcttctattcaaggatggaggatggagatggaataggcttgaaaatcttcttgttcaagggcgccaagatagagagtttgcagccaaagatgcactgcagcctgttctaaagcttctccttggtcctgatggggaggaactgcgtgtgttagttgtgaaagaggcagttcgtgtaacagaagccatcactattggaacactgatcgattcatacaatgctgcttcagcatttttgaggccact

SEQ ID NO: 18614 - DNA, 158 bp, Sorghum bicolor
  Clone ID: LIB3478-045-P1-K1-A3
gatgattcgtcagacagtgtggttgatgatgatgatcatatttctaagtttgagaaagaggtggaagagacatttcagcgagccctgggtggcggcgttaatcgagataatttgatactagagattaatggcctaaggttagcctacagcctttaaca

SEQ ID NO: 18615 - DNA, 295 bp, Sorghum bicolor
  unsure (1)..(295): unsure at all n locations
  Clone ID: LIB3478-045-P1-K1-D12
ctccagctaggaaactcagngcagagaaagggggaaaagcaancggcccacgnctattctgaggacataactgaaaaacaagctaaaatggggctagtgtggcgagttcactcaaacgataagagcanattcaagttgctatattatgagctaagagaaaatgggaggctgagtcttgcactacaggaagacagtgtgaaggcaggagaagatactgctgcaaggatggatatcctaggtantcctgagaaccggtgagaacaaaagaacctggcagctgctgcaaaggatnctg

SEQ ID NO: 18616 - DNA, 192 bp, Sorghum bicolor
  unsure (1)..(192): unsure at all n locations
  Clone ID: LIB3478-045-P1-K1-H12
gctgctntctgtgttggcgagatatgcaagaatgggggtgcttcagcactgaaatactatggggatatancttcgtctctgcataatttgtttggtaacttagaatcagatgatgcagtaagagaatatgctgctggtgttattgtaggatgataatggtgcatctaagtcaattcctctcaaccaggttct

SEQ ID NO: 18617 - DNA, 190 bp, Sorghum bicolor
  Clone ID: LIB3478-045-P1-K1-H7
gtcggaatgatcctcgccaacaccgaggagagcggcgaggagctcatcgccgactcccacctcgtgccggcgactatggtcgggcagaagttcggcgacaagatcaggtattacgtccagacggacccgtcgccgacggcgaccatcatgttgcgcggcacaggcatcggcaagtcgccgtcggcgccgc

SEQ ID NO: 18618 - DNA, 488 bp, Sorghum bicolor
  Clone ID: LIB3478-046-P1-K1-A10
cttgtcttatcaattgcttcagcgtgctacataatctgctgattctatagtatgcgatggcctctggacttgaactaactgaacacgcaccgtgttcgtcgcttcgcaatctgcagggtttcagaaagatcgatccggacagatgggagttcgcgaacgaaggctttctgaggggccagaggcatcttctgcggctgatcaagcggcggaggccggcgccgccggcgccgtacctgcaggcgtcgcagtcgcagtcacaggggtcgtgcctggaggtgggtcagttcgggtgactggaccgagagatggaccggctgaggcgcgacacgagcatcctgctggccgaggtggttaagctgctgcaggaacagcggagcacgcggtcgggcatgcgcgccatggaggaacggcttcagcacgctgtagcatatgcaggtgccgatgattgggtttctttggctggcgatgcttaggccggctttttacaa

SEQ ID NO: 18619 - DNA, 437 bp, Sorghum bicolor
  Clone ID: LIB3478-046-P1-K1-A11
accagcccaaaccacccccgccgccggccgtttccccccccgcactccaccacctgacctgcgccggcccatcctcccggcctggcccaagccaacgcgccccgcgctgcccctgccgtgccgagtcccagccggatccccctcaaagcacgacaaccccacgccgccggcaccgccgcaccaccgaaaccaaccctacccaaaccaaatcggatcctatccccttcccctcccctcgcccaattcgctccgatccgccgcgaccgcgcgatggacgacgacgacgacgtgtcgcactccctctccccgtcgccgccctcctcctccgcgctccccgtggacgggcccgtcaccgtcgccgctgcgccgccaggctccgccatggcggtcgcgctcccgaaccataagaccgcggcgttcctgtacgcccgcgccac

SEQ ID NO: 18620 - DNA, 339 bp, Sorghum bicolor
  Clone ID: LIB3478-046-P1-K1-A3
actagttctagatcgcgatactagaactagtcgactaggtctagagtacctagcgcccgccgcaacgacatctgttgaacgagatggggttgatttgccatgtcgagcacccccccaagtgcatatcaaactaccttgcaacactcgaagcccctactgagcttaatcaagaggtatggaaccttgccaatgacagcggggggacaactctgtgtgtgcgaattaagagcgaagtagtcgcatgtggagtggtctatgcggcagctaggagacaccgcgtaccccgtcccgtagagcctgcgacgcggactgacagggatgcttatcaagcacgaattc

SEQ ID NO: 18621 - DNA, 287 bp, Sorghum bicolor
  Clone ID: LIB3478-046-P1-K1-B10
tacactccacgctcttcttgcttgcctgtacgctatggctatttccatggtaggagagatgctgactgcggaggcgatgccgcacgatggactgcaagtgccaaagctggctgctgtttggtgtccatagatcgccgaacgacctgatatgaggctgcaccaggactgtatgttgcgctgtggaggatgaaggatcatggctgcggaatgccttgaacccttacatggtctatctcacatctttactgagagcgacgcacaacgcgtctctgcactgatgttccaac

SEQ ID NO: 18622 - DNA, 437 bp, Sorghum bicolor
  unsure (1)..(437): unsure at all n locations
  Clone ID: LIB3478-046-P1-K1-B4
ttttttttttttatttttccttttccgccttttnttttacttttttcaaaaaaaaaaaacatgtttttggaggatcatgaacaagttgcgtttgtttttttaatatatataagggaacagtttacagaacggggctaaattgatccatactccattcggttgctagaaagggtgaaaaaaatggccaggattttgtttggactttggagtatgaaaaggcttcataaatctgcaccagcttttttactgatcaactgctttttatttttccccacttccattgcatgtaatctataatatggccacgacagtactctttaaaatcagaagtagctcctacttgtcccactcatgtttcttccactctggcaattgttgaatgatcatttgcgcaaaaaacaagtcttaaaggaatgctatcaatgtcatgccttgtg

SEQ ID NO: 18623 - DNA, 251 bp, Sorghum bicolor
  Clone ID: LIB3478-046-P1-K1-C8
ccacgcgtccggaaagcagcctgcagctgcactccagccgagggcttgccggcgctgcctaccaccaccaggcggcggggtgaccgcaaggccatcacccgaaaggcactccagtggtgcagcgacaacggcgacccgtatcgcagctgagacccgggaccagccgctggggtgccttcacctgcggccgacggcgagccgtgtgcggcttgggggtgccacgtcctcttgggcgcgctaagccgtcgaca

SEQ ID NO: 18624 - DNA, 471 bp, Sorghum bicolor
  Clone ID: LIB3478-046-P1-K1-D7
gcgactacttaggcttagagcttccaatagacttctcacagggctaggggcaatgttcgaattggaatgacatttcgggacgttacaaaacccccctccttaaaatagagctcgtccaaggagtataattggataagcttccaaaggataggtgtcttgttgtgatatcttatatcttatagtacaactcagagactttttcctctccaggattcaaggtataatccattgtctcaccttgacatttcggacaacaacttccagcataaatccttgtggtttcaagtccttgggccttgctgagttcaacatctttacaattccaatatttatttgatctatagagcttttggagaaaattgatcaatattctgttagatgaacttgataaacacgctctgttgagaaaggtacaaggtgctcttcgtgcatcatagatgtcttgagatctctgtatttgcttgatagaaa

SEQ ID NO: 18625 - DNA, 429 bp, Sorghum bicolor
  unsure (1)..(429): unsure at all n locations
  Clone ID: LIB3478-046-P1-K1-E12
attaaacgtgacctggaccttgctacccgccttgtgcgcaagctcgacaacgagctgggcgatgactacttcggtgtggcaaagattgaggagcgtgtccaccagctttctgagagcggtcagctgcagcccgtcgtgcctcccaagcctgaggctaacgacgagatggatgagggtgaggaagaagaggagggtatgatcgaggaggacgaggccgacgacgaagagctgcttactaagaaaaagaagctcgatctctnggtggagtacttacgtcgtgtctacaacttctgcttcttatgcgtgttcgagtctgactcggtacacgagcttcagcgcaagtgttcgggaggccatcttcgacgcccgcgcgcataccttacgactgctgcgaaagagaccgcccgtgcctcggcctctggagaagca

SEQ ID NO: 18626 - DNA, 355 bp, Sorghum bicolor
  Clone ID: LIB3478-046-P1-K1-E9
agttcttacatggctacaagcctgcacgacgacatcacagaacttcagaattttctcttggaagacgatgacgtcaactttggcatgggttcagaaaacatggcgctcgaacgcatccatgcaccagaggatattggagaattgattcatgggttcgacacgcaagaagaacttgagctgggcagcggacctgagctactggagatgcctccagcttctggtcctctgtgtcacgatcccacaatctgcaggtccaacggaaagaatgtgctgtgtacatgtttggacgctactctttctgaagccaactgactcagtacatcgtctgacagcatagtgttcttatcacgcacca

SEQ ID NO: 18627 - DNA, 332 bp, Sorghum bicolor
  Clone ID: LIB3478-046-P1-K1-F5
agcacgcacagcacacacacacacacacacacgctctcatcctgtgctaggcacccacaacgacatacaatggccaccgtcctgagcagcgtacgcgcgccagcagccttctccgttctccgtgttgcgccagcaccagcgcctcccgccaccgttgcgctgcacggcgaccgtggcccgctgtgacaggctgagaacgcaagccacctacaccgtgaagctggtcacgccggagggggaggtggagctgaaggcgcccaactacatcatcatatctgtacgacagctggtgtggaaggcatggaattatcctactacgaccgcagcgggat

SEQ ID NO: 18628 - DNA, 287 bp, Sorghum bicolor
  Clone ID: LIB3478-046-P1-K1-F8
tttattggtttagacaacttatgttacagagcgcataccattgcaatgactgattgggtttataatcttcagaaggttacatcctgtttggaataacaatgattacatagttcctttaaacaatagggataataaagggagattattttaatttattattatgctccaatggtgccttcaaaaacagggataaatggaaatattaattattggtggctagaagggtcataaggtcttttgggactgattctagctagaaagggatgatcttacccattaaacgtaac

SEQ ID NO: 18629 - DNA, 328 bp, Sorghum bicolor
  unsure (1)..(328): unsure at all n locations
  Clone ID: LIB3478-046-P1-K1-F9
gcggctggtggccatggacctcaccggcgcctcctcggtggcgagcgacaccattcctctcctnctgacatacaacaagcagcaggaggaggaggactatctcgcgggcgactacgactaccttgtgcgagccgtgcaacgcggaagctccgggggatggagatccgcgctcttcggtatgggcgtagagatcgccgtgagcttctcctacttatgcatctttgcaaactctgatcacatacctgacgggcccgttggggcagtctaactcttccgcctcggccttcagcaacgcctggtcggacacgggctgcctcatgcccctgct

SEQ ID NO: 18630 - DNA, 317 bp, Sorghum bicolor
  Clone ID: LIB3478-046-P1-K1-G3
catcatcatgtgaaacccgcaatttattgtctgcttagtaacatactcaatagtctagttcacactgtgtgctttaatgtgtcctttttccaaaaatctattgctagcacttgaattatcagccttccaaaaatataaatattgctctgtttttcttttttctgctcctttgatctgtgttccaagccaactggaactacagttgcaggcctgacgcatcgacaatacctgtgcagtagcaagcccaacacatctctcaagctccctgtaccttgatcttcaagaaaataacatggccacagggtacagctcacatg

SEQ ID NO: 18631 - DNA, 147 bp, Sorghum bicolor
  Clone ID: LIB3478-046-P1-K1-H10
gatcgacttgcggattcacttgattgcacatgcgatggtgatatgcttggtgaccatcttgatgacatggaagcagactgggcaaaacctattgcaagcattagtttgagctgcagatgcatctttcttctcgtaggaaagacaaga

SEQ ID NO: 18632 - DNA, 302 bp, Sorghum bicolor
  Clone ID: LIB3478-046-P1-K1-H8
gctagcccgtgttgcaacgctgcatgcttggctatattctacacggcccaggcggcggcggcgtcggggagcgaagtgtctggcgtcttggttgcttacgaccggctatgacaccggtcgtcgcctcggtacggcgcaggggctggctgaggagcgctgccgctgtcgcggtgggcttcaactcggccgacgaggcagataatatcgcgggatgactgctggagggaaccctgctgacctgagacggacgagtctgtcactacttcacgcgaatccacagaagaggtggccgatgggggtgc

SEQ ID NO: 18633 - DNA, 384 bp, Sorghum bicolor
  Clone ID: LIB3478-046-P1-K1-H9
cttttgaagacctcgatgaggtcattgacagatatgtggacccattggtaggacacctgaagagcatgctctcttatcgtaaattcagaaagggtttaaaaaatgaggttgatgagatgttaaggtcagagaaagcagagaaccctatgagaatagcgtatagtattggcatctgtcatgaacatgctggcacctttatattgtcatatattaggagtacatatccacatcacgagtatataggcttatacccgacgggcttcagattcaggatgagagactttgaccacattggccgccttgtgtcctattttcagaagaatatagacagaccaccatccgctgctggaccatcaatgcgaagtgttgctgcactggtaccta

SEQ ID NO: 18634 - DNA, 427 bp, Sorghum bicolor
  Clone ID: LIB3478-047-P1-K1-A12
acacgctgagatggtctgacagatggtctggtgcttgtgctttcagtagccgtcgtaaccgagaccacgatggccgatgccggcgctgtcgcagcgaccgacgacaagaatgtcaacatgcttatcccaaggtgagcaaggttgagcatatcaccacgaacaagaaaagcctgataaatactgtgtcttgaatcaactgtaagcgcagaggctaaaccagatcgaaaggctcaagatgcggaaaagcctgaggaggtgctggcaaaacggaatacaagttcgtgccgtacccgaaacttgtgccagaccctgagatgtgccaaaactggccgtgggattaaccttctcaccaggattggcagtgctgtcagaagcattgttcgccagcgtcggcatcgacgcagcagtcaccgtgcacctgttcgag

SEQ ID NO: 18635 - DNA, 309 bp, Sorghum bicolor
  Clone ID: LIB3478-047-P1-K1-A9
cggacacgtgggtcgggacagcaagctacatcaaccacatgctctgcagcaaatgatgtgaaagttggcgctagcccaacgaggataagggtctgcaactgtctcatccaacgagaacaccaactacgcttccctgtcccgcacacaacctaccttaagcactcttaggtgcgactccatgatacaccctattcaactttaagaagtcgttcgctgagatctctctggacagtatcaaacgtgtgaaggaccatattgcaagtgaaaccaaccagaactgctccactttccacgtggacactgtcataa

SEQ ID NO: 18636 - DNA, 432 bp, Sorghum bicolor
  Clone ID: LIB3478-047-P1-K1-B10
attggaaagtatgcaaaataccttgagatgctttctatagcatttgctggagatagtgataagggtatgatggacgtgatgaacggatgtaagaatctgaggaagcttgagattagagacagtccatttggtgatgttgcactcttgggaaatgttgccaagtatgagacaatgcgatccctttggatgtcatcatgtgatgtcacattaaaggggtgccaagtccttgcatcgaagatgccgatgctcaatgtggagatcatgaatgaactagatggaagtagtgaaatggaggagaaccacacagacatctctaaagtggataagttacatgttagtgaaatggaggagaaccacacagacctctctaaaggggataagttatatgtttaccgcacaactgcttgagcgagggatgatgcaccaaatttt

SEQ ID NO: 18637 - DNA, 468 bp, Sorghum bicolor
  Clone ID: LIB3478-047-P1-K1-B11
gttgttttctgaggtgcgtccggacgcatcctaaccgccggacgtccgggcgctagatgtacccgtggtcttagcagcccaccacctcctccggccttgtttagttccaaaaaaattttgcaaaactttttatattcctcattgcatccaatcttttaatccatgcataaaacgttaaatatatatataaataaaaactaattatatagttcatctgtaatttacgaaacgaatcttttaagcctagttagttcatgattagacaatatttatcaaatataaacaaaaatgttacattgcctattttataaaaaaaggaactaaacaaggccgcttgctgaccaacggggtctcgagcgggatgcatatatagccatgcctctaatcgtgctaaggccagtctcaaatggagtttcacgatgatgtcatgcacatttattatagcgtcatgtagcaaaactgtacttt

SEQ ID NO: 18638 - DNA, 344 bp, Sorghum bicolor
  unsure (1)..(344): unsure at all n locations
  Clone ID: LIB3478-047-P1-K1-B6
cgccgagccgctgctcctgctcctcggccaggacgccgacgtcgcgcgcgaggccgccaggttctccatctacatcatcccgtccatctacgccatggccatcaacttcggcgccagcaagttcctccaggcgcagagcaaggtcaccgtgcccgcctacatcggcttcggcgcgctcctcatcaacgtcctcctcaactacctcttcgtctacgtgctcggctggggtcttcccggcgccgccgncgncttacgacgtcgccactgggtcatcgcgctcggccagatggcctacatcataaggtggtgcaaggaccgcttgaaggggtggttcgccgccgtct

SEQ ID NO: 18639 - DNA, 321 bp, Sorghum bicolor
  unsure (1)..(321): unsure at all n locations
  Clone ID: LIB3478-047-P1-K1-B7
gaggaagctgctggtgctctggctctgctgatgaagcaggctaccatcgtgcatcttgttgggagctctgaaacggtgatcactagccttgttgggttaatgaggcgtggaactccaaagggcaaggagaatgcagtgtcagctttatatgagatatgccggagaggtggatcaacattggtacagcgtgtggcaaggatacctgngttgaacacagtaatacagaacatcacgctcacaggaacaaagcgtgccaagaaagaaggcaagcttgattgtcaagatgtgccagaaaaagccaaatgccatcggctttggcac

SEQ ID NO: 18640 - DNA, 366 bp, Sorghum bicolor
  Clone ID: LIB3478-047-P1-K1-B8
cgttgttggtcatgaagatccagtgcgacgcgtgcgagggcgcgcgcggacacggtggtgtgctggatacactaggacgggctgagcgcgtgctggtacctatagatcctggcgactatcgtgacttggagttgaaacatactggggtattagaagtgatactggtgggagttagggacttaaacaactaggaccttgtagcaaagttcatactcttgtgtagaggtatacatactttcattgcgtgagagaaaccagaacatccaaacacttaacactgatttgaaccacatctggaactagcactatgaatgtgtggttggggacatatcttcacagtacttgactgtaaaaaattatgattac

SEQ ID NO: 18641 - DNA, 397 bp, Sorghum bicolor
  Clone ID: LIB3478-047-P1-K1-B9
taagagatgcagactattgactcactgcacatccttgttgccgtacatgcagatgtctactctggtgctcggcctttgttggagacgacaatgaaaattactggttgagggtttgcacaacataccacttattgcatcttcatggagaataacaccaaagatattagattggtcgatgcgaacggcatgtggacactgatgcttctgcccgagtattcagagactgtgctacaaacatacttctcacccgtggcacaacaggctatgaaatccttacatgagcttctgatggacaaagactcttaaagtgtagcagacaccctctcaaatactgcactccaactgtgaccaaccctgggcactgcatactcagcatcatatggacaaccatcgccat

SEQ ID NO: 18642 - DNA, 239 bp, Sorghum bicolor
  Clone ID: LIB3478-047-P1-K1-C1
cacggccatggccatggccatggacacgggggcatcgtggtcgctggcgacaagcccgaggacgaggaggagtccaccaaggtgcagctccgccggaaccgcgttgtcgttcaggtcctggagatgggcatcatcgtgcactcggtggtgatcggtctgggcatgggcgcgtcgcagaacgtgtgcacgatccggccgctggtggcggcgatgtgcttccaccagctcttcgagggcat

SEQ ID NO: 18643 - DNA, 424 bp, Sorghum bicolor
  unsure (1)..(424): unsure at all n locations
  Clone ID: LIB3478-047-P1-K1-C11
gtgcccttaggggcaaagaaactgtgttcccctttgcccattgcctggagatcgatgcatgctgtcttcagttcagtccgatccatgcatgcatgggtttttgctgaaccggtggaactgaacaccatcctagctaattaaaccgtacttattttattagatgcgtattatatataacaatgtatgtatgatgagtctgatgttttaaaaatcaatgccatctatatgtcatgcatatatatatatcatcgtggtcatgcatgatgatcaggttgtgatcgagaacaagcagcattacaaggtgctgggcaaaggcggggacctgaccacactcatcangctgcaggtggagaacggcaaagtggtcaagcacgaggattgggacgtctcgtattattcattccgatataaatacattattact

SEQ ID NO: 18644 - DNA, 320 bp, Sorghum bicolor
  unsure (1)..(320): unsure at all n locations
  Clone ID: LIB3478-047-P1-K1-D2
ccaacactatctgccagagaaagaacttgtcatccctgatcctcttctgcacttcgttcagtcccatggcgctgttcttactatcgatcaaaatggccgggtcctattctctggcaacggtgatgagatgatagacttgctctcggtcttcctggagttcaacatgtctaaacgagaaactggtggctgtaaggctgcatttcttgttccatactttgagaggaaaaggcgttctcnggctaacagccaagtatccaatttaaaattagcaagcacagcagctgatgtttcaaaaagtactgatgtgaactcaaaatctt

SEQ ID NO: 18645 - DNA, 293 bp, Sorghum bicolor
  Clone ID: LIB3478-047-P1-K1-D4
cttctgttacccatctcgccgcatcgcatggcggcgccggccctcctccctccccctaccatggacgaagaagcgccgccccgcccgccccagcgaccccttgccccgccccacccccactccagccggagccgaagcccccgctcctgcgccggctcccgcccgtgcgcgtgacctcagagttcgacggcgtcctcaagctccgtctccgcattagccatggcgctgggggaggagggatcccctgcggcccgtccgaggctggggttctggctcggaactttttcattgat

SEQ ID NO: 18646 - DNA, 348 bp, Sorghum bicolor
  Clone ID: LIB3478-047-P1-K1-E1
accacgcgttcgctcaactcagactcggctcatttacttttcttagagtcaagctagtattttagctcattaagttagtgagctagctcaagctggcttgcaagctagctcacaagctaaacaagccaaataatttatagctggacaactatatgagattagagtctagaattgatgtatgccacacttatttacttgtcgttgaataaattagtatctattgatttataacagcgtcgtctcatgatagaagaaagagcacaaaatttgctcgaatttgaatgtgtaaggagcaagcgaactaaagagaaccttctggtctcttttgcagcgatcgacacgacactg

SEQ ID NO: 18647 - DNA, 158 bp, Sorghum bicolor
  Clone ID: LIB3478-047-P1-K1-E2
gctgcacaccatggacaacatggtccatgatctcacgaacggctcatatggcgcactgtacaaagcacgggctatcataacccaggaacttgaggctgtcaagatgatgtaactcacagaaggcgaacaaagatatgaatacataccgggagaaattg

SEQ ID NO: 18648 - DNA, 283 bp, Sorghum bicolor
  Clone ID: LIB3478-047-P1-K1-F3
gttacctacaaatagaaacaaagtaaagttactactagtataaaatagaatgaaacgccacaaagattgtgtttctcatgatttcttttgaatgaaatggcaggccgagagctcataccatatgagaacccaagccccaccatgggcatccaccgtattgtcttggtgctctaccagcaactggggcggggcacggtgtttgcaccgcaagtgcgtcaaaacttcaacttgcgcaattttgcacgccgtttcaacctctgcaagcctgtggctgcgatgtact

SEQ ID NO: 18649 - DNA, 450 bp, Sorghum bicolor
  Clone ID: LIB3478-047-P1-K1-F7
gactagttgtagatcgcgagcggccggccttgtgtcatctcacgcagttgtggcagggttgagcaaaatcaccagcgatcggctgcacagcaaggcggctaaacagcagactgaggactataacaactcttcagggctaaggccaggatcttgttgcgagagcactgccgcgagaggagacataccatacggcgctatggaggtcaaaaatgtccacaacgtggcttgaaagaacaccacgaggtggccatgaccacgacttttacatggaaaccccacacgaccatatgacttactggcccgagatatttcaacaaaaccaagccttatgaggacccctcgcctgccttttttttgttcagcttttcttcaaaatgatcaacagaaggtcagcaacattggcaggcagcttcttaattaccacattgtaggactttctgatgttaaaca

SEQ ID NO: 18650 - DNA, 346 bp, Sorghum bicolor
  Clone ID: LIB3478-047-P1-K1-H10
atcaagatagtaacactcattttggtgatccagggtgtgtgtggctgtgagcgcttttcaagcagctcaataggtgatgtgttcagaacaatcataaagcgagatgggtattccgggctcatgaggggatggaagccaagaatgctgttccatgcacctgcagctgcgatatgttggtccacatacgaggcctcgaagtcatttttcgaaaggttcaatgaagaaaggcggaaatagtctgggcatttctctaagccccatgtacttttcctgaagtcaatgtacttctacacagaagaagaagcatacttgctcagctgacagaaagacgtaacttcaggatgca

SEQ ID NO: 18651 - DNA, 320 bp, Sorghum bicolor
  Clone ID: LIB3478-047-P1-K1-H7
ctgttgctctcgatcttgctatagaaaacgacacgaaaggttctatgtgaacggctcttgcacatgggtaagccgatcctaagggacagcgtaaccccagcagacagggcgatctctcgtgttgacccaaagggaatatgactgagagttcacgtgccaccacgaggttgtggacttgaaaattaggaatgtactggacatctatctaccgtctctcaggagtctgttaactttctcaactgctaggcaacacaggcctcaagataggcctatggacctaaccttggtagcaagagcacctctctggtttcttggttctt

SEQ ID NO: 18652 - DNA, 477 bp, Sorghum bicolor
  Clone ID: LIB3478-047-P1-K1-H9
gaaatggtagggttctttggcacctctgctgcatctgatcactgtcatttgctaccaaaaaatggatcagttcaccatgaactgataagaccacaccataacagatcaagaagtgtgatcaggtgctgcagcgcagcaaggggaaggaccagggattattactaccaggtgctcggtatcacagttcattccacacctcaggaaatcaaggaggcttacaggaaactccagaagaaacaccatccagacattgccggctacaagggtcatgactacacgctgttgctgaacgaggcatacaaggttttgatgcgagataattccatgcatgctggtggaaggggcaggagtatagatgggggttaggaagcggtccctggggatggatacagttcttggaatgggcctgttagaagtcaagctctctttggggatgagaacaagtgcatatgatgtccggagggcgtgcattatgct

SEQ ID NO: 18653 - DNA, 239 bp, Sorghum bicolor
  Clone ID: LIB3478-048-P1-K1-A11
cacctcaagagtgtacaaggaagaagaagcaccagcagcttctcttgatgctaccttgatccatcagcagcagcttcttcgtctgctttttggggagattattaggagtaggagtaggattactagttattattactagtgagtgagtgagtgagtgatcgagcgaggatgttggcggcgttcagcggcggtgtggtggaggtgccggctgagctggtggcggcaggaagccagacgcc

SEQ ID NO: 18654 - DNA, 397 bp, Sorghum bicolor
  Clone ID: LIB3478-048-P1-K1-A2
gcctgccaggccggccccagttccaagtgaccgaacaggtctgcgggcccttttttcgtcgtcctctaggcttcctgagatgcctgccaatcttttctgcgctcctactcggctggagctgatctgcttgactcttttcagagtgtgagggaaagctgacctcgttgctggtctaaattaacggatgagccttgatatgttatagcatggtatgctccctaatgacgcagttatagcggtattgggtatgagcatgatagttttgtgagtttttccccccttcatcgttgattacagtaaagctaggatggaaaccaaattaaacaaaatcgttctggtgtgtcgtgatgttacagatataattataaaaccaggccaataaagtctcatgatttat

SEQ ID NO: 18655 - DNA, 350 bp, Sorghum bicolor
  unsure (1)..(350): unsure at all n locations
  Clone ID: LIB3478-048-P1-K1-A6
gttggtgcatgagctgaggtctccacgagcatggatgctcctcctcttctgcgccttgcttgcacgccactctttggccatgttcatcagtgccaggagagcgaggaggcaggggcaggcgcaggtgcaggcgcagctagacgacgacgaccttctcctaccgccgccttcgcctccagctctgccggtgctgggccacctccaccacctcgtcggctcgctcccgcacgtctccctccgcaggctcgcgaggaagcacnggctcgacgtcatgctcctccggctcggcgccatgccggtgctcgtcgtgtcgtcgccgcgcgccggccnagcggtgctgcgcacgcacg

SEQ ID NO: 18656 - DNA, 341 bp, Sorghum bicolor
  unsure (1)..(341): unsure at all n locations
  Clone ID: LIB3478-048-P1-K1-C2
gttatccttactgtgagcagtctgagggcgagcgactccagtgagaggggggagagctgttagagcgagaggatgcgctgngatggcaagcgcatgcatggcgccatggcgtctatctccagctccgagaccggagcggctagcaccagcagattctggggcaaccggcttgccacctactgcgagccgaatcctggggtaagatttatggataagatatgcccaactgaaatgaaacttaagagaatggagcgaaataagactgaccaaacagtcttactgtgctatacaagacgcatgatatgatagtagacactacacaagtcattgcatgccgtgag

SEQ ID NO: 18657 - DNA, 198 bp, Sorghum bicolor
  Clone ID: LIB3478-048-P1-K1-C7
ctgaaccaccgggcatagttcgcgttcttttgggcattggcactcgacatcccacggcatgagcatgatctttgtagcacgtgtttctgagtcaacgatctacatggcttactacacaatcgcacatgatttgctcaatgtgcatatgaatggtaaagaaatctatccagtaaggtcagaaaaaatgacagatgaagt

SEQ ID NO: 18658 - DNA, 402 bp, Sorghum bicolor
  Clone ID: LIB3478-048-P1-K1-D5
cccacgcgtccgaagcaagcaaaaggttgtgtgcttatataagctgtaagcagttgcgagaagtcgatacatcaaaaatactagaagagtgtctatcatcgaatcctggacaagaggaactggcaaaggatctttatgttcctcgagtggaggataagaaccgtaatatgcggatgctcaaaatcaccaccatggatgatttagttaagaattcaatgaacattctggaaccgtcacctgtggatgctactgggaaagatcgcgaagatgtattgtcatcatcttcccctgttgatcttttattattgccaggacaagcttttgatagaactggtcgaagactgggacgtggttgggggtactatgacacattcttgatgaaataccaagaacttgcaaaag

SEQ ID NO: 18659 - DNA, 370 bp, Sorghum bicolor
  Clone ID: LIB3478-048-P1-K1-D8
cagacgcggccggatggcctcggactagtaccggtgacaaagctagatgcgctacatgggtctcaagtgtcgagccatcattatcaacaacaggccgcggcagcagcagttacagttccaggagcaggccgcatcatgcgtcgcaagagtgctgccaaggcatgccagtcggcgttgacagcccctggtacgacgtcaacctgatcctgtacctgcttatcggctccatggagccttcaagcttcctgaccatcaagtgccacagcctctacgggttctacattttcagtattggcgaggatctagagcatcttttcaagaactcgtacgttaactttaattactggctgtgggtatatacttggtacct

SEQ ID NO: 18660 - DNA, 242 bp, Sorghum bicolor
  Clone ID: LIB3478-048-P1-K1-E12
ggttcgcgcacgacaggagggcacctccgtgctcttcaggtgctctccgccttcgccttccgggacatctcgctcaccaagatcgagagcaggccgcaccgacaccggctcatccgcctcgtggacgacgccaacgtcggcaccgacaagcacttcgagtacatgttgtacgtagagtcgcaggcgtccatcgcggagccccgcgcgcagaacgcgctggacgacgaccacgagtacacgtt

SEQ ID NO: 18661 - DNA, 464 bp, Sorghum bicolor
  Clone ID: LIB3478-048-P1-K1-E2
tgtatttaggcgggttacttggtgtgtagaaatgaaaagctagtaacaatttcgattgtttattgttcatatgaaattggtttgagctccaacattttctttgtgtacaaactaacatttataatgctctagtggtattagttgcaaaaaatagaaatttttaaaaaatgctctagtggtattagaatcgtagtgttccaaattggaacaatgatatatcggtagatttttttgaatttgcaaaataccaaatgatgaatccggttaccggcttttgtcatgcaacagaaccagcaggttaaatcatcattagggaagaactttagccttttttcagattacaaggcaatggcactaaggtagagaagcaagcgtgcatacgctccaatagatacgcactgaggatgatatatcttggaactgcattgtaccagtgatctcagttctttcacacacagtaaaca

SEQ ID NO: 18662 - DNA, 369 bp, Sorghum bicolor
  Clone ID: LIB3478-048-P1-K1-E4
caatatcaaaagcattacttgtgaccgattgactgggaagtgcatgtgttctattggacgagtgtagagaaatctgtttgtgtaagggggtatacgcacgacaacattcttctagtgtcataatatgtttcctaactttgtcttctaatcatacaggacgattactcctgatgtgaagtatggtcgactttttggtttctacactcagactatcattgtggatgcaaatcattgggttttcagtaaagccaatgactacattcttatcgattcatatgtatagatcagggcctgcttgtattatcctacttttttagaactctaccattattctagaaatcgttgctaaagctctaaatctgagactct

SEQ ID NO: 18663 - DNA, 513 bp, Sorghum bicolor
  Clone ID: LIB3478-048-P1-K1-F12
atttggcccgtatgttaggatgctagtaattcggatgcagtatcacttttttttatgatgaattttggatgcctttacttttgctggtttcttatcatttggtttcccatacttattcattgtgttcttttggagttaaggtatatgtgaagcagttgcaggagatttcctggatgctcatagtttgcagctgctcaacccttacatgccaaacttaagtgcatcatggttgttccaacgagcgatgtcagtaaggccacatgtcaatgtttcaccaacctttatcaatgagcttctctttgctaattttcagtcaatgcagaaactaggggattcagtacttcagccatttctccaggatgtaatacagtttggacctcttgtaaaaactttggggctagtaatgctcactcgaccacaaattttgcctttcatatttaagcaggttggactgggagtcatccttgactggtcaggccattttatgatgcttggttactacacattcctttc

SEQ ID NO: 18664 - DNA, 375 bp, Sorghum bicolor
  Clone ID: LIB3478-048-P1-K1-F4
cacacgttcgataggactgtagtcggaccctcaaccgaggactggagaggtagctggaccgttatccataacatcattcccactggcactgttgctggcaaggctattcctaaggtccatgctgatttcactggcatgctctctcggatgtcctcccgggatgcgaccgctgatgagtcaactgtcgacattactgggagagtctactacggggcctcctacaacgatatcaaggatgctcttaatggcgcttctgaggggccactgctcgacctcatgggctacttggaggacgaggtcttttccactgacttattgatacaccgcttacagtagcatcttctgtctctgcccttgcaggaccttacgcaactt

SEQ ID NO: 18665 - DNA, 310 bp, Sorghum bicolor
  unsure (1)..(310): unsure at all n locations
  Clone ID: LIB3478-048-P1-K1-G1
cggacgcgtgggcagcctccggccacggggctcacggcggcgagcggccccagctccgatggcgccaacggttgagatcagccacctggggttcacctacccgggcatcgacggccgcccgccacccggcgcgccgccgctcatcgaggacgtctgcttctccctcgacgccggccaacgatgcctcctactcggctccaacggcgcaggcaagacgacgatactgaagatactaggcgggaagcacatggtggatccgagcatggtgcgggtcctgggaaggtgcgccttncacgacacgggactcacc

SEQ ID NO: 18666 - DNA, 157 bp, Sorghum bicolor
  Clone ID: LIB3478-048-P1-K1-G12
atccactagtctagtcaccagcctactaatccctcttattatacgtaaggttgctcgagaaacctcaatacgtattgctgattgtgttgatggagatcgacagcgctcttcagtgacaagtgctgttattctgaggctagatccatggatgcaagtc

SEQ ID NO: 18667 - DNA, 141 bp, Sorghum bicolor
  Clone ID: LIB3478-048-P1-K1-G4
ggccgtcctttttttttttttttttttagagctgtacgcatttgtcagtcatcatatatcacaatcatacacaggtcatatacacacacgttacacgaaggtacatatagaaccgttattatcagaacgatatcatgacgt

SEQ ID NO: 18668 - DNA, 298 bp, Sorghum bicolor
  unsure (1)..(298): unsure at all n locations
  Clone ID: LIB3478-048-P1-K1-G8
agtgaatctctagaatcattttagtcacacaatatctggcctgagtaactatgaacctggccataacaatggtgaggcgaagtcccttacggaggtagcactctgcaacgccatgagatcactttacaagcgggaattgcaagatcacaatatggtgtgcataaactaactccagcacgcttgggatgctctcatagaccgngactacgctgaggacgggcacaaagatttcggtgggtgcacacattcgatgaaggaagcaggctctgctctaaatgaacttcttaaggatgatggg

SEQ ID NO: 18669 - DNA, 503 bp, Sorghum bicolor
  unsure (1)..(503): unsure at all n locations
  Clone ID: LIB3478-048-P1-K1-H4
ctcagattgatgaatacctaaagagaccagaaggttccctctttttaaccgatctaaagcagaagttgttattaacacaaaatgaagcaaacattgctgggactcgttacaatgtccctctagttaattcacttgtcctttacgttggcatgcaggctgtgcaacagttgcagcaaaacaaggtgaatgcatcagcaccagcacaaattaaccaaagtcaaatggatatattccaaattgaaacagctactgagatgttcagaaaccttgtaatgactatggacacagaaggtcgctaccttattctcaatgcgattgctaaccagcttcgctatccaaatagccatacccactacttttccttcatcattctgtacttgtttgctgaggcaacacaggaaattgtccaagagcagataacaagggttcttctggaaaggttaattgtcaatcggccgcattcttggggattactcattacttttatngagcttataaagaac

SEQ ID NO: 18670 - DNA, 312 bp, Sorghum bicolor
  Clone ID: LIB3478-048-P1-K1-H5
gccccggcaaagcaatggcgctccggctctctgctccgttcctcacctcgcgctttacgccgtcgcaggcgtcggccccgcgcaggcgcacccgggcccgctgtttctctccgtccgccgatgcgcgggccgcgtgtttcaggagaccctacacgtccgttctgattgtccccacgggcgtcggcgcggccgtcgggggcttcgccggcgacgcccttccggttgcgcgagccctctgcggcgtaggcgactgttcatatacacccaaacgtgttgacgctggatgctgactggccgtgccgatacacttac

SEQ ID NO: 18671 - DNA, 313 bp, Sorghum bicolor
  Clone ID: LIB3478-048-P1-K1-H7
agcgaacgagttgtctctcacttgaagataggagaaggaggaggcatcttgaacaggatgaagatttagcacataaaataagggatgaagaggaaattgcataagcaaggaggagggctttatagttgcaacggcaagcagatgaaacagctgcagccgcaattgcacctgctgaagaatctgctacacttattgaggttgatggtgacgatttaaaggaaacatatgcacaaaacaagccagctgttgtggacgctgataacatactgagctttgataaatgtgttggtgctggaggacttgcttatgaaaa

SEQ ID NO: 18672 - DNA, 174 bp, Sorghum bicolor
  Clone ID: LIB3478-048-P1-K1-H9
gagggcgggagcgcgactcggtggggatggctttgctgcaaagccagagccgcctgcccggcattggctgcaacaccagcatcctcttggcaagagctagggtgcaacagtgtctggcagcggcgtcccactcacgctcgccctttctgcgagctaatggcggcaggaggagca

SEQ ID NO: 18673 - DNA, 197 bp, Sorghum bicolor
  Clone ID: LIB3478-049-P1-K1-A10
ggccgcggtggcaccgtcggcaggggcggtggccagacgcaccttaacatcctgtcccatccttcgtacaccatcaacgcgtccatgcgcgttacactacatgaataggtcattatgttaatgtacgacgtggagaacattagctaacagtctatgtagcgaataacagtcaccacgctaagacacgctgtggactc

SEQ ID NO: 18674 - DNA, 110 bp, Sorghum bicolor
  Clone ID: LIB3478-049-P1-K1-B1
gccagacgccacggggcgactagatggcgaccgctccgacaccagtcatgaacggttacgcacgtgcaccctccacctactatgacgggggaactggcttctacgactgc

SEQ ID NO: 18675 - DNA, 376 bp, Sorghum bicolor
  Clone ID: LIB3478-049-P1-K1-B12
atgagatttacaaggaaattcggagacgtggtctacatgtagctgttgctggtattcccaagactattgataatgatatagcggttatagacaagtcatttggttttgatactgctgtagaagaagcccagcgtgccatcaatgcagctcatgtggaagcttcaagtgctgaaaatgggatagggttagtgaagcttatgggtcgctatagtgggtttattgccatgtatgctactcttgcaagcagagatgtggactgctgcttgattcctgagtcacccttttatttggaaggggagggtggactatttgagtatatagataggaggttgaaggtgaacaaccacattggtttttgttgtggcggtaggagctt

SEQ ID NO: 18676 - DNA, 150 bp, Sorghum bicolor
  Clone ID: LIB3478-049-P1-K1-B9
ggccaggaccccagcacatcagacaccacgccatggcgctgcaccacctccgcctcgcgccgctcgcgctccttcacgccgcgagcgtcccgcctctcgacttctcccgtattgccgcgagccgccaccgtcacgttctactattcgagc

SEQ ID NO: 18677 - DNA, 405 bp, Sorghum bicolor
  unsure (1)..(405): unsure at all n locations
  Clone ID: LIB3478-049-P1-K1-C6
gtgctttctgtggtactgttggacagaaaggtgatctaagtatgatccatgcttttgtttgaactgaatcttctcgtcatgtttttgcatcaatcatgaccattttgcactgcttatttgttgtcatgcaaacctctgtatgggaatgtaactctttacattgtgttcataggtttcagggcatgttctctttccgtcatgttttactattattatctgtccgacaaggaattagtttctggcgtttattgctttcttgttagttatgatacagtttatgtggcagttttccctgacaacgttttaaatcctcagttgcttttcttttatgtgattttgntttcaggctgacatggtaattgtaccagctacaactgggtcagatgggtgttattgccaggccat

SEQ ID NO: 18678 - DNA, 575 bp, Sorghum bicolor
  unsure (1)..(575): unsure at all n locations
  Clone ID: LIB3478-049-P1-K1-D9
cccacgcgtccgcccgagtccgattttctcctcaggactatcccgttccttgtgcacaacccggagattgcccttgtccaaactcgctggaaattcgttaattccgatgagtgtctgctgacaagattccaagaaatgtcgttagactaccatttcaagtacgagcaagaggcagggtcctcggtgtattcattctttggcttcaatgggacagctggtgtctggaggatttcagcgatcgatgatgccgggggctggaaggaccggacgacagtggaagatatggacctggctgtccgtgcgatgctgcagggatggaaattcgtttacgtcggtgacataaaagtcaagagtgaattgccaagcacattcaaggcataccggtttcagcagcacaggtggtcatgtggaccggcaaacttgttcaagaaaatgatggtagagantttagaaaacaagaaagtgtcactgtggagtaaaatccacttatggtacgatttctttcttcgttgggaaggttgctgctcatacggtgacattcatcttctactgctttgcgatccctgtgttgtttt

SEQ ID NO: 18679 - DNA, 132 bp, Sorghum bicolor
  Clone ID: LIB3478-049-P1-K1-E3
cgcacacatccgtacaacggcaagagccaacccgtcgttactacgacgactactacgacctttgttgtctggatacaagccgcagagcctgagaacagctcgcccgagatcggctgccgtgcgcactctgct

SEQ ID NO: 18680 - DNA, 310 bp, Sorghum bicolor
  Clone ID: LIB3478-049-P1-K1-E7
atatcgaatgagagacctccctgttcgcttgagcttttcaaccgaatttaacagtatttttctcttacaattattcaggcagcaatgctttatgtaatagcttatcatccaaacgaataatgtggagtgttatatttgttgtatctttcctgtcatcataatataagaaggacataagaaacatgcttctcacttggcagagcggtatatcatatctaacctatatataatagttcgcctcccgaaattctttccagattttcttctcatattactaaacgtccatgttaatgtttttctccaacacttt

SEQ ID NO: 18681 - DNA, 290 bp, Sorghum bicolor
  unsure (1)..(290): unsure at all n locations
  Clone ID: LIB3478-049-P1-K1-E8
tcgcacgcatatacattacagtgcacgctataatgcgagctatatggccggcgacatcatggctatcaccatcggtgtgatcgtgggcgcgcttgtcaccaacaccaccatcgacatcttctgtgacggccttatcatcgtgcgcttgactgttggcaagactaatgcttggcgatttgatataccttgtacagggcctgccgcgggctgtacctgggtccgttccttggtgcgccctcaggctagctgaccggttagntaccggctactacagttgggacactggctgg

SEQ ID NO: 18682 - DNA, 145 bp, Sorghum bicolor
  Clone ID: LIB3478-049-P1-K1-E9
gcaaacaaaagctccactgccttgtctgcaatggcgtctggggctatttccactagcgcccttcacaccttctagcttggcggcctaggcaactagactccactcttccttattcgctttttctgtcaagtctcatctatcttcc

SEQ ID NO: 18683 - DNA, 145 bp, Sorghum bicolor
  Clone ID: LIB3478-049-P1-K1-F3
aggtgtgttcgtcgccgagggcgacatcaacgacggtcgcctactctccaagctcttcgacgtcgagcccttcacccacgtgctccacgttgaggtgcaggccggcgtgcgctacaccatggagaacctggagtcgtacgtgcac

SEQ ID NO: 18684 - DNA, 206 bp, Sorghum bicolor
  Clone ID: LIB3478-049-P1-K1-F6
ggaccaccgggccagtatcagagcggctctcgacgtctgcacacatggttaaggcctgccccaccgtgagtgaggactacctctaggcggacgacaaggccaagcgcaagctcctcggactcaactcttagacgaactgccccactgtcatgcttcggctggcatggcactcagcagacaccttcaatgtggccactaagaccgga

SEQ ID NO: 18685 - DNA, 483 bp, Sorghum bicolor
  Clone ID: LIB3478-049-P1-K1-F8
cggacgcgtgggtaaattctctccgtccaaaaaggcaaaaacacatcctcccgagaagttctgtttggccttttaatcttggtgtacttcaatttttttttgtttcttggactcatcttcttgtaaggttgcgttctgagcttctgattggaggccgccatggatgaggtcccgggaagaagtagctccgtgagagctacaaggagcatctttggcgaaagcatcggtgggaggaagccggagacgaacagggcaaggaatgttctaggacaacagcagaatttgtcaccggagatcaagcagctagcaaaatccaccacgggtaagctcaatgaacgcaaggccgccgtggacagagaaagagccggcgccgagtccgagctgtcgagggcgcgcgccatggcgaatgagctggagcgccaaatcgagcaggccaaagccagggcgtcgtccaagaggtccgagccccacgcatttcgggcg

SEQ ID NO: 18686 - DNA, 285 bp, Sorghum bicolor
  Clone ID: LIB3478-049-P1-K1-G10
gacttgccgcacacacgtaatcgcccaaaaacaagctgaggcatccattgctacctacatcttccgtgcgctggtaatgctgaagatccccatgctgacacatgcaagctaaatatgctcagaagactgcagcgattggagaccatatgctgcgcaagcgctagcggcttattactaatggttcgacgaggctatgaatccttttgatgcgagcgaattcatcgccaggcacacatggtgcaatctgaacgtgtaagctccaggatgttgatgatacactgatgg

SEQ ID NO: 18687 - DNA, 414 bp, Sorghum bicolor
  Clone ID: LIB3478-049-P1-K1-G7
agcacgcgtacgagcagcttgatatacagcacgctatcgaacacaccatccaaccgtacgtacgtccatcgctaggtcgttcgtcatgtcctccatcttctctgccactatcaccgtcgcttgcgccttcgccgcgccggtcgccaggacggtggccatgacggtgcgcttcactgtgcgcgcggctgtcggcacggccgccgggaccgtcgccgtgagcgtggtctttagcggccttgttatcggccgcgacatggtccaggacgcgctcctaggcgcacacggatgcgagctcatctagtagaccagcgaggtcagcgacaacgtcagctacaacatcaacttcaagaacaacgacagcttcccgtacaacgaggactacgaccacgacgaagtggacaccagcaagaactc

SEQ ID NO: 18688 - DNA, 422 bp, Sorghum bicolor
  Clone ID: LIB3478-049-P1-K1-G8
cccacgcgtccgcccacgcgtccgcccacgcgtccgcccacgcgtccgcccacgcgtccgcccacgcgttcgcccacgcgtccgcccacgcgtccgtccacgcgtccggtcggagatcgagccggacctggaggaggacgccatcgacgtgtatcgcaccaacggcatcgccccggaggacttcgtgtcttctgcagatctatgatatcttccagcttcttccatcgaagattcaagttggggtggtctcagctaccatgcccccagaggccctagagatcacccgcaagtttatgaacaagcctgtgaggattcttgttaagagagatgagcttaccactgagggtgtcaagcaattctttggcaatgtggttaaggaagactggaagctcgacacattatgtgacctgtttgataccctg

SEQ ID NO: 18689 - DNA, 396 bp, Sorghum bicolor
  Clone ID: LIB3478-049-P1-K1-H10
gaactcttgatatctcatgtttgccaagcaggcaagtgtaaatcgtggtctgtgacgcctcagatgccacttactactgcagagaagattatggactctcatggtgtggattaccttcctgtagtttctgaggatgctaatcctcaggacagaggacctttgataggttttgtagacagagaatgcattgccatcgctcgaagggccaccgcaacaaaagaatttttcagttctatgtatgagataaaaaaggaagagaggtagcacgaaaggaagaaatgagacggcacagaagcactctctacttagcaagtctggcatcttttcctggtcaaggctatgacctctccaggttatttagttgctaactaaaaacgtgctccagggatgtgatta

SEQ ID NO: 18690 - DNA, 554 bp, Sorghum bicolor
  unsure (1)..(554): unsure at all n locations
  Clone ID: LIB3478-049-P1-K1-H11
tgcttcccgtagcagatcataatgctcagcatcagcaaccacaatcagtgcagctacacagccagggcccctgtccacctcaaccaagcaagcccagtcactgcagtgttgcatcctatgctgttcaaggaaatggccagacctacagctccacatacaagaacccttctaactgccctgcaactgttgtagctcttctgcctcagcctccagctactgcttctatggcgtatcatcccttgggaccacaggtcgtgcacaaccatccatttggaaatttggttgaaacagctagtgttgtagggtatccacgggatcaagttgagatactcccagtggttactgcagcccaacctgtaatggttgataagcttaatgctggcagcaatgtaacatcccctcgtgagtggtcagcatagtggacaatgtgcgatggtagacggtacatttcactgcttccacaacttactagtatacatataatgcagttggaagcacatcangtctattttatctggctccttttttcccatcagccagcagattagaacaga

SEQ ID NO: 18691 - DNA, 468 bp, Sorghum bicolor
  Clone ID: LIB3478-049-P1-K1-H2
gtgcccctccgaattctaagatccaaaggtctcttggataagatcccattcacaactgttatcacggatctcagcacctgtcacccaacatggttccataagcttgtcactagatgttactgtccatcaactgaggtggaaaagagagcactaaaagctggtctgaagccctcacagattaaagtctatggcctcccggttcgaccctcttttgtcaaacctattcggccgaaggatgaactgcgaagagacttaggcatggatgaagatctgcctgctgttttattaatgggtgggggtgaagggatgggtcctattgaggccactgctaaagcgcttggtgattctctgtatgatgaaaacctacgggaacccactggtcaaatacttgtaatttgtgggcgtaataagaagctggtcaatcgattgcagtcgataagttggaaagttccagttcacgtgaaaggc

SEQ ID NO: 18692 - DNA, 341 bp, Sorghum bicolor
  Clone ID: LIB3478-049-P1-K1-H8
gtccgtccgtccatccgccatggcgaccgccacgctgctgagctcctccttcgccatgcccgccgccgccgccgcccggagggccaccttctcctcttcctccgccacctccttgggcttcgccacgtcgcagctcgccggcctctccctcttcgccggcgccgcaactccaaccgtcgtcgcccttcttcccaagaggctgcagctccagcccattgttgtgcggcgggtgtgcccgatctcggacaagaatactaaccgggccaacatggtgtccttactcaaccacaagaccaagaagcagctgttcttgaacctgtcttacaagaagctgtggtggg

SEQ ID NO: 18693 - DNA, 201 bp, Sorghum bicolor
  Clone ID: LIB3478-050-P1-K1-A10
cagaactacaagacatgcagggcaggttactgaacatgagcttgcagtatgcggaagtagagcaccaacgggaggaattagtgatggagcttaaaaacgtaaatgcaaagacgaaggggggacggtggttctagcaattagtgacagagctaaaactgggtgccaagcatgagccacagcaacaaggagggttgattatat

SEQ ID NO: 18694 - DNA, 163 bp, Sorghum bicolor
  Clone ID: LIB3478-050-P1-K1-A5
ctcacgcgtccgagcaatcaccagagcaagaaccactccgacgaatcatacggcgaggctaagtccaaacttacttgatgactcactcgaaggagagcgcgaagcagaccaccaggaagtacaccgccaggaaggagctgaggacgcaggtggcgaccaaggc

SEQ ID NO: 18695 - DNA, 314 bp, Sorghum bicolor
  Clone ID: LIB3478-050-P1-K1-A8
cccacgcgtccgggaccccgctccccggcggcctccgccgccgccgcttctggcctctcccgcacgcaggcgccggcacccctcttcttctctactctcggtgacgactcttcttgtgttcctcacaagtcacaagcttaggcggtacccccgatttgatgcgaaggcttgcgtttctcctagatgcggcgggacaggacagggggaggacggatgccacgcacgggctggcgcagggacgagcgactcgggagagaggtgcaggaccccgcggcttggacagagctcgtggatatatacacaaaagatgtgtg

SEQ ID NO: 18696 - DNA, 233 bp, Sorghum bicolor
  Clone ID: LIB3478-050-P1-K1-B8
cccacgcttgcggcattctcttgtacatgactcatgcttcttatcagcgcccatctctacacttctctaaataacaatgtggggcggacacaatacactagagcggcggacaccacggagagcttgaggatcatcttcggctacctacttctattgcttctggccttagtagccaccgccgaggcccgcgtagtccgcaagctgatcggccagaacgcatgccatgagacatg

SEQ ID NO: 18697 - DNA, 200 bp, Sorghum bicolor
  Clone ID: LIB3478-050-P1-K1-C12
gacggtgagccgtcgggcccgttcgccgtgttcaagggcatgaagaacctgcccccgggaatgccgcaggtgctcatcgtcaccggcctcacctggctctcgtggttccccttcatcctcttcgacaccgactggatgggccgcgagatgtaccacggcaagcctgacgggagccccacggaggtggccaactaccagga

SEQ ID NO: 18698 - DNA, 250 bp, Sorghum bicolor
  Clone ID: LIB3478-050-P1-K1-D10
cggacgcgtgggtataaaaaaaaataaaaaaaaaaaaaaaaaaaaaactaatatgtttatttttaaaatttaataataaaggtgttgggtgtaaatatttataatataaagggcggccaaaatgtggggttccatcttaagtacccttgctttcttcgtcatactttttattttggggtctcttattttaaattaacaagattaatttttttcactctcgtgttaaaaaattctttttggtaaaccaatt

SEQ ID NO: 18699 - DNA, 124 bp, Sorghum bicolor
  unsure (1)..(124): unsure at all n locations
  Clone ID: LIB3478-050-P1-K1-E12
catggcgcatgggcgcgtcacgctactacagcactgaacgacacggactacctcatagcggtggataaggagtcgatactgctgcacacgacgactccaatgctgacggcacaatanaccatgg

SEQ ID NO: 18700 - DNA, 193 bp, Sorghum bicolor
  Clone ID: LIB3478-050-P1-K1-E2
gcgccacatgatcacccttgtcgggcactgcatcgccagctcctaccagcgcctgcttgtctacgagttcgagcccaacaataccctcgagtcccacctccaccggaagggcgtgccgctgatcgaatggtcaaggaggctcgccatcgccctctgctgcgcaagggcctggcttacctgcacgaagatatat

SEQ ID NO: 18701 - DNA, 274 bp, Sorghum bicolor
  Clone ID: LIB3478-050-P1-K1-E7
gaagaaatggtgatgcgagcccagcaagcccctgctggttcataagcttcacaagatagtgataattacatcattctgtggggatgttgcaatgcacgacctgcaatgctgatcctatcttttgaacagtttgctggtgtaggaggtgatagcctcatatatagcttgtgttattctctcattacttcattctgtttgtagaacaatatcatacttattttcagtgtacgagtagtggaataagtggactgtgcatcacatgatttacatgtac

SEQ ID NO: 18702 - DNA, 370 bp, Sorghum bicolor
  Clone ID: LIB3478-050-P1-K1-F10
gcgagttgaggcggctgttgagcaattcaatggctatgtacttgatggaagaagtttgagggtgaattctgggccaccaccacccagggatccatcctcacaaagaggacccaggggtgatgccaacagggtctacgtgggcaacctttcctggggtgttgacaattcagctctcgcaaacctgttcagtgagcaaggtgaggtcctggaagcgaggattgtatatgacagggagagtggaaggtcaaggggttttggtttcgtcacgtatggttccgctgaagaggttgagaatgcgatatcgaaccttgatggctccgacttggatggcagacagatccgtgtcacggtagcagagtcgaagccacct

SEQ ID NO: 18703 - DNA, 241 bp, Sorghum bicolor
  Clone ID: LIB3478-050-P1-K1-F11
gttctagatcgcgagcgcccgcccttttttttttttttttaattttgtatgcaggagcttcattcgttgaaataaacatatatatggatgtgaatcatatatatgtattataatactcgtgctggagcttcaaaatgaaaatgggatcttattggggcagtgtcaactgatgaacatgcatggatgcatgatatgtggtcatcacttgaagatgctgcttagggagcaatcgtcgtgaaca

SEQ ID NO: 18704 - DNA, 185 bp, Sorghum bicolor
  Clone ID: LIB3478-050-P1-K1-G7
atcaagctccaactggcgaactgcagcgtggggcggatgcagtaccccatcgacctatatcacgagcttgccaagctggggcaatgcctgagctacctgaaaaccttctaccgacccgctgcagccaccatcggtaccagcggacacgacatcatggtgagtttcaaggacaacgcctagagcct

SEQ ID NO: 18705 - DNA, 148 bp, Sorghum bicolor
  Clone ID: LIB3478-050-P1-K1-G8
cgcggcgcgctggccgagttcctcaagccggacatgctgaggctgtacgtgggcaagatcgacggcgaggtgcggcgcgccctcgacgagcgctgtgccggtcgcaccacctttacgggatgccttcatgaagcggttacgactaata

SEQ ID NO: 18706 - DNA, 338 bp, Sorghum bicolor
  Clone ID: LIB3478-051-P1-K1-A2
ctacttgcatgactctgtctagtgcaacagcatatccagctaatgccattgtatctcaatcttgttccattttttattcattaacatgattatctggattcaacataatcttatatattgagcccaaacaaagtatctcagtaaacagtgtacagataacatcgtttagaacgaggagtgcatggagtagcaaaacaactagagccttacaaggcactaaaaatactgtgggctattgaaaataatagcgcatctgtcacctaatattcttaagtggggtggaaatttatcatattgcatgggtattgatgatgatgatgaacaatggtctgaaagga

SEQ ID NO: 18707 - DNA, 192 bp, Sorghum bicolor
  Clone ID: LIB3478-051-P1-K1-A4
gttcaattgatgctgtgcatgcaggtgctgcaattcattgttggccatccccagcttgtgctgtcgcagatatcagcagagtccttcgcccaggggagttttgtgcttcacattcgtatcacatgttattcaccaggtttccagtttgagacgacgaccgacattaccaatactggcacatcctctattgag

SEQ ID NO: 18708 - DNA, 324 bp, Sorghum bicolor
  Clone ID: LIB3478-051-P1-K1-A6
gatatgtagacgggagatcaggggtatatgcgtggttgatcactaaggcaggaatgtaacggatccaatccagctatgttaggtatatactgcttgaagcattcatgcttttactcaataagaatgataaaggtcgacatgtgtagaataacttgttgacctcagtggctgaatgcctacagtcctacagatccggactaaagtgaattgcacttaagttctatgtcaaataactacctacttgttttttgccacactattcatgatcaattacatgcttgatttacactaggtcataatcagtatttggtgctgactgatctg

SEQ ID NO: 18709 - DNA, 168 bp, Sorghum bicolor
  Clone ID: LIB3478-051-P1-K1-A8
ctcagtctcaggcgagcgagcaaccgcggctcacgtccacaggcccagcaacagtaggccccgccctctccagatccacaggcagccgccgccgccgcggataaaagcggcgcgcgcgcgcgcgcccgtgagggaagagagttggaacgcgcgtcagcgcgcgagcgg

SEQ ID NO: 18710 - DNA, 221 bp, Sorghum bicolor
  Clone ID: LIB3478-051-P1-K1-B1
cgccgctggcaggtttataggccttacggatgtacacgccaagccagacgacagcacccatggtttgcacggacagaagcaggctcagcatgagtgatgggagcctacaccagaccaccatggtgtaatggctgttgaaacaatcatcgacgaacgcgagctgcatctacatgatcctgaaggcatcactggtacccaccttcttaccaacaatgctcttg

SEQ ID NO: 18711 - DNA, 153 bp, Sorghum bicolor
  Clone ID: LIB3478-051-P1-K1-B11
actgtgccagtccatggttcagtgtggacacacatgcatgtctttgtacgagaactagtcggcttgtctaattaagcacatggcaaacatcgatgccgatatcacatctagcacagctcctaactaccaccatcaatcatggcgtattggggc

SEQ ID NO: 18712 - DNA, 247 bp, Sorghum bicolor
  Clone ID: LIB3478-051-P1-K1-B3
cgaagacgttatctcactaatcgagaggaggagaagccactcgacgtgcatgggttcctcagtactcgcttaaggacgctcataactagacgcactgggtgtcagatcgagcatcaaagaacagtcacattatatatgcctgaaaataaattacatccacaaaggtgaacatatagagcatgaagaacaggatgggagtcctgcagaacaccaggagtgatgacaggcacgacaaggtatatttctg

SEQ ID NO: 18713 - DNA, 375 bp, Sorghum bicolor
  unsure (1)..(375): unsure at all n locations
  Clone ID: LIB3478-051-P1-K1-B4
gctctctgcccaaatgtgaccacacgtgggatccagctagccacagcacagttgccatgtctccaactcatggactgtggaatgagcctatgcactaacatgaagaatgaaaaagagggtccatattttggtgaactcaatggatgtattagaattataccaaaactatccaccttaaagaggcaacctattcaccaaaagcttattataaagcatgggaatttgtagaaactcagtctgtggggctgttctgcaatagatgctctatatgtaaatngggcacagttaaatgatcataatttgaactgttgtacataactacatgcagaacgtttgcttcttcagtgtccaaaattgaagaatgttcatgcattt

SEQ ID NO: 18714 - DNA, 392 bp, Sorghum bicolor
  Clone ID: LIB3478-051-P1-K1-B8
ggtccgttggtatccaggtgtcatcatctcccgccgagactcaacacgccatggtcgtcaagcacagctatttggtcagtgtcctagtactgctcgtcgcgggctactgtacggcggcgctagcctcggccacggcgacgacgttcatcgtcggtgacgatcagggctggacgatgaccggcgtggactacgtcgcttgggtccaaggaaagacattcgcgatcggagacaaactagtgtttaactacccgagcgaggagcacacggtgacggaggtgggcaagaccgactacttcgcctgcgccggaggcaacgcgctgagcaacgaccgcagcggatcgaccaacatcacgctcacggcgcccggcacgcgctacttcatctgcaacatc

SEQ ID NO: 18715 - DNA, 115 bp, Sorghum bicolor
  Clone ID: LIB3478-051-P1-K1-C6
aacgaacgtgcgagagcatcgcagagggaagaaggcggcccacttggctggctcgatcgccgctgtggccacgcagatgaatcatatcagcaccgtggggtccaccagcgcagac

SEQ ID NO: 18716 - DNA, 324 bp, Sorghum bicolor
  Clone ID: LIB3478-051-P1-K1-C9
actatactaacatactacgcagctgtatatcagacatgcgttggcggcactgccttaactacagaagcattccatgctgtcgctatggtggtatgacctcatccatacgatcagctagacataaagtacatgtcatagagtctggctcatgccatgagcaatcaactattatcagctcctctatgcctgcaggaatctggatgactcgagtagacaagcgtgacttccaaactccctcaggacaattcatgtcatagacagaccaggctgcgcgtaactgcaacagagactggtataccgcttgtctctcatgcactaacacat

SEQ ID NO: 18717 - DNA, 406 bp, Sorghum bicolor
  Clone ID: LIB3478-051-P1-K1-D1
cgcgagcgccgcccttattttttttttttttttcaccataccactttgatttttcgtattacagtgacaaagtcatgtaaatcattgtcaatacaaatatacacttgtaatcaatcaactattttctactgcaattctaatggcagacatataataaccaaaacctttttctgcttagagcacatcaaaatagaaattggatcaaacaaatttaacccacaaactatacatgtatatgcacatgagcaccaaacatgacttcaatcaccacaaaacacactaaatcacaacaacattgtacctagatcggctgtagagcggcacagatcaagtgagaggactgttgtgatcagccttgcaagcatgtttaggatgacatgttgacagcacatggtcttcttgaacc

SEQ ID NO: 18718 - DNA, 105 bp, Sorghum bicolor
  Clone ID: LIB3478-051-P1-K1-D3
gaaccacgaggagatcggatgaggaagcatccatgcccaccgcatggctgagcggcaacatcaccgcaggactggcagccagcgcttctgctccgcacgaagccg

SEQ ID NO: 18719 - DNA, 286 bp, Sorghum bicolor
  unsure (1)..(286): unsure at all n locations
  Clone ID: LIB3478-051-P1-K1-D9
gtatctgactgggataccgatggagccatctactttcagtactcccgtgtttgtcctgactttgctcagtacgcctcantgcacatcctggtatcaagcacacactgttaatgtccgtgcggtctctgtggccatggtcgctgctccataagactgctgcgcccctagcgactccagctgtgttccggtcctgcgcactcgcgatacgtgcagctgctcgttgtatacccggtgccacccagagcatctgcatgcgcactgcagctctatgggatgcagagagagc

SEQ ID NO: 18720 - DNA, 155 bp, Sorghum bicolor
  unsure (1)..(155): unsure at all n locations
  Clone ID: LIB3478-051-P1-K1-E12
aatttttggacctcgtgatggtcggacggatggtgaacaatgttatcacgacaagcgttaagtaatactacacattattctctccggngttaatggaaccccaccagaacacctggggtagcggtgttgaaaagcatggctaagcaagctgactc

SEQ ID NO: 18721 - DNA, 231 bp, Sorghum bicolor
  Clone ID: LIB3478-051-P1-K1-E5
atctgctctgcccacagatgtcacccctgacacagcacctcatcatcatcctgccctggatccatcggcaacaccatcccctccttctggcccgacgtggtgcgacatggatgcgcacgaggagaagactgctactgctgtcaccacagaggagcctgcaccggctgcggagcctaagcctaagccagctacggaggcgcacatggcaggtccgtcggcgttggcaacccc

SEQ ID NO: 18722 - DNA, 227 bp, Sorghum bicolor
  Clone ID: LIB3478-051-P1-K1-E7
atggtctaatgctgatagacggccagctataggatctatcctagcatcaccatactggctatacacaatttgttcagctgaaatcaaggacacctctgatgcccctgcattggctgtctacaatcataatcacatgggtgcactgactcaaaatgaatggtctatgaaaggcacaatgattcttgcagtcacgctatggattttaggggaagctattggagtgtcta

SEQ ID NO: 18723 - DNA, 264 bp, Sorghum bicolor
  Clone ID: LIB3478-051-P1-K1-E9
ctctcgccacaaagcgccggacccaccgagccgccccagccttctccgtccgcacgtgcgttcagagcaccccttctaggcagaccaagggagcgtaggcggacctgtcgtctgccacagtcctctactcccacttctcgccgccggcgacaggggcctcgccctggcggcggcggctgcaccgggggcgggccttcaaccgtcgtctactcgtggggagccaacaaggcacgctccgaaggcttcccatcgacccttcgctcg

SEQ ID NO: 18724 - DNA, 238 bp, Sorghum bicolor
  Clone ID: LIB3478-051-P1-K1-F5
cagacgcgtgcgggactacactctggcacagtacaagcttgagaccttcgaagacctagcttactatggtacaatacagaagcttgtgaaggatctgggctaccctgaagagttgctgactgggcagtctgattggacatatatgatcagaggactactgcttgcaaagaacagaggaaatatcttgaagacggatcgacacaagtatgtgaaagtggcataccatgatggtaaggaa

SEQ ID NO: 18725 - DNA, 426 bp, Sorghum bicolor
  Clone ID: LIB3478-051-P1-K1-G8
gaacgagcgaatcatctaacgagaaatgtgtctaagataatatcagcttcaagtaattgtagcttgtatgaaaggatgcaactcattaatgttttggaacgtctctgcttggatcatcttttcaaagaggagcttaatgtcatattgtctgagatttacaaaactaatgatattagtgggagtgatcttcaaacgacagctttgtggttctatctacttcgtaaacatggatatcaagtttctccagatgtctgtgcaaagtccaaagatgaacaagggaattttgcagcaaacattccattggatgtactgagcctttacaatgctgcatatttaaggactaatggtgagaataatcttgtgtgaggcgtgtttctattaccaaaaggagtgttgaatcaatttttatcaaccttgtagggccat

SEQ ID NO: 18726 - DNA, 304 bp, Sorghum bicolor
  Clone ID: LIB3478-051-P1-K1-H9
gacgaatggcgatagtatctgtgcttggaaggaagaagtcaacggccaaagaaacagttgtcccggaccctgactataggttaccaattgctatacttgggattgctagtgcttttgcatatgcagacaatcttctagctgctgcacctgtaggactgctggggcttcttcttttgttccagactacaagagtgaggttcgtctttgataatgaggccctggaggtgaaagttggagaccagctgcaggagtcaggtgaaaatgtgtttgtcggcggcaagaaccgttggaagtactcaacggt

SEQ ID NO: 18727 - DNA, 354 bp, Sorghum bicolor
  Clone ID: LIB3478-052-P1-K1-A1
ggcatcaaacaacaagcagaccatccaccagtattgggttcataaataaaaatcaatcagtaaatgctgcaacttttgccatgaattcggagtgacaaaagatgggtggtgagcatacaatatcagcaggcacaactgcaatgcctgctcaggcaaatataccaaacagaggtcttgatgctcctcggaacatgttctcagcatttccagctgctgttatggagaaccagagcattccatcatctccagtggctcaatcgtggatctcatttggtgctactaccgagaacaaaccaaccattgtcagtccaacttttcttgcaattattgtggctggaaaatgccatttgctaa

SEQ ID NO: 18728 - DNA, 429 bp, Sorghum bicolor
  Clone ID: LIB3478-052-P1-K1-B12
gccgtgctggacccgtcgactactctccgcccgcgtaccactccgccgctgccggatacgccgccaccgccgcgagtaggcgcctgaggatgattgctgcctccaacaggtccgccttcaatgcctcctccgcctctcattttctcccctcgctcggttacatctacgaggagtacatcaccgacgctgccaagtccttctcgcgcgcctcctccgttctttttagtgttataatgctgcttcttgtatcgtttctttgcttcccttctctcatttatttatctctactataactttcttttatttctattattatctttctttaatcatattttttctctttattaaatttttctatttaggctcttttttttcttctttttatttttatctttaatttttttatttttttgctttattttctatatt

SEQ ID NO: 18729 - DNA, 272 bp, Sorghum bicolor
  Clone ID: LIB3478-052-P1-K1-B7
caaaatgctgtggccgagcggatgagaggaagatggctgccaccagcctcagctcctgctcctccctgcccagggctactgcaaaactagcaggactaccaagatcatcgtcgtactacacccagctgaccttttgctcgaggcatcccttcgagaaggcggcggcagctgcagccttccagaagctcccacccgagctcctccggctgagctacccggcgaggaatagcaagcatgcaagaaccagctgccggcgggccacggacaacgac

SEQ ID NO: 18730 - DNA, 452 bp, Sorghum bicolor
  Clone ID: LIB3478-052-P1-K1-B9
atcgggtctgtcaggagatgacacgattaaaaaccgtgtactggaagcattgtatcggcgcatacttcgagctgagagagagaaaaaacgctttaaggccatcatcatcatacctcttttacctggttttcagggaggcattgatgatggtggagcagcatcggtgagggcaatcatgcattggcaatatcggactatctgcagaggctctaattcgattcttcagaatctatttgatgttattggacctaaagcacatgattacatctccttttatgggcttagagcacatggtaaactctatgatgggggtcccttggttactagtcagatttatgtacatagcaagttaatgatagttgatgaccgcatcacattgattggctcagctaacattaatgataaaagcttgcttggatcaagagactctgagattgctgtggtcatcgaag

SEQ ID NO: 18731 - DNA, 207 bp, Sorghum bicolor
  Clone ID: LIB3478-052-P1-K1-D12
gtgtctacaccaacagcgtatctatctacatagactactgactctttgatgacgatgtggtgagagctaaatgatcgaagtggcgaaatcataaaaatgcacacgtcatcttgcgaacagatatgattaaaccaaagcatgtattgtagttgataacacatcacatacatcttcgatacttctaatcaaatgctggatagatcaaat

SEQ ID NO: 18732 - DNA, 445 bp, Sorghum bicolor
  Clone ID: LIB3478-052-P1-K1-E2
tttccttttatttttcattacttattttctattctatattattttactctactcaattattttatttttcatgttcatatttatttcttatttttctatatatttattatttgttattcatgttttatgtgcttttttcttagctattcttctcatttttatattattttttttactataagttatttttagtttagtttttttattttctataatctatgaaatgctatgttcatataatatagatgtgatattctatgatattttttatgatgttcacatgatatataatgtcaggttctgtgatattttttgtgatgttcatgtagtatatatatatgtaatattctatgatatttttttgtgatattcacgtgttataaatgagatgttctaggatatttttatgtccacggagtatagatgtgatattctatatgtattt

SEQ ID NO: 18733 - DNA, 332 bp, Sorghum bicolor
  Clone ID: LIB3478-052-P1-K1-G2
cctacgcgtccggcttgctctcatgcagtctgggatcaagtctgagtgcgcctgtaatgctgcacctcactgctgatctcatctatctgggcaacctactaggggctgctattcatgctcagtcaccacaaacctcaccacacacctgatcgctcttgacatcactgatcacaacagtggcctgatggcatctcgtgcaacataaagggcaaatgacaggccagacgtcagtgataactgttggaacaatatttagtgcattgtagaacgactaataaaactaatcatccatcacatctaccattgcaatgaataatttggtgaaagctaag

SEQ ID NO: 18734 - DNA, 258 bp, Sorghum bicolor
  Clone ID: LIB3478-052-P1-K1-H11
cgatcgcacgcggacacacacttcactgtcagcagcgattagctctgtcgaggacatcattggtgtggtggagcactgatgagatggcggcggtgcggcacatcgtccacctgtctctgaactactccaactatcacaatcggacctttggctgatgatgctctgcgtccagtgactgatctttcgtttggatgtacattgtgatgatagtggaaccggatcagcgtgttcttgattctatcaatgcatgtgctgata

SEQ ID NO: 18735 - DNA, 163 bp, Sorghum bicolor
  Clone ID: LIB3478-052-P1-K1-H6
ccccgctcgacgtcggcgtcagtgaacgacagcctaggcgtcaggaacgcgtctcactttctaagcgagactaccgctcggccggtcacctgttctcgttcacatagcctacgtccctgcacttagcgtggctagcacgccgatggccaccacgaccgcgagc

SEQ ID NO: 18736 - DNA, 426 bp, Sorghum bicolor
  Clone ID: LIB3478-053-Q6-K1-B11
cggagtgctaggggtgctagctaccggtgggctggcgggcggacaggatggcctacgcctggggcgggcgctgcagctactggtgcgagctcctggtgggctccgacttcacgaccgacgcgctagccgtgctcctcccacccgtcgaccgcgaggtgtgggacgactggctccccgacctcgccgagggggacgcctgcttgttcgacctcgaggagcgccacatcgtgcctgtccatggcaccgatcaggccggccgaaccgtcatacgcatcgtcagcacgttcttaacggatagactctgggatggcgaacgtctgaagaagaaagcgatctacaaactccggactgaattacctgttgcgacactctgcatgacggacatgcagacgactgtacatcctgatgataacaaccctgggatgt

SEQ ID NO: 18737 - DNA, 510 bp, Sorghum bicolor
  Clone ID: LIB3478-053-Q6-K1-D3
cggcttcattgtcaggcttcttgatctctttgactcggaggatcctagggagagggagtacctgaagacgatccttcacagaatatatggcaagttcatggtgcaccgtccgttcatcaggaaggcgattaataatatcttctacaggtttatatttgagacagagaagcataatggtatcgcagagctgttagagatcttggggagtataattaatggctttgctttgccgctcaaggaagagcacaaattgtttttggtccgagcactgattccgctccacaaaccaaaatgtgttgccatgtaccatcagcaactgtcatactgtgtcacccagtttgttgagaaagattgcaagcttgctgataccgtcataaggggtttactcaagtattggcccatcacaaatagctcaaaggaggtgatgtttttgggtgagttagaggaggtgctggaagctacacagccagcagagttccagaggtgtatggtgcaactttttcgtcagat

SEQ ID NO: 18738 - DNA, 548 bp, Sorghum bicolor
  unsure (1)..(548): unsure at all n locations
  Clone ID: LIB3478-053-Q6-K1-D4
tactttcatctccagcaacagaaactaatagagttgattcgcgcgggaaaaataaatgaagctttggagttcgctcaagaagaacttgcaccgagaggcgaagaaaatcaaacatttctcgaggagatagaaaaaactgtagcactactggtttttgaagatgtaaaaaattgcccttacggggaacttttggatgtttctcaacgtttgaagactgcaagcgaagttaatgctgctattcttacaagccaaagtcatgagaaagatccgaagcttccaagcttgttgaagatgttgaaatggacacaaaatcaactggacgaaaaggcggcatatccacgaatcaacgacttcaccactgctgcactggaagatccatcgatatgaatctgctgccaaggtgatgataattgagggtaggcaccgagcccgcctggtgcctgcatgtggtttgctctggatctgtcaatagatcatcagctgcagcgattgagttcacccctttcaccagtgtttangctcaatgcaagcagntgatctgaaaactt

SEQ ID NO: 18739 - DNA, 529 bp, Sorghum bicolor
  Clone ID: LIB3478-053-Q6-K1-E6
cccacgcgtccgccttgaaaactcaagatcttttgtccgagtaccctaatcctataccaaaactggaggggaaggagacttccgtgaaccagtcaggatcaacatcagtagcacatgagaatttagctacaaagacatgtgtcggtgcacctactagtaaaattgatagcttgcaaccacttaaggagagatcatgtccaacagataggggctcagtcaatcaattagagcatctgtttgaagataatgtgacaaagagaaataatgaagtggtcaatcctgtatctgatgctgaaggcattgctgtatcagatgtgttggaatcgttaacagaacaagattgttctttacaaaatttaatgccagcttcagctgaggaagaacaaccacaatactctagtcctattgcattgtccccttggggtgaaccaagttactatcagggtgaagcttgtgattctgctctatggggcgtccaagatgaccctggtaatgacatgtggtcaatgccttcaccacacctggtctt

SEQ ID NO: 18740 - DNA, 536 bp, Sorghum bicolor
  Clone ID: LIB3478-053-Q6-K1-E7
accacgcgtaccactgcaacctatgtttcttaacctctctgcgtcaccacgctttcactgctccccgggcctcctttccaaaacggccggggtctgcatggcaccaacacctacttccaaggggcggacaatcgcttcaactttagggcaccctctacttcccgttaatgaccactgccaacaaactgtcgaccacgactctccttacgacaaacacctgcatgaccacgcgcggcctgcgtcactgccagacgatcagatcgtacgggcccgccgccctcacaagtactgtaaccagcaccctacaaccgacgcattaaaaccgcatgacgctgaccccaagctcgcccgctgtgcccacccaccgcacgctaacgcattgaatgttgccagaggcacggtgctgcaccagaaggcgtacttccgcccgatcaaggacatcaacaagcccccacccgatcactgcaccatactagctgtccataccacactgctgataggatagatcctgtcgctgaacacctatcactctgctc

SEQ ID NO: 18741 - DNA, 244 bp, Sorghum bicolor
  Clone ID: LIB3478-053-Q6-K1-F4
aaaaaaaaaaaataaataaaataagatttcaaattctattttattttttttgaaatacacgaaaaaagcgagggcgtgtctaattataaagagggggcggccgttcattgaaactcccatttatattacaccggcatgcacacataataactctgctttaatccaaccttatttcatttaacttcccttatcttaccaccgctaccattgttaaaaccttgtctttaccaatctaaatctccat

SEQ ID NO: 18742 - DNA, 541 bp, Sorghum bicolor
  Clone ID: LIB3478-053-Q6-K1-F7
cgacaggctaggcctcagtgggcttattggaggaaagattggttcgtctttggttatttttcttgttgaaaactacacagaagaccatgccaacggtttctttgatgatgacaaactgcgtgagggcctgaagtggctgataagtagtttggcaaggcagcctgatgtcacttttgtgaagactcatgagttacttctggacttcttgaatccacaacttgagctgcttaacacccacgttgcacctggagctggccctggggattgcatttcagtattcaacaatgctgtcaatcaactagcagaagagattttggctgcggcacgcgcaaactctagccaatggccacctcctgagattgatcttctggagagaacaagcaatgagaggatatatgcagaaatgttcttgcctagcattggatggtcttcgccatcaaggatccagccactgcttgcagccatcaatagttgcaagattccagatttcagttatgatctatcttggctaaaccatggttctcacatgggccagcagatc

SEQ ID NO: 18743 - DNA, 468 bp, Sorghum bicolor
  unsure (1)..(468): unsure at all n locations
  Clone ID: LIB3478-053-Q6-K1-H1
gatttagtggtgcttcaatgaatggtggggtagagaaatattaattataaatagtttgctgtcctacatgcatttttacatatatttatgttgtcctacaaaaatagtactgataatacctttatatttcttgttgctggttctgtttttcttaactcgccaaccattcagatcatgcaatgaaaacaagtgggggcactactctcaggctctaaggcatgattgacaaattcaagctgaccatgtgaaacgaagttttgggtgagtattaaccattagttntgcattatcttagcacttttaatgtatgcaattgaaagcatattttttgcctcgtagttgggttcccaggatccaatgctcatgcctttcccattctattctaatacagagcctatacacttgtagcatgaaagaatcatggaagatagtggtggatgtaataaggatttttagatctgtagaaac

SEQ ID NO: 18744 - DNA, 539 bp, Sorghum bicolor
  Clone ID: LIB3478-053-Q6-K1-H4
ccattcttcactacttttaggtcccctcaacatcagaccagaatctaactggtccttaggtagatgaatgaatggatgagaaactttttgccatctgacgttacatgggttgagatggacagaaaggtttttgtttcaccttttatcccaactttacaagtgcgaagtggggccaggtgtgttgctggcttactgctgctaagtacagtagcaagtgcagtctgactctgttttgcatttgagtgctgttggggacagggggcccagattgatctcacccctgcaatcatactttaccctgctcatgttttgtttatcctgtaatcatattgcccttttgtttcatatagccatcttggaatctttgtccaagatggctacacagcaatcatgcattcgtacccccattaggcagcaataatcatgagtttcaaggaacaatttttaagcgattcaggtgtaatagtacaagagctgaatcacccagtctgaattcatgttttccctccgtataaattttattctttcttcagtagtgc

SEQ ID NO: 18745 - DNA, 482 bp, Sorghum bicolor
  Clone ID: LIB3478-054-Q6-K1-A7
gcgtgctgctgctttggttgagaaggaaaggtctagaagactcggcacctccattcttaatcaagttattagagaagctatagcattcaaaccaccaccaagaacaagaggtggcaaaagaggtcgtgtctattatacaacacaggctgccattggtccaccaacattcgttttatttgtaaatgatgcgaagctcttccctgatacataccgccgttacatggaaaagaaactccggtcagatgctgggtttccaggcactcctattcggttattgtggcgtagcagaaggcgtccagacaaacgaggtaaatctgctgatagtagaacgcagagcccaggaacccctagcaaaatggttctagctgcctaactaaatcacagcctccagggcatggagcctccctaaatgcttgtggcaagtcagctctaccactgggattctattgagacggtggcaattgctgcttcaatcaataact

SEQ ID NO: 18746 - DNA, 489 bp, Sorghum bicolor
  Clone ID: LIB3478-054-Q6-K1-B11
gacgagaagtatgaagctaagcttgcagatttcggtattgctaaattggtggaaggttcgacgcttagctgtttcgctggtacgcatggctacatggctcctgagcttgcgtattctctaaaggcgactgagaagagcgatgtttacagcttcggtgtcgtactgctagagttgcttactggacgtagcccaactgatcaacaatttgacggtgaaacagacattgtctcctgggtttcatttcatttggccaagcaaaaccatgcagctgttcttgatccaaaagtaaacaatgatgcatcagattacatgataaaggcgttgaatattgctattgtgtgtaccactcagcttccatcagaacggccgacaatgagagaagtcgtgaaaatgctcattgacattgatcctagttccacagctaggagggcaaagaacaagaatgataagtaacagcgacaggctgtcttagtaggatatactagtaat

SEQ ID NO: 18747 - DNA, 488 bp, Sorghum bicolor
  Clone ID: LIB3478-054-Q6-K1-B4
aatgtttcatttcagccagaatttggaaaacaattgtgtctctttgttatgaatctgaatgttctatgggcattagcatctgtaatccatcattttccttgtaggcagaaagagaaccggaaaagacatggagccccatagttgaaatacgttatggagggggaacttatagaggtatatgccaagaaggtgttcctgaaggaaaggtgaaatcagatcgcatgtcctatccacagtataaattagaattcacaatataaatttaataagaagagctcttccaccgtatctagtttctgttataacttctaagaacacatcctcattatttcagtcacaaacctgtcttattttattatctctgcactatcataatcaccactatactattttatatatctatatatgacttattacggaccatctggtcttaacatatctttactttatttgtctatgtaaggagctatctcgtatgcactcacgct

SEQ ID NO: 18748 - DNA, 485 bp, Sorghum bicolor
  Clone ID: LIB3478-054-Q6-K1-C11
cgaggaaaatgaattacaacttttattggatcggttcaggagggcttttgagaacctaagtgaattgctgatagcttctcggaatctggagtttttcaccaatggttatcgatatttaattcagattctgccagctgcagttgttgctccaatgtacttctcagggaaaattgagtttggagtaataaaccaatcggtgtctgctttcaatcatattcttagtgatttttctctcattgttttccaatttcagtcaattagtgcattctcagcagttatcgatcgtctaggtgaatttgatgatctattggatggaaatgagccatctgtatcatctcaacgtgatagcattgatgggatcaacattgttttcaaaagcagtggtccttctgttcttagttctaatggatcactaacgcaatctgatccatgcatggttctggagattcgtaacttgacattgttaacaccaagaagtggaaatg

SEQ ID NO: 18749 - DNA, 482 bp, Sorghum bicolor
  Clone ID: LIB3478-054-Q6-K1-D12
ggaagagggagaggtcgctttgggcgtggtgaccgtaatcaaggcaacaactttgggtcaggagatggtggcagctggggctctggcgcgggagatggtggcagctggggctctggcaggggaaacggtggccggagtggttacaggaactggaacacctctggtggagatgatcaggcaggaaagagtaatgccaacaactcctggagccagaacagatcatctccatctatcctgggtcagccaagcggtgatgctaacaagtgccgaccctgcctcaactgccgggcgtgcccggcgtgccgctgccgtccgccgcggtgccctaggtgctgcctccgttgatgctgtcccgttcccggcgtggacgagcaccgccgcgcggccaccgacgtgcaaatgtagccggcgatgccctgtcatgtacctgtaccgtgtgtgttttatgttcgggtgtgtgtgtctcattatattcgtcgaga

SEQ ID NO: 18750 - DNA, 493 bp, Sorghum bicolor
  Clone ID: LIB3478-054-Q6-K1-D5
gttggccaccaggacacatggtaaggagagtaggcatatctttttctggaagaaggatagatcaaacaggaggcaaactgtagaaggaaccagtagttctcagccagttaacaaaatagttatactgaagccaaatccaagaagagagattgaccatgctgtagctgttagttcaactcaagctccaaaattaggtgcaactgaaggctcaaaattttcaattaaggaagtcagaaggagattcagaatcgtgactagtgaagctacaaaaggaagaccctcagtgtctgaagataaactccaaaaagatcaacattgtttcaaaagttcagctttcacgataataaaagataccagacagctcgctgaacaaacctcagaagggaaatcctcatctacagttataaaggattttagatcatcaaatagcggtaggcaaaagaaaaggaatgatggaccaaccgaaattaataacagcagcataatcacaaca

SEQ ID NO: 18751 - DNA, 490 bp, Sorghum bicolor
  Clone ID: LIB3478-054-Q6-K1-D8
ggaggaggaggtgagggcgacggactacaacgaggtcgcggcggcgctggagagcatctacaagctcagccccgccgtggaggtcgacgaggagaatgagcgccacggaggccacgacgacgacgacgagggcggcaagaaggccaagaagaagaggaaaagcagagtggcgggcaggagcacggtgatcgtgaagagccggcggcggcggcgcgggaggaggatggacctcgggaagcgggtggagatgaagagcgccgccgttagcagggagggggacgaagacgacgagggggagcgcgagcgcgagttcgaggagatgctgctgcgggagcactcggtgtcgacggacatgggcagccttgactggaagcgcatgaagatcccgccggtgctcacctcgtcgcagagcgcgcgcctcttcaagaccatgcagcccatgaaggccatcttcgaagtgcaggagagcttgcgagaggagctgcagaga

SEQ ID NO: 18752 - DNA, 489 bp, Sorghum bicolor
  Clone ID: LIB3478-054-Q6-K1-F11
gcaacagctcagcaatgcgtttgctaatgcatatgaggcgttgatgaaagcatttgtggatcacaacaagtttgggaatttgccgtatggattccgtgcaaacacatggcttattcctccaatatatgttgactccgccacgaagtgcccagcactgccagttgaggatgagagttggggtggaaatgggggtggctgtggacgtgatggaaaatatgaccgcagacggtggtcaaaagagttttctgttttggctagaatggcatgcaaaactgaggaagaacgggtgatcagagaccggaaagcttttcttttacacaatctgtttgtagatacagcaatttttagagctgcatcaacaataaggcgactcattgatcagtctatgaactcaattggtccacgtagtggcacacatggttcaaacgtatttgaggaacgtatcggggacatgaatataactgtgaagaaggatgaggctgatgctag

SEQ ID NO: 18753 - DNA, 490 bp, Sorghum bicolor
  Clone ID: LIB3478-054-Q6-K1-G11
acaacgtgcagaaggcgatgcgcggcctcgcaattacagatgctgatcactatgggagacttggagtcaccaggctagcttctaccgatgaggtaaaagctgcttacgagaagaagtgtgaagaactaaatagcaaagaactagaagaagaggagcttcacaaggaatatgacctcataaaggaatcatttaccatactatcaaccgaggaagagcgaagattatatgattggagcttgtcaagaagtggacagcctgagcgatatgtgtggccatttcaagttgatcctttggagatggcaccagatcctccacaggaaccagaagatgagttaccaaccaagctcgttggctacttcttgctggcgtggttcatactctccgttgctttgtcagtgaccctcaacaaataaggaatttctcccaaaaagagcataaattgtaacccaataatctctttgaaacgccttggttatacgtactagtccgg

SEQ ID NO: 18754 - DNA, 493 bp, Sorghum bicolor
  Clone ID: LIB3478-054-Q6-K1-G8
gcgtgaaggccctggacctccgggacggttcaggagagatcccggtcgtcggcgaccaggttgcaattcactattatgggagattagcagcgaagcaaggatggcgctttgattccacctatgatcataaggacgacaccggggatcccatgccatttgtcttcacccttgggtctggcaaagttatacctggtatggaagcagcagtgaagtccatgagagtcggtggtcttcgccgagtgatcattccaccatcacagggataccaaaacacatcgcaagaaccaattcctcctaacttctttgatcgacagaggctatttactactatattcaacccaacccgtctcgcaaatggcgagggttccactctcggtacacttatcttcgacatcgagctaatcaacataaggcaacattcataattgttgtgctgcgtgaggacagaagactgatcaacccccttattgaaaccttttggctccatactctt

SEQ ID NO: 18755 - DNA, 509 bp, Sorghum bicolor
  Clone ID: LIB3478-055-Q6-K1-A1
tgttcgtgaagttcctgaatatgagattgacccagcggagcttgatttcactaatggcaatgacctatccaagggcacatttagaaaagcaacatggaggggcattcctgttgctgttaagaagctggacgatgatctaattgtggatgagagcaaagtgcaggcgttcagagacgagcttgatgtgctgcaacttatacgccatccgaatgttgtgcaatttttgggtgctgtgacacaaagcaatccaatgatgattgtcatggaatttatgcgcaagggtgacttgcgcactcacttgagtaagaaaggagctctgccaccatcatatgcagtgaagttagctcttgatattgcaaggaagatggattacttgcatgagcattaaccttaagctattattcattgtgaacttgagccttctaacatattgagggatgacacttgacatctgaaggtggcagattttgatttgtgtaagatgcttaaatggagaaaaaaagtttgag

SEQ ID NO: 18756 - DNA, 507 bp, Sorghum bicolor
  unsure (1)..(507): unsure at all n locations
  Clone ID: LIB3478-055-Q6-K1-A7
nnntcagagcatgtactatgatataggggtttgtagaataaattacatatatctaataagtatgtaagagccactatttcccctcatgcatgctactaggagaaggttatcttgcagaccatgccagtcattgagaatgccataaaagaagtatacacaactcttgttcccagaaccatggtcattgctgacctaggatgctcttcaggaccaaacacattgctctttatatccaatgtgataaacatcatagctggccaatacaataaacctggtgatcctgtggaacttcaaatcttcctaaacgacctaccaggatacacacccccattgtgctacatttctgggttgccaaaatcatactacagcagactgtttcctcgccaaagcgtccatctctttcactcctcttgctgccttcactggctctctcaggtacctgaggaactatatgcacggaaaggagctntcttaaatgaagataatatntatatcacaaagaccaca

SEQ ID NO: 18757 - DNA, 508 bp, Sorghum bicolor
  Clone ID: LIB3478-055-Q6-K1-C10
gcatgagcttgctcaaaattggggaatcagggcgacagttctttatgatcaatctcctgattttttccaccctgcttcattgatggagaaacatgggttgtttagcaggctagggaattccatctgtagtgctatgggcaatgctgattgcatatcagtggaggaagtaggggaacacatgaacactactgcctttaccagtaacattgatggtgaagttttcttgaagcctaatagacctgcacttgttgtgagcagcacaagctggacgccggatgaagatttcagcatacttctggaagcagcactgatgtacgacagacgcgtcgctgcagctttaggtgaagatgattcaatggatgaggagcaactttggatcgatatcaagaatgggaagcaatttgtctacccaagattactgttcatcattacaggtaaaggacctgataggaagaagtatgaggatcagataaaaaggttgaagttgagacgtgttgccttgcggacg

SEQ ID NO: 18758 - DNA, 503 bp, Sorghum bicolor
  unsure (1)..(503): unsure at all n locations
  Clone ID: LIB3478-055-Q6-K1-D7
cttcgccgccatggctaatccaacacctcaactgttccagacccaacgaagcggcggcggcggcggctccgaggaaggagaccacaacagcagctccacatccacccttcctatgagggaagggtggtgggcggcggcaccgctcttccgtctgcacggctgctggctcacggcgcgactcgctaggagcgtcgaactcgtgcaagccgagttcaagccgcgccccgacgacgtcctcctcgcgacgttccccaagtccggcaccacctggctcaaggctctcgccttcgcgctcatcaaccgctcccgccatccggtcatcgtcgacgacgaccaccaccacccgctgctcagcagcaacccgcacgacctcgtgccgttcctcgagctgcctgaccggaccctccgccccgtggcggagctcgaggcgctgccgtctccaaggctcctgtgcacgcatctnccacccgcgctgctgccgccgggcatgttgacgacgagct

SEQ ID NO: 18759 - DNA, 330 bp, Sorghum bicolor
  Clone ID: LIB3478-055-Q6-K1-D8
ctttgaaagcatgacatttgcagcacatacactgtcacgaactgatctggtcggaaactattgttgtttccaagagggagaccactgcctgcagttcacacacgaccttattatgaggggcgggtggatggctgtgactgctgtcctgcataaggcgcgttgtacctaactgttctgctggcctggagcgcctatcttcaggatcgctaccaaagcacgaacaggctcgatgagctgctggctacggtccgaggacagtcagcgcgacaatcagggctataagatcaagcctcacaaggctcagaaagaagacacggatcttctaatacg

SEQ ID NO: 18760 - DNA, 509 bp, Sorghum bicolor
  Clone ID: LIB3478-055-Q6-K1-E7
gaaatcagttgcccgagaagataaagcagcaaatgttgtcgcacttctgcctacagttcaagacagaggggctcaaccagcaagctatgctaaattgtctcccaaaaggaattcggtcaagcatagcatacaacttattttttacaatcctacaacaagcctccctttttaatggagtttccaatattttcattgcagacctggtaatggatgtccaggctgagtatttcccaccaaaggaagcattatggtgccaaatgagggggccgccgatttcttccttattagttcaagaagtggggatttgatataccaccattaatgggtatgagacacaggtgttaaaaaagttggagggagacatgttccgagaggttggtgctctctgtgacataccccagacatttacttgccgcaccactactctataacagctcttgagaataaggaagataagactaacagagattatgcaagaacacagggaagacagcaatatactaatgaat

SEQ ID NO: 18761 - DNA, 511 bp, Sorghum bicolor
  Clone ID: LIB3478-055-Q6-K1-F5
caagttcataagcaacgggcagcctggcacggcgcaggatgtcgataaatcgaccaccttggctcgcaaagttttccggctcctcaagtgggtgaatgatctgcatgctcttatcagcccgccggctaaagggacacctctcacccttgtcctgcttggcaagtccaaaaatgcgctgctttcgacgttcttgttcctggatcaatttgtgtggttaggacgaacagggataatcaagaacaaggaggcgacggaccgggttgccaggatatccttgtactgctggatggcttcttctgtctgtgcaggtctagttgagcttggagagcttaaaaggctatcaagatcaatgaggaagcttgcaagagagctgaggaacacagataaatatgagaatgaacagtaccaaaacaaaatgaagcagtcagatgaaaggctcctggcccttgtcaaggcggccatggacgtggtcgtggccattgggcttcttcaattggcgcccaagaaggtc

SEQ ID NO: 18762 - DNA, 304 bp, Sorghum bicolor
  unsure (1)..(304): unsure at all n locations
  Clone ID: LIB3478-055-Q6-K1-G3
cggacgcgtgggttntttattttttttacaatattttttgttttgtttttgnnnnngnnggaggggcccaaaaaaaccttgtgttggcacataaccccggtacattgtgggccccccccccacagcattacgcaagatccgtttttgagatgaactagggtctacatacaccaacagtggaacagaaacatgctttatatactatacaagaacggggaccggacatacttatttattccagacaccacaggctatttgttgacataaaaaaaagacgccgcacagctcattttacttatgatga

SEQ ID NO: 18763 - DNA, 511 bp, Sorghum bicolor
  Clone ID: LIB3478-055-Q6-K1-H3
gaatcaccgagcacttcaaagcgactgcatagaacatcaagcattccattcgacttgaacctcccaggtgatgaggcggaagcccatgatggtgatgatgacagcagtagcagccatgagaactcgtccagtgatctagagggatatgtgggcaacctcttacgttcagtggatgagtcaatcaatttcaaaccatttgactttggcaaactttgtgaggacatcatgcaggaatttagcagtactatgagcaagactataggctccaggtgcaggctggagattgacgctgtggctatggagcaagtagtggcagcggcatggacatctgattcacatgagaagaggcctgtggggacgtgggtggagcaggtgtttgccaggagccttgagcagctgaaagtcaggtgtaagaatttgagcagctgtactctgagattggttgcctgtgagaatgaaatgccggtgaaagaagatggttttggagctttccttccctcgacaatagttc

SEQ ID NO: 18764 - DNA, 273 bp, Sorghum bicolor
  Clone ID: LIB3478-055-Q6-K1-H6
aacccacccgtgcaaacaacgcgatcaacctaacaaggggcacccaaaactaaatcaacgggccgccgattaacaccgccggcacgggaaaaacccggggcgaccccaactaaaacgccgggaagaaaatccccttttccccggctggcataataccaaagaggcccgccccgaacgcccttccaaacagtggcccagcctgaagggcaaagggaaccccccctgcagcggcgcaaaaagcgcggcgggggggggggtaacccccagggggac

SEQ ID NO: 18765 - DNA, 114 bp, Sorghum bicolor
  unsure (1)..(114): unsure at all n locations
  Clone ID: LIB3478-056-Q6-K1-A12
cccccagagaatttgttgtaactcaattttgctgaacgttcttganatacctctcctatttgggacggaaataccttggcacgaactgaaacagcgcaatttacttttattgag

SEQ ID NO: 18766 - DNA, 538 bp, Sorghum bicolor
  Clone ID: LIB3478-056-Q6-K1-B11
ccgcaattctcattgatcagaacgccttctcagctcggctcaggaagaatattgagcagctagctgcactggtgagcagctatccgctgtctgatccggagaatgaacagattcaagacgtgatggagaagataaggctgaaattcagggccatcactgcaagcttaggcgtgaagttagagtatgaaggtcaccccacatcatcaaagcaggatgttgaggatctgtgagcgcgatggacattacattttagtttctctgtctttgctttcttaagctctccaaatcttgtcttcaacttattgggatcatgaggagctaccctgagacaacaacggtcagattcagatcataaatcacttgtatagttttaacgatgtcttaagttttgtcttattacctgctgcctgaggtctccatgtattgcccatgatcagtcattagggtttcaccagagatccactagtatacttgtgtaataattcccgtttagaacgcgaaagcattattatgaatggtattccttatcatttgtttg

SEQ ID NO: 18767 - DNA, 456 bp, Sorghum bicolor
  Clone ID: LIB3478-056-Q6-K1-D1
gaaaaaaaaaaaaaaaaaaaaaaaaaaaaaaaaaaaaaaaaatttattttcacccggcgttttttgaggccaaacccggccaccccacaagttgggggggtcggcaaccttccaaccatttcccatgggaggggggccccaggccttggaagggccggacctgccgggccagcccttccaggacttccggttccggacctttcagggcccttgggaaccttccgttgggtttccgcaacctgcttcctcttccgggtttggctggggtgggttttaaaacccggaaaagcccgaccccccctacgaggcctacttcccttaagggttccaaggcggtccaagtttttgtcctggtgcttaaggaagaacttgcaaaattaagggttttccattttgttggctcgggttaagctggggtctggtcattaccggggttttccttgctggcatttcatg

SEQ ID NO: 18768 - DNA, 594 bp, Sorghum bicolor
  Clone ID: LIB3478-056-Q6-K1-D6
gatgtttttcgttctggagcaataaaatctgctaccgattttcaaatatatgaggaagttggccgtcttcctggacttgattttgcatataccgatacaacatctgtgtatcatacaaagaatgacaagatgacacttctgaaaccggggtctcttcagcatattggagataacatgcttgctttcctactccattctgcagcatctccaaaatttttgaaagatgcacaacaacggaagcaaggaaacacagagcaggataaagctgtttacttcgatatcctgggaaagtacatggtggtctatccacagcgacttgcaaccatgtttcacaactcagtcatattgcagtcaattctaatatggggaacatcattgcttatgggtggacaccctgcgctggtgtcctttgcaatatcatgtttgagcatcattctaatgttgatattttctatctgcttaccagttgtggtagcatttgctctgccctacatatgtccgtttcctgttccatatgttgcaaacccatggttaattattggcttatttggttcacctgcactgcttggagcatttattggtcagcatattgga

SEQ ID NO: 18769 - DNA, 480 bp, Sorghum bicolor
  Clone ID: LIB3478-056-Q6-K1-E7
ctacgcgatggccgcgctccgcctcgcctcctttaccctactacccgccgccgccgccgaggcgtgggcgtgctactgcgcgagccgggtggggccccgatccggctgcttcaagcgcgcggggcgctggctaccctgcctgcgactgggcccgccccgtcgccgcggggacctctgcaggccacatgccgaggatgaacaggtggctacactccgtgctgtcaaggagtctgcgaaggaacgggacgctcaggctacgatcgtacctcctcaagagagtggtagagagaccttgtgccggactgacacttgcgaccagttgcgattcaactaccatgtgccccgaggaatggaccgcgctgatcgatataatcaatctgttgaactaaccacagacgagccttctgtgctctatcaacagcctgatctacaactggggtgcgacaaatggggctgctgtctgcccacattgtccaaaac

SEQ ID NO: 18770 - DNA, 455 bp, Sorghum bicolor
  Clone ID: LIB3478-056-Q6-K1-E9
gctacctccctcccccccttccactgcgccgacactagccagccgaaaagccggcgccatgctgggggggctcaaaccgtccccgggggggagcgcactgcgcgcgcgctcggcacgccgcgcgtggtcacggaggccatcacgtggggcctgcgcgcgcccgcgaccctgagcgcaaccgcccttgcgccggcctagagcagaccgattgtgcgcagacgatgggaggcggccaaggacaaatggccacgcctgacgataacgcggtggcgccatgcaacgccgagaaatcttgaggtgaacgtggcggtcgcgcctgctaggatgccgctaattacgagtctgtacccagaagggcaaaacatcgcagcggtcttgatatacctcagaggccttctgatcgcacgggtaacgaggagggactgggccatgttcgatcagtttgcaactgacaa

SEQ ID NO: 18771 - DNA, 281 bp, Sorghum bicolor
  Clone ID: LIB3478-056-Q6-K1-F6
tcacgtttccaattgttttacacgacaactgcataatgagcgggcgtgaacttacatacgacggtggcgggaaagcttatttcatacaacttttttcattttatacaaaacaacataatagagtttttcgtttcaaaattatttttttctttgcgaataatgaaaataatgaaagaatgaaaaaaaaaacatgtctaatttttttgtaactttaatatttcataaagatcatccttcaaattaagaaaatttgcatacactcctgcataaatataatattc

SEQ ID NO: 18772 - DNA, 590 bp, Sorghum bicolor
  Clone ID: LIB3478-056-Q6-K1-G10
cccacgcgtccggtgatgatgatagtgatggtgccactcctagttcacctggaagatctcagcgtggaatgtattctagtggtgatgtgcctagactgatcaggagcctctgctgttggtcttactgctgtggttcacaaggatccagtaacacgagaatggacaattgagggaggtgcactagtccttgctgatccccatttgccttattgatgaatttgacaagatgaatgatcaagatagggtagtattcatgaagctatggagcaacagagtatcagtatgtcaaaagcaggaatttgcagtgtaattactgcagcaaacccaatagggggaaggtaacttcaggatattgttgatccatttacagatgaaatgcttgcaaggtttgttgtggatagtcacaccagatctcgacccaagggggctaaccttgaagacaggattccaacagatgtggatgatgatccactggcctctgtaagagaagctaatccagatgtcaaccgtactctgtctacaatgttgagggctgtgctgaaaaagaatctgaaaatgtgggaagaatgccttccacatgttgaatttgc

SEQ ID NO: 18773 - DNA, 571 bp, Sorghum bicolor
  Clone ID: LIB3478-056-Q6-K1-H7
cacccatgccgttctcccaccactccccagctgctacaagtcagctactcgccccttcccgccgcacgctcctattgccattgccatgcccgcgagccggcgcgaccccggcggccgaagctgtgctcctacccggcgggctgcgagcggagtcgctgccacgacacgtggctgtagtgatggacgggaactcgcggtgggcgcgcgcgcgcgggctgccgtccgcggccgggcacgaggccgggcgccgcgcgctggaggaggtggtgcggctctcccgcgcctggggcgtccgcgcgctcaccgcctttgccttctcccacgagaactggagccggcccagggtggaagtggaattcttgatggggcagtttgagcgagcgatccgcgaaagcgtagctgaatttctgagggacggaattcggctacgtgtaatcggcgactcctcaagactgccggtttctcttcagaagatcgcgagagaagccgaggaggccacacggagcaactcgcagctcgacctgacactggcaatcagctacagcgggcggagggacataatccaagcatg

SEQ ID NO: 18774 - DNA, 508 bp, Sorghum bicolor
  unsure (1)..(508): unsure at all n locations
  Clone ID: LIB3478-056-Q6-K1-H9
cggacgcgtgggtcaaatacaagtaccccatcaacagttcgtcggtaacaatgtggtgcatggtttaaatccttctgccgttggccatcctttagatccaagaattctggctctcccatttaatgctgagcacacttttgggcatccaatgcatccacctctgataaaccaagctaacaatgggtctttaagaattctgccatatcagaacgctacagtgatggatcattcaaggatttatgaagcaggacatgttattgatgaacatagagatatgcgtttagatgtggataacatgacttatgaggagcttgtagcattgcaagagcagataggtgatgtcaatactggtttgacagaaagctatatccaagaaaacttgaagtccactttntatgttccaggagcagctagcatccctgatcagttttctgagctttctttggagaatgatgcctgcataatatgccaggaggagtatgaagcttaagaacttataagaaccctt

SEQ ID NO: 18775 - DNA, 279 bp, Sorghum bicolor
  unsure (1)..(279): unsure at all n locations
  Clone ID: LIB3478-057-Q6-K1-B2
cccttcttcccctctgccgcantgacaatgctggtcgccgccgcctccgtcaagccctccaccaccgcggctgcgggcacctgcaaggcgcccttcaagcccctccgcctccctcccctccccgccgccgccggcctcaggccgctctccctcgccgtctccgcgcgtccgctgtaccgccaggagcatgtcctctcaaccgtggcggtggcggcggcggcgggccgcaacgaccgggccacgttccccgcgccgccgttcgacaccgcggacggggcc

SEQ ID NO: 18776 - DNA, 605 bp, Sorghum bicolor
  Clone ID: LIB3478-057-Q6-K1-C12
gtgaaattggatagctgaagtttatgtcttttgtacattgatgttctaaaagcattccttataatttgtttcatgtcagtgttagcgagctcaacattttacttttgttggttttgccaaacgtcacatgcatctcactgaaggggcttggtatggccactgtcagtatgcaactatttgttcattctatctgcagatgtttgttgttgtgttatggcaacttgaaatgatactgttgtatcttgttgaggcttgccttgtttttgcagctaaggagccagattgcttctgcaacatcagctattaaatcagtatttggacaagaggtccaacagcaggatgcagcgaacaaattagagcagctcagagaaaggatgctcaaagtgcgagagctttttcgcgacacggaatcaacagagtttataattgtgacaatcccaacggtgatggcaatcagtgagtcatcaagacttcattcttcgctgcaaaaggaaagtgttcctgtaaggagactcattgtgaaccaagttcttccgccatcaacatctgactgtaaattctgtgctataaaaagaaaggatcaaacacgtgcactggatatgata

SEQ ID NO: 18777 - DNA, 590 bp, Sorghum bicolor
  Clone ID: LIB3478-057-Q6-K1-C6
tcatttttgcaaccacggaccgagcagtcccggttccgggcggttcagcgataagagagcaggagcggcggcgacagctgtgaccgcgtgcgagcgtgctgcgtgctgcgtgcgccggcgatcgatggggtggtgggagagcatgttcggcgacggcggggacggcggcaacgtcggctgcttccggaggatcggcaggaagcatgccaggaactcgtacgctttcccggcggatcctgtgagcgagaaacggagaggacgatcgggcggccccgtggcggaggaggtgatcacggtggaggtgccggaggtgccgctgcgcgagctgaacgagatcaccgcgtccttctccggcgagaagctgatcgggcaggggtcctacgccaaggtttaccaggcgacgctgcggagcggcaggctcgccgtcgtgaagcggctcgagaagccctccaagcacgcgtccaacgtcgtcttcctcaggcagctcggggtggcgtcgaggctgagccacgacaacttcgtccgcctgctcggctacaccatcagcggcgacctccgcgtgctcgtctacgagttcgccaccatgggca

SEQ ID NO: 18778 - DNA, 605 bp, Sorghum bicolor
  unsure (1)..(605): unsure at all n locations
  Clone ID: LIB3478-057-Q6-K1-E5
ataactttcaaggaagctatggctgttgccctcaaggtattaattttgatccagtaagaaggcaatgcacttctagtaagcggcaaagtgttcttttgggtattgctgtcggaattagcagtggttttggagtcctacttcttacattgactgcaatcatattagtcaaaaggtggaggacagacacacaaaagaaaatccgaagggcatacttccggaaaaacaaaggcctactcttggagcagctgatctcttcgactgaaagtgttacacataacacaagaatattttccttggaagaattagagaaagcaaccaacaactttgactcgacacgtattattggacatggaggccatggcacagtttacaagggtattttatctgaccaacgggtagtcgccatcaaaaggtccaaaattgtagagcagagtgagattgaccaatttgttaatgaggtggccatcctgtcacagataattcatcgcaatgtggtgaaactttttggttgttgccttgaatctgangtgccacttctcgtatatgaattcatctctaatggcacacttcatgatcttcttcatggcaatctgagtgccaaatgc

SEQ ID NO: 18779 - DNA, 456 bp, Sorghum bicolor
  Clone ID: LIB3478-057-Q6-K1-F1
cccacgcgtccggagaaagacgaccaagaagagcacggcagcacgggcaaagagcgggaacagctcgagatggactgcgagaagcaggcgaagaaggtgagcgatgtgtacgaagcgcccaatcccatcaagagaacgaagtgaagaagcaccccggacaccgcgcgcgcgcatcagacggccggtgactgccgggcatgagcagcaatatataagtgatgatgtacagagtcaccgatccgatctcgcgtcatcagctatgtaaatgtatgtaatgtatatgtatgtatgcaactcggcaacagacagacgtttggctcgtggatcccatgcccatgggtgatgggtgggtgtactaccaaattcagtagtctgtgactgtgtgaccgtgaccctggcctgaagctgagtatatagcagtcgtattgtgatgctgctgtgtctttttttggcatg

SEQ ID NO: 18780 - DNA, 457 bp, Sorghum bicolor
  unsure (1)..(457): unsure at all n locations
  Clone ID: LIB3478-058-Q6-K1-A9
nnnnnncattgatctacagaagaccagtgacattatgtatcgttaacctgagacaagtctgatgtgggcgagggtgataattacggtgtgcatcgaagccctaaccgactgagggcacctaaaaacataggttctgcacaaaaaaaaggtgtgaggtcaacgcacaccggtcattgttgctcgattaacggccctgtgacaagccaagaaatacgcatgctatactacccgaaaagccgacgggttgacgacagctaacaacataggcgttgtgcaaataaaaacctggaacgcaaatgaccacctgacactttcgtgcaataactgcctaactgctatgaatccacaaatataaaaaatgaaacgcacgtgcataacgaagcatcgcgacattcatactgagcacaaatgaactaaaaagcacatttcacaagacgcgatacatactttgaacact

SEQ ID NO: 18781 - DNA, 467 bp, Sorghum bicolor
  unsure (1)..(467): unsure at all n locations
  Clone ID: LIB3478-058-Q6-K1-D4
gcgggttcnngctatattagaccaatacaacgatgaccacattcttttgggggaccttgcacatgaactcggaggtgatgtgagcttccaatggattcatgagaaaagagcatgttactatcatttcaacttcaccacaagaacgaaagaagctggcattgctaatctattctttgctgaagtgtcacggatgcaaatagacggggattgggtgctcagctgttgttgtatggttggacctaatgataatggtggctgttatagttgtgcaagtgatgatagccctgatattaagcacccaagccataccaattcatacactggtggccacgtggatgaatatttaagattcggaggtgattcatgcagtgactcagatgatgatgaggaagttcacgtggcttagctaaggataaagtttaaggtacattctgacttgtgcagccattattgtagtatgcatgtta

SEQ ID NO: 18782 - DNA, 483 bp, Sorghum bicolor
  unsure (1)..(483): unsure at all n locations
  Clone ID: LIB3478-058-Q6-K1-E11
ngttgctgctccggtggaagctcggaacaagctgtccgtctccgagggcgctctagtcacgagccgggggagtacaggagcctcgctggtgccctccagtacctcaccctgacgaggccggacctagcctttgctgtccagcaggtctgcatttgggctccagtgctgtcgatcagctcacagcctactccgacgccgactgggctggctgcccagacacacgccgctccatctacggcttctgcgtctacctcggcgacaacctggtgtcttggtcttccaagcgtcagacgaccgtgtctcgctctagtgccgaagcggagtaccgtgcagtagcccatgttgttgctgagtgttgctggcttcgtcagctactgcaggagctccacatctccatcccgcttgcaacggttgtctactgtgacaatgtgagcactgtctacatggctgccaacccaatacaccaccgtcggacgaaacaca

SEQ ID NO: 18783 - DNA, 331 bp, Sorghum bicolor
  unsure (1)..(331): unsure at all n locations
  Clone ID: LIB3478-058-Q6-K1-E12
nnccggaggcagcagtaagaaaacacgtagaaaccgtactctcggcgccatggcacgcagcagggccgggcgtgttgtttcttctcgcgctctcgtgctgctggtcgtggtggtgcggcgccgtcgtcgtcacggcgcggccgaccccgagcaccaccaccacagccggcggcggcggcggcagcggcttcatcgcgtcgtggtgcgcggggacggactacccggccctgtgcaacgcgacgctggccccgtacgcggcggaggtcggggccagcccggcgcgcctgtcgctggccgcgctgacggtcactctgggcggcgcgcggaaggc

SEQ ID NO: 18784 - DNA, 560 bp, Sorghum bicolor
  unsure (1)..(560): unsure at all n locations
  Clone ID: LIB3478-058-Q6-K1-H7
nnnnnttatgtacctgaaatatccagcactgatgaatcgatttcattgcaagacaatgccatcagcgctgagacactgctgggttcatcaaatatcttanaggctggtgttctgaatagtgtggtccaaaatgggagtgcggcagatgcaatattgatggaaacaaatcttgagaaacaagatgaagttccatctggaggatccattgagtttgacttgaatagttctgaagagcaagctcgtttgtttgctcaggtttctgattcagatgaagacattgtactaaacagtcaggcagatgcacaggatggaacagccagtagtgctaccgatggagttattcttcccttagagtcttctgctgtttatgaaagcaatgctgcacttttaagagatcatgagacattacctaatgataatcatgatggatcaactgatggtgccgtggatgatgcaaaccttcttgcaacgatcaatggtgttcaagcaaaagcaagcttctttacatgagcatgatgcattaactggaagggtgtcgattgacaatgctcagagctttg

SEQ ID NO: 18785 - DNA, 443 bp, Sorghum bicolor
  unsure (1)..(443): unsure at all n locations
  Clone ID: LIB3478-058-Q6-K1-H8
nnnnngaatcctcctagactgctaggcattgctcatttagtttctttgcttatggtgagcatcgggacagagtgtatgttcttgcagctagtgaaatcacccctccttcaagaggttacactcttgcttggagaatgagggaagggcacgccattggtggcaagccagtccttgtgtgggcacctaaacaactgtgacttatgcacagccttagtggcgactccgaaccacggaataaatattgtgtgctgatatatattcttgcaattattgatactgaggcgattagagggattgtggctgatctacttgaacatacttgtgtggatgcatatatttgatattcacttactaacatactggtatgaagctagaaaatttatcctatctaaatatccttggacgaattctgattaatactaagatggttctgcccaaggcgt

SEQ ID NO: 18786 - DNA, 209 bp, Sorghum bicolor
  Clone ID: LIB3478-059-Q6-K1-H9
ggactctccctgtatcgtctcattaaactcatctgttgtggtgtttacgcgcagtcgtacctcttcacttgccatcgccctaacacccactcctttcaattttttccctttcttttctcgccacatttcccggctttccccttcaaactttaaaatcgggtcctccctttaaggttcccatttaaagccttacagcacctcttacccca

SEQ ID NO: 18787 - DNA, 375 bp, Sorghum bicolor
  Clone ID: LIB3480-001-P1-K1-A6
cctccctctccctctgcctctccctctctctccgctcggcgctcgcaccaccacccaaccctccgcgtcaacctcttcgggtatgattattctggttatgggagatctacagggaagcccactgagtgtaatacatatgcagacattgaagcagcatataactgtctcaaggaaaaatatggtgtcgcagatgaggatataatcttatatggtcagtctgttggaagtggtccaaccattgatcttgcttcgcgattgccagacttgcgagccgtggttttgcatagtgctatattatctggactaagagtactatatccagtcaaactgacgttttggtttgacatttacaagaacatcgataaaattggcttg

SEQ ID NO: 18788 - DNA, 399 bp, Sorghum bicolor
  Clone ID: LIB3480-001-P1-K1-A9
agggccggtacgtccagcactagaaccgccatgtcgggccgatggcctggcccgtcggcccgctctgcctcgccaggacggcgcccgaggcgccgtggcactgccatggcgacgtcgccgtcgccaagcctgcttgaatgcggtggctcgacgagaaggccgctgccggccgtgccgtcctctacgtagcgcttggcaccatggtggccgtgccgggctctaagctgagggaggtggtggacgggctggaccgagctgggttggacttcctatgggccgtgagacccgttgatgccgaccttgggagtgggcttcgaggagcgcgtccagggcaggggcatgctggtgcgcgagtggttggaccaacgcgcgatccttgcgcacgagtgcgtcaaggga

SEQ ID NO: 18789 - DNA, 430 bp, Sorghum bicolor
  Clone ID: LIB3480-001-P1-K1-B2
gtcggaggccccagcgaccctatcgtctccatcttcttgccgggcacctttctcatcgtctccatgtcggccaccgccagaccttagacgagacgactcaacattgagccagggtgcgagatgccggatccatcagtctgcgcccgccttgagctgagtcgttcgttcctccatggctagccgcaattgatgttggcatggattgcgtcgatgatggcgatggctaagtggcgtcgttctcggctggataaacgccgccacgatttacaggagaaatccatggcgttcgtacctcgctctcttgcagcaatggactaccactctcctcctccaagcaatgaggcaaccgccaggattggcactgatccaagctgtgaagggaaagggacgaaaagaagacagcgttgccaagcagtctggccatgacaag

SEQ ID NO: 18790 - DNA, 445 bp, Sorghum bicolor
  Clone ID: LIB3480-001-P1-K1-B6
ggccaaacgacccacggtgccaaagttcggcgcctgggacaacgacgatgtcgggtacacggtctacttcgacaaggtgcgcgagaacaagggcgccacggcgccgccgctgcaccggccgcacagcctcgacgacccggaggaggggcccatgatgagagtccctccgccgtcgtcgtcgaggccggccaccgcgggaggccaccgcgaggcgccgccgtcgtcgaggcggcaccacgggcagggcggccaccggcgaacggagagcagcagcagcgtggcgtccgacccaggctccgcccaccaaagcaagttcgcgccgccgccgcagtactaccaacgcacgagccacggccaccaccgtcaccacagcggtggccaccaccaccaccagcagcagcagcagcagcaagccccgtccttccacggtcacggccaccgagcc

SEQ ID NO: 18791 - DNA, 433 bp, Sorghum bicolor
  Clone ID: LIB3480-001-P1-K1-B7
aacgtgttcgacaacaagacggcgttcgccaacgagctggactacggcaagagcaagcgcgaggcgcagtgggcgatcgcgcagcggtccctgcacgggctgcagcagcccgaggcgtcgggcctcttcaacaccgacaacagcaacgacttcattgagctctctgaaatcgccgagcaggccaagcgccgagcagagatcgccaggctaagggagctgcacacgctgaaagggcatgtggagtcggtggtgaagctcaaggggctggacatcgacaccatccaacataactacaccgtgtgatggatcagcgtagctacacgttattacatgcatggatcggagtgagacagcatcgatgcatggcatcagctggtcatgcggcagcggcatcgatcgatttggaggaggaacttctctttttcttttcaaa

SEQ ID NO: 18792 - DNA, 324 bp, Sorghum bicolor
  Clone ID: LIB3480-001-P1-K1-C7
gtcctccaacaagaacggcggcaacatccgggactcgccggaccacttcggctggcgcaccgtctccgacggcgacggcatcaccctcttcggctccaccaacgtgtggctcgaccacctctccctctccaactgccaggacggcctcatcgacgtcatcgtcaagtccacgggcgtcaccatctccaactgccacatgaccaaccacaacgacgtcatgctcttcagctccagcgacaagcaccccgaggaccagatcatgcagatcaccgtcgccttcaaccactttggcagaagccttgggcaaaggatgccaaagggccc

SEQ ID NO: 18793 - DNA, 361 bp, Sorghum bicolor
  Clone ID: LIB3480-001-P1-K1-D2
cccaaagaacccgccggtgatcatgtgggacgacagggcggcgacgcggggcaaggacgggaagcccgtgggcacctacggcagcgcgacggtggcggtggagtcggactacttcatggcgtcgggggtccacttcaagaacgcggcgccgctggcggcgcctgggacggagggcgggcaggcggtggcggtgcgggtgtacgggaacaaggcggcgttctacgactgcaccttcgacggcggtcaggacacgctgtacgaccaccgtggcttacactactttaagtcgtgccacatccagggcacggtggactttatcttcggcttcgggaggtcgttgtacgaggactgcgccatcacg

SEQ ID NO: 18794 - DNA, 290 bp, Sorghum bicolor
  Clone ID: LIB3480-001-P1-K1-D7
aacggcttgtagattgtgggttcaaaagctactgcatccgtcccaacataaatcaacttttggagttgtatcattaaatcaaattattttaaagttaactaaatttttataaaaataccaataattatgacaccaaattaatatcatttgatatatcataaaatatattaatatattatggatttattttatgttatagatgatgtcactttttctaatctaactcaaaatattttgtctttatattatgtggttctaaaatttgatttgatttatttaggacagaggtt

SEQ ID NO: 18795 - DNA, 254 bp, Sorghum bicolor
  Clone ID: LIB3480-001-P1-K1-E1
cggacgcgtgggataaaaaaaagaacctgataatagaaacagaaaaactataaaaaatacaagaaagactaaaatgaaaggaaaaataacgaacttcctctccatccacggtctagttgtctattgatccctctgaagtttggatcttgatgtaagtaccgctcatcactaagtcgctttgcatgtgcgtctttctcggacacttcttgtttttcatccagacattcatcatctgataaacactcaactaaatt

SEQ ID NO: 18796 - DNA, 431 bp, Sorghum bicolor
  Clone ID: LIB3480-001-P1-K1-F1
ggattttgttaggaaggtctgatgttgcaggttggggtgcattcattaagaatcctgtaaataaaaatgattatcttggagaatatactggtgaattgatctctcacaaggaagcagacaaacgcggcaaaatttatgaccgggcaaactcatcatttctatttgatttaaatgaccagtatgtattggatgcttatcgcaagggggacaaattgaagttcgcaaatcactcatctaaccccaactgctatgcaaaggtgatgttggtggctggcgaccatcgggttggtatctatgcgaaggagcatattgaggctagcgacgaactcttttatgattatcgttatgggcctgaccaggctccagcttgggctaagagacccgaaggatcaaagaaggacgaagcatccgtctctcatcatcgagcacac

SEQ ID NO: 18797 - DNA, 437 bp, Sorghum bicolor
  Clone ID: LIB3480-001-P1-K1-F3
gtgaaatggtgaaagccaaggaaggcgtggagagaaagctgtacggatcatacagccttggcagggatgagcccagcttggagccgcaaggctcctcctccttgccactgtaccatggcaaatacaggagttattcgttccacagctcacagaaagagagcattacgattttccacagttcagaggatagtactaccagtagctgctctgatgatagcgagagttgcagtggtacgagttctggagaaatggaactggatgagtctaagttagcagaagaagctgggccctccaacactgcaaatgttgaggagggagttcaacatgaactagaaaaacagcaccagcattgcagcgccccataacccttggttgctggaaggatcagagctagaattgattgcaattcggaacatgtctggaaggacaatatactg

SEQ ID NO: 18798 - DNA, 438 bp, Sorghum bicolor
  Clone ID: LIB3480-001-P1-K1-F5
ggcgtcgccgatggggctacattctggctcttcttcaacacctggtcagagataaaccggcgtagcagcagtggaggtgaagggtacaagctgtccacaccgccgcctgtgttggacagatggttcctcgacacctgtccagtgccagtccctctacccttcggcaagctggaggacatcgtccagcgacctgagtactcgccggtgcaagaatgtttcttccacttctctgcggagagcataaagaggctcaagacgaaggcaaatgccgagatggcgggaactgcgacggccaccatctcctcgctgcagtccctgctcgctcacctttggcgagctgtgtgccgagcccgggggctcgcaccacacctggagaccacgtacaagcttggcattggatgccgcgctcgggtgaagagtataccacaagagtacatg

SEQ ID NO: 18799 - DNA, 303 bp, Sorghum bicolor
  Clone ID: LIB3480-001-P1-K1-G10
gaccatgtacctgcctcaagctgatgcatatccagtcctacccggtcaactatgacctcagggtcggcatttttctttagagccacttctaaaatacccaacatcccctacatgaggggctcactggacacgctggctgcgttcaaagagcccatctggctcaccgattgtttacgtaaccaaagggcccaagcaggtggagttcctcttccttctggccttcacagccaccgcctaggcccgcgttgtccatgagctgatctctttgaactcatgccatcagacattcaaccaggtgcactt

SEQ ID NO: 18800 - DNA, 402 bp, Sorghum bicolor
  Clone ID: LIB3480-001-P1-K1-G6
atcgacacccacttgcgtcatatgatcctgcagttgtgggtagcatgtattgaatggagcaacttgtaatttatggttgtcccccaacacaagaggttggtgatttactcctaagtagaatatgcactcacggcagttggcaatacaaatccgttttgcagctgcaatgatatgcactctttcacaatgctccacttttactaccttaccaacagcaccaagaacaactgtagcatcagaacagccatacacagtagcatacttcagtggtgctaatatgtagataacagaatcatggcagttcaaaacctttattgtccctttgacatcagatgcatgcttgacaacagaagttttggaaaagccttccacaaacgttacatttctgtagtacgcatgatt

SEQ ID NO: 18801 - DNA, 133 bp, Sorghum bicolor
  Clone ID: LIB3480-001-P1-K1-H6
gccacacatcgggtgcggccagactagaggcggcaagcttacatgctccagcctgacacgcgcgagcgtgctaatagagagatctaatatcaagtcaccgaccgtcaattcacagcgcggcgactgacaaaac

SEQ ID NO: 18802 - DNA, 437 bp, Sorghum bicolor
  Clone ID: LIB3480-001-P1-K1-H9
ctgggcatcttcattctggcatggagattcatggcctctgcctccttcccggtcagagcatccaaaaggagtgccctgaagctccggcaaagaggtcaaggatctgccgcatgcagacaaagtcatcaacctcaggggacaggaatataaccgggtcatcggcgtagactgatgcacagtggatgatgacgttcctaggcaaggggcgtagcactgctcgtcggtcgtcctccgagatgagggcgttgtggacgtccatataacaatgacgaagagtaggggggatagcgggtctccctggcgcagtcccctggaatgaagaatgcgtctgcctaggcgtccattaacgagcaccctggtactagccatgccgaggagtgctgatatccaatcgcgccatctgagccgaaaccctatgtgcgccagggtcttcaaca

SEQ ID NO: 18803 - DNA, 463 bp, Sorghum bicolor
  Clone ID: LIB3480-002-P1-K1-A4
cccacgcgtccggctgcaagacaaggttatgatggcttagctgcatatcttgctgagaaagggctgactgctcattttgaggctatgtcactgtccaaggataagcgatcaacatcaaggacacaatcactaaaacaaaataccatggaatttgaaaaccttagtgaacaagaactgtgcttacgagaatctttagcagcctaccgtaatgctgctgatgctgctaacaacatacaagccgcgctcagggagcgaactcttaagcttcaaacaaaagcaattcagttggccaatcccgagactgaagccgcttcaatagttgctgctatgaggattcagcacgcattccggaactacaacagaaagaaaatgatgagagctgctgcacgaatacagagtcatttccgaacatggcagattaggaagaacttcatgaacatgcgaagacaagctatcaaaatac

SEQ ID NO: 18804 - DNA, 455 bp, Sorghum bicolor
  Clone ID: LIB3480-002-P1-K1-D6
attggatcaacaatgtgttcctgacgggcaagttggaagctgagaagttcctacgtgagaacgctgcagtggcagatgagatctgcagtaccgtgagaaatgagctcttgcataggtgacatacgaaggccactggaagttggctctgactcgggttgactaggtgcagttatcgtattaattggggcacactgcacctccaagcaaccattttaagtagctgccggtttatgaatacccttacagccttactctatgatatgatggaagtaaagctaagcgacggcgaccaattagagaggctaatgtattgtgagtcggtctgtcttgatcccttcatgaatcatgaggcattgagatggaaatgttgtacaatcatgtattcgtagatttctataggatattgctgtgcctgttgtgtaactttgacttggcaacagttaattgagtttacg

SEQ ID NO: 18805 - DNA, 453 bp, Sorghum bicolor
  Clone ID: LIB3480-002-P1-K1-E7
cccacgcgtccgttggtttggctctgagttcctgcgtctggtggcccaacatatgcatctatttgtttcaggactcaggactttcggttgacttgacctgacagtggttgggtcatcggaaccttcataacattataaagcaactttgaactggtcaattacgacaatcggtccctgtgactatttcgcgatggatgtagttaattggttgatgtgattgggtatggaagtttgcaagcgtttgaaggtgctccacttctagcagtctgattttttcgcatgcttaaaagttctatggaagagaagactttgtttttcctgcggttaaatttacgattgtgcggaggcaggtgcataatgcccagacttgcacaatgactacttgtccatattccaacactatacaccgtacggcggacgctttcagatatgctttttcagaagcatggtcat

SEQ ID NO: 18806 - DNA, 464 bp, Sorghum bicolor
  Clone ID: LIB3480-002-P1-K1-F3
cggacgcgtggggtcggagggagagagggggtcgatcgagaaggacgagggaggagatcagggagagatatggagtgcctgctagggctgctcaaggtgcgggtggtgcgaggagtgcacctggccatctgcgacccgctcacccacagcagcgacccctacgtcgtcctccgccacggacagcagaaagtgaagtcaagtataaaataccgcacgtgcaacccagaatggaacgaggaactcaccctgtccatcacaaacatgatgaacccggtcaagattgaactcttcgaccatgacacgttcaccaaggacgacagcatgggcaacgccgagttctgcatcctcaacttcgtggagatcgccaagcaggacctcagcgacgtccccgacggcacggtgatgaagtcgatcctcccggagaagggcggcaactgcctcgccaccgagagccacatcacgtg

SEQ ID NO: 18807 - DNA, 452 bp, Sorghum bicolor
  Clone ID: LIB3480-002-P1-K1-F9
ggcccgggcgtgggccaagatcaagcactggcgggtgcccaaccccatgccctgcagcgacaactgcggcgtcagcatcaactggcacgtcatgaacaactacaagtccggctggtcggcgcgcatgaccatcttcaactggcaggactacaccttcaaggactggttcgccgccgtcaccatgggcagccacttcagcggctacgagaacgtctactccttcaacggcaccaggatgggcgcccccttcaacaacaccatcttcatgcagggggtgccgggactcgcgtacctcgaccccatcaccgacgggaacacgccggcggaaccaaggcttcccggaaagcagcagtcggtcctctccttctccaggaaagacgcgcccaacatcgacattcccaaaggggaagggttccccaagagggtctacttcgacggcgaggagtgcgcgc

SEQ ID NO: 18808 - DNA, 460 bp, Sorghum bicolor
  Clone ID: LIB3480-002-P1-K1-G9
gaggcggcagtggtcaaaggttcatcaccaccagatcaaaccacgagcatacggtgatcataacttcaccgctagatcaagtggtccagtggtggtacaactctcatcagtattagatcaaataatggaaccacgatggtcagatactcgtcaccgctgcattggaccacggaccgccggaccggtggcaagaaaacatccattattgcctgatcaaatggtgagccgccgatgatcattatctcatcactgccaaatgaagcgatgatctgacagtggtagaaggctcataaacgctagatcaaacaatgaccagcagtgagcaaatactcatgaccacaggattggaccactggtggtgactgcaaagtttagaagaagaaaccagaatcaaatcttccattttagagtcttcagatacatatacatgtgtacaataggcacttgggccatgggcctt

SEQ ID NO: 18809 - DNA, 178 bp, Sorghum bicolor
  Clone ID: LIB3480-003-P1-K1-A7
accattaagcctctctacactctcgctctagctcatctatgcctagttggacttgcatgcgctggtgctgcacaaatgtgcactccttaccacctacaatccgcaggaaccattataaacatgctaacgaacaagacgcagctgccactgaccttgacacactcgccgtcagttgatc

SEQ ID NO: 18810 - DNA, 422 bp, Sorghum bicolor
  Clone ID: LIB3480-003-P1-K1-B11
ccaggtgttcgtgcccatcgatgacctgctggccggcgccgacagagggaggtgactcgaggcccgtgagctaccaagtgcgcaggcccaactctggccgcgcccacggcgtcttctacttgtgctataagtgcacagacgtcccggccgtggcgtgcgtcccggaactggaaggcaaacaaggccggcacgccaagtacgtgctggaatccaggaacacgacggacaatgcgatggtgccgtccaccgactactcaccgtcggccatgcagcttacgtaccaaccgacggcaaagtgggccggcataccatgagacgcaatatggctcgtcgtacccgggctacccgatgcagccttactggtacgctgctgcgccaccgaacgggtacaaagcggttaccctacaacccgagatgtacgg

SEQ ID NO: 18811 - DNA, 389 bp, Sorghum bicolor
  Clone ID: LIB3480-003-P1-K1-B12
gttacaactacagcggatagtaaagggacaaagtcaacacgtacgatcaagaagagaactgtgcgaaggaatactcatgtgccctcgactaacatgagagatccatatggaagaaaagaacatgaggtatcagttgacaagtcctgcacaccaaacggaaggatgtaaactctacctgggcatacaccaatttcacaacatattgagaaatggacacaaagagcatcacgacattcctaaacgatacaagctaacacatcatgaatatgaacttgacactgacaaatggaagaatcacaaatgtgcaggagaactcggagcactgtcatgtgtggtgaaccacacactcaaaaatctttacatattactgctgacaaatatgttacaaa

SEQ ID NO: 18812 - DNA, 166 bp, Sorghum bicolor
  Clone ID: LIB3480-003-P1-K1-C12
ctcaaatgttgtacgtagcgcacgctgtagaatgaatatgctcacgtgcacgtatggtgcgttgaagtttcatttattagcttaaaatgcattaagaaccaatggcttgatttgccacacgcccaaaatgaaagcacactcccaaactcctaaaattaaaggaatt

SEQ ID NO: 18813 - DNA, 262 bp, Sorghum bicolor
  Clone ID: LIB3480-003-P1-K1-C7
gggcaacctaattgtgcacgcaagcatagaggcgtcgaacttttcctgtgctgggccataatgcaaggatttgttatgatgttgcataatagatatcagcgtcaaagattatatactaggattgctttggggaacgctaaaagaatggatgttgtatggggagagactgctggtgttgaaggtcaattgttgctgttgtgccctctacttattttcttgcagggcttttagggttatgttggattttactattttgaacagc

SEQ ID NO: 18814 - DNA, 341 bp, Sorghum bicolor
  Clone ID: LIB3480-003-P1-K1-D10
gcgcggtaaatactaacgagagccgcctagaccaatgaaaggtggaggatcatggcaagctgaataatgctaatatggatggtctgtatatgcaccggaaaaggccgcgtggaacgcgagctgatatacaagaacccatgccagcagacatgcaatcgtgtgcaatggaagaagataactccaaacatgaagaaagcttcctaaagtgactaaagctatggaggctcttactcgagtaaggccaagttaatgggacaaggggtatgaagacaaaaatcaggtggacaacttctctaggaggttccacgagggcccgtctatggaggacattctgagaatct

SEQ ID NO: 18815 - DNA, 458 bp, Sorghum bicolor
  Clone ID: LIB3480-003-P1-K1-F1
cccaagcgcctttactgaacaagatttggatgagagaataatgaaacaactgcaagaggaggaggaacggaagcggcaacgcaaagaaaagaagaaagagaagaaaagagaacaggcagcccaacatgaacctgaggatgttgaccctgacattgctgccatgatgggttttggcgggttcggttcctcaaagaagtgaccgctctgtgtgaccttcatggcttcgcccctgaagatattgctcgaccccataaacaccttgctacaaagaatcattttgacagatctgcgataagatttgaatggactggatgcaaggatactgcgttttgacactgggatattgaactttgtgcatgggagttgattgtcaaatggagcatctatgggtgttttggagtaaacatgtttatttgttacttgggggattccggccatagaaaccgttggcagtcgtg

SEQ ID NO: 18816 - DNA, 321 bp, Sorghum bicolor
  Clone ID: LIB3480-003-P1-K1-F12
acgaaaaaaaaaaaaaaaaaaagaaaaaaaaaaaaaaaaaaaaataaaaaaacaaaaaaaaaaaaggggaaaaggggaaaaaaaaggaaaaaaaaaaattaaaataatggaacaattgtttaaaaacaaacgtaattggaaaaaccctggggttaccaaattaaatgctttggaacaaaattttattttgccaaattggattaaataataaaaaggccggaactaatggcctttaccaacatttgaaaaccctaaaagggaaaaggaaagcgctttttactaaataattaaggccgggggatatgtggttaacaacaaatg

SEQ ID NO: 18817 - DNA, 399 bp, Sorghum bicolor
  Clone ID: LIB3480-003-P1-K1-F7
cccacgcgtccgcccacgcgtccgtacaggtaaaggcagcagagaacttctgtgaccttgtaaggtcgatttaccatgcaataaaagtggtttcaagacgtcgcaatgggaccttgaattcacaatttcacgcaatttggaacttgaagatggctctgctccgttcatctacaaaggaaaacattgaccaagtttttaatattgaagaaatgaagctaaagtttgaccagctttggaggaaatggtacctatggctatcattagcgtgtgttctcgatcccagatataaaataagggttcttcgttgctttaacgaagcctttggtagtcatgccaaaaggtatatctctgaaatgcgaggaaagctgtatgagctctttcttcagtactcttgtcatg

SEQ ID NO: 18818 - DNA, 284 bp, Sorghum bicolor
  Clone ID: LIB3480-003-P1-K1-F8
tccacacatacaaaaacgacatacaaaaagctaaaggcagaaaaaaaacttatgagaccttggggggtcgatttaccatgcaataaaagtgtcttcaagacgtctcaatggtaccttctattcacaagtgcacgcaacttgtaactagaagatggttgtgctcacttcatttacaaaggaatacattgaccaagtgtataatatagaagaattgatgctaccgtttgaccatctgtggaggataagatacctatggctatcataatctgttgtgctcgaagcca

SEQ ID NO: 18819 - DNA, 370 bp, Sorghum bicolor
  Clone ID: LIB3480-003-P1-K1-G11
aacacattgaagaaaggaagagaaccagataacaagaataagacaaaaaatggacaatattgggcacagtgttttaagggtcccagctacacaaatacgtgagtgcaagaagattgcgtgcatacacattgatgtaagcacggttcaataacaagagactgaaacatgggcacactgaggaagaccgtgatactgcgccccttccaatatatgtcatacatgaagtatggtaaagaccctgaaatgcacaatgggttcccatccgatgtattacatatcgcatacatcgcttgggatgggcctggttcccacaacattaacagccactataatgctggaggagcacctcattccattaaagattaccatt

SEQ ID NO: 18820 - DNA, 152 bp, Sorghum bicolor
  Clone ID: LIB3480-003-P1-K1-G12
cgcctaacaccgatggaattgacccagactcttccacgcatgtgaagatcgaggactgctacatcgtctccggcgacgactgcgtcgccgtgaagagcgggtgggacgaatatggcatcaagttcaacatgccgagccagcacatcgtcatc

SEQ ID NO: 18821 - DNA, 134 bp, Sorghum bicolor
  Clone ID: LIB3480-003-P1-K1-G4
aaatatagaagatgttgctggaggcggaggtcttagtatcttggtgtgagggaattggagaagaggcggtgtgaggaggaagcaagcaaaaaattgccatggataaacggtatgattgaaaagattcctttttt

SEQ ID NO: 18822 - DNA, 435 bp, Sorghum bicolor
  Clone ID: LIB3480-004-P1-K1-A9
cttgcatggaaatggtcagagaaggaaggtgaggatggtaagaaggaaggtggtttcaaaagagtctacttgcaccaagagggagttcctggctcaagaatgggctcaattgtttcacttcctggtggtggcgatgttcatgagggtggcgagtttgtacatgctgctgctttagtaagccagtcagcacttttctcgaaggatcttaccgaaccacgcatgtctggtgctgccatgattaacgcatccgaggtagccgccaaaggttcaagctggaaagatttgtttgaacctggtgtgaggcgtgccctgttagtcggtgttggaattcagatccttcaacagtttgctggaatcaatggtgttctgtactataccccacaaattcttgagcaagctggcgtggcagttcttctttccaatcttggtctcagc

SEQ ID NO: 18823 - DNA, 323 bp, Sorghum bicolor
  Clone ID: LIB3480-004-P1-K1-B2
ggtacaaccgcctcgacgtcgcggagccgtcctactccgtctgccgccccggctcctcccaccacaaggacctcggcatgagggacgcattagccggtttcggagcgaggaacaagaggatccattactcggggccgctgatgccgcccggcgggaacatggaggacatgctcaaggagcacgagaagtagatccagcatgccgtgcgcatggcgcgagtcgagaaggagatgaccaacaggcacttattactgaacaatgaggaaaacaattggcatcaatttggcgaattctttccatggtcttacagaccagtgctttcg

SEQ ID NO: 18824 - DNA, 117 bp, Sorghum bicolor
  Clone ID: LIB3480-004-P1-K1-C1
tagatctagagcgttagcgacctcattctcatatccaccattacagacccgtacatacggcgtaaggagttttctaaatacaaggctaaagccaatgcacgggatggtcttgtacat

SEQ ID NO: 18825 - DNA, 381 bp, Sorghum bicolor
  Clone ID: LIB3480-004-P1-K1-C10
accgtgaccgtcgacgacacttcgtcgtcggcgtcggagttcaccatcaacgtcaagtcctaggagccatgcatgctactatacgcgcagtaagtctggaggagatttaattagttattaattagttctttatttctttctttctggtgaataaacagatgagagagagggagctagagaggaaggaaaggagacgtggcatatgcagtgtggccacattattagtaaatttcttgctcggcgatttttgtaagctactatatatgccacattactagtacagaaaagattttttgggcagtctaaaaaaaaaatataatataataattataatattataaattttatttatagtattcttttattaatatatattattgg

SEQ ID NO: 18826 - DNA, 452 bp, Sorghum bicolor
  unsure (1)..(452): unsure at all n locations
  Clone ID: LIB3480-004-P1-K1-D10
cgcgggctgaagtgccaggcgctgacggatantacggggcgctggaccggagagctctcccaattcttgcgtatcaccctagtctgactgcgctataccattcctgttatccttcacagtcatcctagcgagctcactggcgtccatctaggggaatgtttcagaatcccggcgaatcctcaagagcggcagcagccgccacagacacaccttccctggttcctgcagaggcgccggcccctgcctcagcatcggacacgtgtaccgttaagccgtcatactgtggccgacctggtcaacggatttttccgtggtttttactgaagccagcactagtacatttggtccaggtctgctacttggctagatgcttatggacacacaccttacaaatatacaaatatctattccgtgtatgcattaacttaatttaacatgaacacacctgcttt

SEQ ID NO: 18827 - DNA, 457 bp, Sorghum bicolor
  Clone ID: LIB3480-004-P1-K1-D3
gtccaacagtacaaggatcaacctgtgcaacaaccaccccctacccctcctgtgccacagcaggaccgctatgttcttagccaagctatcgtctactacccacagtgccaagctccaggtatccaggacacacaggggcaaccattgcaaccagaagtgcaatacttaccatcaagacccgcagcacaagatgttccagtccatgctccatcccagccacctcagactggaaatcaaacacagccacagccttaccctccttaccagcagcagtggcaccagcagtccccccagccaactccagcaccagtggcccagacacaacagactttctcacaaccatttcctccacccgcacagaagccccagctatccaatgtgcagcagttttcaccgcaaccggtacagcagccccaatccaatgctcaacagtatccttcaccagtgcaaccacagg

SEQ ID NO: 18828 - DNA, 295 bp, Sorghum bicolor
  Clone ID: LIB3480-004-P1-K1-D9
cccacgcgtccgtagacacgttgtggcatcgcccaccacagctcagggccgccatggttcgtccagttccagggggccaccagtggcaatggctgtgccagtgccaatggcggagccggaccttgagatcgctatgcctcctgcccctgcatagagcgcttatatatatatccattccaggggagttcactccagctccagctagcattgtttgtttgtgtgtgtatacaatagctccagcttttgttttccgtgacctccatctccatgtatgaatggcctatatatggtatat

SEQ ID NO: 18829 - DNA, 395 bp, Sorghum bicolor
  Clone ID: LIB3480-004-P1-K1-E1
gcgtactacacggcagctagcgcgcgatggcgaaccacctccgtccgctcgcgctcctcctcgccgtcctcgcctgcgcgctgctgtgccgccgcgccgacgcgaccgggttcgagggccgcggcgacgacgggtgggtagggccccccgccagcgatggcggcaggtaccaccagggggccgtccaaaacccgtttcttggtggcgacatcggccacttcaaggaccaggaggacctcgtgatggtggggaccgaagccgactaccacagctggagcgcattgcaccccattttttttttcaacaaccgcgacacggaggtggcgctggaccacccgggcaccatctattttattagaggcgagaccgggcactgtgagcgcgggcagaggatg

SEQ ID NO: 18830 - DNA, 213 bp, Sorghum bicolor
  Clone ID: LIB3480-004-P1-K1-E3
cggacgcgtgggaaaaaaaaaaaaaaaaaaaaaaaaaaaaaaaaaaaaaaaaaaaaaaaaaaaaagggaagtcaatctagtaggttcctaaaaatataaacgcgggcttgcgactgtcatagcttcttctttagtcgacccctaaattcatttcctctggccttttttgtacaacgtcttacatgggtgaaccgtggtgtctcccaacttaac

SEQ ID NO: 18831 - DNA, 217 bp, Sorghum bicolor
  Clone ID: LIB3480-004-P1-K1-E5
aaaaaaaaaaaaaaaaaaaaaaaaaaaaaaaaaaaaaaaaaaaaaaaaaaaaaataataaataaagatcggaaataacaaatggggcccttgactaaaggaaccctgctctcccctttctttgctgttctggtgaaagaggcccagcccttttgaggtttaggcggtttaaagagaaaggcccgccccaattttagtttttaggaatgggttttaca

SEQ ID NO: 18832 - DNA, 455 bp, Sorghum bicolor
  Clone ID: LIB3480-004-P1-K1-F11
gacgccttgtcggtttgacatttaatttggactggccatgaaaatgcagctcccctgctgcatgtccatcaaatagttaaacatagattggtaggcagaggccagactgataggaatggcagcaaaggagcactttgtgcttgttcatggtgaagggcatggagcctggtgttggttcaagctccgctggctccttgagggcgctggctaccgtgttacatgcattgaccttgccggaggtggcgtcgatcctactgatcccaacacaatccggtcgttcaagcagtatgacaagccgctcatagatctcatttcaaccttgccagagggggagaaggttattctagtcggacatggtgctggagggctgagtgtgatccatgcaatgcatgaattcgttgacaggatcagtcaatcattttttgtggcagctacaatgctaccatttggatttc

SEQ ID NO: 18833 - DNA, 397 bp, Sorghum bicolor
  Clone ID: LIB3480-004-P1-K1-F3
gcgagagctgttattgtccgttgagtatactgctgctgatgctactactaggaccttttttgttggttcatattctgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgtttaaaagaatcaaagttaactaacccgggcatgcaacgaaaaagtttttttataggggcaccaaaattaaatccacgggccgggttttaaaaacgtcgaaactggaaaaaccctggcttaaccaaactaaatcgccttgaaaaaaatcccccttttcccagttggggaaaaaacaaaaaggcc

SEQ ID NO: 18834 - DNA, 441 bp, Sorghum bicolor
  Clone ID: LIB3480-004-P1-K1-H1
gtagttttcggctacacatttcatcaagcttttgatgctggtgagaggcagcagtagcagtatcttcatctttgcctttggcaaagtgtagtgtactgggtggactactcccagactctttgctgtatgtcatggaatgcggtggccattttgttttttgcgttttattttaacacaccaaaaattatatgcaaccacatcatgctagcagaaaaccttatttattaggtattttatatgtatccttcatttttttatttgtaaaaacatgttatgaaggtcatggatgacaacatagtgtttctcttccattaattttcccttctgcttcgattgcccttcatatgtctgcttctaaaaatttggaaagttttttttgtcagaactaagatgttagtattactttagatggtgattgctaattgggtttcccactttcgc

SEQ ID NO: 18835 - DNA, 459 bp, Sorghum bicolor
  Clone ID: LIB3480-004-P1-K1-H12
ctcctcacacagtagcagcaccaccacacagaaagaggaggaggaagacgaggacatggctagatgcctcatcctcctcgcccaggggccccccgccgccgccgccgttgagccagcaagagtaatgccggcaccggcaccccccagcaggccaaagagcacgagtgctcgtcatgcggcgcggtgttcgcgtccgggcaggcgctcggtgggcacatgaggcgccaccggccgctcaccaccagctcgtcggccgcggcggcgcccgagagcgtggtcaccgccacggggacgacgggggaccaagacagtagcaagctgctgcaggagggcaacatcaacctggagctggacctcaacctgctgccggcgccgtcgacggagcaggaggtgacatccccggcaaagccgccgtgccatgcaccagcagttcagctgatgcatgctttgactcgccac

SEQ ID NO: 18836 - DNA, 414 bp, Sorghum bicolor
  Clone ID: LIB3480-004-P1-K1-H7
accaaaaacagaaaaatgtccacgatcgcaacacacagcatagatcaataatcgtcatcgagccaccgatgaaaccctaacccttggtcttctcattactctccctcatcataagcctgtgggtgctgttctataaggacaagggcatggcactgtgcagcaggccctatttaacccttactgtgatgggcctaaggcagcgggggcgtggcatggacaccgcaagaggtggatgcactctgccatggcacatctgaataggggagcggccctggcacatttagcggggtggatcgatgaaggagaggagctgatcgatcgaggttgcaaaaagcagctaaaactggacggcaaatggctctctccctggagtgaaacgatacgcgcgcacgttttatcgattaggcccaccaa

SEQ ID NO: 18837 - DNA, 431 bp, Sorghum bicolor
  Clone ID: LIB3480-005-P1-K1-A1
gtgacagtcgcaatggtctagctctgatgcgtgggtttctcttctggttgcagaacaatgtacatgatgatcagttcaagccatgggtagatgattctaaagaacaggaggttatttgtttggtggactgagctcacactgactaggtggctatatcctttgtttgcttgatttggcgcaatggtgataataactctgcgctgcacgtgtgacaaattgtcctcagcggagaatgtaaggattccaatatgggatggaaacctcgatcctggaaataccaggtcctggtctcctggaatacagttcagctgttgaatgaataaatggttcctcattgaaataatatgtaaacactctatcttatgtcattacgtgattacgatccctgtagagttttccccagactggacttaagactctgtccatcttgg

SEQ ID NO: 18838 - DNA, 228 bp, Sorghum bicolor
  Clone ID: LIB3480-005-P1-K1-B2
tctagatcgcgggcggccgccctttttttttttttatgattttcttctgttgttttgaaaaccaaagtgggcgaccactattttaccttacataaacaatattgtgaagggggtgcttatagctgcacaacaacacgtgggagaacatagcatactttattttggggaagcctacctataaataatcagagaaaatgaatctttggcatgatcattgagtacccttgg

SEQ ID NO: 18839 - DNA, 318 bp, Sorghum bicolor
  Clone ID: LIB3480-005-P1-K1-C2
cgtacggaacgctaggcaaattcctccaacctaaagttgctgaagatcacatggcggcctttatagaggtctcgggctctcgactctagcttccaagcttatttccttgatgcagcgcctgcttagttgacttatatggcacgcattttacagcgaactgtcaggcaatatccagttctagcagatcgtaatggtgatcgctcacaactacaatgcctctgagagcgttaccactacaacctgcagactgatatgataacagggctttgctgcgcactgagcttggaacaggtcactctcaatttctgcagaaagcca

SEQ ID NO: 18840 - DNA, 252 bp, Sorghum bicolor
  Clone ID: LIB3480-005-P1-K1-D1
caagatcactggaaaggagcttgatctttcagtcgatttgaatgctgctagtgctgctgagcaagaagctgcttgaacatcctcttatttttgcagctctacatgatagctacttcttctatttttttaaaatcattccatagatggataagtttattgaaatccattgctcatgcttttggagttccatttttgtcacttgtaatgaactacagtggctcggatttataaatgttacattattcactggtg

SEQ ID NO: 18841 - DNA, 400 bp, Sorghum bicolor
  Clone ID: LIB3480-005-P1-K1-E1
ccctgctcgtcctccccgtcggagccgctcaccggaggtcccctgctcgtcctccccatcggagcacctgactaccacccgccgctagaggtcccctgctcatcctccgcgccggagcacctggccaccacccccgcgggagcagatcctcagcgacggtgaggcactcgcccaccgtgtcgctgcggcactccctccggcccacggaggagaggaagaagtccaggtccacggcaatgttcatgtcgggcttcatcgccgccggctgctccggcgccgccgtcagcacgcggggttcgtcgaccacgccggtcgatgtcgatggggggggcctccacgccgcggcttgccctgcttccctcgtgcgccggggtaggtgccaccttcttgctggcgtact

SEQ ID NO: 18842 - DNA, 436 bp, Sorghum bicolor
  Clone ID: LIB3480-005-P1-K1-E3
aaagaatgcggtacatggctgcggatatggaagatgcaggtttcggcaactcttccagctcacatgactgtagcaggagatctgacccccatagcattgcagtggacatcaacaaagcttttccagatggaactaacttggctttggtgcaaaaagacttggctacacagtctgcggagattgagaaacagcgcatggaaattgaagttgaggcattggagcttgcaaagcaacgtctcaagtgggagatatttagtaagaagaaggacagagagctagaaaagatgaggttggaaaatgaacagatgaagatggagaatagacgtttggagctagaggtaagagacaaggagttggagcttgaacgcaagttacaaggcagtggcagtcatgcaatgacatgataacatctttgaaattgcgaagattgaaatgc

SEQ ID NO: 18843 - DNA, 214 bp, Sorghum bicolor
  Clone ID: LIB3480-005-P1-K1-F10
acgcacacatttactacatggctcatgggaagctgcaattagcactgcctttggaaaaggagcaagaggggagccagatatctgtcatgagaactgtggacagcaggatgaggaaagaaagagatgaggacaggaggaggatataggatctagcggaaaacggcctgtctgaataccacatggttgctcgatggtagtcgaggttataggtgat

SEQ ID NO: 18844 - DNA, 393 bp, Sorghum bicolor
  Clone ID: LIB3480-005-P1-K1-F12
cgccctcgccatcttcatgttctggaggttccagatgcgccagctcgccggcaacatgaacaagaagatcagatagtaccaatgcaatgtctccttcactcctttgattttgaagaatctatagtcaattgcctttgttatgccgcagttggtgtagctagatacttgtggattagacacgttacttctgtgatctttttatttgataggaaccaatctttctaagtagccactggaccttgaaattttcacattgtcatggaaaagggcaatttgcaatgatggtgaattggacttgtgattcaataaaccgatattggtttggttttaaaaccaaaaccaacaagttggttttgtcgatcccttatcaacaaattacgacttgtccctcgg

SEQ ID NO: 18845 - DNA, 368 bp, Sorghum bicolor
  Clone ID: LIB3480-005-P1-K1-F2
gtcgagggcatcatcaaggtctccgtccactacgacatctcctacttcacaccggccaagctccatgaggaagtggagatggacgggcgggtggtcgagcagaaagggcggatgacagcggtgacggtggagatccggaagaaggagtccggcgagctggtggccatcgggagacagtggatgacggcctccaggcccaaaggctctcagagcaagatctgaagcttcctttaaatttaatcagtagcttgaaaattaatcagcaagatctgaagcttcgttgaaaattcagttccagatgttactggtgttgatgtcccctgtaatttaatcatgcattggcaagcaagatggaaattttcatctca

SEQ ID NO: 18846 - DNA, 452 bp, Sorghum bicolor
  Clone ID: LIB3480-005-P1-K1-F5
cccacgcgtccggcaagaccagcttcatggttaagtatgtgggagacgacggggaggagcagaacggtttgcagatgactggcctgaatctcatggacaagacgatggccgtcaggggagctaggattgcctacagcatctgggatgtggcaggagaccaccagtctgtcgaccacatcccgatcgcttgcaaggacgccgtggcgatcctctacatgtttgatctcacgagccgctgcacgcttaataacattgtagattggtacgagagggcaaggaaatggaataagacggctattccaatcctaatcgggacaaagtttgatgactttgctcaacttcctcttgaaatgcaatgggccatcggtaaccaggcccgagcatacgcaagagcgatgaaggcgaccctcttcttctcgagcgcgacgcacaacatcaacgtgaacaagatc

SEQ ID NO: 18847 - DNA, 337 bp, Sorghum bicolor
  Clone ID: LIB3480-005-P1-K1-F7
cccacgcgtccgcccacgcgtccgggcccgtgcgatatgtattatgaagcatccaatccccgacaccaaggattcacactccgtgcagatcatcctcccaaagaagcaattaaagcgcaaatcagacatgtacgtgttttgctgctcttacgctcacaatgttgcaccaaaaggcaagttcattgctttcgtttcgactgaagctgagaccgacaagcccgagattgagttgaagcctgggatcgatctgcttggccctgtagacgagacgttctttgacatctatgacagatatgaactcattaacaatcctgagggggatagttgttcttgacaa

SEQ ID NO: 18848 - DNA, 475 bp, Sorghum bicolor
  unsure (1)..(475): unsure at all n locations
  Clone ID: LIB3480-005-P1-K1-G1
atcttgtaatcggcgtgggggggcattaacgtgcgaaagcgaggctgccggtgtggatggacggagagcgcccccgccacgccgcggccgaggtggacgacggcgaaatcgtagcgggcgcgtgatcctcgaccacgactgccggggcttcatcagtgtcccagtggcgccgcattgctgtccgcaaattaagtgcggctggtgtatgattgggatcgccggcaaatcgcctacccgcacacaccgaccatgtcggaggtaggatgccaatgcatatacctgagttttttttacacatctgtcattaaaagcttcaatttctagaatctgtataaaatatcttataaaaatatatnttataataaatctaatagtactaatttggtactataaatttatcatntttttagaaaatcaggcaaagtttaaattttttgacttaagataactctagaaattgaagcttgaacagagg

SEQ ID NO: 18849 - DNA, 310 bp, Sorghum bicolor
  unsure (1)..(310): unsure at all n locations
  Clone ID: LIB3480-005-P1-K1-H11
ctgcatccatggcgtcggccagcgcagcggacggcggcgacgaccccgacgactggcccgggcggatgcgggtcagaggtcaatggggaataacaacgggaaagcaaccattgaggaacgttagttatgacgtaatatgcaagagcacacgcatggtgcgtgcgaggacggccacctctatacacatatcgagtacgttcggagtgagtataaccgncgacttgatactcagataagatactgtgttaccagtctgcatgagagcatgtgagatganatactatagtaataattactggcagatgatatg

SEQ ID NO: 18850 - DNA, 242 bp, Sorghum bicolor
  Clone ID: LIB3480-005-P1-K1-H3
acgcgagcggatgggtagccggcggtggcggagatcctacaaggccggcgcatccctagcgcgatgccaaaggtgatcgcgcggaactgatacgactccattgtgccggaggccgcaagcttcaaccggagcagcatcagggtcatcggagccgacacggagctcatggcggccaacttccggtccttgctcgccgagctgaggaagctcaacgggaccaagcagtacaagctgtgcaagtg

SEQ ID NO: 18851 - DNA, 387 bp, Sorghum bicolor
  Clone ID: LIB3480-006-P1-K1-A10
aaaaaaaatcatcacaaatactctgaaattgacatttgtatgttgtgaacgaaaaaatgcaattcttagtctttatataagacagccaagtaataccaaaataataattaaatcgctacagcagtaaactaaaaattattatttttttaagttataaataataaaacgatcaaaatgagtggatatcatcaagaagtatcaacaaacattgaaaacagccgaaactcactacggcgcatcgcaacaaacgatgatacagaattctcccgcgaaagtatcgtgaatttaatggagaaattcgtcaaaactgtgaatgttatggatgaaacgatactggtaccatgccgattgatggatagaacggttggcgatgcaactgatacagta

SEQ ID NO: 18852 - DNA, 397 bp, Sorghum bicolor
  unsure (1)..(397): unsure at all n locations
  Clone ID: LIB3480-006-P1-K1-B11
aagatatatcgcccatggatgtgccctcttgccagagcattgtatgtcttgatgtcattaatcactgttcttataggattttatgacctctacaagaatgtgcccatgttgaaggcaactgcctcaagattatttggccctttctttgattggatagaaacgtgggaaatgatatcaagacttaagtatcttggaactatgcttttcctgcataactttcagcaggcttttacatggtctcttaagattgtgggtgctgctaagtctgttcttagtgttttgacaaagccaattgcgggaccaattgtggaggttttggaacttaccatgccaatgtggaacctttgtgctgagacagcangacatctgagttcagttgtcatggtagcactggaga

SEQ ID NO: 18853 - DNA, 305 bp, Sorghum bicolor
  Clone ID: LIB3480-006-P1-K1-B8
gactcgctggagatcgctagcggccaatctggcggggccacgctggcgaactcgtgcttgcgactgaggagctgttctatatatcaaccaatactaaattcactggtctcctttgtactgcggagagcctggaagcaccgtgtggctgccgaactgaatgatggtgacactcatcgctttgttggcagctagcatgttaccaagtaggactgagccgatctggcttacaaacagatgggtatactgactggtgtttgggactcgctctgtaacagcgcattaatcgcaggggatgtggtggacac

SEQ ID NO: 18854 - DNA, 463 bp, Sorghum bicolor
  Clone ID: LIB3480-006-P1-K1-C5
gccctgtcttcctattcttctcggtcaacaccagcggacagcttgtacgtttggctgaaaggttagggcctgttgatttcaagatgaccatggacttctgggaagaagataaatggaatggctctttccctataaaatggcatatcataaaggatgctccaaatcagttgttcaaacatataattcttgtaaacaatgacaacaggcaggctacttttagcagggacacacaggagatcgggctgacgcaaggcgcgcaaatgttgaaaactttcaaggatcatcctcagggaacatcaattctggatgattatgatttttatggaagaaaaagctaatgcacgccgtgctgaaaagagaggaaattcagagtcgacatatgaagctcgattctatgatgacttgaaacctattgaaaatctgaggccagcatggagagttgggtttattcgacattgggagt

SEQ ID NO: 18855 - DNA, 464 bp, Sorghum bicolor
  Clone ID: LIB3480-006-P1-K1-D2
gattaccgcggatatctggaaagtcatattctattgagatgtcaggaaatgtaattgatgaagcaactgggaaaaaactacgcagtcttggaaaacttgctcccacgattgagaagttgaagcgtggctttggcatgcacgtccctgaagagtttagataactggttctagtacaggtcttggctttgctaatagtacactcttcaaagattaccatggggtgcaaacctatgatttctgcggattgtggtattaaatatcagatttctctgaattggactggagctctacaagcaatacttaagatccttggtgtgaagcgaagggtggcactcaagaagccaagataatgtggtctaatgccttaactaccaatagtatccctcctgctaattccattactttaatggaaagcacgtttgctagtgactctagtctatcaggcagttcttaacttcactgct

SEQ ID NO: 18856 - DNA, 278 bp, Sorghum bicolor
  Clone ID: LIB3480-006-P1-K1-D9
aaaaaaaaaaaaaaaaaaaaaaaaaaaaaaaaaaaaaaaagggcggacactataggggatgggagtttactgatgcaagcaaacaaaaaaaatggctcttctgttgggcgacctagatttacattcactggcctccggtttataccgctgtatagtgggtaaaccgtgtcgcatcctaacttaattgggtcgcaccgcatccacctttagcgacctggcttcctaccgttgagcccccttaaaggcgtatgggacaccccctgttacggcgcattaag

SEQ ID NO: 18857 - DNA, 465 bp, Sorghum bicolor
  Clone ID: LIB3480-006-P1-K1-E12
gctacgcaaacgagaacaggatataatatacgagaggaagctttacaaagagagaagcaaggaggaccacctctttggggacaaggataaatttgtaacatctgcctacaggaagaaacttgaggagcagcaaaagtggcttgaagaagagagaatgaggcagcttccagaagaaaaggaagatgtaactaaaaagaaagacttgagtgatttttacttcggacttgagagaaatgttgcttttggtgcacggacacatggtaacacaaaatgtgctgaccctcaaaagtcggacaatcaaccggaggatacaaatcctagtagtcttgatgctgaagcttctgaaccttctccaaagcgtaaaagagaatccagtgtatgatcggaggggactaacagtatggaagaaccctcggcaagtcgaacgagggattcaacagctgttgcatctactgagaaaaatgc

SEQ ID NO: 18858 - DNA, 403 bp, Sorghum bicolor
  Clone ID: LIB3480-006-P1-K1-E5
acaaactacaactacgaagaggagggcgaatgggccgacgctcgggatgtaccacactacgcgcagcgctccggctacaccgtatccgctctcatgaatagaccgactagtgacggacggccatctgtggcacatcgtgggcactctgaactcgatcgcgcgtcacccataaactcagggctgggagcacgccattttcaacagcagcgacaacagtctactacgacgcctgctgcgacacgtccacacatgtgcctactatgtatgtgaataggaccacacactagagatgctcatctgagccgtcgagggacttgtacacgcacaatgagtacagaacgagttgcgataacactgtcacaaaacatgagcatttgtagcatgactataacagcacggtgga

SEQ ID NO: 18859 - DNA, 405 bp, Sorghum bicolor
  Clone ID: LIB3480-006-P1-K1-E8
gatgtatactctcatattcatagcatatcacataaccaagagattttgatccgatctatagaagacacatccgccaatacgaaattattaaaccatcgtcatataaaaagacttcaaactcgcccagaaagcatgagccaccttcttcaaactcgcccagaaagcatgacacatatcaaagcaactaaagtaccagctacaaactactatagaagcggacggaccgaccgcatccgtccgggccttgtcgggggagatccatcccatcagacgggggagaggagctggaagacggagggcttgggctcggagttcatgccgatgacgatgacgagcgggatgaagccgtagtgcgccaccaccttggccttcttcatcggccacgtggtccactcctttacgagc

SEQ ID NO: 18860 - DNA, 450 bp, Sorghum bicolor
  unsure (1)..(450): unsure at all n locations
  Clone ID: LIB3480-006-P1-K1-F3
gcggcggcgggggcggtagcggtcgcggcaggctcaaggggcagctgagctcctggtcgcggcaggggtcgctgatgtctcagatctcggagatggacagccaggagatcggagggagcagccccgacgctgctgccggcggcaggggcgggtacatcccggggtatccgaagagctccgtcgggtgggacgactcgtcgtaagcgctcatgtccgacagcctgtccgggatgaaacgcccgctggactcgtcagagcctgccggccagcaccagcaacaacagccgaacggtggtggagggccggcgcaccagttcagtctgcccaagacgtcgttagagatggctgccatcgagaagttccttcagtttcaggacgccgtgccctgcaagatccgngccaaagcgcgagtgcgccacgcacccacgcatcatattcaagcggttgagg

SEQ ID NO: 18861 - DNA, 471 bp, Sorghum bicolor
  Clone ID: LIB3480-006-P1-K1-F7
ataggacctgggctttgtgaacctgatgaggatgacactggaatagagattgtgataacagttcttcttccttctcggctcagtctgcctaggtgcatttacacacaagggggtgggaattgcacaatcctatcgattttagagtgagacacagcatgcatgcgttacccacctccatgcaggtcggaaatttctgcacattcctatagtagtaccattaaggcttgcacctcacatcaaaagccaacagacgtgatattctgaccactgatgcagagctgccttcaactgatggtgctccatagcttagcttatccgtggcgaaatccaccagacatgtaagcagacatgagatatatagggaagtcttttgtatatgtgcaatcacctaagcgtttggtgataaacgaacctctggctaaataatcaattggatatgattgtgaacataacatggttgcgaaccatgag

SEQ ID NO: 18862 - DNA, 325 bp, Sorghum bicolor
  Clone ID: LIB3480-006-P1-K1-F9
gtgccatacgcctctatcagcaccaataatgcctgttgcaaccacgtctcgagctccattaccaaagaaaatgaagatcgcggcggtgctcttcacgttggtcctagcactcatcaggtggagccgctgccgacaggacggagacagaagacacttgcacaaatttctgtgcacaaaagaagctcaaggagccagcctgcatggagtcctgcgccctcaacaggcgctgtaaaaaggtgtggatcgaggctgtccaaggctgggtgaaatgcaacatgaagcacggttttggctctgcaaacttcaagtcttgcgacgaaggatg

SEQ ID NO: 18863 - DNA, 452 bp, Sorghum bicolor
  Clone ID: LIB3480-006-P1-K1-G10
ggcggcgcggggaaagtgagctacgaccactgcgtggcgtcgctggcgtcggacgcgcggagccgcgacgccgcggatctgcaccacctggccgcgctggccgcgcggatcgcggtggagcacgcggcggcgacggaggccaagatcgaggacctgggcgaggtggaggagagcccccacgcgcgcgcgcgcctgcaccactgcctggacctctacaacgccgacgacgacgttctgcgcgacgcgctcgacaacctacacgcccgcgtatacggcaaggcgtcccagcagctggccagcgcgctgggcgccggcgagagctgctaggacgtctggaagggctaggagcacgtccccgtcggcgcgcacgacagggagtacgggcgcatggcagttggtcgcgctcggccttaccagcggaatcgcttgatcgcgcctactacgctaatgct

SEQ ID NO: 18864 - DNA, 436 bp, Sorghum bicolor
  Clone ID: LIB3480-006-P1-K1-H3
aatctccccgcccctcgcactgcgtaagtatggagctggacaagaggggggaggaggatctagaccggaccagctgctcaggcatgttctggagcagaagaagctgccacagggagcagcagtgtgatgcagagatcaacgcttgattctttatttgtggttgtgaatatgtttgaatatgcgggagatgagcagcggttgtttttcctccccagctgtgttcctttctctcttatttacagccaatattttctttgattggtgaaatcctgctgcagccctttgcagccgtagcgtgtgtactgtaaacagttttgttacgatgggtcgtgtacctgtgaatctagatagcttcaaaggcgctagccagttactggtctttgtagctgtatgtaaattgcagatctggatggaaatactttctggttctgatgat

SEQ ID NO: 18865 - DNA, 390 bp, Sorghum bicolor
  Clone ID: LIB3480-006-P1-K1-H4
gatagacgcgagggccgccctgtgtttgtatggagctggacaagacgcagcaggaggatctaatcgggcctacttgaatatgcgaggaacagagcttatttagtgcataaggggggatcggtgagctgcatatatccacgctagaaactcattgcggggttatgaacatggacatctactctggaaacatgcctgatactgtacacaaatacacacatgttcactcatatattacaaacggacacacatttcctttgaatgagagcgccttaagatttgcatgctttagctgcttatcaacacacgggaacagcttgactgcaatgcatgtagagcgcagaatattggctaaaaaagaagaatctcaccttcacttgtatgaagatgatc

SEQ ID NO: 18866 - DNA, 386 bp, Sorghum bicolor
  Clone ID: LIB3480-007-P1-K1-A12
catatctagagggtgttgatcctggagctctaggtggaagaaagccatctgatgttctgttcagtaaggaccgctctagatggtacgatggaaggcgagaagtccatatacatccatcatctggtaatcacaactacgaaagctggtcaatatccatttttggtgtttctcgaaaaggttgagacaaccaaggtgctcttacgtgatactagcgtaatttacacatactcactttttttgtttggtggttccatggtaatccaacatcagacaggaatggctgttatagatggatgggtgaggctgtctgctgctgcacagactggtgatttattcaagcaacttcggataacgcacgatgcttttctaaaagaactgactagaaa

SEQ ID NO: 18867 - DNA, 413 bp, Sorghum bicolor
  Clone ID: LIB3480-007-P1-K1-A5
cgtcgtcccgttgtccacactagcttgtttgttcttacggccatggattatcggaggaagcccgcggtgtgccgtgcccttcttgtgctgctcatcgttgcctccagcgcggcggtgtcgatgtcgactgcgggctacgacgagaaatgctggaaggacgacgaccaccaccctatctgcgtaagcagtgactgcaaggagacctgcctggatcacggccacgtggacggccgatgctcctggcaatggtcatggaggccgtattgccagtgcctgttggcggactgccaatagacgggggaaaagctgcgtcgcatgcatggcgtcctggttgcctcgccggccgtcacgacgccgcgacgacgtgccgccgcctgatccgatcgatctgtgcgtcgacgtacgtacgtgtc

SEQ ID NO: 18868 - DNA, 386 bp, Sorghum bicolor
  Clone ID: LIB3480-007-P1-K1-A7
gcggccacgcgtccggcaggctcggtgatgcgctgtaccggatcatcacggacgtggggttcgacccggacgacttggtgtcgacggtggacctgacataggagcacaagattctggacctcaatgaccggatcgaggcgtctgtcatcatctgtaacaggaaggtgcacatcaaggacggaaagtcctcctggggctacgccgtcagccaggagaatagggagcagttcgaggagctggctcagacgctgatgatcattatcaagcacaggtttcccggcatcccgcaggccacgctagacatggcaaagatccaagaaaacagggacgttgggttcgcgctgctggagagctactccagggtgctggagagcctggcgttcaat

SEQ ID NO: 18869 - DNA, 382 bp, Sorghum bicolor
  Clone ID: LIB3480-007-P1-K1-B11
aaaaaaaaaaaaaaaaaaaaaaaaaaaaaaaaaaaaaaaaaaaaaaaaaaaaaaaagaaagaaaaaaaaaaaaacaaaaaggcccacccataaaaaaaaaaaaaaactaactggggcggcccttttaagggatccaactttccttccgcttccatccaaggaaaatagctgttccttggggttcccaaaactaaattggctggcccctgttttacctctctttatctggaaaaacccggacgttccccacttcaatcgccttgaaaaacatccccctttccccaatgggctttatcacaaatgggcccgcccagcttgcctttccaaaaagttgcccaccccgaatggaaaatcggcccccctctttagcgccccattaacc

SEQ ID NO: 18870 - DNA, 368 bp, Sorghum bicolor
  Clone ID: LIB3480-007-P1-K1-B12
caatcttgcacctaaactaacactgtctccaaacagattgaagcgagattctatatgacacatgtcatctaggagttctattggggtgcgtctaaatggatttcttagcatatggtatattccatgcaaaccgtgcacctatcttgcatcaagattagcactatctgcaaaccgatcgaaccgaccttccacttgagcctgttcaactaggagtaccatcatgtgcgtccaaaatagtttcttagcctatggtgcattaggcacataccgtgtacctatcttgcaccgaaactagtactatcttcacatagaccgtagtgagattctatatgacacacattatttaggagttctatagggtgctttca

SEQ ID NO: 18871 - DNA, 432 bp, Sorghum bicolor
  unsure (1)..(432): unsure at all n locations
  Clone ID: LIB3480-007-P1-K1-C1
ggccaaggtgctcggcacggtggtgaccgtggccggcgcgatgctgatgacgctctacaagggcccgctgatgcagctgccgtggaccaccaccaggcacgtgcacgcgtcgtcgccggccgccgaggcccccgccgccgcggagatcagcggcagggactggttcctcggctcggtgttcgtcatcgtggccaccctcgactgggcctccctcttcgttctgcagacgcacaccatcaagcagtactcggggcaggtgtcgctcaccacgctcgtctgcttcatcggcacccttgaggccatcgccgtcaccttcgtcatggagcgccgcacctccgtctggaccatcggntttgacatgaacctgctcgccgccgcctacgccggcatcgtgacgtcgagcatagagtactacgtgcaatgtactgtgat

SEQ ID NO: 18872 - DNA, 371 bp, Sorghum bicolor
  Clone ID: LIB3480-007-P1-K1-D2
gtgtgctgctgcatgcatattgcagctggtggatcggaggacggacgcgcgtggaactgtggtcatcccaacacgtgagggcggtaatgctattcgccatgacagttaagcgtgtaagtacggcgctgatcgtcgatcttcctagctcgctggcgtgacagaaacatataccctcagaacggtcgggtgactgcatgtctgcatgcagcacacaagagcagcggcaagcagcggaagaacggctagtgcatactgtagtcaagactcaacgcaacaactgtcatgaggtgaaggcaactctcatgaggtaaaagtgtaacacgtcaatgtggcttcaaatcaaaatacttgaatcctacaatcttagcatc

SEQ ID NO: 18873 - DNA, 361 bp, Sorghum bicolor
  unsure (1)..(361): unsure at all n locations
  Clone ID: LIB3480-007-P1-K1-D5
ccgtccatgccacgcgatagcttatctatagtgtaacgtaaattaaattcactggacggggcgttacaacacaacgactgggcagacaatgccgtgacccaacttaattgaattgcatcacatcccattttcgtcagctggcgtgatatcaaagaggacaggaccgatcggactgcccaacagaagagcagcctgaacggagagtggaacgcgccctgcaccggagcattaaattcagcgcgtggtggggtgacgctcagcgcgaccgntacacttgacagggcagtagcgtacggtcctttcgttttgtttccttcctttcttgccacgttaggcgggtcggctcttcaagctataaatt

SEQ ID NO: 18874 - DNA, 442 bp, Sorghum bicolor
  Clone ID: LIB3480-007-P1-K1-E10
cccacgcgtccggttcgttcctgttcgttatgaattttttcccgttcggtcgtcttcatcatatggcgtcgcgtcggcatcgtcgatctagctaggatccatgcacgcctcccgaaggcaggctatagctggattcttaattaccaaggttcctcatgatcagttgcctttcttcctcaagagttagagccaaataaatgcaagacagaaggagtggtaggaaatggggacagatactcatcatatggatcagtgtaacacagagaaattaatggtgggaaggtggagagatgggggtagtagaggtagacagaaacagcagagagaagcatgcatggcagcgcaggaggggagcagcaaatggtgaagtaagatagagaaacaaaatgcatgcaaatagcttattgcactttgcaggagggagcagcaggcatgatgaata

SEQ ID NO: 18875 - DNA, 291 bp, Sorghum bicolor
  Clone ID: LIB3480-007-P1-K1-E3
gtactagatcgcgaagcggccgacctactaatttaatataaaaaaaaaaaaaaaaaaggagcgcgccgttcaagaaagaaccaagcttacattccctagcatgccacgaactggtgtacagtatagaagaggttagatataatccaatggccttggacttacaatgggctgtgtgtcaaacccgcgaacaaaagcaaataattcgcctggactcaaacctccgaattcgacaacagacgtgatgctaaaacgacgggacccaaaaggcaatagcaccactcttgcaaaccc

SEQ ID NO: 18876 - DNA, 438 bp, Sorghum bicolor
  Clone ID: LIB3480-007-P1-K1-F1
cggacgcgtgggcgagcaaccgggaaccgaagcggcacgtcatggcggccgaggggtcagaccctacctccccggcgtcagcgccgccgccgccgccgccaccgaagcggcgaaagatcgagccgcccaggaggaccaggccgtctcaagttaccccagataaggacaactcggtagcatcttccaactcatcgccgattccgggttcgctgcctgcgagagttgatctcaacaaagttagagaggcaaagcgatttgccgtccttcaagcgcagcacgaggggtgccttggaagctataaaagcttcgattccctctttgggaattaccttgttcctgtcgtcccaacgaacgacttctttgatcaggtcgggaccaaaccatgaacaagagccaaaccatgaacaagaatggcaatttgtgagtaccgaacaggac

SEQ ID NO: 18877 - DNA, 413 bp, Sorghum bicolor
  Clone ID: LIB3480-007-P1-K1-F2
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatatacaaaggggggggcctttttaggggtccaagtttttctaccgcggtgttgcgaggttttactttttttttgggggcacataattgaatttccctggcctattttttcaactggggaattgggaaaaccctgggtgttcccaatttaattggcttggcaacaattccccttttcgcatgttgcgtaatttgcaaaggggccgggcccattcgcctttccaaccattttcccccctaaatgggaaattggtccccccctttaccggtccctttaaccgcgttggtgggggggtttccccc

SEQ ID NO: 18878 - DNA, 332 bp, Sorghum bicolor
  Clone ID: LIB3480-007-P1-K1-G12
aacacacatagttgagcatacacagaagactagagataatacgatagaggtaattatgtaaaacatagattccaaaagattttattcttccatcataaaggattcttttttttttgcagcatctttgtcgcagcacaagaggcacaatgttgttgaaacctagcatacaatgaataagaagttagatagactaatgcttggtagtggatcgggttaatagcctactaaacattgactgaatgtattgacataatgagttagtaaataagtaactactgtacctatttgtgactcttagatggagtggctttgcagatatcatcccttgtttt

SEQ ID NO: 18879 - DNA, 441 bp, Sorghum bicolor
  Clone ID: LIB3480-007-P1-K1-G7
gtcggtcttccccacccgtcctccagctcgaaggaaaggccggagaaccctaaccgagggcgagcgccgccgccaccgtggtcgagggtcaggcaggcgagggtgggcgcaggcgggccgcaggccgtaggcgcgcaggttttcttggcgacgagcgcaggcccgggcgcagccaggcggcctcggcggcgcgcaggcgagcaggcggccttggcctcgtttgcaggcgggctaggcggatggaggacgacgacggaagaggtcactgatgccgaccctgaagagatccatgttatccatgatccagagaaccccaagattgtgaagggagaattgtttcctgatattgtatcattcaggaaatctattaggcaccatgctgtgaagaaagggtttgtgttgacgggtataaaaacagacaaaacatggtttcttgcaaag

SEQ ID NO: 18880 - DNA, 427 bp, Sorghum bicolor
  Clone ID: LIB3480-007-P1-K1-G9
gactagttctagatcgcgatctacaactacaacactaggagttatcgttctgcttggagcgaagaggggggagctcggtcagctgtggaacgccaaggcgtaacctatctgggaggctcatagctgatatgatggcactggttgcaggcttcaaatgggctttggtttaggtagacttgtgctcacgtatctgatcggcttttggtgaaattatgccaatcataagcatgatccatggttaggagatttctttggttgagcgcgaaacacacacgaagggtggttaaattatactagcctgctgcacagcacaatgcatgtcaaagtcagtagcgtgatgtaaatttgagcaaaattagacgatatctgttcctgtcttcctgacatgtttgattacaggcaatgtaaacgtcctatagtcattcag

SEQ ID NO: 18881 - DNA, 179 bp, Sorghum bicolor
  Clone ID: LIB3480-007-P1-K1-H5
ctgcaggtaccgatttcgcaagtcccaggtggacgtacgcatacgtcttaacctccaaccgtccatcctaaagaatccaagtttccttcccctccataccagggcataacctctgttttagggggacctaattccattcaactgcctgtggtttaccacctcgtgaacgggaaaaccct

SEQ ID NO: 18882 - DNA, 289 bp, Sorghum bicolor
  Clone ID: LIB3480-008-P1-K1-A10
actacgcgtacatcctgagcctaagttctcatatataacatgacgacatacgcccacatgcggggtggtccataacttatatagcatgccagactgaattctctatgcctctaccgacaacctccagacttgcttgcccctggcgcctgctacttctagtgcgatgcaacatatccgcactgccagagccggagccttaccttatatgccttctcctggaactgttccaagcactggagagctgtgtacgtctacctagaggcccatctcttgcttgcattaagcccgg

SEQ ID NO: 18883 - DNA, 287 bp, Sorghum bicolor
  Clone ID: LIB3480-008-P1-K1-A12
attaaggatagatacccagctgccgatcatagaggatacaacattacgtgcggcatcttgcgacgtgattgaccctgtctagcgtgaccagtacaactttgaataggctctaattaacgctaggaggactgggtctaacccaaggggcatgcatatgtcacgtgtagcaaactatcaccaccataggctgttatccacataacgaacaggcaagcaccgcatgacgttcacatcagttcagcagtctaaacgactattactgcgcacgatgccactgcatattgatc

SEQ ID NO: 18884 - DNA, 425 bp, Sorghum bicolor
  Clone ID: LIB3480-008-P1-K1-B7
gactaagtgtgcatagattgcagcccatacaaatgcagcatgctgacaggccaacaaatgggtatgttgtctgtggctgatggattcatcaaagagcacagacttcagcaccatggagcactaaaagcatatggatgatagttcattattctgcagaaaaagatctcatgaacatgagacccagtttgcccttaacagaagcctaaatgagcgtaggatggctcatctgcagaacgaggaaggatacagtaaagcagatgttgcgtatgaaagtggccacacaaatggcacatgagtatgctgaacctcacacgaatggtggaggtagcaccaccagttcggagtcaggaagcatagtagatgcatagaagctatatttggaagaacaaaactgttcaagacaagcagttgaataccccagagaa

SEQ ID NO: 18885 - DNA, 362 bp, Sorghum bicolor
  Clone ID: LIB3480-008-P1-K1-C4
catgaaccttacagcttcaaggcgcttgttgatgtatcccgcacatcatttccagggaacaggcctgtcagaaaggagggtctagcagctatcctgtgaagcatattttccaatgtgtcactgaattcattatgggcttcccttccttgcaattcagagttactaatcctatctagtagcttgtattacgtggtgactcatgtaatttgcattactagtatttctgctattcccttctgctactacttttggaagacatgactgaactgaaacacctaattacacattattgttcttttgggccccgtcagttatgactgaactgagacacctaattacactagattgtgctttttgcccac

SEQ ID NO: 18886 - DNA, 337 bp, Sorghum bicolor
  Clone ID: LIB3480-008-P1-K1-D11
atgatgggaggcgtaaggtccttggccttcttcattatgattcaataggatggtgcttaagggaagagcttgagcggtggaaggcactataccagagagagaatttccagcagtcaacagttaatgggcactgaatatgtggaactgctgaaattttgttcgtgccttgtagccaagaagatacgaaatatataaagcgacattccgacaaaactaggattaacttagaacgcatctgtcaaagagtcccctcgtcaactgtaaagcctcgagtcttaccaatatatgcattttgtatcaaacatacacataagaggtttaagaggtgatgatccat

SEQ ID NO: 18887 - DNA, 392 bp, Sorghum bicolor
  Clone ID: LIB3480-008-P1-K1-E3
caagaagacccatctccaatctaaacttacagaggaggtaaaagaaaatacagtcctccatgcaaatttagaaaggcgaaaagaagcactacatgagcgtcgtgtagcacttgaaaaagaagtggaaaatttacgagatcagctgcagaaggagagaaatctgagggcttcattggaatctgggctaatgaatatgcggagaggacaagtgtcccttccgtcaacgatagacaccaagactaaggctgatcttgaggaagttgctgctgctgaagctgatattatgaacttgaagcaaaaggtttctgatcttcggggacaactcaacaaccaagtcccattgagttccacctcgttatgtgaatcatgcaacagcaagcgatccataaatg

SEQ ID NO: 18888 - DNA, 373 bp, Sorghum bicolor
  Clone ID: LIB3480-008-P1-K1-E9
catagccatagctggtgttgttgcatataacaaccacaagctcaaggtaaaaccccaagcgaacccacagcaaggtgacgagaacaaggtcatctcaggaagcactcgagatgtggtattatcaatgaattcatcaaaagaagcttcgtaacaccaaaagtagtgagattttgaaacacttatatttttcacgaggagaattgggctctcttttgttgggttggccagctctccttggatacattctttttcctccccgcggatctggagggaagacattttgtacaatgatatgctcaagatgatacacttgccttcacagttgtaatattgctgctcaaaaaggtgggagcacgccatacagatgaaaatt

SEQ ID NO: 18889 - DNA, 481 bp, Sorghum bicolor
  Clone ID: LIB3480-008-P1-K1-F11
gcttcagtgcccaaagatggctaagtcccaggaaacccgactttcgttcacgtgacgaatatagtggcagagggcaaaaagagaagttcggcatggcgagagtggccagaattcgttgcacgcgcacgtagtatgtgcgctgccgaattcccgggaaacccgactttcgttcacgtgacgaatatagtgtccggggtcaaaaacagcagttcggcaaggcgtgagtgcccagaattcgtggcgcgcgcatgtggtctgtgcgctgccaaattctcgggaaacccgactttcgttcacgtgacgaatatagtggcagagggcaaaaccagccgttcggcacggcgtgagtgtccagaattcgtggcgcgcgcaggtggtctgtgcgctgccgaattcccgggaaacccgactttcgttcacgtgacgaatatagtggcagagggcaaaaagagaagttcggcatggcgagagtgcccagaat

SEQ ID NO: 18890 - DNA, 244 bp, Sorghum bicolor
  Clone ID: LIB3480-008-P1-K1-F5
actggttctagatcgtgagccggggctggagatgatccacgctaacgcacacgatgcatgacaacgaagatacgcttctacatataagggccaacccatggccaatgcactggcgcgaagcgcaacaacacctgagactgggaaaaccgtggcaagagctatctaaatctcatcgcatcacatctgcattgcggcagatgctgtgacacatacatggcccgatgagatcgcccaccccaacagt

SEQ ID NO: 18891 - DNA, 290 bp, Sorghum bicolor
  Clone ID: LIB3480-008-P1-K1-F8
aaaaaaaaaaaaaaaaaaaaaaaaaaaaaaaaaaaaaaaaaaaaaaaaaaaaaaaaaaaaaggaaagagaaaaaaaaggaaaagagaaaaaaaaaaaaaaaaataaaaagggggctgcttttttaggggttccatttttttttacccaggcatgcccattttttcgtcttttttttggccacttaatttaatttaacgggctgcctttttccaacgtcgtgtttggaaaaaccttggggttacccaatttattcgccttgaacaacatcccctttccggcaggtggttta

SEQ ID NO: 18892 - DNA, 292 bp, Sorghum bicolor
  unsure (1)..(292): unsure at all n locations
  Clone ID: LIB3480-008-P1-K1-H2
cccacgcgtccgaaaaaaaaaaaaaaaaaaaaaaacaaaaaaaataaaaaaaaaaaaaacaaaaaacggggggtaaaaaggaacaggcgggccgggcatataatatacaaaaggggggggggagctagaacactttccctagtccgccgcccgaaacttccaagtttagctgtgggtaagcacatggggggccgggtcttttaataacactcaccttcccccagatcggccncaagggcacgtcatatgacgtaccccagaagtgatcagcgcgcgggcactatcaaacaat

SEQ ID NO: 18893 - DNA, 346 bp, Sorghum bicolor
  Clone ID: LIB3480-009-P1-K1-B8
gaagaaactttgccttggcgtcaccctgcttctcttcttgctcctggtgtctgctgcccatggagctcggcttcctgatgccaaggacgtagcagcagcagcagcagcagcaggtgatggcgagaggatcacggtgaggacaggacatgggcacggctacagcagccacagcggcgggcacccgaacggcggcacgccggagcagggcggtgcaggggttgtcgatcctcgtaacaacaatgctaggagccaccaccgcaatggcgcggcgagcagggctcttggctactcttcttggctcatctgcacgctcggtgggaggagttgttatgatgcttcttgtatg

SEQ ID NO: 18894 - DNA, 416 bp, Sorghum bicolor
  Clone ID: LIB3480-009-P1-K1-B9
ctgagcaggacacactgttggcccagaactaccaactcctacctccattgaagccaccacctcaatatgaggaaacagaggatgagaatgaagaatccaacccaagtctgacaccgaacccagcaaattctaatccaaccttctcgcaggatcagagaaataacgagcaacagcacactccccaacatggtcagagggtttcattccaactcaatgctgtggcagctgctgctgcaaagcgtcctcggatgaccattgatcagctgaacatgggctaaccattcatcgtcgtcggttagactagtatccttttcctcatcctctagtctggagaataatgttttgaagagattagtgttgtattgggatgatcttattgactaccacccacctatttaccacgtgtgcagtacagc

SEQ ID NO: 18895 - DNA, 421 bp, Sorghum bicolor
  Clone ID: LIB3480-009-P1-K1-C3
atgaattacaaataaaagtgttacgttatgtaaaaactttttatccagggacaataaggcggtcggaaaagaaaaggaaatatatataaaaaagaacttgtagtattcatgtggtgcctccacgctgcaagtggcaggtagttagagcagttagtacagcgttgcacgttgcatggcttgtcgtctcggcatgtggcccatagacaaatgcgtagggtcaatgcctggagatggaggaggccatagggatatactactaggagtaggccggttagttccggtactccatcgccacggtattcggcggcaggaggcgcgagattgcgggctcttgtgcttggcgctgcccggccggcggccctgaaacccaacaccccacgacggtgcgcgtcggggggggtaaacaataaatggcaagggg

SEQ ID NO: 18896 - DNA, 350 bp, Sorghum bicolor
  unsure (1)..(350): unsure at all n locations
  Clone ID: LIB3480-009-P1-K1-D1
ggcttcttctacccctccggttcggtttggatcggattcgtcaggttcttcgggggttccggatcgtgggtgagctgaagagatggcgagaattagacgttgagtaccgctgcttcatcggcgggctagtctggaacaccgacgacaaccccctatatccgtcttaaagcactaccgtgtggtcctagagtgcaagatcatacaggatcgggagacgcacacgtctcaacacttgcgctcactcattatcgaaacggacacgccctgtcgaggcgcactaaaagcgctgaacgtgaaggatactcacagagngaccattacactctacagagccctatagcgcgctcttc

SEQ ID NO: 18897 - DNA, 394 bp, Sorghum bicolor
  Clone ID: LIB3480-009-P1-K1-D11
gcatgatgtccacggagtcggtgttcggcctccaggtcgcgccgtccagcgacttcaccggcttcttcctggcgcacccggagctcatggacatcgccacgccgccgcgcagcagcagcgccttcgccgacgccgacgccgacgccaaggccgcccctgtcatctcgccgcccttcgagagcatcccggagctccccgagagcgccatgaagggaaactactccttcgccttcccaaacttgatagaggacaagaggaactactccaagaagcagtcgcagcgggaacaccagccggagccagcaacaccaacggaggtggccaagcccgcaccagcagcaccggcgaaagctgaagcgaaggcggaggcgcagccggagacaagcagcaaacc

SEQ ID NO: 18898 - DNA, 460 bp, Sorghum bicolor
  Clone ID: LIB3480-009-P1-K1-F12
gccaccatcagcgacatggatattcatgtcgtcgacttcaaccttggcgacggcatacagtggccatcgctcatgtcagaccttgctcgccttggcggcaagtcattccaccttacagcaatcataacagatgctggttacagtgacgacactcatcaggcagctgcacggcggctttcagagtttgctgagtccttgaaccttcccttccagtacagctctctctgcatacgccatgaggaggacctggaggacttctccaggaactgtggaggctcagtggttgtctcatgtgacacaacgaatctgtgttacagatcaggtagcaagttacagatgctactacttggctgtgtcaggaagttgcaacccaagtcagtggtggtcatagaagaggagctggtcagaattgtggaaagaggcctgttgtcccaggccttcttttgtgggttcttcttcg

SEQ ID NO: 18899 - DNA, 244 bp, Sorghum bicolor
  Clone ID: LIB3480-009-P1-K1-G4
gttcatcatgaaagaagtgcttcacaaggatggaaagtattttgatacccatgataacttagcgaatccagagtaccaagatctcatagaacatgaggattcgtagtaccaagcaaaacaatgagtggaaacttttgttgttcacacgtggtacttatatggtgtatttttagttatttttgtagtttccactactgtttgtagatgaagaaacaatctacctgtgagtctatgaattatatac

SEQ ID NO: 18900 - DNA, 181 bp, Sorghum bicolor
  Clone ID: LIB3480-009-P1-K1-H4
agcacgcgtacagcgacacgtgctgagatgctaccaatcatgcgggtattagggggtcggcgggatgcttgcactcacgcgtggtaagacctgggctatgcgagtgagtggcatcttttggtgtgcttcactacgcactatacgcagaccactcgtgcccatggacaagggtagaactaga

SEQ ID NO: 18901 - DNA, 380 bp, Sorghum bicolor
  Clone ID: LIB3480-009-P1-K1-H6
acgtgttctaagatacgcggacggagatgtacacagaggacctcataagacctccagaggaagagggagagtctcttgcaacagatgggcgatccttctgcgattaggcatgtgccatatgtcgagctgtcactggcagacgtagcagctcacattgagtctgtgacggagaagatcataatggaggaagagaagatgaagaagtggaagatggagaacttgaggagaaagcataactacgcaccgttcctgttcaatttcctcaagaattttgaggagaagcagcagttgaagcccctgatagagaaggcaaaggcgaggcagaagtctcacggccccagtcctaggtgaaagcctgcattacacctactgtctctttt

SEQ ID NO: 18902 - DNA, 412 bp, Sorghum bicolor
  Clone ID: LIB3480-009-P1-K1-H8
ggcacctttgttgcctcctctttggctgtccggagaggaggagaaggaggccgcaccaattctatctgggagcgcgggcgggcggacgaccaaaataaaaatgccacgcggcggcaagcccgcggcttcgtcgaagccgaaccccttcgactccgactcggactcggagtccaataataagccggcggcgaagaagtccggggcgtaccaggcccccgccgacgccaagaagcggtacaaggacgggttccgcgacgccggcgggctggagaaccagtcggtggaggagctgcagcactacgccgcgtacaaggccgaggagaccaccgacgcgctcgagggctggctgcgcatcggcgaggacatcaatgaagacgcgttcgacacgctcgtcaccctgcacaagcaaggg

SEQ ID NO: 18903 - DNA, 432 bp, Sorghum bicolor
  Clone ID: LIB3480-010-P1-K1-A1
aaaaaagataaaacagaaacagacactatataaataaaaaagaaaaaggtaggaacatcttgggaaagtacaaaccaaaaaaaactgggactcagaaaaaagtggaagccatggaggagtctgaaatggtggacgtgtggctggggcgtggaagcccaggaccacgaggccgccgcgaggcccatcctgtggcactgtatcatcaacaagctctagggccagttaccgtgaccagggtttaaaggacgagagctgtgcgaaacctggggattgcgctccttgtgtgctaggcgaggctgtcccttctccaggtacttggtcaacgaccgaatgggcctttccgacctcactcactaatacagtgtgcactattttatggagagggactcctcctttttggtcctcatttacccccacgttgagggggttttc

SEQ ID NO: 18904 - DNA, 445 bp, Sorghum bicolor
  Clone ID: LIB3480-010-P1-K1-A4
cagcgcccccagcccatcgcacccaaggccctcagcgatcgccggagcccgggcccccctcgcgccggcggtcgccaatcatggccaccacccccgctgaggagctggcgcctgggctgcctaccaccacccccgacgagaagccggcgcctgcgcctgcgctgcctaccaccacccccgccgaggagccggcgcctgcgctgcctagtaccaccaccaccccctccgaggagccggcgcgtgggctgcctctgcctcctcccaaaggtctcggcgacgagccgcagccgcggcggcggcgcccgtgcgtgctcctcagcttcgcagccgcgcgcgaccgcttccttcggggccggttcctctccgcgggcctgcgccccttctccgtgcgcctcccttcgctggcgggcaccaagcaccgtcgtccacctctgggcgcccccgc

SEQ ID NO: 18905 - DNA, 435 bp, Sorghum bicolor
  unsure (1)..(435): unsure at all n locations
  Clone ID: LIB3480-010-P1-K1-C12
cccgtagtgatctctgcagctagctgaattattaatcatctgcaaataagatccgcgacagaaaacatcacgtccattgcagatcgtaatatggccgttaatctcgtcgcggttccatcctcagggactccaattgagcccgggcacgccgacagatcaaggctgcagcagcagcagcaccatcttttattcaggcaggggaccaccgatcgaccggcgccggcgccatggctctgagccagagcacgcagctcggcctcgccaccgcgctcttcggcgtgctctccttcgtcctcgccgtcctcgccgagctcaagaaaccgccgtacgggacgccgatcaagggacgggacgtcgtcgtctgccggttcccgccggacccgacggtggcgctgggggcgctgtcngcgctggccgcggcgtgcaacgccgggc

SEQ ID NO: 18906 - DNA, 222 bp, Sorghum bicolor
  Clone ID: LIB3480-010-P1-K1-C9
ctctctctactctatcttcttcttaagaaaacaagcataggagggagaaggcagcgacggcgcggccgggcatgggcgtccagccctctccagcgggcatgggagggagcacggccccctagcaccaggggccatggctactcgcagcctgggcttgcgaccgtccacggcagcggcaggggcgcggctcccggctgctgcccggcaggccagaggctctag

SEQ ID NO: 18907 - DNA, 402 bp, Sorghum bicolor
  Clone ID: LIB3480-010-P1-K1-D12
cccacgcgtccgcttaaaatctcacaagtgctaatacaaaattgactggtgaccttccaatcaatattttggctcattttcaaagccatccttaatagtcattacgaatgtttcatgtcttacatcttgtcttcctttcaagaatgagaggttgctctactcattcttttttctggcgatgcaaattcatatctatttctatacacggggtgtggttttctaattcattgggcagtctaagtccttgtgcatgttccacagagtatcatttacataatcaaaaccaatgattaatcagttcttagctattccatttttacaccaattgtgttctttttttaaaaaaatagatattgttttacatttccacttcatataaagaaaacactaatgctactttac

SEQ ID NO: 18908 - DNA, 432 bp, Sorghum bicolor
  Clone ID: LIB3480-010-P1-K1-E5
gtcgaggacggcgctttctcaaatccgacaaacttcagtatcttttcgacttcatagacatcggcaggactttcaagccaggaacttatagactggtgaggtcttatcccaggcgtgctttcactgaaggggagagccagatgtcattgagtgatctcggtctgactagcaagcaggaagctctgttcctagaaaaactgtcagcgtagagtataaggttttagagttatggttgagtaatgtgcacttttaaattgaagtcataccaggcgttgtgtttacgaaatactccggcggttgaatggttactcatatctggaggagatcccgtcgccatcttttgtgctcttaaacgcaggtgtttctctgactcggtagcacactcaattctcatggccacatttaaagtgcagatgtacactcaattctcag

SEQ ID NO: 18909 - DNA, 254 bp, Sorghum bicolor
  Clone ID: LIB3480-010-P1-K1-F12
gcggcagtactacggcgggtccgcgaacgcggcgctgggtgccgcggtgggcgaggaggagcggctcgcgagcgcggtacggcttccactggacgtaacgtagcgcgggctgcgcgtggtggtgacgggcggtgactggttcgtgggcagccacctggtggaccgtctcctggagcgcggtgacagagtggtggtggtggacaacttcttcacggggcggaaggagaacctggcgcaccaggcctggaacccga

SEQ ID NO: 18910 - DNA, 370 bp, Sorghum bicolor
  Clone ID: LIB3480-010-P1-K1-F5
gacgggtggaccagaagcataggctgaaacctggctagaagctacagctgtgtacaattcggagcgaaaggcatacattgatacattaagagcaccagccaggagaacaaacatgactacacaaagaacgtggaggaccggaagatgcaggtgcacctgctggcgaagttccagcacgcattcgtggccgccgaggacgcatgctgccaacacgttgggtcggtgaacaacgtggtcgaccgggacgtctacagcaggatgaagagccaccagcagaactacgacatgaacccgcaccacaactggaaggactgctgcagcctgcacaaccgcatactggccgagtacgacaagtacggcggcttcaaga

SEQ ID NO: 18911 - DNA, 308 bp, Sorghum bicolor
  Clone ID: LIB3480-010-P1-K1-G10
cccacacctacggcaggagtggcctcttccgtatcgaccgctcctacttcggcgtgcggggaacgcacgccgggtatgccgaccacacacatacacatccagcacctggaccccaaaggctacctcgagtaaaacagctccgggataaaacttaacgcgtcgaaaaacgcgtgccacgcacccagggtccaaaagatcttaatacgctctggcaactcccacacagtaactctagagcttacaggtcgctgaatgtgcagcatcatgatccggcgtatacaataacctgctcttgagacgcgacctgc

SEQ ID NO: 18912 - DNA, 411 bp, Sorghum bicolor
  Clone ID: LIB3480-010-P1-K1-G6
gcatgatccattatatcacctagattgattttagtttattattattgagcatctgggttcatccaagtgtcagattcacatccctcttgatagaacaacatgcctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaacgaaaaaagaaaaaaaaaaaaaaatgcacaaacaagaaggggggcggggtttaaaaaaataaaaacaattgaccggggaaagccaaatttaatcctttttaaaaggcccacaaataaaaaaacggagggcccattttaacaaacccggactgggaaaaacccggtgggaccccccctaa

SEQ ID NO: 18913 - DNA, 361 bp, Sorghum bicolor
  Clone ID: LIB3480-010-P1-K1-H10
ggcggcggcggggaggcggaggcggaggcggaggcggaggtggagttctttgcggtgtacgacgggcacggcgggccacgggtggcggacacgtgccgggagaggctgcacgtggtgctcgcggaggaggtggcgcggctgcacctgcaactcgggaaaggcggcggcggcgacgacggcggcggcgtgctgcggcgctggagggaggccatggaggcctgcttcgcccgcgtggacggcgaggtcgtggtggtggagcgcgaggtgaacaagaacaagaacaacgccggcgacacggtgggctgcggctccaccgccgtcgtggccgtcgtggggccccgtcacatcgtggtggccaact

SEQ ID NO: 18914 - DNA, 370 bp, Sorghum bicolor
  Clone ID: LIB3480-010-P1-K1-H11
ccaggagtttccggacgcgacggcgctcatgtccgccaccccggccgtggcgtagcgggaggcggcgtgcaacatcacccggcccaagaagcgcgcctccaagtgctgcgtctccttctccgcctactacaacgactccgtggtgccgtgcaacacctgcgcctgcggctgcggcaacgacacgtgcacgtgcgacccggacaggcacgccatgctgctgccggcggaggcgctgctcgtcccgttcgacaacctgtcggccaaggcccgggcgtgggccaagatcaagcactggcgggtgcccaaccccatgccctgcagagacaactgcggcgacagcatcaactggcacgttatgaacaactacaag

SEQ ID NO: 18915 - DNA, 444 bp, Sorghum bicolor
  Clone ID: LIB3480-010-P1-K1-H3
attttaaaaataatttgtggcctctggaactttttgacctttgggttgtaagctcctcagtaacgaaaattctggtttctttcattcattgagcctcgaaagtcctaaaaaaacgtttgattaaggcattttgtcataggtttatatagtttgtgccatcatccatcagttcctttgtgcttatgtcgagttaaattgttgtttgtcaggagtttggacaaaactgcctcagcatgtttcatattttatataattttaatacaaagaatttatttctatttcctttggtaaatttaacaaaacatgcgatgttgtcattcactacattgacatacaagcctcgtgtttcagtatttgataagaattatgtttttaaccacacaaaataccaaacatcaacaatttgcattaaagcgattttcattaaactattaatagactcac

SEQ ID NO: 18916 - DNA, 383 bp, Sorghum bicolor
  Clone ID: LIB3480-011-P1-K1-A11
ccgacgagaagttcgtggacgtcgagctctcggaggagacgctcgtcgacaccgtggggctggccaacctggagcactactcctccaacttcagggacttcgaggtgtacggcagcatgagctacccgacggaggcgtgggagctgctgggacggttcaccgccgagaacgccaagcacgcgcagcgattcgtgctgccggagcccaggtggacgcgctacctccagctgcgcctcgtaagccactacggctccggattctactgcatcctcagttacctcgaggtctacggcgtccacgccgtcgagcggatgctgcaggacttcatcgctggcaatggcgccggcgcctgcaccgaagacagcccatgcaaggaccgtgcc

SEQ ID NO: 18917 - DNA, 407 bp, Sorghum bicolor
  Clone ID: LIB3480-011-P1-K1-A2
atcgtgctcttcatatgcacaaggaagtgcgctccccggatgtcagctcggtcttctggaaggagagaagttacactcttccaagatattggtgtcccaatcacttatgagactgttgttcgagccactggaagtttcaatgcaagcaattgcattggaagtggaggctttggagccacttacaaggctgaaattgcaccaggagtgttggtagctattaagaggctctctgtcgggaggtttcagggagcccaacagtttgatgctgagataaaaaccctagggagattaagacatccaaatcttgttaccttggtaggttaccatcttggcgagtctgaaatgtttctcatatataactacttgtctggaggaaaccttgagaggttatacaggagagatcgaag

SEQ ID NO: 18918 - DNA, 376 bp, Sorghum bicolor
  Clone ID: LIB3480-011-P1-K1-A4
agagagcaaggcgaaagaactgaacgtcatgttcatcgaaaccagcgcgaaagccggcttcaacatcaagccgctgttccgcaagatcgccgcggccctgccgggaatggagacgctgtcggcgaagtctgaggacatggtggacgtgaacctgaagcccacttccagccagtccaactcgcagcagcaggcggggagtggatgcgcgtgctagaagagtgctaactctgcacatacactggcttgacaaacgtgttgttaactgttaagcagttatatcagttctgttactgctgtccttaattccctgattacctgatgcttcttctgtagtgagtcttactttgttttctcgatcatgtgcatctcgattttt

SEQ ID NO: 18919 - DNA, 415 bp, Sorghum bicolor
  Clone ID: LIB3480-011-P1-K1-A5
cacccatggggctcacgcatcatgtagaaaatgccatagagagaggagccttccaggagatacttgacccgacggtgacagactggccggtggaagaggctctggaattcgcaaagctggcattgcggtgcggcgagctacggaagaaagacaggccggatcttggaaaagaaatcttgccagagcttacgaggttgcgtaatcttgggcatgattatgagacttcccaggttagcagcgcaagtacaaactgttcaagctccgcaccatacagtttcaataatgatgacatctaaataccatgagaacgaatcttctgccggattaagcaaatcaggcataattataacagtatagagcatagacagacatggacatgatgatcagaaatcagtcctaacttagatgagatgat

SEQ ID NO: 18920 - DNA, 335 bp, Sorghum bicolor
  Clone ID: LIB3480-011-P1-K1-B2
gttttggggtaagtagctagtgtggagcaatggccaacgggactgaatccgcggctcgctgctgcttcccgatctggaaaacccggcgactgcgagttgagaagaggccgggaacggcggcagcggccggttgtctgtgggtccgtccacttggcgtcgcatggatgtttgtatactggcacttttgcacggtgtcgcgagatttgcgagatgccactttgttcagtggagcaggaaagtatatatatctatacttatatatactagcagcaatttgcttcttgtaactgtgcagatcaataaactgtataagaagccctccattttttcactca

SEQ ID NO: 18921 - DNA, 441 bp, Sorghum bicolor
  Clone ID: LIB3480-011-P1-K1-B7
aaaaaaaaaaaaaaaaaaaaaaaaaaaaaaaaaaaaaaaaaaaaaaaaaaaaaaaaaaagggaaaaaaaaaaaaaaaaaaaaaaaaaaacaaaaaaaaaaaaaaataaaaaaaaggggggggccgttttaaaggaccaaacttttcccccccctcattgcaaggtaatagtttttttatggggcccccaaaatcaaattcacgggccgggttttaaaaacctctggcctggaaaacccctggcttacccaaattaaatggcttgacacaaaatccccttttccccatttggcttaatacaaaaaggccccgcacaattcgcccttcaaaaatgttgcccacctaaattggaaaagggacccccccttttaccgccctttaaaccccgggggttgtggggttcccccccaggtaaacctttacatttgcaagccccttagcc

SEQ ID NO: 18922 - DNA, 422 bp, Sorghum bicolor
  unsure (1)..(422): unsure at all n locations
  Clone ID: LIB3480-011-P1-K1-B8
caccaagcggtgctggcacggggacccggcgcagcggccggcgttcgcgtccatctgccgcgtcctccgctacgtgaagcggttcgtggtcatgaacccggcccccgcggagcagccggacgcgacgccgccgccgccgcccgtgccgcccgtggactacctcgacgtcgaggcgagcctgcagaggaggttcccggcgtggcagtccggaaacgcggcgccgcgcgtctccgacgtgccgttccagatgttcgcgtacagggtgatggagaaggagaggaacagggcggccatcctgcacatcggcggcggcggcagggacaagggcctncgactccagcagcgaaggcaactcgctgtgcggggacgagagcggcagcgcgacgctgtcggacgccgatgctctgtccgtgttgagccgc

SEQ ID NO: 18923 - DNA, 431 bp, Sorghum bicolor
  Clone ID: LIB3480-011-P1-K1-C3
aggcagaccaaagtactgtctttgatgaagcaaagaggcatttctagcagatatataccacatatggcatcttctgggcggatcatccatccaggcacatgcaataagcctaactcaaatggaaattgtgaccatccatggtgcagtactccaattcttgtcacctcaccagttggtcagactgtttcaaatctgatacggaatggattgttcggtgttgaggaggcactgagatgttgccatgattgtttatcctctcttgctgcagcagcatctgcaggagtccgtcacagtgatatccggccagagaatgtgatccgtgtcagtaatggttcaggtgatccatattttgtgcttattggatggggtcatgctatcctagaagatagagaacgacctgtgatgaatctgttcttctcatctacgtttgc

SEQ ID NO: 18924 - DNA, 235 bp, Sorghum bicolor
  Clone ID: LIB3480-011-P1-K1-D12
ctggactcgccggcgcgcgcggcctccatcatgcccctgtacagctcctcgaccggccgggccacgcggtccgggtcgaccacctcgccgccctcggcgaccgtgagcacgcggtcgggggacccgtccatgcgctcgtacgggggagcgtccctgtcgcaagcgagcgcgccggcgtcgcgcgcgagcgcgtacacggggctcccgtcgatgccctgaatccacgtggcgccca

SEQ ID NO: 18925 - DNA, 321 bp, Sorghum bicolor
  Clone ID: LIB3480-011-P1-K1-D4
caggaatgcaagctttattagatctgctgtttgctgttgaaggttccatatcagatgcagcgaagattttaggcctaagcactggtgctttgtcaagactgattctgccagatgattctctccgaacggccgcgaatgaactgcgagcttcgaagggactgaagcctctgaggtgaaatcctttgtaaaattctcagcttcaagtgaaccatatcccataggtgccaagttccatagaagtgagccggcatgatttctagggaaaaccttcggtgtctcatgctggctctgagggatgttcatcatcatttagattgccgt

SEQ ID NO: 18926 - DNA, 273 bp, Sorghum bicolor
  Clone ID: LIB3480-011-P1-K1-D7
cccaacccgtgcatgcgaggtactatacttgttatactgaaacctaccaacacttgactatctctattcaaacaccgtagagacatgcaaaaccctccctgctcccacacttaacacgcttgcagacatcctgctcttcccagctctggtagtagacaacaggcatgcacaggacgcccttcacaacacgtcagaagtctcaatggctgaacgaaaacgcgccttaatctccattaagcctggaagggtggtggtaccgcagcgctccgatca

SEQ ID NO: 18927 - DNA, 430 bp, Sorghum bicolor
  unsure (1)..(430): unsure at all n locations
  Clone ID: LIB3480-011-P1-K1-E1
ggacgacgtgcgcaagctctggtccgtcnacctgggcgatcgccacgtggtggcggcgcccgagtactgccacgccaacttcaccaagtacttcaccgacgccttctggtcggacgaggagctcagcgccgcgttccggggccgccgcccctgctacttcaacacgggcgtcatggtcatggacgtggcgcggtggcgacgcggcgggtacacgcggcgggtggaggagtggatggcggtgcacaagcggaagcggatctaccacctggggtcgctgccgccgttcctgctggtgctcgccggggacatcaggcccgtcgaccaccgctggaaccagcacgggctcggcggcgacaacgtggaaggcaggtgccggagcctacacccgggccccatcaacctgctgcactggagcggcaagggcaagccg

SEQ ID NO: 18928 - DNA, 263 bp, Sorghum bicolor
  Clone ID: LIB3480-011-P1-K1-F1
cccacgcgtccgaactaaatgaggcttacatccatcgtatgctcaccgggaaggcttttgcgaactttgaggtaaatatccaactccaagtaacttcctaatcttccaactttgctaaatcagtgttcacatttctctgaaggacctgctagcaaatattaaatacagtgtacagtgcatatctagagtttgaaatgtgagatggacgatagatcctatataaccaattgtggtctggaggactgttgaaagcccattgcatc

SEQ ID NO: 18929 - DNA, 311 bp, Sorghum bicolor
  Clone ID: LIB3480-011-P1-K1-F9
cccacgcgttcgcggaagaatatggagataaaggggaaagtttcagctctaactaaggtggaacaagatgtaacaaaggttactaaccttaatgcttttgacattatttctctttcagaaggcttcaatctttcaggcttgtttgatgattctgagaaaagaaaagagacaaggttcacatctagtcaaccagcttcaactattatctcaaaactagaagatgtcgccacctgttcaaagcttacagtaaagaagaaagaaggtggtgtgttaaaaatggaaggtgaaaatgaaggaaggaaaggtgtact

SEQ ID NO: 18930 - DNA, 335 bp, Sorghum bicolor
  Clone ID: LIB3480-011-P1-K1-G2
ggtagggggtagcggcaaagcagatgccgatgccactgctggaggagaagctgaagcaaggaagagcagcagttccagcgcaagtggcgatgctggaggaaatgaaggtggcgaaactgatgcggatgcaactacttctagtggcggtgaggcaggaggtagtggcaaaggagatgtcgatgccactgctggagctggaggagaagctaaagcaagtaagagcagcagtatcagcgcaagtggcgatgttggaggagatgcaggtggcaagactgatgcggatgcaactacttctagtgacgttaaggcagggggtaacggcaaatcatatgtcg

SEQ ID NO: 18931 - DNA, 310 bp, Sorghum bicolor
  Clone ID: LIB3480-011-P1-K1-G3
cgctggcccccccgtcccgtccgtgccccacccaccaccctcgtcggcgtcgtcctcctgtctgtcctgtgcacccccccccggccaagaaggcaaggctgcctgctgcctgctggttggacctggaccaaggacgagagagagaggctcgtacgcacgtcgctgctggtggtaggggtatacgcgcgccatggacgggggcacggtggaggatctcatacggcggctgctggacggcaagaagcacaaggtgacggggaagaaggcggtgcagctgacggagcccgagatccggcacctctgcgtcacc

SEQ ID NO: 18932 - DNA, 348 bp, Sorghum bicolor
  Clone ID: LIB3480-011-P1-K1-G7
ggaaacctcagctgctgctacctgtttcattccagcaaatttttatttggttcaaagggaagatgatggagtggccgccgccatcaacgtcgccgtcgccgtcgctggtggtgcgcagccccagacagacggtcagcctgatccgcaaccgccgaccccaccgcgactgggccccctcctcgaggtccccctccttcgccgcccgcgaccatggccccaagccgtcggaggtgtacggcttcgtcggatccatcaccacagtcatcgccaccgctgtctacctcgcctgggcatacacgcctgagcccgtgctccggtctctctgcattacctactaccctagcaagc

SEQ ID NO: 18933 - DNA, 268 bp, Sorghum bicolor
  Clone ID: LIB3480-011-P1-K1-H10
agctgattggatactgcgtagaggatgagcaccgactgctagtatacgagttcatgcggcgtgggagcttggaaaatcatctgtttaggagaggctcatacttccaacctctgtcatggaaccttagaatgaaggttgcacttggagcagcaaaaggactggcttaccttcatagtgcagaggcaaaagttatttaccgagattttaagacttccaacatcctccttgacacagattattctgcgaaactttctgattttggattggc

SEQ ID NO: 18934 - DNA, 335 bp, Sorghum bicolor
  Clone ID: LIB3480-012-P1-K1-A3
aagtcttcggcgtccatggaaaaagaggcatgcgcagagaagaagtacggaggaattgcacccaagaagcctttgatatccaaggaccactagcgcgcctacttcgactctggggactgggtgctgggcatgcaagctgcaaacagcagcacaagggctgctgtcgagtctctgaagcccaagctgaagagaacgcctcaccaccagctgccccctcgttagcccacctgcgctttcagttgagacgacgcacggtcacgcgttgcatctgctggagtggagggagagctcggaggcaaggatgtaggatgcattgccgagctgggataaatgtt

SEQ ID NO: 18935 - DNA, 271 bp, Sorghum bicolor
  Clone ID: LIB3480-012-P1-K1-A8
agcggtgcgccctctaaggcgagttcgtccacaagcgcctctgccgcaccgaccagcagggttcgttcgcggagcaccggtactacaaggtactgtacaggcgctacgccttccttttattgctcgacggcggagaccatgatgagaatgagctagctatacttgaatgcatacatctcctggcggaaactatggaccggcacttgagctatgggtgcgagcttgacatcatgggacatctagaagaagtgcacttgatgtgggtagagat

SEQ ID NO: 18936 - DNA, 477 bp, Sorghum bicolor
  Clone ID: LIB3480-012-P1-K1-B11
caaatgggccagcatcgtttccttcaccagcaccctcggcatcaaatggcaatatgatgcctgctgctcagcactcaagccaaatgaattgccaaccatgtcatcaaacccacctcctatgcaaacacctacaagtcgacttcaggaacctgagccaaatgagtctcaaagctcggtccagaggatattgcaagacttgatgatgcagtcccatattaatggtgttggaccagtgggaagcgatatgaggagagcaaacacaattactcctggtcttaatggtgtcaactccttagttggtaaccctatgacaaataaccctggaatcaatggaatgggatttggggctatgggtggccttggtcaacaaatgagaacggctatggggaccaacgcattggcaatgaatggaaagaccgggatgaatcacagtgcgcatgacctgacacagttgagccaccagcagcaacagcgaga

SEQ ID NO: 18937 - DNA, 312 bp, Sorghum bicolor
  Clone ID: LIB3480-012-P1-K1-B7
cggacgcgtgggcgctgagttgggttttcctccagctgcgttgctgattatgaaaggagtggtctctgcgctgcacatacgaccctgatggcttccaagctagagcatgatcctggacatgcacgaagcatggtcgggccttcccacttcagtggcattgtctccggttcatcagctgctgatagcaacatggaccatgccatctcatcatctggccatggcgcatggtcagactgcgttgactcgtcaggagacatgcagagcgctggcaggctccttataccacatcaagtgctggtccctggctcattg

SEQ ID NO: 18938 - DNA, 375 bp, Sorghum bicolor
  Clone ID: LIB3480-012-P1-K1-C12
aggtaactctggttgcaaaacaatctatcatctgagttagttctcatgccctgtttgtaggctgacagaagacagggtgctgctatttgtactcaaaaaaagttgctactgattacttatatgtaattagacagtgaggactgaagtgacagatgatagattgttcgatcttctgatcttttgttgttcgttcaacactccatattatatagatttggtcaagtaccatctaagtttaagtaaaaattaacaagagacatggattaaagttattcatgactgcatgcttggttcaatgatttaaatttttttgatgtagagctaacaactaaagcaacaaattcttgtgcaaagcttaacaaaaaagcaaagagc

SEQ ID NO: 18939 - DNA, 351 bp, Sorghum bicolor
  Clone ID: LIB3480-012-P1-K1-C9
agcaatatttatagatggagtagttaacatggaatatagttaatttcggatttttttttggagagggggaattctgagctagtttagagctggactccacgttattatgtgctgttttacacatggatccgagttgtatttggaaggcatttatagatattcaacatttattgagctaatttggaatttagttatttttataggtggaatataatacagccaagttataactggcgctgacatttaaaaaacaatagaacgtctactatttctatgctgattagaattcttctataaaaaatgcttctgacaagatcctatgcagccaataaaaatatttaaaaatattgc

SEQ ID NO: 18940 - DNA, 396 bp, Sorghum bicolor
  Clone ID: LIB3480-012-P1-K1-D7
cgcgagcgatggcgagagttcctctcctccgtccagcgcccgtttgctcgtcgatcgatcggttgtggcctgccggccgcgagcacgaggagcggctagccagacggacgtgtcgtcttggcaggtgcagcaagcgcggatctcgatcgccgccatgtctttcaccggcacgcatgacaagtgcattacctgcgacaagacggtccacttcatcgacctcctcaccgccgacggcgtctcgtaccacaagacatgcttcaagtgcagccactgcaagggcacactctcgattagcagctactcttccatggacggagtcctgtactgcaagacgcactttgaacagctcttcaaggagacagggaccttctccaagaaatttcaaggtggagcatc

SEQ ID NO: 18941 - DNA, 371 bp, Sorghum bicolor
  Clone ID: LIB3480-012-P1-K1-E10
actaatgctagactgacagccgactgctcagatgatacctgcttccccacgcttccgtgcaacgagggagctttgccttacagcaacctcaatgcatctaagtgaccgattgcttacatcgtagctggctgtgtatatccaatgtggctacccaacttaatcaactcgctgaaattcaactatcgtcatctggcctactaacgacatggcccacgctgttctacctttccatcaggaccgcagactgactggcgaccgggacgctccctgtaacagcaccattaaacgcggaaacctgtgcctctacacacactaatgccgctgcaccggccagcaccctatatgacgctgactcgaataaagcaccctta

SEQ ID NO: 18942 - DNA, 445 bp, Sorghum bicolor
  Clone ID: LIB3480-012-P1-K1-E11
atccagcgttgttgtttcaatgattggactctcaatacttcttctgcttggagtgctgaactgggaggattgtttgaatgagaagtctgcatgggacaccctagcttggtttgctattttagttggtttggctggtcagcttactaagctcggtattgtgtcctggatatcgagtagtgttgccaagattcttcgatctttctcattgagctggcctgcagcatttggtgttcttcaagcctcattcttctttattcactatatatttgcaagccaaactgcacatgttggagctttatactcggcatttcttgccatgcatttagcagctgatgtgccatctgtaatgtcaacacttgctttggcatataatgcaaacctctttggatcactgacacattatagtagcgggcaatctgcagtatactttggagcggggacgttg

SEQ ID NO: 18943 - DNA, 263 bp, Sorghum bicolor
  Clone ID: LIB3480-012-P1-K1-G7
gactagttctatgatcgcgagcggtcagctcgcgatctagaactaggttctacaccacgagggaggcggctcttttgcataaatgggattcgaactcttttcttctgcatgaggaaagctccaggaagcaaaacgcggaccttcggtacaaacattttttatagcgaaggcttgatgtttggagtcccgggacattctacagtcacaggatagaatattgcacggatactgctttgcggcaaacccggaatcattcagacggc

SEQ ID NO: 18944 - DNA, 305 bp, Sorghum bicolor
  Clone ID: LIB3480-012-P1-K1-G8
gactcttgcttcgatgatcaagtgcaccaagccggccgagtgctctggtagaggccgcggcggtgcacatcacagacatgaactacgatcaaatcgccaactaccacttcgacctgaccggcacggcgttcggcgccatggccatgaaggacgtggaggagaagctgcgcaaggcgggcatgatcgacatgcagctgcgccgggtcaagcgcaagtccggcgtaaaggtcaccttccacgtggaaaaggggtgcaaccccacttacctggcattgccggtcaagtatgtcgatggtgacagggac

SEQ ID NO: 18945 - DNA, 402 bp, Sorghum bicolor
  Clone ID: LIB3480-012-P1-K1-H10
cggacgcgtgggtttttttttttttttttttttttttttttttttttttttttttttttggttggggtatttaataccaaaaatgcgtccaattcccaaatcgcctgttgtgggggccagcgaaaactacaaatgctatccaagcgcctgagcctggcacccgcaacacactatttaatagattatttatcaataatcaaaaatcgaaagacatccgaccccttccaaaactacccactaagcacgggttacggataacctttgttcatgggccacttggcaataattaaaaattattatgccttaacttcgacccagaccccattcggtgggtgcataacggacaccgggcacggttcatgcacggtaaaaggttaaacgctaatcaatacaggctgctca

SEQ ID NO: 18946 - DNA, 119 bp, Sorghum bicolor
  unsure (1)..(119): unsure at all n locations
  Clone ID: LIB3480-012-P1-K1-H6
tggcatatcatactgttctcaacatacctgccgcccttgcctgtggacacggtgganaaagggagagctttntccagggagattgaaacccgcttaacatccaagtgcgatgctttggc

SEQ ID NO: 18947 - DNA, 309 bp, Sorghum bicolor
  Clone ID: LIB3480-012-P1-K1-H8
gacatatggcttaagcactgggctcaagtagaggcttgttcagagaagcactccagctgatcctgggggagtgtcctatccacgcccttcctccatatatatactcgtacaagtggttgccgcgttagatcgatggcgacggattagtcgtgtccgagtgaactagaattgaccttgttgctctaatgtccgaggtgacaatgttgaggatagatttagcgtcgagtaggcaaaaaaaaatataaatatttggatgagcagtccgagtttggcatggacagttcgatgaaaaagaaaattatctggacc

SEQ ID NO: 18948 - DNA, 376 bp, Sorghum bicolor
  Clone ID: LIB3480-012-P1-K1-H9
ctcatatacaatgaagatttgcgcgaacttccttgtgcacatgtcttccacatggaatgcatagataaatggctccagataaacgcgttgtgccctctttgcaaggctgagatagggggctcaacaacaagtaatccggagagtggctctgtgggtcctgacaacgccaacagagttagcaatgacgtcgagtcacaacggtagctgctcttggccttttccatgaccatgaagaggttgatgcggactaattaaactgatgaacatataacaaactacaagtaggaaggttacacactgtatggtccaacaagcccttttttttcctgatggacttgtttcatattggcaatgtagtatttcctgctacaagtgc

SEQ ID NO: 18949 - DNA, 313 bp, Sorghum bicolor
  Clone ID: LIB3480-013-P1-K1-B4
ataattaatattgtttgctttcttttttgacagtgacaacaacggtctatatatagtagcatccgagtacagtataaacaagggctgtccttatattggttcaattccaatgaccaccttacattgcttatataatttatagtataggcactcatgtaataaccgcctaccgaaatgggggtatcagacgacaaaaccaacgtgctagccacgctaataatccaatgtgatacaatctcaatctttggcatactggcatgatgctatgctgtcactgtcgaatcattgtctaaaactacctaggaaaattttt

SEQ ID NO: 18950 - DNA, 351 bp, Sorghum bicolor
  Clone ID: LIB3480-013-P1-K1-B6
gctcggtctcggtggagcaggtcttggtctcggtggaccaggtctcgttggaccaggtctcgttggaccaggtctcggtggagcgggtctcgggggagcgggtctcggtggagcgggtttcggtgggccaggtttcggtggaggattcggttcaggacaaagcgcctcaaatgcagcagcaagtgctaatgcacaatctcaaaatcaaggatttggcggtggatttgttcaaccaggatttggagggggattcgttcaaccaggtggtggattcggtagtcaacaaagcgcttcaaatgcagcagcaaatgcaggcagcaacacatttggacaaaccgttggttaagtcct

SEQ ID NO: 18951 - DNA, 246 bp, Sorghum bicolor
  Clone ID: LIB3480-013-P1-K1-B7
aaaaaaaaaaaaaaaaaaaaaaaaaaaaaaaaaaaaaaaaaaaaaaaaaaaaaaaaaaaaaacggggggtctaaaataatcgaggtgacgaacacttacataacaacaatttaactaatctaatatagacacctaaattaaattgaaatgaccataattttgcggcccccttttctgggaaccaccctttcgttcccctgcttaatcccttaatatcttttttttcctttccccagctttattcat

SEQ ID NO: 18952 - DNA, 324 bp, Sorghum bicolor
  Clone ID: LIB3480-013-P1-K1-B9
cgagccggtggagctggcccgggcgcggaagctgtacagcatggaggagctggagaagcgcacgagggggcggcgctcatgactctcttcaactacatgggctggaacttccagcaggacacaccgattaaactgaaggaagactggacgcttgaaacctaacggcaaggcaagacatttaaggaaggcccgatgcatgcatcccaaaaaggcctgtaccgagaccggtttcccacaggtgggcaggaggagcgcttagtcgcgcccctgatgataccatatattaatataggatcgtggggtaccgacccgcagactgataca

SEQ ID NO: 18953 - DNA, 368 bp, Sorghum bicolor
  Clone ID: LIB3480-013-P1-K1-C1
gagtcggcggagctgcccgcggcgcggaagctgtacgccaaggaggagctggagaagctgaacgaggcgccggcgtcgatgacgctcttcgacttcatgggctggcacttcgaccaggacgagctgatgaaccgcagggaggacggaacgctggacgccgacggcgaggccatgctcctcaagaaggcgccaagcatggcgcccaagaagttctcctacgttgacagcttcgccgccggcggcatgaggagcccttagtgcgacaccggctagtacggctcattaaaccccggacggcggggaacgtacccccagcgtggtgcagtcgccattgaccggcctccgatcgacttgctagcagcagcagc

SEQ ID NO: 18954 - DNA, 369 bp, Sorghum bicolor
  Clone ID: LIB3480-013-P1-K1-D5
cccacgcgtccgcaatatttgaacgccatcaggatctgaatggtaccatgaagattcccaaagaagagatgtttcggttttcacatcaagtgcctttctacaggatgtcaggcgaagaagctccaaatgtccccaaagatagctatgagcttgacccagctgctatttctaaggaacttcttcaagggaccacagaaacagtggaggcaaatggaacttcctaatgttgatttaagacagttgatgatggtctgccttggtggacctgccattttgaagcaatcaagcaaaagttattgacattaagttttatagttttccttctacagcttttgacaattatctttgcatagaagggttagaatggga

SEQ ID NO: 18955 - DNA, 396 bp, Sorghum bicolor
  Clone ID: LIB3480-013-P1-K1-D9
gctggatcttttgtctcgctaccaaatcaaatgtccatgataggaactgttggccccccagtgccaaacatcgatgttcgtctggagtcggtcccagaaatggattacgatgcactggcgagcacgcctcgtggagagatatgcatcaggggagaaacattattctcaggatactacaagcgcgaagaccttacaaaggaggtcctgattgatggatggttccacactggtgacattggtgagtggcaacctgatggatgtatgaaaatcatcgatcgcaaaaagaatatattcaaactttcgcagggtgaatatgtggcggttgaaaatttggagaatgtttacggccttgtttctgcttcagactcgatatgggtatatgggaacagctttgag

SEQ ID NO: 18956 - DNA, 384 bp, Sorghum bicolor
  Clone ID: LIB3480-013-P1-K1-E1
cgcgacggcggaggcggtgatgacgccgtcgagaagcgcgcccaaattcagacgttcccgggcatcgtacgggcgcgggtcgacgtgttccaggaaaagatcaacgccaagacgaagaagctagccaagaaggcctcgccaccgccgccgccggagagcgcgggccgagtcgtcgtgtacctcacgagcctccgcgggatccggcagacgtacgaggactgctggtccacgagcgcgatcctgcgcggctacggcgtgcgcgtcgacgagcgcgacctgtccatgcacgcggggttcaaagacgagctccgcgccgccgcgctcggcgacgaaggcaggctaccgatgctcccgcaggtgttcgcggacggccggcacctgggc

SEQ ID NO: 18957 - DNA, 489 bp, Sorghum bicolor
  Clone ID: LIB3480-013-P1-K1-E10
aaaaaaaaaaaaaaaaaaaaaaaaaaaaaaaaaaaaaaaaaaaaaaaaaaaaaaaaaaaaaaaaaaagagaaaaaaaaaaaaaaaaaaaaaaaaaaaaaaaaaaaaaaaaaaaaaaaaaaaaaaaaaaaaaaaaaaaaaaaaaaaagggggcgccccttttaagggccccaattttcctcccccttccttccaacttaaaactttttttttggggcccccaaattaaaatccccggccccggttttaacaccgtggggccgggaaaaccccgggcttcccccaattaaatccctttgaaaaaaatccccttttccccagttgggtaaaaaccaaaaggcccccccccatccccctttccaaaaatttcccccccctaaaggcaaatgggaccccccctttaaccgcccctttaaccccgggggttgtggggtttccccccagtgtgcccttttcttttgcaagcccttagccccccttttttttttttt

SEQ ID NO: 18958 - DNA, 207 bp, Sorghum bicolor
  Clone ID: LIB3480-013-P1-K1-E5
cgcatgccccgtgccccgccaccgccaaggccgacgtcggcgagccccctccctcgctctgcccggtgtgcggccaccccgcacccttctccgttaccccggcggcgtctgccgcgtcggccaacgcgtcccccgcgaggctgccgctgaagcggaggacaccacccgtacccgaggcgccacccgcggtggtgcgggtggagatcg

SEQ ID NO: 18959 - DNA, 406 bp, Sorghum bicolor
  Clone ID: LIB3480-013-P1-K1-E8
ggccaacacatatgaggagctaccggagcaggtgataggcgcagctcggctggctcatgttgaaccggccacagcagtagttcctgatcttagcaacacaacacgtgacagtagcagcagcaacaacaacggttcctcagatgatgatttgtccaagaaaacaaactgattttattttaatctagtatcagggtgttgtgttggttaacctccttgaaggccttgatacattgatagagcccggtgctatcaggggtaaacagcagtgatttctcaggatactgtgtaacaggcaggaaggctttgttttttcccctccactgtcgcatggatctagaccttctttttgttatttttttttcagttcgatgcgttttgagaatgtagtcaatggattttttgatgc

SEQ ID NO: 18960 - DNA, 461 bp, Sorghum bicolor
  Clone ID: LIB3480-013-P1-K1-F10
cgcgtccgaaaaaaaaaaaaaaaaaaaaaaaaaaaagggcggccgcccttttttttttttttttttttttgtgtggtttttctctttttttgtcttgttttttttgttccgtttcttgttgtctttcttgcttttttttttttgtgttttttaaaaccaaacaaaaaagggggggggcccttctaagggaacaaatgttaccaccccggagaggccagaacaaatcttttttaagggggccccaaaaacaaaatggcgggcggggcgttaacaaacgcggagcaggaaaaaccccgggggtccccaaaaaaaaccctttgacacaaaacccccttttggccaaaggggaaaaaaaaaaaagggcccccccctaatcccctttcaaaaaatttcgcaacctaaatgggaaaggggaccccccccttaaagggccaataaaagcggggggggggcgggtcccc

SEQ ID NO: 18961 - DNA, 434 bp, Sorghum bicolor
  Clone ID: LIB3480-013-P1-K1-F12
catgagcatctcatcctaaattctcactccatactagaagcacaggaagagttcagagcagagcaggctaatatctttgctgctctggacaagctgtacatcctgcacaatgccattctagccgagtctcgcttcatcaaggccttcttcttctattgctgcattgtgttcctcatctacatgctcaccagcgcaaagcaaacgttcggcatcaggggccagctctactttggtctgtgcattacgcttctgttggagattgggttgataaaaatcggtgccgacgacttcgacaagcagttctgggtcatgtccaaggtgttcttggtccgaatggtgttcctcggcgcttccactgttcagatcctgcactccatatacacctacagggactacgaggtgctgaaccatgggctgctccagacgctggtcga

SEQ ID NO: 18962 - DNA, 437 bp, Sorghum bicolor
  Clone ID: LIB3480-013-P1-K1-G10
gtgatggagctgctgcacagcaacctggaggccaagtcgcggctgtacaaggacccgtcgctgagcaacatcttcctgatgaacaacgggcggtacatgctgcagaagatccgggggtcgtcggagacgaacgccatgctcggcgaggcgtgggcgaggaagcagtcgacgaacctgcggcagtaccacaagaactaccagcgggaggcgtggagccgcgtgctggggctgctccgggacgacggcgtgctgacggtgaaggggcacgtgcagaagcctaccgctccttcctcggccggttcgcgcagcacttcagcgccgggaggcagacggagaagtacgtcaagctcagcgccgaggacgtggagaccatcatcgacgagctcttcgacggcaacgccacgtccatgacaaggaggaggacatgacaataataa

SEQ ID NO: 18963 - DNA, 432 bp, Sorghum bicolor
  Clone ID: LIB3480-014-P1-K1-A12
gctgggcaaccgcgactcccccgtggtggcggcgttctcgtcgcgggggccaagcaagcaaaaccaggggatcctcaagcccgacatcacgggccctggagtgaacatcatcgccggcgtgcccaagccggcggggctcatgacaccacccaatccactggcggccaagttcgacgtcctgtccggcacgtccatggccacgccgcacctcagcggggtcgccgcggtgctgaagaaagcacacccgacatggacgccggcggcgatcaaatcggccatcataacgacggccgaccccaaggaccgcagcgggaagccgatagcggcccatgacgggtcccctgccagcctgctgacgctgggcgccgggttcgtcgaccccatgaaggccatgaacccgggggctgtgtacaacctgacggcgctggacta

SEQ ID NO: 18964 - DNA, 293 bp, Sorghum bicolor
  Clone ID: LIB3480-014-P1-K1-A7
gttctgagaatgagagaagatacagaattcgttccctcgtttccctatcacacagaagtaccaaaagttctgttgtttggactattgggattcacattggctgtgctggctcctctgatcttaccttttctgctggtgtacttttgccttggttatgttggctaccgcaatcagttgctcaatgtgtatcgaacaaggtacgatacaggtggtttgtattggccaattgcatgcaacacagtcatattctctcttgtgctcacacagatcatctgtcttggtgtattggactt

SEQ ID NO: 18965 - DNA, 269 bp, Sorghum bicolor
  Clone ID: LIB3480-014-P1-K1-B4
cacgagggctcgggctcgcccctccgccccctcaccctcccgccgctcgtcgtccgacggcgcctctctccttcccgctcccagcagatttgaaatccgatttggaaccggagcaacaggcacgactacgttgagcacttgcgcgtcggccagagccagcccgccgatctgagccaagctgggccgccgcgctgctgtggaaggagttcgaggtgctcggcatccacgtctgccgcgccgagcccgtgttcccgccgcgcccagggtac

SEQ ID NO: 18966 - DNA, 454 bp, Sorghum bicolor
  Clone ID: LIB3480-014-P1-K1-B6
cagaaacgaaagtaggtcattccaattaccaagtatctttaacactgaacaagagagattcatgcagcactttgatcttcttctgaaagctcgagtccctgagcacatttccttctatagttttaaggaatcatcttcccgggcaggcatatcggatttggtgaaatacaacttcttcaaggaaattcagaagatagccccctctctaaggggcagtttcgcaagtgaatcagaaaaacttgccgaggtccgtcgtatagagcaggtagctgagcacaacaggatagccctaaatattatcaaccaagttggagctggcgatccatctctgagggtctcgtttgagtttacacaccaccctcactttgcagtggcagttgtgaagagatcatgattcaagtatggcatcatgtgccaattctttacccctcatcttggtagttatagcagaaaa

SEQ ID NO: 18967 - DNA, 473 bp, Sorghum bicolor
  unsure (1)..(473): unsure at all n locations
  Clone ID: LIB3480-014-P1-K1-C11
ctccgtccctgtccccggctgggcgactcctcatggcgtcgcctcctcccgtggcggctgccgcggggcctcacagcgtcttcgtgtacggaactctgatagcggaggaggtggtgcgggtcctcctgggccgagcaccgccttcctcccccgcaatcctcgccgaccaccgcaggttcagcatcaggggccgcgtctacccggccatcctccccgcccgcggccacgcggtgagcggaaaggttctcaaggagctcaccgacagggaactccatgtgttcgacatgttcgaggacgaggagtatgtgaagacaaccgtcgaggtctcactggctgatgcacaggagaaatcaatcgcctgcgcctacatatggggcaacgagcgtgatcctgacctctacggggaatgggattttgaggagtggagggaggtgcatttgaaggactaccttgagatgactcangaattcatg

SEQ ID NO: 18968 - DNA, 383 bp, Sorghum bicolor
  Clone ID: LIB3480-014-P1-K1-D1
gaacttggtcctgagttcaagaaggttgggtgcttccttagtcgcttcaagtcaatccctagcattgttgagcttgacagcttgaaggtttctggtgatgtttggtttggttctggcattgtactgaaggggaaagtgaccatcacagcaaaatctggcgtcaagctagaaatcccagacggagcagtgcttgagaacaaggatatcaatggccctgaggacctttagatgggaatcatcaaggaagctcacttcaccaagtggcggatcattttttgcatttttttcctgtatattcaaacaggctccatgacactatggagaatattcattgcccagttttgcttcaacataatcaagaaatattacatgtattttacttc

SEQ ID NO: 18969 - DNA, 407 bp, Sorghum bicolor
  Clone ID: LIB3480-014-P1-K1-D6
ccggcatggtggaccgcttccacgccgaggtgcgcctcctccgctcgctcagccacgaccacatcatcggcttccacaaggtgtggctggaccgcgacgccggcgtgctcaacttcatcaccgaggtctgcacctccgggagcctccgcgagtaccgccaccgccaccgccacgtctccgtcaaggcgctcaagaagtgggcgcgccagatcctggagggtctcaaccaccttcacacccacgacccctgcatcatccaccgcgacctcaactgcagcaacgtcttcatcaatggcaacaacggccaggtgaagattggcgacctcgggctggcggcgatcgtggacaagacgcacgtggcgcacaccatcctgggcaccgccgagttcatggcgccggagctatac

SEQ ID NO: 18970 - DNA, 384 bp, Sorghum bicolor
  Clone ID: LIB3480-014-P1-K1-D7
cgcacgcgtccgcgcagcccgctggtgatccacgacgacgaggaccagcagcagcagcagcagcagcagccatgttgtgctgcgacctgtccaccgcgtggttctcctcggcgctcgccagcagcgactggagcacacagtggcgcggaagctccggcctgtgctagggcctcgtggagcagtacttgctaacaaagatatcaaccggcatgaacacctttaaaagcacataataaatgaagctcgctataaaaattgagggctcattcaaggcattgttcgcctatatattcaaacactcttcatgacactatgtagaagatctattgcccgtgtttgcttagatgtaatcaggaaatatgacatgggtcctacttcagaacc

SEQ ID NO: 18971 - DNA, 406 bp, Sorghum bicolor
  Clone ID: LIB3480-014-P1-K1-E1
aacgtcattgtcaaagagcagtatgttgctggacttgatgtcgcggtggaccactcgagagtccgccttctcgtggaggaactcgagcccacgagctgcacttacggcaatcctcgctcgctgcatccatgacaggactggccctggctgagctcccttgacaccctttttaccatggaggatatcatgcaatgatccccttgttgcatactcataagcaagaacgcgggtgatcccttcagcgcagtatccaacgagttggacaacattctcatgcttcaatcttgagacagctgaaacctgcacaaggaattcttgatcaggctgtttgctggagtcaagcttcttcactgcagaattcgtcccatctttcagcacaccgaaatagactctggcatacgagccc

SEQ ID NO: 18972 - DNA, 389 bp, Sorghum bicolor
  Clone ID: LIB3480-014-P1-K1-E3
aaaaaaaaaaaaaaaaaaaaaaataaaaaaaaaacaaaaaaaaaaaaaacaaacaaaaaaaaaaaaaaaaaaaaaaaaaaaaaaaagggaaaggaaaaaaaaaaaaaaaaaaaaaaaacaacaaaaaaacaaaaaaaagggggggcccctttaaaagaaccaaactttacatccccttccttccaacgtaaaagtttttttatagggccaccaaaataaaattcacggcccgccgtttaaaaacaccgaaactggaaaaaccttggcgtacccaaactaaatacctttgaaaaaaatccccttttccccaattggcaaaaaaacaaaaaggcccaaaccaatcgcccttccaaaaattgccccaacctaaatggcaaatggcacccccc

SEQ ID NO: 18973 - DNA, 342 bp, Sorghum bicolor
  Clone ID: LIB3480-014-P1-K1-E5
cgcacgcatgggcgcaatgatctgagcgatcatcgacccaggcgcggacaccgtgcgcgtgctgctcgacagtgtgctgatacggcctggagctgcaacagaacgtgcaggacaaggtgcacaacaagcttaaccggatcgacggcccgagcgagtccgacaccgactcaaacacatactcactggcgtacatcaaggcagtaatgaaggaagtgctgccactgcacccgctgtgcccactgctgttctgaccgcaggtggccacctcagacgtagaacctagcgcgcacctgaccaccgccatcactaacatcatggctatcatgtatgacataacccact

SEQ ID NO: 18974 - DNA, 368 bp, Sorghum bicolor
  Clone ID: LIB3480-014-P1-K1-E7
gcgcagcccagccgaccagagagagacagacagagagagaggagcagacctgcccgtcgcaatggcgatgccgacgaagcccggcgacccgtcgcagcgctcgccggggcggagccccaacctcaacctgccctgcccgctgccgccggtcccgggcggggcgcctgcgccgccggcgcagcaccagtcgggcgccgggctgcccccgacgcgcgtgggccaccaccgtcgtgccagatctgaggtggccttccgcttcccggacgacctggccggcgccggggccggcggcttcgatgagatcggcttctaggacgacctgttctccaccttcatggacatggacaagatcgccggtgccgaccgtg

SEQ ID NO: 18975 - DNA, 313 bp, Sorghum bicolor
  Clone ID: LIB3480-014-P1-K1-F10
acctcacctgcgagtcgctgacgttcagggtgatgaccggcgaccaccgcaaggccacgtcgtggcacgtcctccccgaggactggaagttcggcgtcacgtaccaggcgtccaagaacttctaatgagtagccatcactctccctcttcttcaacctgacaaccgcctgcatcgcaagcagccatgcaatgcatgcatatatatttgattctttcgctgatcatgccctcagatacacggtgccggagtttaaatcttttttctttgttgaaaatcaatgtgcaaattcaaatgagaatggtcattttaacc

SEQ ID NO: 18976 - DNA, 338 bp, Sorghum bicolor
  unsure (1)..(338): unsure at all n locations
  Clone ID: LIB3480-014-P1-K1-F4
tacataatcagagggaagctctaaggagcctgtggaacattctctatggaacggggctaaaccagaagcagattctaaaattggctgcaaagcaagggttaaccgtagagggatgtcctttgcctagctcaagcccagatgttaccacgccaccttccttttcacctcataggcggnttccatcgtttatgtcatttcctagtccgcagtcagagtcttactctccgtctgcttgctttttccaacatggtttcagcactatgtctttgctgaaaaatcagcatgagacacccaccatatgtaggcaggagcacctcagttcttactacatgatgtct

SEQ ID NO: 18977 - DNA, 266 bp, Sorghum bicolor
  Clone ID: LIB3480-014-P1-K1-G11
tattttcaagcgaaccaagtgttttgcggcttaaagctcctggggcgatatttgtagatgaacacggacaacttgcgcgactaggcgaggttataccatgaatatggtgcaccttaaactgaatgtgacatcgcttacattgcatatctatgactgggagatcatgtacatcgccgaccttataggtcttaaactataactctctttcttgcactggaggtttaatatacaggacatgtccactcgattttacgaacatatgaaca

SEQ ID NO: 18978 - DNA, 331 bp, Sorghum bicolor
  Clone ID: LIB3480-014-P1-K1-G12
ctctacttttcttctctccctcatgcatacaccagagaaggagaacctactacatctcctccccatcctctaccatggacgccccttctttcccctccaaaatcctctcaattctctccatcaaagagcagctgcaatttgtttcaccgctgcaccattcattttgaagcgtaaacatgttgattgcgttgtcgtcatcctcttctatatagagctcatgggttacaaccaaggaatcattttcaccgtcccgggtgaatgcttgctgccgacatcaaaatcaaagatcaacccatcacccacacttgatcttgcagcaacgtcaccctca

SEQ ID NO: 18979 - DNA, 343 bp, Sorghum bicolor
  Clone ID: LIB3480-014-P1-K1-G7
tattttcaagcgaaccaagtgttttgcggcttaaagctcctgttaagatatttggagatttacacggacaatttggagacttgatgaggttattcgatgaatatggtgcaccttcgactgcaggtgacattgcttacattgattatctatttttgggggattatgtagatcgtggccagcatagtttagaaactatcactcttcttcttgcactgaaggttgaatatcctcaaaatgtacacttgattcgaggaaatcatgaagctgcagacatcaatgctttgtttggtttccgaatagagtgtatagaacgaatgggcgagagagatggtatttggacatg

SEQ ID NO: 18980 - DNA, 256 bp, Sorghum bicolor
  Clone ID: LIB3480-014-P1-K1-H2
agatcgcgagccgccccctttttttttttttttttatttttattttctctttcatgcaacatcatatctattttataagtgggggaaattcaattaactgaacgtagctatacaacataatgacttaaaaaaccctgacgttacccaactaaataaactggcagcacattctactttatccagctggcataatatataatagtctccctcctatcgcccttccaaacatttgctcatcctgaatggctaatggtac

SEQ ID NO: 18981 - DNA, 272 bp, Sorghum bicolor
  unsure (1)..(272): unsure at all n locations
  Clone ID: LIB3480-014-P1-K1-H5
cccacgcgttccgccgtagcttccgtccgnnacgccgcgggccgacacgcacccgctggcctgacccgctccggcctgcggcgaggacgccgtcnccgccgcgcccacggcggccggcgcctcgccgccgatcccgctgccgacgggtgctctggtcatcgatatcgagggggcgccgnctttacctgcggaggcggcccccgtgctttggtgccggatcttccaccttggcctcgattactactagtcggcggtgccattttccgaggtga

SEQ ID NO: 18982 - DNA, 145 bp, Sorghum bicolor
  Clone ID: LIB3480-014-P1-K1-H6
acggataacaacacaacacacacaaagatgaacagacctgaaagcctgttttatgggatttcctcatgaaactgtcaatggaaaaggtatatcattccttcctcattggggtttaactaccagtctaccaccttattctggtttc

SEQ ID NO: 18983 - DNA, 181 bp, Sorghum bicolor
  Clone ID: LIB3480-015-P1-K1-A3
aaaaaaaaaaaccataaaaaaagttatgctaatgatagaaaaatactactcaatgccaatggcctcatttcaaatgtatagggattctgtggtggaggttccagtttatctaatgtgatgggccggcgccttaagggtataaaagcttctcacgagtgcatccaatggatcaactttttaa

SEQ ID NO: 18984 - DNA, 351 bp, Sorghum bicolor
  Clone ID: LIB3480-015-P1-K1-A4
ggaaaggctcaccctcgaagccgcatgcctagtgccgcctatttctgtctgcgttcttcctccttgcatggaggtagtagctgtttactgcatggtcgttgccgccgtagtgcttgataacaacggggccgacacggtcttcagcactaccattcgtatcgtaacagttagcattgaggagagagaagagatcaatggagacgttcccacgatcacctcttgcgcacgcaacgaatttgagttgttcaccactgccgcgtcctacaagagccctatcactcgcaagaagcgcggcgcgttcgcccttttcatggcgatgtttctgtcgtttggtcggagcgacagcattaa

SEQ ID NO: 18985 - DNA, 495 bp, Sorghum bicolor
  Clone ID: LIB3480-015-P1-K1-B4
ccaccaccaagaacgatcaccggagctgcgacgatgtatccgagcgacctcatcggagggctggaccgcctgaggcagcaggcggcaagagccgcggcctcgactgtctcgctggccaagccagcggccggcgccgcggttgcgggtctggcctcgaccgtctctctggccaagccggcggcgggcgccgcggtggcggggctagcctcgaccgtctcgctggccaagccggcggcgggcgccgcgatggctgggctaacttcgaccgtctcgctggccaagccggcggcgggcgccgcggtggcgggtctgggttcggtgacgcgtcacgctgcggggatggtgtccacccgcgagggggcggtgaagaccgcggcggtggttttttcgggcgccgctggcctactttctgtggcaacggccgtcgttgtccgttcgccgcctgcgcgtcatgaagggcctggcgccgagtgttcttcatttccgaccgcgttc

SEQ ID NO: 18986 - DNA, 491 bp, Sorghum bicolor
  Clone ID: LIB3480-015-P1-K1-C11
gtgtggtagagaaatattaaatataaatagtttgctgtcctacatgcatttttacatatatttatgttctttctgcaaatgttagtaataacaaagttgtaggatatggaattctctgatctttggttaaatttcataatttttggacttaaggatttgggtatatgaaaatgtgaaccttgctctctcaattctcgagcagattctgaggtctgttttcaactatgggttaggctatcttaaaggcatggtaaaaatatgtcttctttatgaaagttgtagatattagtctgtaggttctgaaaatgattttggtttatggattaaaagatataaaaaggtgaagtaccagtgctgcatttgacttggcactttgcatgttgtttggcttgtatgtcgggctagagaatatgagtgcttcacctacttgtggtatttggtaaaatgagttctctctctgatattataatacctaataaacaggtggcaat

SEQ ID NO: 18987 - DNA, 436 bp, Sorghum bicolor
  Clone ID: LIB3480-015-P1-K1-C7
ggcgcacgaccccgataaccagttcaaggtcggcgacgtcgtcgagctccgcccctcccgtcccatctccaagaccaagcacttcctcgccatcccgctcccaccccgcgacacccgccgcaagtcccagctcctcccgccgctccagtcccagtcccaggccggcgacgacgacgaccaggcgccgccgccctcgccctcctccgagtgattgattactgccgcccgcctatgcattggattggattggctagctagcttattgtaatgccgtcgtatcgtatcagctcctctcctctcaatcaaacgtccaatgctttgtttatttgctgcttcccaattccagtgctcctcctattatatgatccatgcccagagatgtcaacttagtttgtctgcaaattttctgtaatacaaaggatttcctttcattttc

SEQ ID NO: 18988 - DNA, 513 bp, Sorghum bicolor
  unsure (1)..(513): unsure at all n locations
  Clone ID: LIB3480-015-P1-K1-D11
ggcgccgccggcgccggcaggcccttcacgcgccaggagaacaccgtcgtcaccacctgcgccgtcgcgtgctactcgctggcgctctgcgggttcgggtccttcattctgggcctcaacaagaggacgtacgaggcggccggagtggacacgccgggaaatgtgccggggagcgtcaaggagccaggattcggctggataaccggcttcctcgtcgccagtagctttggcggcctcctcaccttgattcccctcagaaaggctttggtcatcgactacaagctgacatacccaagcgggacggcaacagctgttcttataaacggcttccacacacctcaaggagacaagaatgcagagtgcgtatggagatcttctctcctgttcattaatggttatataacagctagaatgaagccgattattagacagtagtatgtgtctatagccccatttggtacagcttcaccaccagctngatgagnctttgtgagctattntttttaccaaaca

SEQ ID NO: 18989 - DNA, 448 bp, Sorghum bicolor
  Clone ID: LIB3480-015-P1-K1-D12
cgagaacttcacgcccaagctctccgacttcgggctcgcggagctcggcaaggcgggaggcagcatgccggtggcgtcgcccatgatgggctccttcggctgctgcgcgccggagtacgaccggaccgggcagggcaccatgaagtccgacgtctacagcttcggggtggtgctggtgcagctcatctccgggaggagggccgtcgacaccagcaagccggtggacgagcagaatgtggtcacctgggccatgccaatgttcaaggaccagaagagataccatgagctggttgatccactcataaagaaggaatacgctgccaaagcgttgaaccaggtggtcgccatggctgcgatgtgcttgcaggaagaggactccgtgcgaccactgatggccgacgtcgtcatgacgctgggcttcctcacggcgatgccgccggatccaccg

SEQ ID NO: 18990 - DNA, 371 bp, Sorghum bicolor
  unsure (1)..(371): unsure at all n locations
  Clone ID: LIB3480-015-P1-K1-D2
gttgcacatgagcagttcgagagcagacgtgtgccagaggactgaatataggcgcagggctgtacctgcacaatacatatacattccaaaggaggcctgaataaaccactgggtgctcatgcataacttgacatgaaggttggaaggaaacgcatatgcaactataacgctcttgcatagttacaaaactagcaggaaacaacaagcgcgctcttgaaacatagcacaattgtgcggcttacactagatgggttagaaacaaaatctaaatgccaccttaaataccattatcctagtgcacgaattcgttccgtgtacattcttgtgacgaactgcataaagtttttttactaaatcatatattgttnttc

SEQ ID NO: 18991 - DNA, 393 bp, Sorghum bicolor
  unsure (1)..(393): unsure at all n locations
  Clone ID: LIB3480-015-P1-K1-D5
cggaaatggcagtgaccgccgcctcgccttctggcttgtcgtcgatctcgacgccatcgacgaagaaaatgcgcttgcagaacctgttatgaccacggctgtacctctcgttgcagttgaagcataggttttggcggcggcgttccgccatttcttccggagagaggcgccgctgtgttccctcgccccgacccggctgagaggccaccggaggtgctggcagctgcaagatcggtggtggcgccggtagtgcaggtcgtggtgctggcgccggaggggtaccgcgcggnggcgcccgaggggggtgggaggcagcctctcggcctccatcatctccacctggcgtgcgaggctcatggccgccgccaacgtacccggggttgtggatgcgga

SEQ ID NO: 18992 - DNA, 419 bp, Sorghum bicolor
  Clone ID: LIB3480-015-P1-K1-D8
cgccaggttcctgctcaccagcaccagcgaggtgtacggcgacccgctgcagcacccgcaggtggagacctactggggaaacgtcaaccccatcggtgtccggagctgctacgacgagggcaagcgcacggcggagacgctgaccatggactaccaccgcgcagccaacctcgaggtgaggatcgcccggatcttcaacacgtacgggccgcgcatgtgcatcgacgacggccgggtcgtcagcaacttcgtcgcgcaggcgctgaggaaggatcccttgacggtgtacggcgacggcaagcagacgaggagcttccagtacgtgtccgacctggtggagggcctgatgatgctaatggagaaggagcacgtgggcccgttcaacctggggaacccgggcgagttcacgatgcttgagc

SEQ ID NO: 18993 - DNA, 510 bp, Sorghum bicolor
  Clone ID: LIB3480-015-P1-K1-E11
gcgccatgagcgttgcctccatgtcggctgggactgggagctttgcaagcagccttcttgttactgtggtgatgaccttcacctgtagaggtggccggcttgggtggatacctcaggatctcaacaagggtacaagggtcatgtggactggttcttctacctcaatgcagcgcttaatgctgtggatttctttgtcgtttgtggtgtctgccgagaggtataggccggctccggtgatcatacatggacttggccttcgtgctgctgggggtgagttgaaaaaaaatgaataagattggattggtgggagggtttaagtggttaattgtcccacctccaccggaagctatcggattagaatcgtgtgcgcttaattagagtttgcatagctagttggttttcatagcatacgctcccttagttttataaaataaaaagttagttatcccttgatttttggtggccatatatagccaaccattgacactagttatctaatttgtaagatat

SEQ ID NO: 18994 - DNA, 365 bp, Sorghum bicolor
  Clone ID: LIB3480-015-P1-K1-E3
attgcagtgcaatcggaggctggatttccggtgaaatcagagggaaataattgatttccgtgtggatctaggccccgccgccgcatgcattttacagctctagtctaggatgctggtgcttttgtttgccagcgccggtgcgatattcttgctggcgactcactcacaggccatttatttctttgctgcaggctctgcttcacagcgtgacaagcctggcgaacaagctgcacccagtcgtcgacgcggccgacgggtctcccgcagcgctcgaggatgctggcggccgacagctatgccgcagctctcgaggatgctggcgggcgatacctatgcaccggcttcactgacgacgtcgtggagct

SEQ ID NO: 18995 - DNA, 445 bp, Sorghum bicolor
  Clone ID: LIB3480-015-P1-K1-E4
aaacgtgattacagttatgtgctttcacttaaaaaaaaaaagaaaaaaaataaaataaaaaaataaatataaaaaaaaaaaatataatgcatatttaaaaatataatataaagataataaaaattaaaaaataataaaaaaaaaaaaaaagggcccccttttttccgccccaggggaaccccggccttcccccctttggtgtgaaccgggcccttgcccatggggtccaaaatttcccgggggccctttaggggcatttccccggatttcccttggcgttccccgacgggggggaccttttggggggcccccccgggcttccctgggaaattcccctcccccggttgggccgggggaaaaaaaacttccctttttttttcccacccttggaaccccggaagtttttggggcccttccagggccgtgttttggaaacccccccccg

SEQ ID NO: 18996 - DNA, 535 bp, Sorghum bicolor
  unsure (1)..(535): unsure at all n locations
  Clone ID: LIB3480-015-P1-K1-E7
gactgccaagaggaaagcctgcccaataaatacttagaatatctttcatgcatctccaaggacatagaaacattttgctggtgcaagcaaccaatggggaaagtagacatcgatactagcagaatggaggaatactcacacagctatactgaaccgctgatgttgactggtgacacgaagagaggttgtacaagggatactttcagcagctataagctgcaagtgcttaccgtgctcaaaacaattgctataaactgcaacagcttaacatgctgaacacttgagctgaacatttgtgaagcttacagaggaggatcgggttcttggccagctgccatattccggactatggattcaactgtgcttcagtgttgtcttttttggataattcgaatcactttgattcatttgaatcagagaaataagattaaccctatattacctcaaaaaaaaaaaaaccccgccaccagccctaggctctgtttgaatgtaaaacatttatagattttttttaaaaattaccatggtntcttct

SEQ ID NO: 18997 - DNA, 162 bp, Sorghum bicolor
  Clone ID: LIB3480-015-P1-K1-E8
tcgtgcaagcgacgtgatagctccactatagcgtcacctgaatctaattactgcacattgctctacaacatacacgcatgggatatctccatcctgaaacaccttaatccgcacgacgcacattctctttacatgcgtttgggtactaacaaatagtcccaa

SEQ ID NO: 18998 - DNA, 106 bp, Sorghum bicolor
  Clone ID: LIB3480-015-P1-K1-F2
gctcatacaaccctatcctcttctatattgatccccaaatacaatattctggcctccgttttacaacttattgactggaaaaaccctcccatcacccatcttaata

SEQ ID NO: 18999 - DNA, 424 bp, Sorghum bicolor
  Clone ID: LIB3480-015-P1-K1-F8
ctgactcgtgctcgatgacattgttaacactgccaggccgaaatctgcaacatgataatcatgatggctgtgatcaccttcaaagtgctgcatatctgtgcagggggccttgaatccttaaatgtgggaatttgtccaagattaagtagtctgcgcattgaagacccaaatatgcctatattgctgctgaacggttatggtgatctttctgagggttacatgacaagtcctcgcttgacatcaatagatgcctttgtctagcaggcaggttgcggatgattcactgactcagatggcataagcatgtgctctgatagaacatcttatactgtgatgatgcctattcataggcactgatggattgtcttgattgcgttgccttcctgagctggccttgcttgacctgtcttatacatttttgatc

SEQ ID NO: 19000 - DNA, 291 bp, Sorghum bicolor
  Clone ID: LIB3480-015-P1-K1-G9
tcgttcgttatgggagtcgcaacgcgacccaacgagcactccaaccaggcgtagaacgagagggccggctctatatgatcacaaggtaaggtccatgtgcaggccacactgtaactttcttatacgggcacctaaattaaattcattgggcgccccttaacaacactgcaacggggaaaaccgaaaaactccccaacttaataaacttgcggcacatcccactttcgccagttggagaaatagccaataggccgggagccgtcgaccttacaagagccgcacagcttcgaa

SEQ ID NO: 19001 - DNA, 323 bp, Sorghum bicolor
  Clone ID: LIB3480-016-P1-K1-A4
ggatcaacgaccaccagaagagccgcttcgtgaaatgcgtcgtctcctccatgttcaacaccgtcgccggcaagaagatcgccgtgctcgggttcgcattcaagaaggacacgggggacacccgcgagacgccggccatcgacgtctgcaacggcctgctcggggacaaggccgtcatcagcatctacgacccgcaggtgacccggggagcaggtgtcgcgggacctcgccatgaacaagttcgactgggaccacccgcgccacctgcagccgctcagcgccaccgacctggccaagcaagtcgccgtcgcgccggacgccta

SEQ ID NO: 19002 - DNA, 477 bp, Sorghum bicolor
  unsure (1)..(477): unsure at all n locations
  Clone ID: LIB3480-016-P1-K1-A7
cggcaacggtggtgacggatctgccttcctcgcccgcgactgcgcgacagcggtggcggggccctccctcccagccaccaggagtgccacgttgtgcaaatgcgggcggatccatctccctttccccttgactgtgccctcctcggggtctcaggccgccaccgccctacaccgcgccctcctcggtcgccccgcgcggcaggtccctgtggcggcagcaccagcatcccaacgccctggccatggggtgggggccggaccaaggtgagcgggaggcgcagatccgttgcatgttcgccttcttcgacaccgcgaaacacgagcaactccgctaggcacagatccagcggcctggagactctgcactngggtccaatgagatcgagtcgtcgttgtccccgactctgagagccccagcgtcgccgcccctcgggccctcctgttctgggtgcatttagctgacgctgtctgcacgtc

SEQ ID NO: 19003 - DNA, 462 bp, Sorghum bicolor
  Clone ID: LIB3480-016-P1-K1-C11
ctagaactagtccaaggagttttcaattacaagcatgaaaggtggttaccgtcgagtgttccagcggcctattggttttgagtgggaactcatgacttacacagatgacagttcatctttagcagaaactgatctggatgttctgtccagaaccaagcctaaagaagcaaatgagctttctaaccaggagtcgcaggataagctggaaaaggctcctgatacctctgtgccaactaatcggagtagctcccaagaaaataagcttattggctgcccagacacatcaccagagaaattggccttaaaattagcatttactttaccagcatcatgttacgctacaatggctatccgggagcttctgaagacttccacttcggttgcatatcagaaaacactcagctgctaaattttgttcggaaggacattctttcttataattacattgtgctgcttgtgttt

SEQ ID NO: 19004 - DNA, 154 bp, Sorghum bicolor
  Clone ID: LIB3480-016-P1-K1-C8
acggagttgattctttatctcgggcttttcggttggtgagcgtggtgcgttgtctgtcgattgtctttggctgactggctggttcaagaggacttctgaaaacgagatttaaaaagttcgcatgcgcgttaaaaaaaaaaaaaaaaaataaata

SEQ ID NO: 19005 - DNA, 432 bp, Sorghum bicolor
  Clone ID: LIB3480-016-P1-K1-D10
ggcagtttgcagccgcctataagacgtgggtcgatctgctcgatttgattgacgccaagagcggcaacatcaatatggagaacttcatggttgacaacacagtgagctctgcagtcttatcatacttagtgacaagaccattgtcggcggcggctacggatggccccaatacgatcagtggcatcttgaacggggtcatcgagcaaaagctcaggatcatccccaacaacatcacgtgaatggctccatctttcgttcttacatgccacaatctcaaaacttgaagacattactacgcgcatgcattgatcagtatctatgtttcattgtttcctgtccatgtcgtcctttgattgattgatctacttactgttggcaggtggcaagctgtgtctttgcaggtctttgacgccttcaccaatgcttcatgaa

SEQ ID NO: 19006 - DNA, 169 bp, Sorghum bicolor
  Clone ID: LIB3480-016-P1-K1-E10
gtctgctgcacctctaagaagactacgactaccaacctctccggaattacatgtggtctgaccgtctataaagatcgcctcagggtggaacgtgaacgccaaggtcgtgttcaatactcgtctacaagtactggactaacaacttgcacatacaggatgattctacaac

SEQ ID NO: 19007 - DNA, 417 bp, Sorghum bicolor
  unsure (1)..(417): unsure at all n locations
  Clone ID: LIB3480-016-P1-K1-E7
cccacgcgtccggcaacctccacctgtggtcatggaaggctggtcctcacggcattgcggaatgggtgcaaggcagggtcgtaaagctgaggatgctgttccccattcttaacccactggcctcactcaatgtgattggcttccaagagggcacagataccattttcattagtatagatatggatgtcttcgcagtgatgctgaggtcggagcaggtgaagaaggtaggcaagacggggtccaaatatgccatggcaccctatgtgagcttctacactccagatcttgcaaagggcagattgctatcaccatgaagatgcagtgatccatccattaacatgactgtggtactattgactnttcaaggagatgatgagtcaagtgttttgttttcagtttggatggtttatggaaaaa

SEQ ID NO: 19008 - DNA, 338 bp, Sorghum bicolor
  Clone ID: LIB3480-016-P1-K1-F11
tgcgcctccggccggccggcgtcgcaagacaggccagaggaagaggcgagtaattaagacttcatcatcaaggtcgacgacgactgatccgtacgtctcctccgatccgatcgatcctcatgaagcagctatagcaatgcaacctttaactcgatcgatccatccagctttctatatatgattaatttgttacatatatataacttatttgtatgtaattgtaccagtagcaatccacacgcgtgcgccgcatgcaatgtaccttgaactattcatgcgtacgcacggtgtataggaaacgtacgtaccttagcagacaaaaaaaaaaaataataaat

SEQ ID NO: 19009 - DNA, 288 bp, Sorghum bicolor
  Clone ID: LIB3480-016-P1-K1-F8
aaagacaagagagagcgggccaaatatggcttcggaaatgtcctacgctgccgtcggcgtcgtcatcctctccgtcctcgtcgtcgtcgccgcggcgtccgcagaccccacggcggcacctacggccgcgccgtcgtcgagcaagctctcgctcgaagaggcgtgcaagcagaccgcggggcaccacgacctgtgcgtggcgacgctgtccgcggacccatcgtccaagacggtcgacacggtggggctggcccggttggccattcaggctgcgctatttttcgcgtt

SEQ ID NO: 19010 - DNA, 423 bp, Sorghum bicolor
  Clone ID: LIB3480-016-P1-K1-G9
aaaaaaaaaatataaataaaaaaaaatatacaacaataaaaaaaaaaaaaaataaaaaaaaaaaataaataaaaaaaatgagagaaaaataggaataaaaaaaagaaatcaaaataattataataaaaaataaaataaatggggggcgccttttttaaaggatcaatttttcctccccttatcaaccattttttttctttttttttgggccccccaaaataaattacctggccttttttttaaaaattttggaatggaaaaacccttgtttttcccaattttatacccttgtaataaaatcccttttaccacattttgtaaaataaaaaagagcccccccctattttcttataaaaattattccccttctttattgcaattgtgtccccccctttttgcggccaatttatcccaggttttttt

SEQ ID NO: 19011 - DNA, 159 bp, Sorghum bicolor
  Clone ID: LIB3480-017-P1-K1-A10
cggacgcgtggctgcgtatggtattgtgacacccacgtgatctgatacagaacttacaggaggctgaacttctgtgttacatacatagaacagggcgggctgtgtcgatttgccacacattgtttacttttaaatcaaaatgaactgttgttgttgcgg

SEQ ID NO: 19012 - DNA, 613 bp, Sorghum bicolor
  unsure (1)..(613): unsure at all n locations
  Clone ID: LIB3480-017-P1-K1-A11
ggatcaatcgccgcgcaagcccaagcagatccgccggcgagcgagcgcgcggcgcgcgggggcaagggcaatgggcgtcgtctcggcagcggcggacgcgcttgtcgcggttttctccctgaccatcgccgtcgcggcgccgctgatcgacgcgcagtccgtcctcccgcacaccctctacccggcgccgctcctggaactcaagcgctggtacgccgccgagttcggcgactacctcgtcgcccagccccccgccttcttccgcggcctcgtctgcctcgagctctccttccagtggccgctcgccgtcgccacgctctacggcatcctcacccgccgccgctgggccgncacaaacctcctcattggccggcgtcgctaccctcacatccatgtctgcagttcttggtgagattttgggttcaggcaaagcaacaccaaagttacttcagatgtatgctccttttgccgtttttgctgtcattgccattctacgtggactttgctcatgctctgggcgcactactgctggttcatcccttgggccttctgcccggaagaagagggtctagatcagggacactnggagaattttttggtttcagacagagtg

SEQ ID NO: 19013 - DNA, 336 bp, Sorghum bicolor
  Clone ID: LIB3480-017-P1-K1-A3
ccacctcctgcataaacaactgggttcacgccttgctgcggcctgtccggatggacgggcagattgactggtcgattgcttgtgaggattctaatgacgatatacgtacgaatcatctgaaaatacattcctggatactggacttggttcttgatatgatccctgaaaagatcactggagagttaagagctgtcacttaaagccgcgcttacagacgctggcacggatgctgtgctgtagacgatgctgcacagtagggagcacgactccgagatggacttcgccatggcgatggacaaagagacggagaacgacatgttcatgtacatgctcttg

SEQ ID NO: 19014 - DNA, 572 bp, Sorghum bicolor
  Clone ID: LIB3480-017-P1-K1-B9
aaaaaaaaaaaaaaaaaaaaaaaaaaaaaaaaaaaaaaaaaaaaaaaaaaaaaaaaaaaaaaaaaaaaaaaaaaaaaaggggggaaaaaaaaaattaaccaaaaataaaaaaaaaaaaaaaaaaggaaaaaaaaaaaaaaaaaaaaaaaaaggggaaaattttaaacccaacccaaaaaaaaaaaaaaaaaaaaaaaaaaaaaaaaaaaaaaaaagggggcgccctttttagggatccaaattttcctcccccgtctttccaattaaaaattttttttttggggcccctaaaataaattacatggcccgtgttttaaaaccttgggcctgggaaaacccttggctttcccaaatttaattgtttttgaggaaatcccctttttcccagttgggtttattacaaaaaggccccccccgttccccctttccaactatttccccaccttaatgggcaatgggaccccccctttaaccggcctttaaaccccgggggttgtggggttacccccaagggtacccgttaattttgcagggcccttacccccggccttttggcttttttcccttccttt

SEQ ID NO: 19015 - DNA, 628 bp, Sorghum bicolor
  unsure (1)..(628): unsure at all n locations
  Clone ID: LIB3480-017-P1-K1-C2
gatacgatgacgtcgatgactcttcttcatgtcaagatagaactccaaaagggcatcggagcaaaaggacaggacctggtattcagaatgacatagcagaaaatatagtgactggaggatcaaatgtgagaaggatagctagatgctcttcagatgttagtcagagccacttatacaacacaaaaatagcagacttaatcagaagaaacaccacgctcgaagaccagctttcgaccgcgctggcaagcaaagaccagctagagaagagcttatcgtcggtcattcacagcagagaacagctggagaagatgcttgccaacaaagacaaggaggctgagatgctgaaagagaagatagcatgcttagagctggcgcangaagagtcgaacagcctctcgaacacggtgcacgctgataatgtgcgccttgaacgtgaagtggcattcctgaaggccgtcacagatgaaacccagaaggagctgcattccactcgtagggttntagcaggagaacagtcacgcgcgttccagctccaggttgaagtgttccatctcaagcagaggctgcaaatactggaggggagatcaggaacacccaccaaacaacctntataggctgtagtggtcac

SEQ ID NO: 19016 - DNA, 334 bp, Sorghum bicolor
  Clone ID: LIB3480-017-P1-K1-C4
aaaaaaataacgtgaaactataaaaattgaattcaagggagaaaatgtcaaaaagactgcaagataacgaacacaggcacagggatgtcataagtccatgaggaaaaaggccttagggtcgcccgacttgacgattcttggctatgtatctcgctgggaaaccttttcctagccaactgtctccatataactactcactgtctccgattaccacgttgggatgtggcgaaccgttgtgctctctgttccaaaaagatccactcccttttatggtttctgggagcttcaccaattgttaacagctatggaggttgttctctagcatacgctctgc

SEQ ID NO: 19017 - DNA, 320 bp, Sorghum bicolor
  Clone ID: LIB3480-017-P1-K1-D10
actagttctagatcgcgatctagaactagatttttttttttttttttttttctttttttgttttttttttttttggtggtttttttttttttgtattacaccgacatccccacaggaggacccaagggaaccaaccccaggtgcccccgaattagacgtcataaagcttgcattaggctacataaagggaaggtacgggaccaacgcctaaaacggcaaaaccgggaaaaccccgccgaacccaactgaaccacatggcggaaatcccccttatgaacactggggaaaagcgcaaaagggacgcaccgaaaacagttgcc

SEQ ID NO: 19018 - DNA, 226 bp, Sorghum bicolor
  Clone ID: LIB3480-017-P1-K1-D8
ttgcatgcgacgttgtatgtcttgtgttggggggcctaaatacacttgaccggacgtggaaagacaacgtatgcactgtgaaaaccgtgacatgacctaactgattattctgggaggacatgcacctttcgctagctggacatataccaaagaggcttgaacaggcaggcgctcccaacagttgaccggactagatggaagacgtgactcgccctgtaacggatca

SEQ ID NO: 19019 - DNA, 496 bp, Sorghum bicolor
  Clone ID: LIB3480-017-P1-K1-E11
tggagatccgccgccgcgcgcgcctcccggagccggaggacgacgacgctgccgtcttgctgctggacgccatcgacagcgatgctgaacgggctgtgatcctggagcggctggaggtgcagatctcggaggccaaggacctcgagttcagccggaaggacgtgctggagaagatggacaggtggcaggccgcgctggaggaggagtcctggctcgaggagtacagcagaaacgagaacagatacaacgtcggcaaagggacgcatctcgtgctcaagcgcgccgagaaagcgcgctccttggtcagcaaaatgccggcaatggcggaagctctgatggcgaaagtggttgcgtgggagaaggagaggggcgccaagttcgagtacgacggtgaggtgctgctggacatgctggaggactacggcaacacgaggaaggagaaggagcaagagcggaagcggcagcgggaccagcgccggctgctgcagcaggtgca

SEQ ID NO: 19020 - DNA, 314 bp, Sorghum bicolor
  Clone ID: LIB3480-017-P1-K1-E3
aatacaatgcaccctgcaggcggccgcgatcgcggagatcgtccatgctcggtataaccgagtgactactcggatcatcatactggactgtgacacttgatgacggagctgcaccgaagggagagccctgtataccgggctggggcctaggcacagcgaccgccgacctgtcacgtcatcactgctggatgagggacaccagaaccggtcgactcgccatgcactgcatgctcgacttgttaatacatgcctacttagcacacgaatggccagtggagaacctagacaagcacgtacaataccccttatgcaac

SEQ ID NO: 19021 - DNA, 591 bp, Sorghum bicolor
  Clone ID: LIB3480-017-P1-K1-F4
gctgtatgagcttgtggctcatctcccagacaaggctaacaactaccttacaccagcactctctgttttagagaagaatacctgattgatgtgctaccagactcagacatgcaatatacgggtcatataatgtgtatatttcctcctcttgtaaagccatacgtttttcttatacaagccttgtgattcacatggtatgtcatttggcctttttgtaaagacgattgcagactatgttaaaaaaatcgttgcacatacttcagacattaaaggttgtggaagccgagtcacggcaagccgcccttggtgagagcctgtttggcacggcttcggccggctccggctcctctgacagctgtagctacacgtcaattttctctctcctatctttctctctcactgataagagaggagcacccggagctaaaaaaatcgagtttctttggctcctgtttctgtgtgctacagtacagctacagtgtaaaagagagataagtttcatacctctcccatttgaacagaattataaattcagattttagagtgaagtatttgaacagaattatttagaaacacatacttttgtcttgc

SEQ ID NO: 19022 - DNA, 477 bp, Sorghum bicolor
  Clone ID: LIB3480-017-P1-K1-G10
aagaaaactgtcatgggtgattcctttttcattgcagtatagtactaggttagctttttaataactgtcaaaaatttacagaagatatcgtagtcactctccataaaaacgatctcttcctgcaaaacattttttttacttcacaggctatgactaaaacctgacagcaggaaagaatgtacaggccaagcatgttgagagggccgccgggcgttcatcgggatgctgcggccttctccatgtagctgtccagcatcttgttctgcactctgccgatgaacctgacgcagatgggcggcgtgacgtcgtacctggcgagcaacgcgtaagggatggagaagagcccgtccccgcatatgagcccggacgcaaacacgggcgcgaacacctgcgcgtcctccctgtccgccctgttccacatgtagaggatcaggctccccacgcacatgtcgatggacacggccggcaccagcagga

SEQ ID NO: 19023 - DNA, 642 bp, Sorghum bicolor
  unsure (1)..(642): unsure at all n locations
  Clone ID: LIB3480-017-P1-K1-H10
acaagaacagatagccaccacttacagttgcgtgatgtcaaggtgcaaaacaatgaggcgaggttcattctgtactccatatagtatatcctgattggcccgaccatggagtgccaactaataccgatgctgtacgacaaatctggaaacgactgcatcacattccaacggaacatcctatagttatccattgcagtgcaggtattggaagaactggtgcttacatcacaatccatactacgattgagagaattctccttggagataaaagctcatacgatcttgttgaaactgtaaagaattttagatcccaacgaactggaatggtccaaacagaggaacaatacaagttctgctaccaggcaattgctgacgagctgaaagacctgctaaattcagatcattgagctgtaggaagatctgcagtgctgttggttattcggaatggccgtatttctgtgtgcaccatttttttgtgtggatctcttgataattgatcggctgcgtcaagatcatgatggcaccattattccaacatgaactccactagatggttaccaccacctacttgagtgtaaagaaccatangaagcttcatttgtgagcttnttttggatatgaacaaaacaatgtttggaactg

SEQ ID NO: 19024 - DNA, 538 bp, Sorghum bicolor
  unsure (1)..(538): unsure at all n locations
  Clone ID: LIB3480-018-P1-K1-A10
tatgaatcaatcgtacaattcttcaccagtcggaggtaatattggtggaaacggtcgtggtaacgatcgtaattctgaacgaaatatggatcgaaataatgaccgaatgggagatcttatgggtggtggtggagccccgggtggatatcgccacaatcccaatcgtgaacgcaataatatgggaaatcataaccacaaccattataacaaccataatcgctataataagcacaataacaacagtccgcatccgcacaacaattataacaataatgcggtaaaacagttgccgccgcggtttaaacaaagtgtcatttcacctcaaacaaatcagcaatcgccagagacatttgacactttccggccaccaataaatagcttactttacaaagcaacgaattccaatcgacagactgcacaactgccaatgtcgcagcagccacgtccgnctagtgcatcatctgtggaaacaactggcagtactggcaccacanactattcaacaaatgtaaattcgccgaattcaaactatcaatca

SEQ ID NO: 19025 - DNA, 463 bp, Sorghum bicolor
  Clone ID: LIB3480-018-P1-K1-A6
cggcacacgcatcaagattccagaaaaggccgcgcagccggttcacggggtcccgtctgctggtaaaactcaggcagccggcggaggatcgatcacacgtacggcgacgggacgcaagatggtcgccgccgtcgtcgcgctggcgctgctgctggtgctcggcgcggccgaggcccagatcctgccgaccccgtgctgccgcattgactgctgcgacggcaagccagagtgctgcggtcccggcaccgggatgcccgtggtggaacgcggcacccccggccgtgtggccttcgccggcaacgacgccaagcttcggccaggtgggcgcctcgcaaggccggcgccggaaactagtataaactaggtgtccttgtgtcctagtcccgtgcacatctaagctactactagagtgtcctaggcttcggacgttgggagctgcttctggtgtctagtacgtaagcac

SEQ ID NO: 19026 - DNA, 465 bp, Sorghum bicolor
  Clone ID: LIB3480-018-P1-K1-A8
gcagtagagaaggaatttaatgtacctggttttgcaaagatggtcattactgctagcaacgacctgaatgaggaaacaattgatgccctcaacaaacagggtcatgaggttgatgcctttggaattggaacttaccttgtgacgtgttattcccaagctgctcttggctgtgtctttaagctagttgagataaataatagacctcgtattaagctttctgaggacgtggcaaaagtttccattccgtgcaaaaaacgatgctttagactgtatgggaaagaaggctacccactggtagatatcatgattcgtgaaagtgaaccatcacctaaggcaggagaaagaatcctctgccgccatccattcattgaatcaaagagagcatatgttgtcccccagcatgttgaggagcttctacagtgctattggcctgggacatcagataaacctagagcagagctcccc

SEQ ID NO: 19027 - DNA, 360 bp, Sorghum bicolor
  Clone ID: LIB3480-018-P1-K1-B10
cgtacgcataggctaccaacgcctctccaaggactacctcacgctctcattcattcaagggaggaagctgctgttgatactagggagcattatgtagcacaaggtcctggtctactatttaatcatcaaatcactcggattgtccaaatgatataacgtactatccgagttcatttgtaacaaccgaactgaccattattctgttaaggcgctgaggaacagggaacatggcatgcagattcatttgaacaattgccacatggagacaataatattctactccatgaaggatcgattgctcactatggacttactgttcagagtgtaggaatttaaggggacatacttaaagccaacaat

SEQ ID NO: 19028 - DNA, 410 bp, Sorghum bicolor
  unsure (1)..(410): unsure at all n locations
  Clone ID: LIB3480-018-P1-K1-B11
gtcgtccaccatagccccaaggatgatcacggtgagcagcagcagcagcagctcttcgactacttctactacgacgccaccgccagcgacgatgccagtagcaagcctaccatcgacatcaacctcgacaacatgcaacagttcgattttgatgatagctgcgccgccgccgacgacgacaaagtggatctgacggctccggcggggcctgatgaggaaataaggcatcaccagcagcacctcgacgtgaattgcggccagattgacgaccacaaggattatttcgagataaaggcggcgtcactcgtcngcgcgttcgacatgcggcaggagctgcagccggtggtggcgtgaacgcccgggttgagattgcatcaaggcggtggtgtgatgccggatttgcgtcgaca

SEQ ID NO: 19029 - DNA, 448 bp, Sorghum bicolor
  unsure (1)..(448): unsure at all n locations
  Clone ID: LIB3480-018-P1-K1-B2
tggagcnggggcataatggtaaattcgtagccaaaaattggaggtgggaagaacgctcgccgcanaactttcagggtgcgcagtgtattcagaatgcccgccaaaggccaaaatttttccagcgcacgcacttctgttcagggtgcctcttttttcttctattattttttcttagctattgaaataataaaatactgatagataacaccaaattttgaataccctagaccacttgtttaggtgataaccaaaatatggattatgatgtacttcattatttagggaataaccaaaaagtttagaagttagctatagctatcaaattatttaggaccggttatctaaataaatcgctaatgtcccctcttattacacaccgatagcacttattagtgtgttgaatggtggatgttggatgtgtgaccttccaatgagtctgtcatggatg

SEQ ID NO: 19030 - DNA, 411 bp, Sorghum bicolor
  Clone ID: LIB3480-018-P1-K1-B3
gagagagcgtctgaggtgttcctggaagcatcaccaagacataatacaccggtcccgagccccactgcacaccaggagcaaccatacttcaaggtcagcagcaggtttgagtcagaaatgaaggaagccaatgagatgctgatggaatccaagaagctccgtgtcaacacaggcaagccgaagactgtaacattcgcgccaaccatagaacgcgagttggggaacgaaaagagtggctggaaagacagggagctgcctgaaccagcatcccaagtgttccgaaacgcatttgctacagtctatcagatggtgctcaagatgattgctaaaatccacgaggcaatggtagcatataacattgatagacggcacatgctaagaaagttaatatcagtcaacagatacctgatg

SEQ ID NO: 19031 - DNA, 444 bp, Sorghum bicolor
  unsure (1)..(444): unsure at all n locations
  Clone ID: LIB3480-018-P1-K1-B9
atgacgcagagcttcagaggagcgccacaaggtgtaaatctttctctcataaatggaagcatggttactggcgttgaaactctgagacaagtcgaagccaagtatcctgctttactgtttaaacagcagcttacagcatatgtggagaagatatatggaatgatccgggataatttgaagaaagagatatctcccttgcttggcttgtgcattcaggccccgagaacatcaagggcaagcttaatgaaagggtcttcacgttcaaacactaataccgctgcccaacaagcnttgattgctcactggcaggggattgtgaagagcctaggaaattttgtgaacatactgaaagcgaacaatgttcctcctttcttggtgcgaaaagtattcactcaaatattctcatttatcaatgtacaactatntaacagtttactactgaga

SEQ ID NO: 19032 - DNA, 277 bp, Sorghum bicolor
  Clone ID: LIB3480-018-P1-K1-C1
cggacgcgtgggcacacactgatctggagtatccacacgaacgagatcgtacactcgaactgatgcttctactatctctcatactacattgggggcatttgcagccaggtaagagaaacataacgacccatacatctcgaattaacgcaactaaatgcatttgcaccacactatccacagaacagctcttgcacaaggagctaactgatccacgagcgtcgtaatccatggagacgaccgctcgctggtcagcatgaaccatctttgaatcaaccac

SEQ ID NO: 19033 - DNA, 410 bp, Sorghum bicolor
  Clone ID: LIB3480-018-P1-K1-C3
gcgaggcaggctccaggaggttctcctcctacccgttcgctccctcccctcgatccctttcgccgcgcgcgcgagagggggggagagagaggagatcgaggagacaaaaagaagagggtgttgtgcatgtgatcgggcgggtcgtcgtcgcctcggccggccaaactaacgacgaccaccggccggcactcgattctcggcggtaggcaatgggcaagatcgagtacgccgtggtggcgcgcggtgcggtggtgctggcggagcactacggcgcgtcggcggcgggcggcaacgcgggcgccgtggcgaggcaggtcctcgagcgcctccccgccggcggcgccggtggcgacgactgcaacgtctcgtacacgcaggaccttcacgtgttccacgtcaagcgcaccgac

SEQ ID NO: 19034 - DNA, 427 bp, Sorghum bicolor
  unsure (1)..(427): unsure at all n locations
  Clone ID: LIB3480-018-P1-K1-D4
caaacgtcttcaagtggagctgaactatatgatggtcctcctgctatgcattatttgttccaccctgacccaagggtgggtaatttgttcaggaacaggctgcaacattttgttcccattggggcaggaagtaccagagaaaatgggcaaaacagagcagaaagtctcagcagcggcaggaggcaattcagctcgagtgcagctgctaacgatgactgggtgactcctgggaggatctcagttccaactgatgccagtaaaagaagggtgcgtgccagtggatcccattctggctctggccattggtttactgatgacagtgggaggaaggttatgtctcacaaaatgggcangagttgactggccgcaatgcctatcgacaatatcaaaaggaaagtggcaggggattcggcaggtacaagaaaga

SEQ ID NO: 19035 - DNA, 428 bp, Sorghum bicolor
  Clone ID: LIB3480-018-P1-K1-D7
cccacgcgtccgaaagaacaaaaactagataagaaaagtttataatttaataataaaaaaaaacatagaatagaacaaaaggaatgtaagcggatgaacaggggctctgctgggggatggtaaatcgcaagggggcactttttttttgttattttaagcgcaaaacaacccggatatttttgttgtttctttggagtgtttttatatttcagtggtggaaacggatgttatgccgttgggcggcttacctctgatctgttgtaatattgaaaaactgcttttttttttttttttttggtgaccccgtcttgatatttgtgtgctatttccggagatcttgacgtttttttagagagctgatgcatactattgttgtcttactggagtacatgttctacttttctcttgaacaatttttggatcgtttt

SEQ ID NO: 19036 - DNA, 212 bp, Sorghum bicolor
  Clone ID: LIB3480-018-P1-K1-D9
gcgttctatatctcgagctaccactctatataaaccaatcttacttacgcctgcattcaacctcatacctctcctatagcatcacgggggtgcaattctcttgccggggtggtacaacccccttactgtcaaatcccttactatacccaactaaatcaccttgtagaacatccctcttcctccacctttcgtaatacctaattatccctcac

SEQ ID NO: 19037 - DNA, 565 bp, Sorghum bicolor
  unsure (1)..(565): unsure at all n locations
  Clone ID: LIB3480-018-P1-K1-E1
cggacgcgtgggttcgtcgcgtgggagaagtgcgtggaggaggcggaggccgcgggtgccagcgtcgacgtcgtggagcggtgccaagacgtgacggccgcgctgcggaagtgcatggacgcgcacgccgactactacgagcctatcctccgggccgagcgcgccatggctgcggacctcgaggcctttcaggccgaagaagccgcctccgcctccgcagcgtcggcgtccgaggaaggccagaagaaggaggcggcggccgaggcagcggcgccgccgtcagacggaggccagaataagcaggtggctgaggcggcagtttcggaggagagcaaaaaattctgcagcctgattgggcgaagaggcagcggcatcttcaaaattttttgtgagggatttgaggatatgaataccctntcttctttcgagcatcaattaacatgttgtgacacgagagattggtgtgactagtgagggagatagatttctgtcctcttctcttacataacatgcgatcttttgattgaatcaaatatacacatgttgcagatgacttgactctgct

SEQ ID NO: 19038 - DNA, 357 bp, Sorghum bicolor
  Clone ID: LIB3480-018-P1-K1-F1
ctcactcgcaagatgctggcctacccttgggacaataccagttaggatcgctctatacagagctctctcatatgttattaatgagggacttctgactgaacgctccgtttggatcccttctttggctggtcctacaacaatcgccctcgacaaaaaggccagtgaatatcctgcgcttttccttgtactgatggatatccaacatgtcggctggtcagacaccttggcataccttgtgataccagatcttcttggcatctcacactacatatctactcaagtcacgcaggcaccacagagcactgatactagccaacatggtgctgacgctgtaacagagcccttaccattgctaat

SEQ ID NO: 19039 - DNA, 191 bp, Sorghum bicolor
  Clone ID: LIB3480-018-P1-K1-F12
aatagatcgagagctgggggtctgctgtgctcgcgcgaaggcaaccgtcgctcgcaagatacttcttttctctggtgtcaaatgaattgccttcactaggctggaggtggcgtcgcagcgatttgtccgacctgggcgtgacgctactgatctgtgttgtggaacatcacattctcctacgatgacctggt

SEQ ID NO: 19040 - DNA, 448 bp, Sorghum bicolor
  Clone ID: LIB3480-018-P1-K1-G8
cggacgcgtgggcttcccgacagcattgcaaatttgacagggatgaaaaccatctatctcagtggtaacaatctctcaggccccatacctgacttgagcagcatgcacaccttaactgccgtgcgccttgatagcaatcatttcagtggaacgatcaaaccatcaatggaaaaactagtcaatcttaaggagctatacctgaactacaacaatctcacgggcaagataccagatggtctgaaaaacaaagctggacttgatttgagaactgaggggaacaaatttgaatgaggctggcaaggaggaaatatctttatgcttatcctcaacatgatgctgcacccatgcaaatacagttcaatgatgaagggagaggactgaaggcttcaaaagttgtaggatgacattgatgtctgatgtatgagagctaaagatggatttcatatct

SEQ ID NO: 19041 - DNA, 368 bp, Sorghum bicolor
  Clone ID: LIB3480-018-P1-K1-H3
ctccagcttcgtcaaaatcgacttcggcttcggcttcttcaaacacgacttcggcttcggattcttcaaaaacttcttcggattcttcaaaggcttcatcagcttcttcaaaatcttcttcgactccacctactccgaagcagtagcttctctgaaggagggcacacctttttgaaaactgttaattaacaaaacaacttcttctgtttattttttttttttgagagtgggtgaaagatatggaatgtatctatagtacccctgcttggttggcttggttgcatacatgctttatatatatatatatatatcttagatctcaattggtatgatgtttctcataaacatgaaaattaagagtgatacat

SEQ ID NO: 19042 - DNA, 452 bp, Sorghum bicolor
  unsure (1)..(452): unsure at all n locations
  Clone ID: LIB3480-018-P1-K1-H4
acggctgacatggctgtcatgattttaagatatttcaatgttattggctctgaccctgagggaagattaggtgaggctcctaggccagaactccgagagcatggtcggatatctggggcatgcttcgatgcagcattaggagtcattccaggattgaaggttaaaggaacagattatcccacagctgatggaacctgcataagagattatattgatgtcacagatttagttgatgctcatgtgaaagcactcaacaaggcagagcctagaaaagtcggcatttacaatgttggaacaggaagaggtcgctcggttaatgagtttgttgatgcctgcaagaaagcaactggngttaacatcaaaattgaatacctcagcagaaggccaggagattatgcagaatatacagcgaccaacaaagataacaagggctcaactggcagctcaatata

SEQ ID NO: 19043 - DNA, 573 bp, Sorghum bicolor
  Clone ID: LIB3480-018-P1-K1-H5
acgcgtcagttctacaccatgctgtatgtgcaggaagctgtaaggtaacagaattccttctttcaaaaggaataccagttgacatagactgtggccgtgggacaccacttttccatgctgctaataatgaacaggataagaccttgaagattttgttggaccaccacgcaaatcctaacaccattgttggcggtggcatgggcacaccactaatgagtgctcttatctaccgttcgttgaagtgcatgaagctacttattaaggctggtgcggaagttaatggcgaaggttccgttatgcctcctctagtgtttgctacaggtcatggagggtataccaacttcattcagttactgttgaaggctggagcaaaccctaatattcctgatgatctgggaaggtgccaatagagcttgctgcgctgcgtgagtgcaaggaagaagtagagatgctgctgcccttgacttcgccaatcccaaatgtcaagaaactgagtgttgatggagtaatctctcatgcaaaatttgaaaatacaaagccattggataaaatgcgcattaatagaagaagagc

SEQ ID NO: 19044 - DNA, 564 bp, Sorghum bicolor
  unsure (1)..(564): unsure at all n locations
  Clone ID: LIB3480-018-P1-K1-H8
gtgaattatgcaaaagtgtttgatcttgcacaaacacatttatctcaccgagagatatggaggtgtgctacttggctgactttaattgtccctactagcatgacagcctacctatatctgtactcacatggagaagtgtctcttgcagcatctcaaccagttctcttgtatgctattcttctgatgatcctcctttctccttttgatatgttttacttatcatcacgcttttactttctgaggacagtctggcgtataatactgcctttacaagcaattacatttcctgacttctttttggctgatatttttacatccatgtcaaaggtgttctcagatctggagcgttcggtttgtcgtatggtaaatcgccaggttgcaacaatcgcttggtttgaagcagattctgtttgtggcggtcattctgtagctattcctcttgttcttgtgttcccctacttgtggcgtttcttccaatgtctccngcagtacanggatacaaaggagaagacatgtctcttgaatgctctcaagactcgacagcaattcctgtgattttctttc

SEQ ID NO: 19045 - DNA, 145 bp, Sorghum bicolor
  Clone ID: LIB3480-019-P1-K1-B11
gccacgcatccggagcctccgatctaagggatcaaggctcgccggcgcagccatgccacagactacacgatgagtgacgtcgctgctgagatccacgtactagctcctcctgctgcaagagctacgcctgcgcatacggtcaggc

SEQ ID NO: 19046 - DNA, 353 bp, Sorghum bicolor
  Clone ID: LIB3480-019-P1-K1-D9
aaaaaaaaaaaaaaaacaaaacaaaatttaacaaaaataaaaaacttataaacaaaaaggtcgccacataaataaaaatccaatcgggggggggcgtccttttagaggttccactctttcttccgcttactttcaacttatttcattcttatttagtgtcacaaaattacaactcgcaaacccctgtttcaccccaactaaatagaaaaacctcacttgcaactactttcatttcccatgataaatagccgtctttcactatttgtttttccaaacaatagcccctcctgaatggctattctcaacatttcctcctattaaatgcaatatcggaccccccctggttccccccc

SEQ ID NO: 19047 - DNA, 456 bp, Sorghum bicolor
  Clone ID: LIB3480-019-P1-K1-E11
cccacgcgtccggaacaaagctctcacactcagtgttgtttgttcaactggaaatgatggaaatggtcatgtgtttgaggtgtgcgatgactcagtcaatgttgtcaacattgatacatgggagtgcacctgcagaagatggcatgtgtctgggataccatgctcgcatgcaattgcggtatttgaccgtactgagcagtgtccacttgactactgctccaagtattttaacaacggaatgttaaccgcttgacttatgccatgtccataaatccaatacctgatgtttttgtacctactgcagcaggtgacccatcacagggcacaacattactttcaagccccattctgacccgaagacaagtgggcagaccaaaggaaaagccagctgatccgcgtattgcaatcaaaagagcagtgcgctgcagcagatgcaagggctatgggcacaataaa

SEQ ID NO: 19048 - DNA, 202 bp, Sorghum bicolor
  Clone ID: LIB3480-019-P1-K1-E7
gccgcctgctctcccaccgctgccgcacgacggaccctgcgcgcgccgcggcgttcttcgtgccattctacgcggggctcgccgtgggccgtcacctgtgggcggccaacgccaccggcgccaacgggacagggactgcgtccgctgctgtcgggctcacgccagcgtgtccacaaccacggtggaccttaccgctgccctc

SEQ ID NO: 19049 - DNA, 341 bp, Sorghum bicolor
  Clone ID: LIB3480-019-P1-K1-F12
gatcactcaggtacgccggccgtcgagcgcgcagtgtctcccaattccacccaataaaccgaaactaataacatctcctcgagcgcgaggcgaggcgaggtcggctttcccttaatttccttcatccagcagcaggagcagcaagcgacgatccggtccggccaccaccaccaccaggcgccatggagatgaagacggtcctcgtcgccgagctcgaggtcgccgcctaggtcaccgtcgagctggcctcagacgccaccgatgcgaccgagccctcctaggcaggcgcattaagcgcgcccgccgtagcggtttctctcctgttttacccttttactatg

SEQ ID NO: 19050 - DNA, 137 bp, Sorghum bicolor
  Clone ID: LIB3480-019-P1-K1-F7
cccacgcgtccggaaactggtaataacataaccgatagtgtagatcatgcttatacactatcttatcaaccacaggcactgtcggacaaagttataatttcgtctcaggctggtacagcatattgacgtgagtcaac

SEQ ID NO: 19051 - DNA, 240 bp, Sorghum bicolor
  Clone ID: LIB3480-019-P1-K1-G1
gttctagatcgcgagcggccgctcgcgatctagaactagtatggcacccaactttacatgtgctggcttttctgaaaatttgtacagactttgaattgttgaatgtacatagtgttgtttcatcgtgtccatggacgttctatagattatactcactgcatgggagatggagattattcactgtcactgacagcatacttattgttgtctgcatgacatcatctatgatgatatgctgat

SEQ ID NO: 19052 - DNA, 310 bp, Sorghum bicolor
  Clone ID: LIB3480-019-P1-K1-G2
tgtaggaagcgagcgggatttctagaggaatagagctgacgtactctacagtccggacactatcctttacatacgagacacgtctgctctgttcagaggcttcttgaaatggctcaaaccactgggaaaaccctaatcagcgacatactgaatgaattcgggaaaaccatcataagaatcatgctgcatacattacgcagagaggctatgacctcgaccatgtgaacagttatgcacagatgctgacggatgctactctccatgatgcgattcattaagatcgcactgagcagtggctgcatgcactacg

SEQ ID NO: 19053 - DNA, 511 bp, Sorghum bicolor
  Clone ID: LIB3480-019-P1-K1-G6
ggcagcttctgaaggtacttgagtggctagctcagaatggaatgtcgacatgtgaacatatacatggaggtcctccatgtgctccagttgaatgcttcacagactcgatgcttagttgaacacgacatcaggacgttcaggttaatcagattgctcggagcttacgtgatagacggatcccccacaatacatccacattcgtacatgatgtacagtggactaatacagtctggagttctggtactaggaaacgcatgagccgatgagactatcaacctgacgagcattataagatggtcggactcataatacaaaaagtttgttctggctgtatgagaaataagtcggataggaatcagtgcgcatacaactattgtaatgatgttcttggcatgtgaagttcaacacagggtgcacatgatgaagcccctcctgggttgagtctcaactggagtgtcgggctgcacaactttccatatgcagtgaggttgctccaggactttgcatggag

SEQ ID NO: 19054 - DNA, 390 bp, Sorghum bicolor
  Clone ID: LIB3480-020-P1-K1-A11
cggacgcgtgggcggacgcgtgggacggggccaagttcacgctccagttctccacgccggggcaggccgtggtccaggacgacgtgaaggtgaccctgtacgcgccgccgttcacgacgcacggctactccatgaaccagcggctgctggtgctgtccgtcaccaccttcactgccgacgggcagagacacacggtaacggtcgacgctccgggaaagcctgagctcgcgccgcccggctactacatgctgtacgtcatcgcgaaaggcgtgccgagcaaggcggcgtgggtgaaggtacacaagtgagaagagaaggcggctcgatcggaggtgtatgtccgtcgtcgcgtttggcacgagaatatacgtacgtgtccaccggagtagc

SEQ ID NO: 19055 - DNA, 429 bp, Sorghum bicolor
  Clone ID: LIB3480-020-P1-K1-A2
gccctattgactctgagaaaaagcagaaggagatcattgagttatggcatgaatgcaatgtctctatagtacacagaacatatttcttcctcctcttcaagggagacaaagcagacaatatctacttggaagtagagcataggagattatccttcattagaagttctttcaatgccgggtgcgagcctagtggtactgttatatcaagcttgagaaatcttcggcatgaaagagacatgctctataagcaaatgctgaggagagtcaatcttctggaaagagagagtctttatagcaaatgggggattgatctgaattccaaacagcgaaggctgcaactatcgcgtcgtatctggacacagactgacatggaacatgtgagagaaagtgccactcttgtcacaaaactggtggaacatctggagaagg

SEQ ID NO: 19056 - DNA, 421 bp, Sorghum bicolor
  Clone ID: LIB3480-020-P1-K1-A5
gtccggaagggcaagatggaggtctacctgttcggcctattcgacgaggacatgaagagcatcgcgccggggaacttcgagcggcactggggcatcttcacctacgacggcaagcccaagttccccatcgatctgacggggcagggccatgacaagctcctctcgccggtgactgacgtcaagtacctcccgagccagtggtgcgtgttcgacgacggggccaaggacaagtcgaagctgccaggaaacctgcagtacgcatgtgcgagcggcgactgcacggcgctcggctacggctgctcctgcaacgggctggatgagaagagcaacatctcctacgccttcaacatgtacttccagatgcaggaccaggatgtgcgcgcctgcgaattcgacgggctcgccaagataacagacaaga

SEQ ID NO: 19057 - DNA, 274 bp, Sorghum bicolor
  unsure (1)..(274): unsure at all n locations
  Clone ID: LIB3480-020-P1-K1-A6
nttgataattataaaaaaaaaaaaaaaaaaaaaaaaaaaaaaaggaacaaaaataaaaaaaaaaaaaaattaaggtcccctgctttggggcgggcgggcttttgtttgcttgcctcgcaacctctttccttttgcctggtgtttccaaaattcaagtcagtgaaatctattccctgccctattttatgcccattcctgaccatcacctttcttgatttacccgaattacatcccgggccccccaccttcctttttacaaaaggtgcccaagcca

SEQ ID NO: 19058 - DNA, 419 bp, Sorghum bicolor
  Clone ID: LIB3480-020-P1-K1-B4
gaaacacaagaagcacaaatctgatgacggtgatttggacagtacatctcccaagaaacacaagaaggagaaatccattgattcggatgcatcttcatatcttcagaaggaagaggagaaatccggcggcgattcggacgaagccacgtctcttaaaaagcacaagaaggagaagaagaacaagaagaagaaggagaaatccggtgaggacgccgacgaagacaacgctgcgcccgtcgacgtctccatggacggccaatatgtgtctccctcttccaaggaggagaaatccgacgaggatgacgccatgccggtcgacgtctccaccaccaccggccaatacgtgtcttctccgaagtccaagggaggagagcgtcaggtctccacccctaccgatgcatacacgtctcccgacgagc

SEQ ID NO: 19059 - DNA, 238 bp, Sorghum bicolor
  Clone ID: LIB3480-020-P1-K1-C12
cggacgcgtgggtttttctttttttttttttttgatcctatttttccttttcctattttattattttattcttatacttaaggtgggtggacacacaacggcttataccgtgaatacaatttttttgccatggataacatcaagatgagacttatcacatctgacggctaccgtagccctaccgcctatgggtgcagtcctagccctataaataccgtaacctaagccccaaattcaa

SEQ ID NO: 19060 - DNA, 179 bp, Sorghum bicolor
  Clone ID: LIB3480-020-P1-K1-C9
cggacgcgtgggctctcttcctcccggcgtcggcgtcggccgtcgccagcgccggccggccatgggttgcggtggctccagaggaggccgtggccaccggcaacaccactaccagcgccggcggctgtaagctcctccggaggaagtactcgttcttcaccgggcaagccatactatca

SEQ ID NO: 19061 - DNA, 394 bp, Sorghum bicolor
  Clone ID: LIB3480-020-P1-K1-D4
cccacgcgtccggtcatctttaacgttttgtgggagatggttgtgagctctggtacctgcctgaaaataaatgctgcggctctactgagagcacttgtaccctacactgatgtgaaagtagcatcaactcatattttgccagcacttgttactcttggctctgatcaaaacttgaaagtaaaatatgctagtatagatgcatttggagctgttgctcagcatttcaaaaatgacatggttgttgacaaaatacgcattcaaatggatgcttttcttgaagatggatcgcatgaagcttctatttctgttattcgtgcacttgcaatagctgtgcctcattcaacagataggctacgtgaatatcttttaaccaagatatttaacatgtcaagca

SEQ ID NO: 19062 - DNA, 532 bp, Sorghum bicolor
  unsure (1)..(532): unsure at all n locations
  Clone ID: LIB3480-020-P1-K1-D5
cagccaagctaagagtccccctccagtggttaagggctctgaacgggtctacgaggagaatgagaatctgaggttgcagctcgctttgaagacaacagagctcaaacaggaagagaaccgcaggctccagttagagttgattataaagtcaaaggagaccgagtccctgcagaagcagattgaagatctgaaagctgagaatgagcagctcagaaagaatgtaaagccacaaagagtcgaaaggaaatgccgatactgaaatgcatatgtcatgcatgactaccgcaactgtcctaagaggcgacgagctgcttcttcccctgaagtaacagatggagaggaagaggactcttactaacactgcaaggctgcggcctgttcgtcacatcccttttgcatgatngcatcgatgcatgcatctgttgacacctaggagttcacaaaattctgttccatcttgctaaagttgtcaccgtagtgtccgggcagcagtataaactatgtgatgtttatagttattctgatgtctatg

SEQ ID NO: 19063 - DNA, 342 bp, Sorghum bicolor
  Clone ID: LIB3480-020-P1-K1-E9
gcgcgccggactactgcaacatctacgtcgtggccaagggcaagtccgtcaatgtcaggctcgccaagtgcggcgtccctgccatgcacagtggcgccgacaccatcccttcggacaccgactcccaatcgggcctgtacgtgcgacgcggctcccggggccacctgccgccggtgatgcctgacgccaccaggcgctccgttgacggacgcaccctgccggagctcaacacgcggccagcgttccgcgagcgctcgctcccgtcctcggccaccaagaacgtcgtcgtcgtcgtccccggaaaagacttctccgagacgttctcccgctccgcgaggcacg

SEQ ID NO: 19064 - DNA, 550 bp, Sorghum bicolor
  Clone ID: LIB3480-020-P1-K1-F5
cagcggtaaagttttctttgccccttgagggcatatgcccttaagggcaaaaaaaaaaaaaaccgcgttccgaacccagcgcgcccgcgttccggagctcctacttcaactggttccacttctccatgtcctggggctacgccatcgccacggccgggctgagctacgtccaggacaacgccggctggaccgtcggtttcggcgcgtgctggaccgcgttggcgctatgccttgccgtcttcttacttggcacgcggatctaccgtgccaagcaacgccccgttgatggcggcacgttcgctgaggccgttcgggcgttgggcgcgagggtcttccgtcgaaaggacaccaccgctccaactgatgaaaggtgaacaccagcagacacttctccattgtattgctgcaggctgcttctatctccacaacacgaggaggacggactcatagctaagctgctcccgatatggttgacgagcttagtcttcacgtacggccatctacttcgcaggtgtccactctgttcaccaagccagccagcacattggat

SEQ ID NO: 19065 - DNA, 332 bp, Sorghum bicolor
  Clone ID: LIB3480-020-P1-K1-H10
tgggaattctcgaggtcaagtggtccggcatcgagcttgaggactggtggcgcaacgagcagttctggctcatctcggggacgagcgcgcacctgtacgcagtggtgcaggggctgctcaaggtgatggccggcatcgagatctccttcacgctcacggccaaggcggcggcggaagacaacgaggacatctacgccgacctctacgtggtgaagtggtcatctctgctcatcccgcccatcaccatcggcatgatcaacctcatcgccattgccttcgccttcgcgcgcaccgtctacagcgacaacccgcgctggggcaagttcatcggc

SEQ ID NO: 19066 - DNA, 232 bp, Sorghum bicolor
  unsure (1)..(232): unsure at all n locations
  Clone ID: LIB3480-020-P1-K1-H11
aaaaaaaaaaaaaaaaaaaagaagaaggcaccaagacacgacaaaaaaaaaaaaatccaagaatgaaaaaaaacaaaatacaaatgggctcccctataatctgtgggccgccccttccgtggctccacgctgacgtacccttgcatcccacgttctcaatctatttttgtcgcccctaaattcatttcactgtccctcgtttaacacacgtcgggctggnaaaaccctgccg

SEQ ID NO: 19067 - DNA, 186 bp, Sorghum bicolor
  Clone ID: LIB3480-021-P1-K1-A11
gcaatgcgcccggtgccgtgctggggcgcagagacgatctgaatatctgatggtggaaacaccggataataaaaagcgtgccggcgatgtgcgttctttgcaaaaatacaacactgccaggtttatttacactactattacggcccttatttatggcaccatgttctggaaccttggtagcaaaat

SEQ ID NO: 19068 - DNA, 186 bp, Sorghum bicolor
  Clone ID: LIB3480-021-P1-K1-A12
acgctcttttagagattgcatgattattcccgcgttagtatctaaatcctacgacatggtgcatgtactatattgtctccgggataacatctgctggaccctacaataccactggaactcgcagatggctcaggagttacgctaagtgagtaccctagagcatagactactcaatctggttgaaca

SEQ ID NO: 19069 - DNA, 310 bp, Sorghum bicolor
  Clone ID: LIB3480-021-P1-K1-A3
ggcgggtttgaggacaaaacatttggggtttcacaaagcactctgtgttctgatggggtggaattcgcatgttgctccagacacttgtaaagcccatcactccattccatccgaggaagtaaatgccatgaggggagatcttatgctgtggcctccagttgttgtgatacagaacagctcgactggtaaagaggcaaaggatactggtgcaaaggttgtgtccataaaagaaattgaaggtgtattggcagatataggcgtaccacctgagaaggcgagggttagccatggaagaccagacaatcagagc

SEQ ID NO: 19070 - DNA, 300 bp, Sorghum bicolor
  unsure (1)..(300): unsure at all n locations
  Clone ID: LIB3480-021-P1-K1-A5
cggacgcgtgggcagagacctatattttcccactaagtactctcagtcttctttcactcaatgtatggcttgtatttggaaacaaaacatgtcatactggaggaaccctccttacaacactgccaggtttattttcactactattacggcccttatttttggcaccatgttctggaaccttggtagcaaaatagacaagtcacaggacttgttcaacgccttgtgatccatgtatctntcggtgatattccttggttgcacaaattctatctctgttcagccaagtgtggccgttgagcg

SEQ ID NO: 19071 - DNA, 166 bp, Sorghum bicolor
  Clone ID: LIB3480-021-P1-K1-B11
ctcgatccgacgacctaggaatcaaatccaaccctacccctgcacgccacatcataccgtgtctgttgcgacagctagagggtatggagtgaccgtcgctatacaaccttcttactgctaaaaccctctctctacccaacataatagtcttgcatcatattcccct

SEQ ID NO: 19072 - DNA, 522 bp, Sorghum bicolor
  unsure (1)..(522): unsure at all n locations
  Clone ID: LIB3480-021-P1-K1-C3
agcacattggtgatggagtagtcatttgatatagcaacctttcctagtcccttgactttcccttttgaattgtcaccaaatgtgatcttctcttggttgtcaacatcttcatcaagagaggtgaacatccggggatctccggtcatatgttgagtgcaaccactatcaattacccaatgtgatccaccggtcttgtagttcacctacacacaagagatcaagcttgagatttagggacccacacttgctcagggccgctgaccttctctactagttgctttggcacccaaaatctctttggcctttgcttgtttggtggccccatgaagctaaccttgaccttgccacacttgtgtttttttacaacgtaatgagcaattaaggcaaatggtcttgcatgctttggcatgggtggtggcagtggggcctacactcatgaacaaagggtcctttttgaccacacttaaacaatntttttggttttggcttggttgcttgatcatgagtgactagagacttgtt

SEQ ID NO: 19073 - DNA, 450 bp, Sorghum bicolor
  unsure (1)..(450): unsure at all n locations
  Clone ID: LIB3480-021-P1-K1-D1
cccacgcgtccgtgccgataccactgcagccctacatagttgctaagagtcaacagccaggtctttcactaaacttggatggcattgtgagggctcctttacatcaactgccaagcttcagcatcccagggccatcgccaaatgagttgtctgttccaggcggcattcctctgccaacctgcagaattgcacctcccaatctccttgcactctngaagcaagctnggtaccagcagggaagtatcggtggtctgccaggacatggacatcaacagccaagcttcagcatcccaggaccatngccgaatgagttgtctactccaggcggcattcctctaccaatctgcagaaccacatttcccgatctccttgcactcttgaagcagccctggtatcagccagagagtattgctggtctgccaggacatgatgtcttttcttacttcgaat

SEQ ID NO: 19074 - DNA, 343 bp, Sorghum bicolor
  Clone ID: LIB3480-021-P1-K1-D11
cccacgcgtccgcgctcctatacttcctccccgtcagaaaggcgctccacctttcactcatccacttcctacaccaagagtaggggcacccctcccatccactccacttcctccacctcgtgctcctgtccttcctccccggcggatgggcacctcaccttcccttctccatacctgcccaagataggggcacctctccatccctctaaacctcatctggctctgagttctcccgcgaagccagccactctcaccactctaagcccatccattctgtatccgccctcaaggcctcacttccttttcacaccgacagatagggcccctcctccctttaagctca

SEQ ID NO: 19075 - DNA, 252 bp, Sorghum bicolor
  Clone ID: LIB3480-021-P1-K1-D12
tggatttgtctacaattcattgttgttaaactccttgccttttctatcagaatatactgagataacgccgaaaaaatgggacgggggatcctgcgtagaagttcctcggattcttcatgctcctacaagagcttgagcgtgtagagaagggcatcggggatggcccattgagctatggaatttatgatgcagatgacatctacattcgatcatggactggcactattattggaccacataatactgttcatg

SEQ ID NO: 19076 - DNA, 377 bp, Sorghum bicolor
  Clone ID: LIB3480-021-P1-K1-F5
cgacgagcacccgcaaggtatgcccaccaagtggatccacgaaggatggcatggcctcccgagtcccgatatgcatgaactatggcctctgcattagatttgtaatgatgaagctccttcctcgagcagggctacatcgagctataaagcaggaggaaaaatgcctacgttctgtgatattttcagtgtgtggagctgatacctgtacgccatcgactctatctcagtactagcaaaggtgattcatcttttctcatgcagatttgttcatttgtataatcaaatccattgtacaagtgcagatactgccagctacagagaacctgatacaagtgtgccaatgactccatcttagcactagcaatagcataggaaaa

SEQ ID NO: 19077 - DNA, 137 bp, Sorghum bicolor
  Clone ID: LIB3480-021-P1-K1-F8
tcgtaggcggacggcctggaagccagcggtcagcggttactgtgggtggtacgggcgccgatcagtgacgactcgggtaagatgattgcgatgcactcggcgccggatttgaacgcgctcattccgaagacgctgct

SEQ ID NO: 19078 - DNA, 334 bp, Sorghum bicolor
  Clone ID: LIB3480-021-P1-K1-G1
gcaggatcaacagacgtcggcaatgccaacacaaagcatgtaccaccaccagtatcagtactctgtgcctccatctgtagctgcaaacacgtttggtgatcctttcagtgaccttgccccaatggagtgctcctggaaaacagagcagctcatactgttctctgaactggtgctacactgtctgatcattcaattgagtagagcagcaaacctgtacaggacgagtctattggctgactggatgtgttgtatattaactaacttttgcaatatacagatcttgaaatctcacatgaattaatagcagttatatgcactataaaaaaaacaataa

SEQ ID NO: 19079 - DNA, 397 bp, Sorghum bicolor
  Clone ID: LIB3480-021-P1-K1-G5
cctgcttggaatggaaggcatattgaaattgttagatccagcttttctactgaaacgtaaatgcactgtgtatgtgtatcatagtatctcaactggcatagagtaaaatactccttgaggtctactatgtactgtgatagttcctaggagttaacctgaaccttttagttatttattgatttattgctagtattgagagaagggcatgattatgctcacatctgccattatgatccaagtggttggagacatctctttagttttggggtgatcagtaaaagatcaagtaacaaatcactacctgaatgctgttatgttttgcacgatcaatcttcgcttagcatgttatactttaaaattttccttaactatttctttagggaaaggcttctgtgtg

SEQ ID NO: 19080 - DNA, 150 bp, Sorghum bicolor
  unsure (1)..(150): unsure at all n locations
  Clone ID: LIB3480-021-P1-K1-G8
ggaagatgacatactatggtactgcaccacgtgtaatccatcaacctcattntgctgcaacatccacattcatagcaagagaggttgcataaggtctattaaagtaccaaccagatgtaattatcagtgtacactctgtaatgcaacatg

SEQ ID NO: 19081 - DNA, 243 bp, Sorghum bicolor
  Clone ID: LIB3480-021-P1-K1-H1
ccccgcgtccgaaaaaaaaaaaactattaaagcacaaacttgctgcatgaaaaaattcctactgttgttggagccattgctatttctggattctgggtctaagcatgcagtttgccctttgactatctgtataaacagattcacaacatgcaacctgatgcgaatggcaagtacctatactcagggaatttggactgtgtcatgaagacctttaatagcgagaagtcattcaagttctacact

SEQ ID NO: 19082 - DNA, 190 bp, Sorghum bicolor
  Clone ID: LIB3480-021-P1-K1-H3
gtcgagttcgacactgggaagatgctgtctttcactccgggtcttggacagcaactgaatgctagtacaaactttggcgatctgcagctcagtcaaaaggaattcagcggtctgcatcacctgaacctctctgggcagcagctcccgtcgtttaatgcaacaggagcgacgcataatcctgaacagtcta

SEQ ID NO: 19083 - DNA, 208 bp, Sorghum bicolor
  Clone ID: LIB3480-021-P1-K1-H7
agaggacatcgatgaggttattgagctcactgatgcgcctactaaagtggcagagaggcctgtatcttctagaagagaccgaagttcaagaggatgcactacctgcatcgtggacgggactgagatgactagggcacactcagagtgcatgaattgtaacatacaccaccattctatcgtaccatcgtattagcagacatgtcagaat

SEQ ID NO: 19084 - DNA, 279 bp, Sorghum bicolor
  Clone ID: LIB3480-022-P1-K1-B1
ggaattcttgaaattaatatataataagtagtccactttattgcattccaatgcgggttataccatgatgatccgggcttggttgcgcaattgccggaggcaaagctatttattccaacgggtttatttattgaatcacgccatggatgcattatttatattaagggttggtattacatgtgcactgtagtacctgatgagggagggggtgaggaaagggaccattaatcaacatgcgaccaactggtgtttactcttaggtgcctaatcggttttctt

SEQ ID NO: 19085 - DNA, 148 bp, Sorghum bicolor
  Clone ID: LIB3480-022-P1-K1-C7
atcatctcttctctatcactctttactatttttctctctgttgtcactaatttcctaggacctacctctggtccgaaagggggtagcatttctttaggaggctacttacaccttctagttttcttaacctatcactaatgtatcagta

SEQ ID NO: 19086 - DNA, 143 bp, Sorghum bicolor
  Clone ID: LIB3480-022-P1-K1-D2
ctcgtagacaaaaaaaaaaaaaaaagctctcgatctacaagatccacgctcacgtaacacgcgcatgcaacgtgggcgctctcttttaaggttccagggttactaatctcctgcatcgcgactaaataacttttttatatggc

SEQ ID NO: 19087 - DNA, 200 bp, Sorghum bicolor
  Clone ID: LIB3480-022-P1-K1-D4
gctatagatagagagcgagcggtctatatgaaagaaccaaacttacgcacgcatgcaagctaatagatattttatagagagagctaaatacaattaactgaccggcggtcgacaaacaacggactgacaaaaaaatggcggtactcaactaaatcaattggcatgacatacatctttcgtcagctggctggataaaaagg

SEQ ID NO: 19088 - DNA, 262 bp, Sorghum bicolor
  Clone ID: LIB3480-022-P1-K1-D5
taattaaaaaagaacatatgtatatataccaatgtagaaaaacgcactgtgatgtcacaagctagcgacactgacagacacacaggggagggaccgccagccatgcacgcatgatgctcggaagaatctcaagctaggaagctagtaagcgtcgaacggaccgatgcagtcggtggcgacgtcaaccaagtcggccatcggctccttgagcgaccagggcaggaccaggacttgttacatgaggccggacgacctcgggctg

SEQ ID NO: 19089 - DNA, 167 bp, Sorghum bicolor
  Clone ID: LIB3480-022-P1-K1-E11
cttttttttttttttttttttttttttttttttttttttccctcaaagaagtaaaatacatgtaattttccttgattatggggaagcaaaactgggcaatgaatattctccatagtgtaatggagcctgttttagaactagtcttataaaacaatttttttgggcct

SEQ ID NO: 19090 - DNA, 431 bp, Sorghum bicolor
  Clone ID: LIB3480-022-P1-K1-F1
ccgggcccggcgcaaacacggcggggcgcgtcaactggccggggttcaagaaggtgatcagcaaggcggacgcgagcaagttcacggtcgagaacttcctgcacgcccagccatggatcgaccccacaggcacgccggtgaagtacgacctgttcacatgaggccggacagccggccggcggccgggggatcgatcggagggcacttttttcacggtgggggatgggcggaggaggctgctggcgcgcggtagcaggccatgcacttcgtttgttgggtgtcggaggcaaggggaccgatcactgcatacgtgctacaagagtggaaaatgcactgtcgtccagtttaagttcgcgttggtatgtatactggctgctatgtgagttttgtacctgtacatgaagtttcttttttcttataacacgtatagc

SEQ ID NO: 19091 - DNA, 412 bp, Sorghum bicolor
  unsure (1)..(412): unsure at all n locations
  Clone ID: LIB3480-022-P1-K1-F2
cacacttattgttcggatggagttgagtgatctcagtgcttgccttgctgctattgtgtgttcatcattgcaaccacctcttcgaccccttggatccccagcaggtgattgggcttctgtcatcataaagtctgtactggacagagcaacagttttactcactgatcagcacgtggcttctaactacagtatgcagaatcgagctctatggcaggcatcatttgacgcctttttcgggctgcttacacagtactgcatgagtaagtttgatagtgtggttcatactgcccaattgcaacctgccgctgcagcagttataaccagngaaatgccagtagagcttctgcgtgccagcctcccccataccaatgaggatcaacgcangcaatngctcangtttgctcaacgcact

SEQ ID NO: 19092 - DNA, 266 bp, Sorghum bicolor
  Clone ID: LIB3480-022-P1-K1-F4
gtgcatgcgacgttatatcttttctacccagctcgaatcatgtccatataagataacaggcagcagcgtacacataaaaaccactctggggtccctaatattaaataccaaacttggaaactgcatcctaagtaaggggaacgaggggacacatattgatttgcgggtcctgagagagacatgttgagattatccggatcagatagacattattattaagctatctttcacgcaaccgggatactgatcgagggaccgatcgaaac

SEQ ID NO: 19093 - DNA, 423 bp, Sorghum bicolor
  Clone ID: LIB3480-022-P1-K1-F9
gctcgcaatctagaactagctttggagttgcagttgatgtgggtccggggaactcgccgttgatgaggatgaccttctggggcacgcccagcagggacttggtcccgtacgtcaccttccactcgaagaacaggtacgggtcctcggcccgcgccaccaaggccagcgccgacagcaccagcagcaggacgccggcggcggcggcagcgcgcgtcgtcgtcgccatgtctctcctcgcttgttgctccacccgatcgagcacgcacgcacgtgcctgtaccaatcgatcagcagcagctagctctcgcgcggcgcgcggcggcggcggccgggccggggcgctatgctctagtgggggggtggtgcggctctctcttgaagggatgtatgaggagtttgttgcgggtggaaataagctattct

SEQ ID NO: 19094 - DNA, 623 bp, Sorghum bicolor
  unsure (1)..(623): unsure at all n locations
  Clone ID: LIB3480-022-P1-K1-G6
accaccaccaccacttgctcctccatccgaggcatgaagacgagcgcgatagcgagcatcggggcgcaccagctgcgccgcgtcatcgtcggcgacgaggcgcccaataacaagcagaagcagcaggccccgatgacggtcttctacaacggcgccgtggccaccttcgacggcgtctcccaggacaaggcagaggctataatgaagatggcgatggaggttactacctccaatggaggccgcgtcgtccgtggcgacgcatttgctggaaatttgaccaaagacatgccactcacaagaaccaaatcgctgcagcagtttctgcagaagcgaaaagagaggctgagtgggttgggtccgtatcagctgggaataatgggatcgggaggaacgagccgcgttggtgcagcgacaaccaacaagtcgtttcatgtgaaggaggaggcagcttaacctagcagccgccaagctactaattcaagaagtatattncttgatactttgatagcagtatcgacaaataaatagaagatccacagtgatataagttcgtttgataatttcattaagattaagatctagagtgatcataggcatatgtatgtnggtatatatataaatat

SEQ ID NO: 19095 - DNA, 260 bp, Sorghum bicolor
  Clone ID: LIB3480-022-P1-K1-H1
gcgggcgaccacgcagagctgaccagcgagacccagcccgacaacaagcactcagggcagggtgacgactcgggcgccaccgcggggcagggggagaccgaggccgccaggagcgccagcgacgagcacacaaccatcggcaaggcggcgcacctgggggacagcaccaacaacgagggaggcacgaccaggaagggcagatgaccaccgcgctagaccaggagggcgccaaggaagcggagcaaagaggccgagggcgg

SEQ ID NO: 19096 - DNA, 482 bp, Sorghum bicolor
  unsure (1)..(482): unsure at all n locations
  Clone ID: LIB3480-022-P1-K1-H12
gactagttctagatcgcgagcgatctagaactagttgcagcgggaggaggggaaggtttctgacaagtctagttctgcatgggcttcggaggcggtagcaacaatggagatgacacactcgaagctcttccccttcttcatgactggtctccttcctcaggaggccatgcaatacttggacctagtgtgccgatgcacgaagaacacgcgccatctggtctctatgctcagatctcttgcagagcgccttgaagacgcaaacccgtcaattatacacaacaaccctaccaaactgtatgagcacctacttgtaaagtccccataagcctgaaacccctctgtgcagcgatgcggcatgtgttaaattgtgaatgctaacctttnttttcttgcttgtagtgcagctaatgtatntgagttatttgaacgattgtgaaagccgtgcgtgtatagcttatngtgttatcccagcgtgagtaact

SEQ ID NO: 19097 - DNA, 394 bp, Sorghum bicolor
  Clone ID: LIB3480-022-P1-K1-H8
ctcagattattgaactatctgctgggcttgtgcatatgtggagaaacatgtacgagtgccatcaggtccagaaccatattgcccagcaagttagtctccttggcaacatacctgggagtgaaccaacaagtgacactcattgccaggcaacatctcagctggaaattgaggtgtctggatggcacaatgccttctgcaatctcatcacattgcagcgtgaatacattagcatccttaaccaatggattggtctcacagactgccttccagatgatggtggcttaatgagaagttcatctggaatacgtagcctctctgaggaactccagcgtgctcttgacaggctaccagagaagatagcagctgaagcaataatgacctttatgtcaatcat

SEQ ID NO: 19098 - DNA, 458 bp, Sorghum bicolor
  Clone ID: LIB3480-023-P1-K1-B8
cgccattagaaaaggtccctctgcttgaaagatttgtaaatggagatgatgctttcagaaattcaaggttcaagctcatcccttacatctcaaagggatcttggattgttaaacagagtgtgggcaagaaagcttgcttggttggacaagcattagaaatcaattatttccgtggaaacaactatttggagcttggagttgatataggttcatcaacagtggcccgaggtgtcgtgagcctagtgcttggctacttgaacaatctggtgatcgaaatggccttcttggtacagggcaacacatatgaagaactcccagaattcctcctaggtacctgccgactgaattacctggatgcctccaaggcagtatcgatagacgagtgctagaaggaccccaactgacctcattctttttgaagactgtacatcaaaagaccaaaaggctgaatccattcc

SEQ ID NO: 19099 - DNA, 457 bp, Sorghum bicolor
  Clone ID: LIB3480-023-P1-K1-C3
agaatatccaagaagcagtgcgcaaagcgcgcctcaacaagagcagagagttgtgaagcaggttgctgaggataaactgttgaccatactggcactggtatttccatgtttcgactcatgctgctctgaaaccagatcgaaagattaagttgcttttgcgatgattcaatcctggaatactgggagatcaaccacctttggctagatcggcatggagttccactgcaagggtgtgcccagcatcttctgaaacatcacccacttgttgttgtgccctctgctgcagcgtcgtcgtcttcttccctgaagcttcgaagcagatatcagtggtagcctggtaggagaggctgatggtgtggtgctctcagctaggcttacaccccacctgatcctctagatcatttgaaaaattggcacagaaaggcttttgacagccacacttttgctggacagacag

SEQ ID NO: 19100 - DNA, 519 bp, Sorghum bicolor
  Clone ID: LIB3480-023-P1-K1-D1
gtttggagaagttaagaggggttgtccttcacagtggtatactctctggcatacgggttctgtatccagtgaaagtgacactttggttcgacatcttcaagaacatcgacaaaataaagcaggttgcctgtcctgtgttagtcatacatggaacagcggatgacatcgtggacttcactcacggcaagcgcctgtgggagctagccaaggagaagtacgagccgctgtggatcaaaggcggtgggcactgcaacctggagacgtacccggagtacatcaggcacctgcgcaagttcataaacgctatggagaagctggccaaggacagcaaggcggcccaggcgccgccatcgtcgagcttggcggcggaagcaagacactccaagtgcttgagattcgggaagaggtgaggccggcgggcgaggccgcgggtctcggccgtctttagctgtgtacaggcccagtcactaaccctgctgcattgcattgatgctgctcttgtcgtgtgcaagtcgaaga

SEQ ID NO: 19101 - DNA, 311 bp, Sorghum bicolor
  Clone ID: LIB3480-023-P1-K1-E11
ggatgataatcaggctaagaaaagcctgtattttgcagagcttaaatttaatccggttcttctggagttgactgaatgtgctgatgatgtggagaccatgtgtgtcagctctgtccataatcttgatcattcttgttttggtggatgtcatgagataaataggaaaattgattatgtgatgagtgggaatcaggactacgagcgttgtcacgcatgtagcgatcgtatcaagcatccacatgggacaaaatttgttgcagggcatgatagttccaagattccgtattacactgcaggctgatgtcacaagt

SEQ ID NO: 19102 - DNA, 531 bp, Sorghum bicolor
  Clone ID: LIB3480-023-P1-K1-F1
catgaatccagttctcaaacgaaattacactgttagagaggatgcatatggggagattcgaagagtcaggccaaagattaatggaaattcatgggaaaattcaaaattcaagcaagttgatattattcgaaataatccagctgcaaattcacgtgaagagcccactgccaggaatccgagtgcttccagagatggaaagaagctgttaaatgatattctgggagccaacaatttaagataccctaactttatttcaaaagttgaaactgctgatgaaatattagatgtccccgataaaccttcagctgtaaccccacaacaatatgattccagtttcccgcaagctggtagggaacaaaaaggttttggtgctacaacacttaatcagtgttctaatgaggacctgaagaaaggctttgctttgaaagtggagcctttgaatgcatttcttcctttcgagcagcagatgatggacttatcacacaggaagcaagagcatgctgcctgtgatgattcatgctctctctcaaa

SEQ ID NO: 19103 - DNA, 147 bp, Sorghum bicolor
  Clone ID: LIB3480-023-P1-K1-G1
gccagcgttcgattgaaagtgaccgctaatcaggagtactggtcggatcgcgccgaggtggagcacgcgtacaatcctatcggggtacgagagcgacctcgagtgcgtgatggatcgcttcaaccgacggctgtgcacaaggctcat

SEQ ID NO: 19104 - DNA, 525 bp, Sorghum bicolor
  Clone ID: LIB3480-023-P1-K1-G12
gaatcctaatcaacctgatgaaaggggggtacatgtcaagctatgcaagaaaaacaacagatatcttgaggccatgagaaaaagtgaagacatagaatgtggtgtgtgcttggaccgtgtgctttcaaaacctacggcagcagaaaggaggtttgggctgctatctgactgtgaccattccttctgcatctcatgcattaggaattggcgtagcacctctcctacgtctggcatggatgtcaactctacactcagggcttgtccaatatgccgcaaattgtcatactatgtagttcctagcattacttggtactcctcaaaggaagaaaagcaagaaattgttgaaggttacaaggctaagctcaggtctattgattgtaagcactttgacttcggaaagggcacttgtccctttggaagtagctgtttttacaagcatgcctacgatgatggccgtttggaagacgctttattgaatcaccatgacgctgaagatgcaagtgcggcgattgccagacttatgag

SEQ ID NO: 19105 - DNA, 286 bp, Sorghum bicolor
  Clone ID: LIB3480-023-P1-K1-H10
gtactctaaatctctaatagagtagtaaggtgtcgttccggccaggatagcgaggagctgaataatgaaatgaactaccagattcctccgtgactatctcagtacacgtagacgcgtgtattatcaataaattttgttctgaagtaaaaaaaaaaaaaaaaaaaaaaaaaaaaaaaaaaaaaaaaaggaaaaaaaaaaaaaaagataacaaactaacaaacgcgtgcatgcgacgaaattaagaaatactatagggtaacctaaatattggtgcgctggccttaat

SEQ ID NO: 19106 - DNA, 455 bp, Sorghum bicolor
  Clone ID: LIB3480-023-P1-K1-H11
aggagaaggacacgctgacgcaggaggtgccatgatccacgctcctgccaccgtgcgtgcgagctgataaggaccttctgcagctgcccgactacaaatccatcgacgagaaagactagcctcttgactgcaaggagctggagtggtcccaggacattgacctgttacacgatcattcttccgctaaaaccactactgccgaagtagcccgagacgcgtgcgctcgtcgcaaccagcgagcaacgccgaatgtctacaagacaaacggactaacgcgccacatcaagaacccacggatggatgtgcctgaggacgacgaggactacattagtcggcctgatatcggctgatatgagagatctctgcatgatcttcctggcatgtgatgtgtgcatgtatgcaaaagatgtatgtatgccattatgagatgcactgacacttactgcacatatgta

SEQ ID NO: 19107 - DNA, 483 bp, Sorghum bicolor
  unsure (1)..(483): unsure at all n locations
  Clone ID: LIB3480-023-P1-K1-H4
taaaaaaaaaaaaannaaaaaaaaaaaaaaaaaaaaaaaaaaaaaaaaaaaaaaaaaaaaaaaataaaataaaaaaaaaaataaaaaggaaaaaagaaaaaaattataaaaaacaaagtgaaaaaaataaataatgggggggggccttttaaaggaatacaaattttttgtccccttctttacactttaatatttttttttttgtgcccctaaataaaaattaatggccgggcttttaaaaaactttggctggaaaaacccttgccttaaccaaatttaattgttgtgaagaaaatccctttttcgtaggttgggttaaaagaaaaagggccccccccgtacccctttccaaaaaatttcccaccttaaatgcaaatgggaaccccccttttatccctccttttaatcccgggggggggggtgttttccccccaggagaccctttacttttacggggtcctatccccccggttttttgttttt

SEQ ID NO: 19108 - DNA, 382 bp, Sorghum bicolor
  Clone ID: LIB3480-024-P1-K1-A11
agttacttcacaatcttttaatattattttcaaatgaaaaatagtaacgaaggtgcacatcagaagcccaattgatttccaaaaccccatttcagagatgatgttattccagtttccaaacctaataatgatcatttcttattaatatttactgttgtttctttgctgaattatccccttattattttttcttcctctgtagattttcatgggcccagaggcgtcaaacagcttcgtttcttccaggtatcgcaccagaaaatctttctttactttatcctctactggcattcattgcgcacctctgttaaacatttggtctgaatcttgcaggcgaccacttggtgttcttcatactgaacatcttcacactcaccggtct

SEQ ID NO: 19109 - DNA, 433 bp, Sorghum bicolor
  unsure (1)..(433): unsure at all n locations
  Clone ID: LIB3480-024-P1-K1-A5
ggagaagtgcaggtatagaactacctgctggaaggtatccaaagaatggagctactgacatgataagggcaaattatcatagtgaggttggaagctcaagcagtactccttttggtgttacatctgatattgtgacagcatatgctgattcttttaaagtagagcttgggcgtaatgattttgagaagacagctatctcaaaaagggcagataaatttttaaaatggatgtggagggaatgctacaatcaggaattgacatgtgccatgaaatacgggaagaaaagatgctctgaattgttgcattcttgtaattgctgctatcagatntacttagccgaagaaaggcactgtccttcttgccataagacattcanatccatttacaatttttctgatcatacaacacaatgcgaagagaaacggagaactga

SEQ ID NO: 19110 - DNA, 341 bp, Sorghum bicolor
  Clone ID: LIB3480-024-P1-K1-B4
ggacgtgatgccgatcgccacggggctcgagcgcgaggagatcgaggccgaactccaggggaagaagaggtttgacatggacgcgcccgtcggtccctttggcaccaaggaagctcctgctgtgattcagtcatactacaacaaaaggattgttggttgccctggcggtgaaggagaagatgaacatgatgtggtgtggttttggttggagaaaggcaagccacatgaatgccctgtctgtactcaatatttcacgcttgatgtgattgggcaaggaggatctccagatggacatgatgatgacgatgaccatcaccaccaccatcactaaagttttgcag

SEQ ID NO: 19111 - DNA, 237 bp, Sorghum bicolor
  Clone ID: LIB3480-024-P1-K1-B7
accacattgaccagtcggccgttccgccaggtcatcgacaccctctactcaggcagaaggtttgacccacctcagctggccggcgattccgatgtctcagccgagctgaaagtgaatgaacttaaaaactgccgactatccatggtatgcatgtatggataatttttgcaagccagatatactagcaaagtcgacgtttgtgttctagaacatatgatcttgaatttcttaaaggta

SEQ ID NO: 19112 - DNA, 466 bp, Sorghum bicolor
  Clone ID: LIB3480-024-P1-K1-C11
gaaacttccaagagccgatcagataggaagccaccaggtgttggccgtggaagaggaaggggagacgttggtactaaacctggaggcagaggcattggacgtggccaagatgatggaggtagaggcagtggtggccgtggaaggggtgttggtgccaaaggtggcaacaaaggtgggggccgtggccgtggctgatgctggtggacgcatgggacaatgccgctttttaaggcctgtaattgtgttgcatagattgcttaggacatgaagaatgaaccaagttggttggttggttgttttggggcgaaacccagaatggttcctgtggtctaaacattgaggcagcggaggcggccgggcctgtcactgtttctcaaaacagtttggttgatatcttgagtatgagctaatctgttcatttgtggagaggcattcctgttaaatgacttattggtgttgccgattt

SEQ ID NO: 19113 - DNA, 453 bp, Sorghum bicolor
  Clone ID: LIB3480-024-P1-K1-D1
cccacgcgtccggtctgatagcatcttggtgtgaacagaacggggttcctgttccatctggaccgccagaatctcccaagctagaacacctgagaatttcatccctggaaagcagcgcatgttcggcgacccatggcgctaacgctgttttgttcgaagacacagctgacaaggataatgccaagtcggagagtgaagtttccatggagatgttgtctcgtcagaactccggagaggccacctccaaactacgtgtacatgaagaagtctcaccggagaactgctctctacagagctccaaggaggttgcacctgagatatgtggggttgaagactctgtgaagaagagtgctcatcagaactccaaagatgatgtgccctgcagtgacagatgtgaacagtggctccatgtgctgaacaagaacgatgctgagagtatgagtgagagacata

SEQ ID NO: 19114 - DNA, 328 bp, Sorghum bicolor
  unsure (1)..(328): unsure at all n locations
  Clone ID: LIB3480-024-P1-K1-E10
cccacgcgtccgaaaaaaataaaaaaaaaaaaaaaaaaaaaaaaaaaaattaaaaatattaaaaaaaaagattaataaaatggaataagggttatattaaaaaaaattattgtgtatacantttttttnttaatggggggggcctttttaaagattcaaagtttatttaccctttcttgcaaggtattaattttttttttgtgtcacctaaattaattttatttgcctgtttttaaaaacttttgaatggggaaaaccctgtttttaccaaatttaatggctttgaaaaaaatcccctttttccaagtttgcttaaaaacaaaaaggc

SEQ ID NO: 19115 - DNA, 383 bp, Sorghum bicolor
  Clone ID: LIB3480-024-P1-K1-F11
ctgcactcgaagaagatcatgcaccgcgacgtgaaggcggagaacatgctgctagaccggaagcggacactgaagatcgccgacttcggcgtggcgcgcgtggaggcgcagagctgcgaggtgacggggcagacaggcacgctgggctacatggcgccggaggtgctgcaggggaagccgtacgaccacaagtgcgacgtgtacagtttcggcatcgtgctgtgggagacctactgctgcgccatggcctaccccaactacagcctcgccgacatcttctaccacgtcgtcaagctgggcatccggccggacattccgaggtgctgtccacgggcgatggccgacatcatgacgcggtgttgggacgggaacccagacaaccg

SEQ ID NO: 19116 - DNA, 387 bp, Sorghum bicolor
  Clone ID: LIB3480-024-P1-K1-F3
ggcgggtcgtggctcatggcgcagcgagctcgcgcagttgatagcgggcggcagagcaagcgagcacggcgtcgttgggacgagctggacgggcggcgcgagaagggcgggcgtgctgctgcagcggtggtcggcgagcgcgaggcccgtggtgtgagcgcctcgcagcagcgctgacgggcaacgcgggcggcacaagaagggcgggcgcggtgccgccggaggtgagcgggaaaggctgcgcggcgctacgggcacgaacgagatggacgaagaaaccaccagtttcttttcaacagtgattttgccgtttctttgggccttggagcgagcggctacgttttttctgggtgaagaaatagtttctaccgttttccctttctttct

SEQ ID NO: 19117 - DNA, 411 bp, Sorghum bicolor
  Clone ID: LIB3480-024-P1-K1-F4
gtgctcaaggacatcttgaagttggtccatgaagcccttcccgggagctattttaacagcttgctcctgaacagatacgagacaggttcagaggatgtttcatggcatgctgatgatgagcccctctacggaccgactccagagatagcatctgttacctttgggtgtgaacgccacttcttactgaggaagaagcctgctaaatcgcaagccatttctgcatctggagaagctggtcgaaagcggctcaaggtcgctgcatctcaaaagcagcattcttttcttctgaagcatggctcgctgcttgtgatgagaggctacacccagcgggactggcagcactcagtttcgaagcgagccaaagtgagcttaccgaggatcaatctgactttcaggcatggtgctgcctaa

SEQ ID NO: 19118 - DNA, 266 bp, Sorghum bicolor
  Clone ID: LIB3480-024-P1-K1-F9
cggacgcgtgggagcttactttggcggagcaagagcaggggcagctgcagcagcagctccggcaatggactggtccttcgctagcaagcccggcgccgccccggcgttgatgtcgttccggtcggcggcgagggaggagccttcgttcccccaattctcctcctccttcgacggcgctaagaacccggcggcctctcgtatcctcacgcaccagagatctttcggtcccgacagcacgcagtacgccggcgtgcaccgcgcgcagc

SEQ ID NO: 19119 - DNA, 396 bp, Sorghum bicolor
  Clone ID: LIB3480-024-P1-K1-G7
aaaagggaagccaacgcaatcaccgcaaggaatttttctttcctacatcgcctgatcagtcgcccctgcaatctctcccgcgcggtggatttggccttcctccgaagtcgccctcgccctcgcccgctggcctcgcaggacatcgcacccgtgttgtccccgtcgccctcgccgttgcgagccgcggccgtcctcgcccgctgcatgtgctctacgatctcggtgagtcttgcggttgtatgctttccctctccctccccctccccctacgctggatgtgcagctgccaatctactaagctgcttggagccacagactcaaatctctccccactgcccctctcgtcaatcgctgctattgcgcctgtcggatcctcacctatgcctgcacgctagc

SEQ ID NO: 19120 - DNA, 416 bp, Sorghum bicolor
  Clone ID: LIB3480-024-P1-K1-H1
gtccttcaaggcatatcttatcgcttcccatgattcaacatcccatatgtcatcaacaacgatgaagtacctataattcacacaagaatgcagagctatgaatagtttggcaaatcagtatagagtatccaaatagaccagacgcaagtaacattttttttcgagaacatgtgctgcatgtatttcattaagcataagtaacatgaacatggttctagcaagaaaaatttgcagcctatgactccatgggagaggattatgtgtctatcaattcaaatgtgctacaacttaaggatccaactaaaaaaaaattgaaattccaaatatttttctagatgtttggcaagaaaattcgttgtactttttaaccaaaactggaatatctcataaacgatttaatcgaatgaactgaatgc

SEQ ID NO: 19121 - DNA, 178 bp, Sorghum bicolor
  Clone ID: LIB3480-025-P1-K1-A10
gtactacatggctccctttgcgacgatgatcctgtcagtgccagccatggtgctggagggcagcggcgtggtgagctggctgtacacgtacgagtccgtggggccagcgctgtctatcatcttcacgttgggggtgctggccttctgccttaactttttcatttattacgttattcac

SEQ ID NO: 19122 - DNA, 351 bp, Sorghum bicolor
  Clone ID: LIB3480-025-P1-K1-A2
gaaacttgtttacaaagagctgaatttggatgctgctaagaagtttctgagcgcatatgagagctgatgatgaacaatagatagatgctgctcaaggatcagcaggtgccaatgatcatggagaattgttgatgcttttgagattttgatcattggcaaacttaggccattgaaatgtgttgtgtgcagacagtagatatccctttttggttagctacaatatatatattttttcagataaacgtttgaagttgtccatttgtacactaatatacgtttttctgtgtttgcacttgtattcgttgtatcttttttaaattttagtataaaagggaacctactactcttaaa

SEQ ID NO: 19123 - DNA, 217 bp, Sorghum bicolor
  Clone ID: LIB3480-025-P1-K1-A4
cgcagacgaacactaagctcccctggccctattaaaatggcccaagcatatgcagtccaaattaggcatatggtcatgaagactggatagaatgaatttcaggacactggacgagtcatcatttagcgaataactatcttcatacacaatgtctatctagattgatttgacttactgatgttgcatggtcagttttattgttttttgagagctatta

SEQ ID NO: 19124 - DNA, 291 bp, Sorghum bicolor
  Clone ID: LIB3480-025-P1-K1-A5
gtatgaactaccaggacgtggcgtgacacaatgagactactagctgcaacactgatatcatgcatgcataacaagtgtacagattggacgcccaggcatgtttcatagtggccgatgttgaacatatttacaatgaacgatgcaagtccggaacggacatgtattgaacactgagcgtcggatgtgtagctgaaacggactgcattgctctccatccagggagtgaggacggcagactgtgatatcttgtatgagattattaggacacccatgactgtacgtagtaggcaa

SEQ ID NO: 19125 - DNA, 438 bp, Sorghum bicolor
  unsure (1)..(438): unsure at all n locations
  Clone ID: LIB3480-025-P1-K1-A6
cggacgcgtgggctcgacaccggcttccgcgcacgcctctccgacttcgggctcgccaaggtcggccccgtcggcgacaagacacacgtctccacgcgcgtcatgggcacctacggctactgcgcaccggagtacgcgctcacggtcaagctcaccaccatgtccgacgtctacagcttcggcgtcgtcttcctcgagatcatcaccggcagccgcgccatcgacaccaccaggccgccagacaagcacaacctcgtcctctgggccggcccgcgattcaaggacaagcgacggttcgccgagatggccgacccgctgctccagggcgcatacccaaccaagggactctaccaggcgctcgccatcgcagccatgtgcctncaggaggatgccaccatgcgccccgtcatcaagcgacgtcgtcactcgcgctcgagt

SEQ ID NO: 19126 - DNA, 353 bp, Sorghum bicolor
  unsure (1)..(353): unsure at all n locations
  Clone ID: LIB3480-025-P1-K1-A7
ctatgttgatgaggctattgcgtcagctgggaactggctgatcggtggcgacttggaggtgttggaacccatcaaatacaatgatggtcttgatcactacagactttcacctcggcaacttaggaatgagtttgacaaacggggggctgatgctgtgtttgccttccagttgagaaatccagtacacaatggtcatgcgctattgatgaatgacactagaaggcgtctcttggaaatgggttacaagaatcccattctactgctacatcctttaggtggttntaccaaagccgatgatgtctcactgcggtagaatggaacaacacagcaaggtcttggaagatggagttctt

SEQ ID NO: 19127 - DNA, 459 bp, Sorghum bicolor
  Clone ID: LIB3480-025-P1-K1-A8
ccaaaatgcttcaaggtttaatatattttagcaaggttgtagtcatgatgtcattaccgctcttttatgatattttcattctcatttggaatcattcattggcatatgttatgatgagtactcagttttctataatgtttgttttccacttttattgagacgagacatgaaatgcttttttccatgatttcaaattaccatgtgtggccttacttcatactttaagccctgttgccaaatatatgctgacctatgctcaagttgcctgtgtttgttgcttcacaacgctaaggaatatgctaagttgtagatttgcaatgaggaaaaatccattttatgtaacattgttgacagttatgtccatgttttttattgcaggttaattaaggttgtttggatagttctgcaattgtagttaggcatggattctatgagaagtcagggtagatctactgaatc

SEQ ID NO: 19128 - DNA, 466 bp, Sorghum bicolor
  Clone ID: LIB3480-025-P1-K1-B1
gcccagtttcatgctacctacttctggaacagagacaatgatgaggttcattggatgacagatggtacacattataggattgatttcattaccttctgcaggatattgggttttggaaatgaccatagaacctactctcgaattcacaatgagagaaggtttgaaccacaagaggtgagttttatgtgggaggatccaacccaagtgaacaacaggaggactgggttgaagagtttctattatgtgatgaacaaccttatcaaaatgacactcaacccaaaagacaatgccactgatctaaatggacatattactaatgtgctgtccagatttccagaaggggataaatttaatatcccaaggttcatatgggtagagctggcatatgctatggatgatggaaggaggtcacttccttatgctccttatctgatgttgtgattgagagagtgactggagtcaaata

SEQ ID NO: 19129 - DNA, 509 bp, Sorghum bicolor
  Clone ID: LIB3480-025-P1-K1-B7
caccaatgtgcaactggcgaagttgtccatcacagcacctggcacgagccctaacactgatggcattcacatcactcggagcaaagatgtgcgggtcacaaattgcaagatcaagactggggatgattgcatatcaatcgaggacgggactcataaacttcatgtctccaatgttgtttgtggtcctgggcacgggattagcatcggaagcttaggagatgacaactcacgagcccaggtctctggtattaccatagattcagtacaattacatggcacaaccaatggagcacggatcaagacataccagggaggaagtggatacgccaaggacatcacattccagaacatgatcatgtacaatgtcaagaacccgataatcatcgaccaaaactattgcgacaaggctaagccatgcagggaacaaaggtcagcagtgcagattagcaatggtgtcttcaagaacaatagagggacaactattacccaggatgctatcaagatgcact

SEQ ID NO: 19130 - DNA, 320 bp, Sorghum bicolor
  Clone ID: LIB3480-025-P1-K1-C1
gaaaaaagaaaaaaataaaaaattaaaacccataccctcttaatataagaaaataaacatacaactacataaaaaaaaaaaacatatattaggggtatgggtaatcaaaaaaacagagtaggaggtggcgctccgatctttatgttccttgttttctcccccttttatcgtacctttttccttttttttggtcaccccaaaatttatttctttgcccgtaatttaacaattcattaccttgggactctcttaacataccccaattttgaatctttcctgcacatccccttttatccattgtgtaaattatccaataggcc

SEQ ID NO: 19131 - DNA, 396 bp, Sorghum bicolor
  Clone ID: LIB3480-025-P1-K1-C2
ttgacgtagaccgagagctagctctctagcggatgcactcgaggatacacgtgcatgcgcagcttgtatgtcatgtattgggtcacctatagtgaggccactgtccaattgactggaccgtgtttactagcaaaacgactgcgaaacccaagtcaatacccaagtaacacatcttgctttacatagctggcgtgatagctggcaggccagcaccgagggccctaccgaacagtcgtgcaaactgtagggcaaacgggacgggcaatggaacgcgccatgaagcgcggcattaagcgcggttgctctcatggtgaccctcacactggccagtgcactagctagcgctctatcggccgcttttcttgcctttttcgctacgtttgtcggctctaccgg

SEQ ID NO: 19132 - DNA, 455 bp, Sorghum bicolor
  unsure (1)..(455): unsure at all n locations
  Clone ID: LIB3480-025-P1-K1-D10
ccatacacttctctcagcaattaggtgctgatgacctggacaagagcgcagtggagaggctgacagctctgagggctagggttgtggcaatggcgacgcaggaatcgtcggcggctctgaagccaaggcgaaaggctgcagcgcggcatggagggtctagcactgctaatctcctccaggctctggaagagtacttgccagctctgctagaactggtggaagaaggcagtgagatgagaaacaaggtggagtttgtatgggctaaccaggaagatgtggctgaggagacatccatggcagatccttggtatgaggtgctgtccgtgctgcatttgatggccatggtgtgcttcttgcaggctaacaccctgctacttcctaggccctatgtggatggtcacggtcccagagtgtcagtagagagcangcatgccactgtagtctcttcttgaagg

SEQ ID NO: 19133 - DNA, 222 bp, Sorghum bicolor
  Clone ID: LIB3480-025-P1-K1-D2
cacctcagggtgagacccattaacattattgaagatgatgaggagggcgactaatgcaattggcctggttgcattcatcggcgtggccaaacctgtcacttacccgacgacgactacagaagctgcggcggtgtctcctgcggcggcggagttcctccaaggccggtgcaaccctagcgagctaccaaaggagaccccccggctcttttacaactccctcct

SEQ ID NO: 19134 - DNA, 387 bp, Sorghum bicolor
  Clone ID: LIB3480-025-P1-K1-D3
cactcatcaggctgcaggtggagaacggcaaggtggtcaagcacgaggattggtgggacaagaagcctctgaagaacagggacacggtgggcctgccgctggtgggccgtctcgcggaggctagccggcggggcgccatgctgctcacccacgccctcatgggcttcggaaacgaccctaaaccttctccacactagtaccagtgtccattttgccgccacgtcaatccaatccatcagtcagcagtactccagtgtagtgtgtatttcggctgtgcctttagctattgatcaatccaacggattacacgtatacattatttactgtattctcatcttgcctatactattaattaacatgatgtgggggataaacccctgcctatat

SEQ ID NO: 19135 - DNA, 162 bp, Sorghum bicolor
  Clone ID: LIB3480-025-P1-K1-E12
gaggggtgcgtgctatgtgagagccattttatgtccccacctaaatgcaataatctgtcctttattgtacaacttaaagtctgttaaatccctggcgttttcaaactaaatcacttggaaacccattcccttttccaactatggcgtattggggaataggcc

SEQ ID NO: 19136 - DNA, 398 bp, Sorghum bicolor
  Clone ID: LIB3480-025-P1-K1-E4
cggtcatcggcgggcggcgcaccgagggcgcgagctcgagcgccgcccggtccgtgcggctggtgcggaagctcgccacggccttgtccgagggccggagcgagcgcgtctccacgggcatctggaccgcgggcgacgacccggagacgttggaggaagttctcgccttctccctgcagaagctggagaccatggccgtggacgcgctggcggtccatgccgagatggccgacgaggacgcgccgttcgaagtgtcagcgtctgcgggggacacgacgagcgtgttcgactcgctggtgccgtctgacgagtggtccgagtctgctgcaagcggtggcttcgactggcgcgtcacgctggtagcggccatccatgtgcgcgacctggggcggcggtac

SEQ ID NO: 19137 - DNA, 451 bp, Sorghum bicolor
  Clone ID: LIB3480-025-P1-K1-E8
ggctccatcgtcgctaacacagggtgcatgactgctgcatagcggccgatgccaatggcctgtgcccttatgtggaactaacaagacgcaaccatcctgggagaatgcacagtactccttgtcctaatctcaaggttcatgttggatgtaccagtgtaagtgacctccgagcactatagactaaatagcaatgaggtgaatcacaacatcctaatcaccaataagtcattgggctcactgctctatgggcagaatgcttacatggagtacgatggacatgaccaaaagatgacgggcatggataaccacactggcattgccaaaatcatgattgtgtgcatggtgatgaagtgctacttaaccaccttcttcttgcgggatggcatcacatttgtagggttagcatgaagcatagctctattcatactaacaaaaccagctatatgctgct

SEQ ID NO: 19138 - DNA, 391 bp, Sorghum bicolor
  Clone ID: LIB3480-025-P1-K1-F10
cggctactacatccggcgaccaaacaagtctatgatgagctcacatcttaccatacgcatgcaatgctgacgtcattactttacatatagtgggcatgtagaagcacaatgcactgactgtgccgatacaatgaaaatactcggaaagcgttgcccaaactgacaataatctattgaggatgcagcccggtcgcagcagaatgcgtgagctcaagaaggacgaaacggatcgcacaaacgagcaggtgctcacacagaaagatgagtgggacgcgcactgtagcggctcatgaagctcgttacctgttgatgacaaccactgaagatctactacattggtcagggagatatgtcaatatgtttttgctgcttaagagcgctgtgttggcat

SEQ ID NO: 19139 - DNA, 439 bp, Sorghum bicolor
  Clone ID: LIB3480-025-P1-K1-F7
tcaggatcagccttgcacaagctatactgtttctagaaagcgattgacaggtggagtgaatggcgggatcataagtgatgggacactcaagtcactacactataaaagagactacctcttcccattgtcattgttattgcaaaattccaggcctctaggctatgcggaaacattgcagttgctcatttgtattgtacttttgggtgatttttccatcaccctgctcatgcttgtacagtactattggatattcgtcggagcttttcttgccatactgctcatcccccctcttgctttgctttcacctattctagctggactcaatgcactatttagccgaggtctaaaacgatctttagtgacccgcatttttgcactttggaacattactcctgttgtaaacattattgtagcaatcatatacggctctttgtatttt

SEQ ID NO: 19140 - DNA, 149 bp, Sorghum bicolor
  Clone ID: LIB3480-025-P1-K1-G6
caacatgtgttgtgtctgccctgatcctgggtcggttctgttgtattttaagtagttttggtttgtctaccgaagacattatgcaaacgtgttgggagagccaatagatgggattgaatcgagtttctgctttgttctgattctttata

SEQ ID NO: 19141 - DNA, 469 bp, Sorghum bicolor
  unsure (1)..(469): unsure at all n locations
  Clone ID: LIB3480-025-P1-K1-H10
gtcttgtgtgtggactccgatcatgtattaaaccaactactgaacgaaaaccttttccatggtccgttgatgcaaatcttgaagcaacgtctctgttatttcgaatgactgcagtgacagaacctaaacaagcatcccgtagattcatagatcctccaaaaaggctaacaagtttctgtggaactccagcactgcatagtgataattgttctgcactactctcacaagagtgagatataatagcagcagccagctctgtgacattctcgttctcactgtccaaaagcgaaagaacaaaatccatgttttccccactattaacatcaaactttggagctaatcttgattgatatatcattctgagagcacgtgcacttgcgtccacaaccttctcgcgcagcgcgcggacgcgctcgtgctccacctnctctccgccggcgccggcgccggcgcagccctcggcgggccc

SEQ ID NO: 19142 - DNA, 471 bp, Sorghum bicolor
  Clone ID: LIB3480-026-P1-K1-B1
ctgaaaggtctataccaggcacttgcaatctcatcaatgtgcttacaagaagaagcaagcagtcggccactgatcagtgatgttgtgaccgcccttacatttcttgctgatccaaactatgatcctccagatgacatcaaagatcctctgcccataacagttccaaacatagacatagaaactaatcaaaacgaaactgaaggaggtaaagaacaattacagcaaaatgaagaagatagccatgagagaaaaaatgaagaagatagccatgagagaaaaagtgaagaagatagccctgagagaaaaaatgaagaagatagctgaaatggcttctggaattaagagatgataaatcaagccagagttgtgtagagaggaaccggatggagggagtatctacacaatacattttttgttgtaatgtcacatataggcaggatgtaacaacagattgtcttcttgaatgaaaca

SEQ ID NO: 19143 - DNA, 200 bp, Sorghum bicolor
  Clone ID: LIB3480-026-P1-K1-E5
gatccgtcgccacgcgtcgttctagatcgagcggcgttagaatccactctccgtgcatgcacttacttttgggacgtaatcaatactgccgcgttacactctgactgaaacctgcgtccactaatcgctgccacatccttcgcagctgcgtaatacaaaggccgaccgatcgccttcctcagtgcgcagctgatggcatg

SEQ ID NO: 19144 - DNA, 237 bp, Sorghum bicolor
  unsure (1)..(237): unsure at all n locations
  Clone ID: LIB3480-026-P1-K1-E8
atcggtagatactgagtctcattccgaactctagctggaactccttctcaagcagtataccatattccgcgtcctttcgtgaaacccaaggacaacctgtgggttgtcttcgaggaggaaatgggcaagccggatggcatcctcgtgcagaccgtgacgagagacgacatatgcctgctgatatcggagcacatacccgggacatgataatatgatcgtgggacatcggtnatgggg

SEQ ID NO: 19145 - DNA, 239 bp, Sorghum bicolor
  Clone ID: LIB3480-026-P1-K1-F3
acgcggcagcgacgtatagcttggataggcaccaatcaatcactgccgcgttacacgcggacggaacccgcgaccaactaacgctgacaatcccttcgcagcgggaaagcgaaaggccgaccgacgccttcaacagtgcgcagcgaaggcaaggacgcccctgagcggcctaagccggcggtgggggtaccgcagggccgtcactgcaggcctacgccgtcttcgttcttcctccttct

SEQ ID NO: 19146 - DNA, 355 bp, Sorghum bicolor
  unsure (1)..(355): unsure at all n locations
  Clone ID: LIB3480-026-P1-K1-H10
cgttccggtcgttcccggtcatccaggcgccgtcctgccgcggcatgccgtcgctgaaccacctcctcgggctagacggcgccggcggagtccggagccacttccacggcgcgacgcacgccacggngacgctgtacggccaccggcgggcgcgcatcaccatcgcgctgcacgagagccccggcgccccgccgtgcgtgctgctggacatgggcgtgcccacggccaagttcatccaggacgtgagcgcggcggggatggtgcgcgtcacgctcgagtgcgagaagcagcagcagcagcagcaccacgcggcggcggagtcgtcggtgcggctgctggacgagccggactggac

SEQ ID NO: 19147 - DNA, 463 bp, Sorghum bicolor
  unsure (1)..(463): unsure at all n locations
  Clone ID: LIB3480-026-P1-K1-H6
attggtaacaagggatcagtatcagtcagcatgtctatacatcagactcctttctgcnttgtctgttgccacctggctgctggtgaaaaagatggatatgacctataaaggaattcaaatgtcgaagaaatacttcgaagaacagtgtttaacccagtcaatgctgtaggcatgcctatgagaatacacgaccatgaaaggatcatatggttaggagacctcaactatcggatcaacttatcctatgaaaggacacacgaactaatctccaaacaagactgggatagattgtttgagagggatcagctgaaaagagaattgaggaaaggatgcacatttgacgggtggtttgaaggagttatcagctttcccccaacatataaatacgagtttgactcagaatactatgtaagtgatgagagtaaatctgggagaagaactcctgcatggtgtgaccgcattc

SEQ ID NO: 19148 - DNA, 393 bp, Sorghum bicolor
  unsure (1)..(393): unsure at all n locations
  Clone ID: LIB3480-027-P1-K1-A10
ctgcactggtgaacgacaccgtggggacattagctctaggacattattatgatgaggatacagtggctgctgtgatcatcggtgctggcaccaatgcttgctatattgaacgcactgatgcaattattaaatgtcagggtcttcttacaaactctggtggcatggtagtaaacatggaatggggcaatttctggtcatcacatttgccaagaactccttatgacatctcccttgatgatgagacgcaaaatcgcaatgatcaggggtttgagaaaatgatctctgggatttatctcggggaaattgcaaggctggtgctgctcgcatggctctagaatcagatgttntggcgatgcttgtgatcatctatctacccccttcacattgagcaca

SEQ ID NO: 19149 - DNA, 291 bp, Sorghum bicolor
  Clone ID: LIB3480-027-P1-K1-A4
gcgcgcccagacacacacgttattatgtctcgcgcgctcgcccttgcggtcctcctcgtcatggccgccgccatcgcggtggcgccggtggccgcctacgcggacgccgtcgtcgtgcagtccatccccggcgccggagccgtcggcggcgtcggccccgatcgcgacccgaccagcggtctgctggccgacccatcgcccgacgcgcgccgctaacgccacgcgcaccaggcgttgttccggccggcctgtatgaacattgcaagtacggtcatgttgttatgtctgttg

SEQ ID NO: 19150 - DNA, 484 bp, Sorghum bicolor
  unsure (1)..(484): unsure at all n locations
  Clone ID: LIB3480-027-P1-K1-A6
ctgggccaaattgccgctgctgcgacgcctcatgctctcccacccggaggtcgagtggatctggtggatggacagcgacgcgcgcttcaccgacatggcgttcgagctgccactgtcgcgctacgatggtcacaacctcatcatccacggctaccaggacctcctctttgagaagcactcttggattgctctcaacaccggcagtttcctcttcaggaattgccagtggtcgcttgacctactggacgcgtgggcgcccatgggccccaagggcttcatccgcgaccaggccggcaaggtactcacggcgaacctcaagggccggcagcattcgaggccgacgnaccagtccactgatttacctcttgctctcgcaaaaggacaagtggatggacaaggtgttcatagagaattcctactacttgcatggcttctgggctgggctggtggacaaggtttaggagatgattgagaatcaccaccc

SEQ ID NO: 19151 - DNA, 136 bp, Sorghum bicolor
  unsure (1)..(136): unsure at all n locations
  Clone ID: LIB3480-027-P1-K1-B1
cccacgcgtccggcgggagcactncgacctgnccatgccggcgnncctccagaacgcggaggagaaggccggcatcgngcccggctcctaccggccggtggcgtgcgcgaggcanggcggcatccggtacgccatc

SEQ ID NO: 19152 - DNA, 359 bp, Sorghum bicolor
  unsure (1)..(359): unsure at all n locations
  Clone ID: LIB3480-027-P1-K1-B5
ggccggccggcgaatcaatcaagaacgtcaccgctagttaggggcgtggttgttggacctgcgtgccatgggggatcaccatatgcggctgcacaggccggcgccgatcgagaagatcgcggtgccggagaagaaggccttgttcctncacgccgccggcgcgtcgtcgccggtgcagcagcagcagcagcacggcgcctcctcgcacgagagcatcacgccgcggacggccacgaataagcagccggcgagcccccgggcgtgcctctgctcgccgaccctgcacgcgggttcgttccgctgcaggctccaccgcggcaatttcgcggcggcggcggcggcggcggcagcgcgacggc

SEQ ID NO: 19153 - DNA, 320 bp, Sorghum bicolor
  Clone ID: LIB3480-027-P1-K1-B6
ctcgacctgaggggtaatcagcttgcatcattgccgccaagtcttggtaggttggtgaagcttgaggagcttgatgtgagtgcagaccatcttacctcactccctgccgcaattggaagcctcaaaaatctgaagaagttaattgtcgagacaaacaaccttgatgagttgccgtccactatgggcaattgtgtgtcactggtggagttgcgggcaggctacaatcacttcaaggccctccaagaggccgtcgggaagctagagtctctggaggtcctctctgtgcaatacaacagtattagggggcttccaacaacaat

SEQ ID NO: 19154 - DNA, 421 bp, Sorghum bicolor
  Clone ID: LIB3480-027-P1-K1-B7
acgctagatctgatgatgcaccacatctgctattgccgagggacctgcgccgaaggagctaccatgcactagagtgctgtaggatggcgtatgatcacatagctcaccaacatacttactggaatcgcacttcgggaagagaccatatctggttcttttcatgggatgaaggtgcctgctatgctccaaaagagatctggaacagcatgatgcttgtccactggcgaaacactaatacaaaacataagaattcaacgactgcttatcgggcagacaactgggatgatattccttaggataagagaggcacccatccatgttttatccaagaaaggatctagtgcttccgcgtggaaggaaccaaaccctggagcaatatggttaaaacttttggtatggtccatgaagaaccacacaacac

SEQ ID NO: 19155 - DNA, 545 bp, Sorghum bicolor
  Clone ID: LIB3480-027-P1-K1-B8
ctccaagaaattctcatattttattccccaaaatatggtatttgtcaactcttaaattagtatgagcaggaaaaaaagaagtcatctccaagagtttgctatatttttatcttaaaatttttttctcagcatttttttcctacgacccggtcttatattttatattaggaactctcaatttatttctatacgtgtgtaagccctttcactaaatctttctctcttgtgtttttctcacatggaaccctgtctttctccttactagatgggccggaaaactcaagatacgcgctcctaggccacgtgcatatatgcgcgctgagagaaatttttgctgaggttggaaagatggggaaggaagatggcaaactattggagagagtttttttttattttgccaaaaaattaatgatggaaaggccggatggcaaactgttagagatgctcttatgtagtaagtttttgtaggagagtaccctacaaccaatttcagcatatatgcgagcactgctgcagcaaattaccttaaatttgcttctatattt

SEQ ID NO: 19156 - DNA, 490 bp, Sorghum bicolor
  unsure (1)..(490): unsure at all n locations
  Clone ID: LIB3480-027-P1-K1-B9
tgaagacaccagccaagagagcgtgatgctgtggctactgaaggacaagctaagtgagatggaccatgacggagatgggaggataaacttggaggagtttgtcgcccaatctgatcttgagcgtgccgaagctgaagagaagttcagagaattggacgccgacatggacaactacttgacggtggaagaagcacgctctgtactgcaaagcctcattacaggggagttctcatatgctacttcacatgccaaatttttgatgaaggctgatgttaaccaagacggcaaattgtcgctggaggagatgctagatgactacgtaccttctacagcaccgtttatacggatatcattacagcaatgaagttgatagtgattcccacgacgagctatgagcagttaagccagggcaggacagcgatacgganggggnagggtctttttactttctaataggagttcgcagccaaaaaaatgaaaaatgtacagc

SEQ ID NO: 19157 - DNA, 354 bp, Sorghum bicolor
  Clone ID: LIB3480-027-P1-K1-C11
aagcggcatagccctgcgccgcgtccggcagcatgtggatcaggcccgcgcccaggaagataccggcggccagcgcgtggcccgtcgcggcgatcggcgacccgtgcaacgggcggctcgtgcggaaccagggtatcgccgcgaccaccgccacgacgaccaatgtcccggtcagcaggatcaggagaagctcccggttcacgctgtcacgcctcccatcgcctgcgcatcatggatcgatggcgatgtgatgatgtatcattggggatcggtcaacatggcctgtgtccgaccgccgcccccctcataacgaatacgtcacgcagggtatcgtttttgccgtcagtcatctat

SEQ ID NO: 19158 - DNA, 242 bp, Sorghum bicolor
  Clone ID: LIB3480-027-P1-K1-C4
aacaagcatactcaatattttgagtggggcgtccagacgttcatgagccacaatgcgcccccagcatacgaatgtctttctactgtgggtgctcttgtggagccagcacttgcggatcctgctagtggagagagtcctgaaacacatgtctatcctcgagcaaaattattcaaaagcataatctattgtgcgcctgaaaatacaaaatgcgcgggcgcagtaccttgatgaggacatcgcat

SEQ ID NO: 19159 - DNA, 369 bp, Sorghum bicolor
  Clone ID: LIB3480-027-P1-K1-C7
cgctggactggcattccagtgactaggcttggacagaatgataaggagaggctggttggactggccgataggcttcatcgagagggtcattggacagcatgaagccgtcaatgctattgcagaggctgttctgaggtccagggctggtcttgggcggacacagcagcctactggctcattcctcttccttggaccgactggtgtaggcaagactgaacttgccaaggctcttgctgagcagctatttgatgatgagaagttgcttgttcgccttgatatgtctgaatatatggagaaacattcagtttctcgactaattggtcaccacctggctatgttggccatgagaaggagggtaccgcgtgcgga

SEQ ID NO: 19160 - DNA, 365 bp, Sorghum bicolor
  Clone ID: LIB3480-027-P1-K1-C8
cggacgcgtgggcgtgaagccgctgttcccggacgcgaggtcgcgcccggcggcggtgcggcggctgttcgacgggccggtgaagctggacacggcggggctgatgcaacagtccatctgctacgacggcgccaaccgttggacggtgtccgtggcgtgggggttcacggtgctggtggccaggggcataatgtcgcctcgggagatggagatgccggcgcgcacgttcctcaactggtaccgtcgcgccgactacacggcgtacgcgttcaacacgaggccgatggctgcgcagcccgagccagaagcctcgcctgtactaatgtcatctgggcggcgccaggacgacgcggcggggagaccac

SEQ ID NO: 19161 - DNA, 302 bp, Sorghum bicolor
  Clone ID: LIB3480-027-P1-K1-D11
aaaataaataaaaaataaaacaccactaaaaaaaaaaaaaacaaaaaaatattaccaataaacacaccatcaacaaacaccgggggcgactctttataaaaacatcctgccttaccaacccatccataccatttaatattttttatattttccaaactaaatttaattgcctctcccttttttaacaacccgactactataaaaaaccttttccctacctaacttaattgccatgaaataaaacctttttttagctcccttaattaaaaaaaaaaagccccccactcttcttccttaccaaa

SEQ ID NO: 19162 - DNA, 432 bp, Sorghum bicolor
  unsure (1)..(432): unsure at all n locations
  Clone ID: LIB3480-027-P1-K1-D3
ctgtatatgagagtgttaggttggtgatatggcgtactttcgtcttatttgacaattactgtcctatcatggactaattaggcgtgaaagatttatctcgtaaaaaaaaaaaaaaaaaaaaaaaaaaaaaaaaaaaaaaaaaaaaaaaaaaaaaaaaaaaaagagggnaggaaataaagggttaagaaagaaaaaaataaaatgaaaaaaataagataaatataaataaaaaaaaaattaaaattaataaaaaaaatttaattggggggggctttttaaaaaaaaaaaaaaaattttaaatgtttttaatannaaaaatttttttaaatggtacaaaaaaaaaatttattggcttgtgtaaaaaaaaaaaggaaggaaaaaaaattttttttataaaaaataaaaaaattttaaaaaaaaaaacctatttcc

SEQ ID NO: 19163 - DNA, 353 bp, Sorghum bicolor
  Clone ID: LIB3480-027-P1-K1-E10
ctgaaaaagagcttcaacatgagcaacctcatcatccaccagacgatgctgccgccggtggaggccgcagacgaggagggggacgcctacgactacgcggagctggactccgagctggagaagcgccagcagcagaaggcacaggagaaggagaaaggaattccataggcggttgcagagcacaagaaattcctcgaaagactaatggatctgctcaaggatgactggaagggcatctgcaagggcttcttcaacagcatgacggccacccaggtggccaaccatgcccagaagtacttccttcagtagatcaaccccgggaagaaaaacgccaggagaagctctttgacagc

SEQ ID NO: 19164 - DNA, 372 bp, Sorghum bicolor
  Clone ID: LIB3480-027-P1-K1-F10
ggctgatcacggtttagctgaacgaggcctacacgcattgccttaccaccacacccgtctaacctcaggttcaaatagggccctatattttcacctttgaccacacctatggcctctcaaaaccttcatcatcattaatataagagcaatgcatgcactcctcgattgatgcattgttcagcggatacaacgccactgtcctagcatattgccagactggttctcacacgacatacacaatgggtactgactacagtcgtgacagcaactgcggagggattagtgctcaagttctggatacaatattcacaaaagttgatacctaaaggatggctccgagtttttaatttagtgtcttttaatgagatattc

SEQ ID NO: 19165 - DNA, 312 bp, Sorghum bicolor
  Clone ID: LIB3480-027-P1-K1-F8
gccttggcggcttcttctccaagccatggaagcccaagaaaaccaagcagatcaagggacccgcgcacgtgtcacgagatgactcgttcaagaagaaggccagccgcatggagcaaaaggacaagctcgggctgagcccgcgagggaagcgcgaccctcgacactacgccgaggccaccgatgccatggacaaagttcagatcgagaagaagaagcaggacgaccccctcgatgacctcaacggcgtgctgggccagctcaaaggcatggccgtcgacattggcagggagcttgacaggcaaaaccaaacgc

SEQ ID NO: 19166 - DNA, 153 bp, Sorghum bicolor
  Clone ID: LIB3480-027-P1-K1-G1
ggatttgttacattttccgatccatctgtgcttgacagggttctagaggatgcccatgtcatagatggaagaacagttgaagtcaaaaggactgtcccaaaagaggaaatgtcctcgaaagatggacctaaaacaaaaaaaatctttgtgggt

SEQ ID NO: 19167 - DNA, 214 bp, Sorghum bicolor
  Clone ID: LIB3480-027-P1-K1-H11
gtggggttattgacgtgaccctgaaggccatcactgatgactcgctggtggatgagtctctggccatccttgccctgctggcaggtgaccacgagacagtagaggagatcggcgagaccggcggcgtggcctccatgctccatgttataaaagaagaccagtgcaagcgcaacaaggagaatgcagttgcggtgctcttcgcaatctgtatgta

SEQ ID NO: 19168 - DNA, 468 bp, Sorghum bicolor
  Clone ID: LIB3480-027-P1-K1-H3
tgttttcagtcacagaagctattgaaaaaatgcctcttgaactctttcttcaagttgtgggatctccaaaggtggacatcactataactaagtgttctgggagaacactttcagagattcctatcagccaatacaatttactcatggacgctcatgccaagggccgtctctcacgcttaataaatattttagataagctcaagttgattgaacttgtaaacgaacatgtagaggattctgatgtgcgtccaagggctgtcactacatattcactggagatcaggccttacattgaagaacctacaccaagagttattccatcatcaatgtcagtgttaaccatcatccaaaattcggcatgattttgtgctttcaaagctggagtctgtcgatgcttactgggaaacgttaaagtactgctatctaacagcaggattggctgatcaaaatgcctttcctggccactgt

SEQ ID NO: 19169 - DNA, 431 bp, Sorghum bicolor
  Clone ID: LIB3480-027-P1-K1-H8
cccacgcgtccgtccggctccaggccgacgagataggatagccgatatatcgaggaggcgacgacgaccgaattgaagctgctacgcgcgtgctccaccaccacgaactaggaaatggcggcgccggcggcgaggcgggtggtcctggaggtgctcaggtcggcctcccgcgacgccttccaggtggccttctccttcgcggcgaggccgcccgtgtccaccatgctcaagccggtcgtcaccaagcccctccaccaccacgacaacaactaactgatcgatccacggcggcaagcatgcccgcagcgccgcgcacgcgtcggatgctttatttcaccgcccggccctgcagcacagggtgcgcggcgacgacgacatgccgtgtgctgttgcgagttgtgacataggctctcggtaaggtccctaccttc

SEQ ID NO: 19170 - DNA, 152 bp, Sorghum bicolor
  Clone ID: LIB3480-028-P1-K1-A5
aacaatcacaaaggggaccattttggttacgctgcaggtgataggatgcatcatgtagcatgtggtgtttgttcattccattggaatcgtaacccagtaaagtttgaacgaatgaggaatgactcaatgttcattctgacttttatcggata

SEQ ID NO: 19171 - DNA, 197 bp, Sorghum bicolor
  unsure (1)..(197): unsure at all n locations
  Clone ID: LIB3480-028-P1-K1-B11
ccgcccttttttttttttttttttttttttttttttttttttttttttatttttttttttttttttgaccagtttgcgggaggctactttttcatagaccgaaaatttgcaggaattttggtagcattcccgntcactgcaaatatgctttttgccattgatcccaaaattnctatacaaaacagggacattttttt

SEQ ID NO: 19172 - DNA, 288 bp, Sorghum bicolor
  Clone ID: LIB3480-028-P1-K1-B12
tctgggtctgcccgcccgcctccttgctcagttttgctccgctacgttttcttcaccacgtcctccacccgacggccgccgatcgaccacgccgacgaatagcaggatatggcagtggcagacgcgaacggaccggaggaaacgaggcatgaggacggaatggcccgaaaaaggcccatggtacagacgggcctgatctaggctagtctaaattatttctctcgattatcatcgcggccatctgattttttttcactgaagactaaaacaaaaccgtttggttttgca

SEQ ID NO: 19173 - DNA, 140 bp, Sorghum bicolor
  Clone ID: LIB3480-028-P1-K1-B4
tccggttccactacgccgtcctgcagtgggtgctgctgctcgcctccctggcgccgcggcaccgggcctccgtcgtcttcctgatggcggcgtccaagggcctgctcgtctacggtggcctactcagtgcattccccaac

SEQ ID NO: 19174 - DNA, 283 bp, Sorghum bicolor
  Clone ID: LIB3480-028-P1-K1-C1
gtgcctcagctcgtgacctcctcgaccccggcctgcagcctggccctggctccccggcccacacgacacgcccaccacaaggatctccgttctccggtgccgacgatctcccggcctcctccacagcactactatctagcaatcagccagcggctgcagcagcaatggcggacgacaacacggtgacgctggtccgcctcatcctcgccatcatcctcccaccgatcggcgtcttcctcaagcacggcctaaaagtgtgatggtcgatctgctcgtatcctgt

SEQ ID NO: 19175 - DNA, 284 bp, Sorghum bicolor
  unsure (1)..(284): unsure at all n locations
  Clone ID: LIB3480-028-P1-K1-C10
atgatgttgctcgtcgtgctcacaggacacctcgacgacgccgagatcgccgtcgactccatagccatctgcatgaacatcaacgggtgggaggggatgctgttcatcgggctcagcgcggccatcagcgtgcgcgtgtccaacgagctcgggtccgggcgtccccgtgcgagcatgtacgcggtgatggtggtgctggcgcanncgctggccttggggctgctggccatggtgctcgtgctggcgacgcgggagcanttccctgccatcttcaccgtggacag

SEQ ID NO: 19176 - DNA, 416 bp, Sorghum bicolor
  Clone ID: LIB3480-028-P1-K1-C11
gttggcagatgctgtggcccacctcatccatgcattctccactttcatcaacaaattttaaaaagtcataactcctaaactaaatatctaaattaaaatccgattacaccatcgcatttcttataataaatccttcaaaacaagatctcacatggatgtatttagataaaattttattaataaacatttatcttataaagataaaacatttttatttatgagagacgatgttctaggttcagaaaacaaatgttccatattcataagaaaaatgttctcagcttaaaaaatagtgttctagtttagattcataaaactgatattataatatttaaaataaataaattaatacatcatgtaaacaaaaaaatctaaagcaaagcataagaaaaaaacccgttattgagaaaatttta

SEQ ID NO: 19177 - DNA, 190 bp, Sorghum bicolor
  unsure (1)..(190): unsure at all n locations
  Clone ID: LIB3480-028-P1-K1-D2
gaagctgattccctgagtgatcgacagatggcaccgcttacggagatgacatttctttgacctcccattctttntaatatatcatagtcatatgatagaggatcaccttcttttcttcttcttcaattctccctatctactggatngacttggtcagacactaatgtctgtgaatataacttatcgatca

SEQ ID NO: 19178 - DNA, 389 bp, Sorghum bicolor
  unsure (1)..(389): unsure at all n locations
  Clone ID: LIB3480-028-P1-K1-E12
cagaccttttgatcgattgacctgccagtttctttgtgatttcaaacgacgataagaacccggccgggccggcgctagggttgcttggcgagcgagcgagcggcgttgacaggtttcttcccgcgctcctgcactgcatgcaatgcaagtcccttttcgccacgaccacgattggatcggccgatcgatcaggcacaggcggacagggactagaaggagacgaactcgctgccgcaaggcctgaatgaatgaattttctatgcccccatactatggagagtttgtctcgtgtttttacactgctaccatctttttcgcaaccaaaaatacagggcaaattttaancggtggttcggcaccaattcttttcgtgctattactcaacggtt

SEQ ID NO: 19179 - DNA, 383 bp, Sorghum bicolor
  Clone ID: LIB3480-028-P1-K1-E9
ggcggtgactgcgcggtgtgcctcggcgagttcagcgacggggagctggtgcgcctcctcccgcgctgcgcgcacccgttccacgcgccctgcatcgacacctggctccgcgcccacgtcaactgcccgatctgccgttcccccgtcgatgtcgttccctccgatccccccgtcgctgccgcggaggctgaggcaggtgatgcccaatcgggagaacaccatgttcatgaggaaatgtcgctatcccagtctgaatcggagactgaggtctcggaggactctgaggcctctgcagctactcaaagtgaaggcacaacggctacaacggatgaggatggaagggccacacctaatgtaattaggcgctcggcgtccatggattc

SEQ ID NO: 19180 - DNA, 251 bp, Sorghum bicolor
  unsure (1)..(251): unsure at all n locations
  Clone ID: LIB3480-028-P1-K1-G2
cggcaggcggcgtgccggtgcctaaagagcctggccaacagcgtcaagagcgtcaacatgggcaccgtcgccaccatccccggcaagtgcggcgtctccgtgcctttccccatcagcatgtccaccgactgcaacaaggtcagctaaatgatgaaatctaccacttaagtacataccattgcacgtgatgaagcttgcaagccatgaaaaataaaataatttncggtggtaacatacaagaagattaatag

SEQ ID NO: 19181 - DNA, 139 bp, Sorghum bicolor
  Clone ID: LIB3480-028-P1-K1-G4
gactaggtgtagatcggggaggtacggtctatgagatacatgctatcctacacgatcatgccacgtcatagctgtaacatagtgacggcgaaattcaagtcactggccggcggcctagagagggttcacttcaaaaact

SEQ ID NO: 19182 - DNA, 234 bp, Sorghum bicolor
  Clone ID: LIB3480-029-P1-K1-A11
gagaattggaaccaagaggggttttgcccttgggaagaaatgttaaataaaactatggtcacacagttccccacccaaaacacaaatggaaaaaaaaaaaaacggggcacacattactccaaataatgtcattccccggttctgtggacacgtttttcggacaacaatccgcggcaaatattttacacgtgttaggtgattttagggggcgtaagcctttgcctgtgttttatt

SEQ ID NO: 19183 - DNA, 383 bp, Sorghum bicolor
  Clone ID: LIB3480-029-P1-K1-C5
ggtgttccaaatgttcgacaagaacggcgacggccagatcaccaagaaggagctaggcgagtcgctcaagaacctcggcatcttcatcgccgacgaggagctcgatgccacgatggacaagatcgacgttaatggcgatggttgcgtggacgtcgaggagttcggcaggctctaccgctccatcgtcgaggacggcccaggggccgacgccgacggcgacaagcacgatgaggatgaggacatgcgggaggcgttcaacgtcttcgaccataacggcgacgggtacatcaccgtcgacgagctgcggtccgtgctggccagccttggcctcaagcaggggcgcacggccgaagactgccgtaagatgatcagcaaggtcgacg

SEQ ID NO: 19184 - DNA, 404 bp, Sorghum bicolor
  unsure (1)..(404): unsure at all n locations
  Clone ID: LIB3480-029-P1-K1-D4
tggtgagacagtaatagacgaaaggaaaataagaataaagcccttgcctgctggggcagaaaatagcaaaacaccaattgctacacttgcagatatccctcttcctgattcgagattgacacgtagaaggaattctttcaagttggactcatatttggatcctgcttttatgtctataattaaggatcctgatctccgacgcaaggagcaatgngaaaaatctgctcaggcaaacaagggacttaacttggctaacatgcttgggtttggtgatcttggcagtccaccattatctgctgctgaagaatattcacttcattcacgataccttgctaaagcgaattctatgaatctgtcagatgttgctgaaatgaaaataaattacccgtggaggagttgatagt

SEQ ID NO: 19185 - DNA, 107 bp, Sorghum bicolor
  Clone ID: LIB3480-029-P1-K1-F10
ccatttttctgctgccccaactgggcagctcgattgtggttggcacagttgtaattgtaaagatcatcaatttactgatatgataagaaggtgcactttcacagggc

SEQ ID NO: 19186 - DNA, 244 bp, Sorghum bicolor
  Clone ID: LIB3480-029-P1-K1-F11
gggacaagaaattccagttccagattcattccaaattgtgatattgttccatcgttcagcttttggttccatgaatgctctaattaggttgctaacttatatgatagtatgattcatgatttatgcagcttgatatgaacttggaacgcttgcagtcagctattgatgtcctacttattaggctttcccaaacttttacaactaccaagctgcagcacctttttcttttgaataattatgacat

SEQ ID NO: 19187 - DNA, 418 bp, Sorghum bicolor
  Clone ID: LIB3480-029-P1-K1-F6
aggtaacaatgaaaatacattgcacgatgaagactataatatacttatttagtaataagaacattagtattctaatataagcttggttaaactttaaataattttgcttaggacaaaattagaacataaaaagaatgagacagaggccgtaataaaggtatacacgtcatcacttgcacctgtcacattctgcccctgcatcatcctcagcgttgcgccctgaaggacggcgtctgggcctctgctgcttgcatcgacacgacaacgacgacgacgagagcgcatgcggcggcgcctgatgcagtctagcgacgcgaagcatgtgccgcaacctggactgcgcatggttgtagatgctgagcctgtgcctgttgcaggatgcaaagaacaccaagataccattgagtatgcccctgat

SEQ ID NO: 19188 - DNA, 372 bp, Sorghum bicolor
  Clone ID: LIB3480-029-P1-K1-H5
tggactagttctagatccaaagcggacgctctagaggtatacatgctccaggacgatgatcatcacgctcaaggaggagctgatcatccagggcgacaagaccatcgacggccggggcgcgcaggtgcggatcgccaacggcgcgcagctgacggtgcagttcgccaacaacgtcatcatccacaacgtgcacatcaacgacatcatgtcctccaacaagaacggcggcacattcggactcgccgacacttcgctggcgcacgttcgacgcacggatacctcttcgtcacacgtggtcacaccttcttcactgcagacgctatgactatgagcacgcgacattcactgcatacacacacactatgcttagtc

SEQ ID NO: 19189 - DNA, 298 bp, Sorghum bicolor
  Clone ID: LIB3480-029-P1-K1-H7
cttcaccaccgacgagaactgccagaagagcaagatcttcttcatctcctggtccccggacacctcgaaggtgaggagcagagatgctgtacgcgagctccaaggaccggttcaagagggagctggacggcatccaggtggagctgcaggccaccgaccccagcgagatgagcatggacatcgtcaaggcgcgagctctctgagtccatctcaagacgagacgcgcaggcgcagcgccgctcgcgcgatcgacatgcatgccccccggaccggaacagtgtgttgtcttgcatcgacc

SEQ ID NO: 19190 - DNA, 390 bp, Sorghum bicolor
  Clone ID: LIB3480-030-P1-K1-A11
tattacagtgttctggatacatacctgtattcacagtgttctggaaagccacatcgagcctttccataacactgtgaatacaggtatgtattcggcgatgtgcattttgcagtgccctgtatactgtgggatacatctgacaacctcctgcagcagtatctgggaaatgatgcgggctgcataagatagcgttatgttgttcagttgggaatgatattcgatttcccactgtgactcgctcgggaagaggagtggcacggtagatgcaggatcaattggaggccggtgaaagacaggtctactctcactctgtccagctcatttgttcacttaaatattggaagtatcacatatgtacagcagtaacatcactgtcccatgactaatttt

SEQ ID NO: 19191 - DNA, 235 bp, Sorghum bicolor
  Clone ID: LIB3480-030-P1-K1-C12
gtagtagtagatcagcagccgctgtagtagatgcaccatgatgacctcctccatcctgcgacataattgttctatagtggcgcctactaacaacactctactcgccgtcttacaacaacgtgactgctgaaaccacgttgtcaccacccaacataatcgtgctgcacaacatacttcttccatcagctgtcatatcaaagaagaggccaccaatcatcgttcctaacagcagttg

SEQ ID NO: 19192 - DNA, 484 bp, Sorghum bicolor
  Clone ID: LIB3480-030-P1-K1-C5
gaaagagctagttccagagatgttttaccttcctgaggtatttactaatgtaaactcaagtggaagactaggatctgtagcactgcctccttgggctgaaaatgctgttgattttgtacatatgcatcggaaagctctcgagagtgatcatgtctccacacgtttgcatgaatggatcgatctaatatttggatataaacaaagaggtaaagaagcagtagtagccaacaatatattcccacatgttacatatgatgggatggtggacattgataaaatcaccgatccagtccaacggcaaggtgtacaaaatcaaatatgttattttggacagacaccatttcaactgctgacagttccacatataagaagaaagccgttgacagaaatattacaattgcagacaatattccggaacccaagtgaaagtagatcttatgtgcttccaagtccagagcacttgaatgttcctgctagcacgatg

SEQ ID NO: 19193 - DNA, 517 bp, Sorghum bicolor
  Clone ID: LIB3480-030-P1-K1-C7
gtcatccccatcaccatgaccatcatctagctccatcacttggtgtgtaccaacctatctttgtatttcactcatgacaaaggttaatacacataggtttcatcaattatccaaaaccaaactagggctttcaaaggggctgatcacctcaggcgaaagggtaaatcatgactcacagtgaaagtgtacaacctctgtagagtgtaaaactgatatatcatccgtgctcacggtcacgagcggccttggaccaatacagaataaataatcactaatggcaaatcattaaatgttattattgttaatatgttgtttatgctattctttattcactttacctgatcatgagtttactatgggtcatgacaacttgatgctactcctatgctaaaattgtgacaactaaaaactacatgcagttgaaccagtgtctaacctttgagcctcatgaaccccatgttacacttgttaagtacgaggtgtacttacacttgtttattttctttatttggataaa

SEQ ID NO: 19194 - DNA, 341 bp, Sorghum bicolor
  Clone ID: LIB3480-030-P1-K1-C8
acgcatgcaacgtcatatctcatcttatggcgtcagctaaatcaaatacactggacgacttattacaacccaaacactggcaaaacaaggggctgaccacaactaagctaacgggcaaaacatgactcacattgcaggtggcaaccagcgaagaggcccaaaccgatcgtcattcccaacaactgcgcagaccggatggggaatgggacacgctctgtagcggctcatgagcacacgatggaagggaggatactcactatgtggccgatgctattctcaatgcactatacctgaccatgagttcactatggcttatgacaacttgatgctactcctatgct

SEQ ID NO: 19195 - DNA, 425 bp, Sorghum bicolor
  unsure (1)..(425): unsure at all n locations
  Clone ID: LIB3480-030-P1-K1-D2
gcagttttggtgggtgaccatctgtatgttgcaaatgttggtgattctcgtgctgttatttcaaaagctggcaaagctatggcactttcagaggatcacaaacctaacaggattgatgagcgaaagagaattgaaaatgctggtggtattgttatttgggcgggtacttggagggtaggtggtgtattggcaatgtcccgtgcatttggcaatcgtttactgaagccatacgtggtggcagaacctgaaattcaggaagaacaggtcaatggtgagctggaatgcctggttcttgctagtgacgggctttgggatgttgtcgaaaattgaggagctgtttctcttgngaaatcagaggacgcgctagattttgtagcttgtatattgacatgatatgtctatttttgtggcaatgctgacattat

SEQ ID NO: 19196 - DNA, 229 bp, Sorghum bicolor
  Clone ID: LIB3480-030-P1-K1-D6
aagagggtctacttcgacggcgaggagtgcgcgctgccggataggatacccaaggtgtcgagcgcgcgccggcgggcagggacggcgagcctcgggcagcttgccatggcggcggcgctcgtgatgattgtggcgctagtggattaattccttgtgcctcctatgatgatgatgagtgaaaacgatcgtcgactgacttcatgggccggcggggtttatacatatggga

SEQ ID NO: 19197 - DNA, 364 bp, Sorghum bicolor
  Clone ID: LIB3480-030-P1-K1-E1
gccgctgctccccacctccctctccccgcggcaggcgctggagatgcaggtgacggccgccgccttcctcgcccgcccgctcccacggctccgccgcattgacggctagggtccggatgcgccggcggtgcgcggcggtgccgtagcgctcccgccgcggctgcgggggtcacggtgctccatcagcctctccatcggtgtcggcgctggcgttggaggtgaccgtgagttcatcatacgtactattagctggtattcgatccttgtaatgttcactgctcaatgtgattggtaaaatttgatgtgcgaatatgagttacactggatataataaaatgtatcctatgtaaatttacattttatg

SEQ ID NO: 19198 - DNA, 224 bp, Sorghum bicolor
  Clone ID: LIB3480-030-P1-K1-E8
aacgagccaatggcgctctaagacacgaaacagctctttgaattgctggtggtgtacaagattgtcggtgtctacaacgacactgctggcagtgtggtgacaagacttattgatgccgagatactgattacatatgacactacggtgctgacgacagtggacaagttgacatagatgccctgctagttgatgaatgatgagttggcaaggtacaacattaactt

SEQ ID NO: 19199 - DNA, 122 bp, Sorghum bicolor
  Clone ID: LIB3480-030-P1-K1-E9
gtgatacatcgccttcggtcggtagagaggagccacggttgcacccactggcatgctacgagacttctctgctatgacgagagcttatttcagtgcactgtgcgacatttgacaagcgcaca

SEQ ID NO: 19200 - DNA, 412 bp, Sorghum bicolor
  Clone ID: LIB3480-030-P1-K1-F2
atcatgctctcagattttgatctgtctctgaggtgctcagtgagcccaatgcttgtgagaacatcatcagtaggcagagatgagcccagtaggccttctggtccctgtgcacaaagctgcattgatcccctgtgtatccagccatcctggagcaattcgtcctgcttcacgccccgtttggtttcgtctacaccatcaaggacacggaggcctagagctgagcccctgaagaaaccatcacttccacagctcgttgttgagcccacggaagcaagatcaaattcatttgttgggacccatgaatatcttgccccagagatcattcgaggagatggccatggtagctcggtggattggtggactctcggaatcttcctttacgaattactctacggtaagacaccattcaagg

SEQ ID NO: 19201 - DNA, 217 bp, Sorghum bicolor
  unsure (1)..(217): unsure at all n locations
  Clone ID: LIB3480-030-P1-K1-G7
gcatcttacatcctggatagatttgctttgtggacttgtggtatttggatacactgtaatggattggattaaattaatacatcgtggatgctggaacgaaaggagtaatgggattctggttgaaaatcatggtgttatggaataaatagagaatgccaatgatagcatnttagttgaatttgaaatattatgtgtgtaaactcaagcagacgtagta

SEQ ID NO: 19202 - DNA, 201 bp, Sorghum bicolor
  Clone ID: LIB3480-030-P1-K1-H2
gtaaggatgaacggcgtgcgtgcgttctagaagaccctgaacggcgatgctgtgcctgctaccaagaccgtgtggtcttgagcaaacgatggtgaatcaaatggtcatccctttacaacattgcgactggtaacacgacaggcttaacactctaacttacgaacgagtatagcctgctctgagcaggtgaaagcttatata

SEQ ID NO: 19203 - DNA, 379 bp, Sorghum bicolor
  Clone ID: LIB3480-030-P1-K1-H7
ctgttctaacggtaaaacgcatggcctctaattgtttcaaataccttgtctacaaaaaaaaaaaaaaaaaaaaaaaaaaggggaaaaataaaaaagtaagatacaaaaaaaaaaacaattaaacataaaaaaagtaaaagctaatgtaaaaggaaatagataatggggcggcctttttaagggatccaactttctgtacgtgggattgcaaggttatagtttttttttgggttcacctaaatatatgtaagtgggcggtgtttataaaaatttggaattggaaaaaccgtggggtacccaaatttaatggtttgaggtaatgacttctttaatgacgtggtgtattatggaacagggcttattcgttaggttttttaaa

SEQ ID NO: 19204 - DNA, 258 bp, Sorghum bicolor
  unsure (1)..(258): unsure at all n locations
  Clone ID: LIB3480-030-P1-K1-H9
gactagancgagagcggccgcggnagaggaaccaagcccacgcacgcgcgcacgcgacggcaaagcnanaccagggggacagcgaaacccaaagcacgggccgnagacggacaacgacgagaccgggaaagcccaggcgcnacccaacgcaaacgcaaggcagcacaggcacagnccgccagcaggcgaaagagcgaagaggcccggaccgancgcccgcgccaacaggagcgcaggcggaacggcgaaggggacgcg

SEQ ID NO: 19205 - DNA, 375 bp, Sorghum bicolor
  Clone ID: LIB3480-031-P1-K1-A11
gtgtatcgaccgacgaagacaagacgacggaggaggaaggaggggatgcgccgccaccggcggcggcagcggccagcgggcatgccgaggagtcgtcggagacagtagcaaaggacggcgatgctgctggaggcggtaaaacgccggcgccggcgggtgcagagtctcacggcggcaacctcagagtccccgtctcgtccgtccttacaattgctctgtcgtctctagctcttgttggcatctaacctctcttcttcgtttcgtcggccgtatcactgtgacgatatgtttagtatacgtagctgagcatgctgtaagtatatattgattgacgatggttagctgaagctattaattaaaattctaaagtatgca

SEQ ID NO: 19206 - DNA, 180 bp, Sorghum bicolor
  Clone ID: LIB3480-031-P1-K1-B2
cccacgcgtccgaggcgatggccatcgccgaggggaagaagaggaggcccgccctgatctgctgcggcgtgctggtggccgtgctcgtgctccgcgccgtcatcttcgtgacgctctacttcaccctgttccggccgcggtcgcccaaagtggtggcgacagccgtgggggcggagatct

SEQ ID NO: 19207 - DNA, 118 bp, Sorghum bicolor
  Clone ID: LIB3480-031-P1-K1-B3
ctcaagcgtgctaggccattgctatctaccaaagcaaaaatacgagtccctccctcatcttatgtatcgtactttcttccctactcggacttcgctcaactatcttttacacgctcta

SEQ ID NO: 19208 - DNA, 458 bp, Sorghum bicolor
  unsure (1)..(458): unsure at all n locations
  Clone ID: LIB3480-031-P1-K1-C5
tgctgttggtgacttgaaagaatttctggaggatgttgtattggaggaaaaccgtggtttgccgtgcttcttatttgggcactccactggtggagctattgttttgaaggctgtgctggatccttttgtagaacttcatgtagaaggggtggtcttaacgtcgccagctattcatgttcaaccatctcatccaatcatcaaagttgttgcaccaatattctccatgctagctccaaaataccgagtcagtgctttgcataagagaggacctcctgtttcacgcgacccagaggctctgaagatgaaatattcagatccccttgtgtatactggaccaattagagtcagaactggcaatgaaatactcncgatatcgtcattnntgcaaagaaactngagcagagttactgtcccttttcttggtctcatggacagctgacacataactgatcgagagc

SEQ ID NO: 19209 - DNA, 209 bp, Sorghum bicolor
  Clone ID: LIB3480-031-P1-K1-D1
tttctagatccgagcggccgctcgctatctagaacttgtagatcgtgagctaccgctcgcgatgaataacttcacgcgtcattagggggggggactatgacccgattactgatgactttaccttctttcatatctaagatccttaagatttcggactgatagtcttgactgaagagatatttattcgaagagttacatgtacttctatt

SEQ ID NO: 19210 - DNA, 496 bp, Sorghum bicolor
  unsure (1)..(496): unsure at all n locations
  Clone ID: LIB3480-031-P1-K1-E11
gccgtccgcgtgccggcgttcctcgtcgtcggcgtcgagtcggccatctacttcgccaactccatgtacctggtggagcgggtcttgcggttcctccgcgacgaggaggagcgcgcgctcaagtccaacctcccctccatccgatccgtcgtcctcgacatgagcgccgtgacggcgatcgacacgagcggtctggacgcgctgtcggagctgaagaaagtcctggacaaaagaagcatcgagctggtgcttgccaacccgttggggtcggtggcggagaggatattcaactcggcggtgggggagacgttcgggtcggaccgcctcttcttcagcgtaagggaggccgtcgcggcgggggcatgcaaagcggcgcagccctgaccggccggctgaccctgaggtggatggnggcatggagcacagggggtcctctgaccagcagaagcagctgcagtagaagaagatgcgagcgcttntcggaggaggatgacat

SEQ ID NO: 19211 - DNA, 287 bp, Sorghum bicolor
  Clone ID: LIB3480-031-P1-K1-F4
cccacgcgtccgcagagactgggttagatgaagaccagtcctcaaccggtaagagtggggattcatcattttttgctggtttcttgagagaagggtttcaaggacctttctttattaaataagtccatggacagtgttaaggtttcaattaatggtcatccaatctctgaaagagcccttaagaggcagagaagaaagctgtcctgtgatccggttcatattgtacgataccggctgttttgggtgtatggacagagtgatcgcatgccctcattatagagattata

SEQ ID NO: 19212 - DNA, 388 bp, Sorghum bicolor
  unsure (1)..(388): unsure at all n locations
  Clone ID: LIB3480-031-P1-K1-F5
cgctcttactcgcggtcacggcgccctctcctccctgtcactcccccgccccccgtccctcatcctccatccacgcctcgttttcctgggntgcaaataaagtaaacgccgcgggtgacaggtacccaccaccgaatccccccctgcgccctctttaacccgtcttctccacgcccgctctatcccctccgtcttcttcgccgccggccacctgaccgtgctatctcctctgcatccgagaatgaccctgcgccatgaggttctgagaagcttttctcaactggctccgcatccttttcttcaaacaagatattgaactttccttgataaggcttccaaaatccttggaatacatactttttaaccttttttctacttgaggctttaa

SEQ ID NO: 19213 - DNA, 438 bp, Sorghum bicolor
  unsure (1)..(438): unsure at all n locations
  Clone ID: LIB3480-031-P1-K1-F9
atcttccacttcaatggaattgccaagtctgtgctgaatgggaatgcaagtgcaggtggctcatgccctatacagagacccaggttatgcaaactaaatgtcactgtccctccaaggtggactcaagatgagtatctggctgatgttgtaagcgcatcaaccagcagcagcagcaaggatgatagtattctttctctagctcccccagttcagactaatcagcatgcaccattggtggactgcattaggacacggtggccacgagctgtttgtagctgggctggagatgttccaagtattgtctgacacagtggatgttgtgtgcgccagtcactctagctatgttgctcataaccncattccaagaatctgctcagagcaagcactttgagcttcagatngtcatgcctgcaaaaggaatcgtaatacatggttttt

SEQ ID NO: 19214 - DNA, 309 bp, Sorghum bicolor
  unsure (1)..(309): unsure at all n locations
  Clone ID: LIB3480-031-P1-K1-G5
gcacttgaatcaccagagtttatgatctggactgcttttttctcagaccaaataatttcaggaggatgttagctcatcttacttaaagatttggccatggactctgttcctctgttaattactgcttactactggtgttatgggtgaacattaaactgactgtaagtcatgccttagagattgcttttttggccagaattagctacactggtagaatatttcttgtccaaactgactgctgctagcagatttgagtgcctcaagtagctgtttgatagatgtgcactcttgcttctttgctctgccnna

SEQ ID NO: 19215 - DNA, 390 bp, Sorghum bicolor
  Clone ID: LIB3480-031-P1-K1-G9
cgaaaaaaaaaatctaatataaccaaaactactatgtgcgactccatttggcgtgtccaagcttccatacactgtctttccacttcgtcgcggagccataaagtcacctaagttccagtcactgcccttcgatttacaacatattgactaggatggccctggcattacccaacctaatcttaactcagtacatcctcatctaacaagctgtccttatactgaatatactctaaacagtcatccttcaaatcatatgctcatcctttatgaacactgtgtcgctccctgtacaggcgcattaaacgcacctgttttcctattatgagcaatgttaccgatactcttgccacctccttactagccactaatttccctttctttactttcttt

SEQ ID NO: 19216 - DNA, 211 bp, Sorghum bicolor
  Clone ID: LIB3480-032-P1-K1-A1
gcacacggccatgaggggctagttcagtcactgtggcttgcactcggtgacggatagcatcatcatggctggttcgaatctagcgtccgcggtggcgcgcacatcataacatgaacgccaagttcgtcatcgatgtgcttggcgccggactcaaggtttgtccatccagatgaggtgacagcgaggagggccatagcgaccgcagttagga

SEQ ID NO: 19217 - DNA, 439 bp, Sorghum bicolor
  unsure (1)..(439): unsure at all n locations
  Clone ID: LIB3480-032-P1-K1-A6
cccacgcgtccgcggcctcggaggtgccacctcctgcgccgcatcattcttggaggaagtcaatagtgatccttagcagctcagtgtccggcgtggtgctactcctggcgggcctcataatcgttgtcgcggtggcggtggttttgcggaagcggcgggggaagggcaaggtgacggcggtgcanggctcgttgctgctgttcgactaccaggccgtgaaatcggcgacgcgggatttcacggagaagctcggcagcggcagcttcggctcggtgtacaaggtgacgctccccgacacgacgcccgtggcccgcaagaagctcgacgggttgcggcaagggcgagaagcaattccgtgccgaggtcgttacccttcgcatgatccagcacatcaaccttgtccggtttcgcgggcttctgctgcgaggggaacaagagg

SEQ ID NO: 19218 - DNA, 350 bp, Sorghum bicolor
  Clone ID: LIB3480-032-P1-K1-B12
caacaagagagagcttgtgcaacagacacctgtagacgcttggaaatgcgcgagctcaggcgaggaagctcagaaagaatcacaaacttgcgggaatttcgggggcgaccaaggcaaagaagatcggcatgcaaagcgagcaaaaccagcaatgcagagccccctagcctcgactcccaaatccgtgaagaaattgagccggagaaattggggggaaacaaaaatgcagataatccaagtacaggagaccgcgccaatgtgcccccttaccaaaaacaaaaaacaaaaaaaaaattatagaaaagttgcagcaccaaatccgcggcaaaacaaggaatttgacgcgcgat

SEQ ID NO: 19219 - DNA, 369 bp, Sorghum bicolor
  unsure (1)..(369): unsure at all n locations
  Clone ID: LIB3480-032-P1-K1-C4
cggacgcgtgggtacgcctgccaatatccttgatgttcgtggaagtgcatcaaagcggcatgttgtgtaagcttttaagatacttacttgagatgagatagtcaatgcaattctagtgaacatctttgaaaacattatcaantctgatgtgatagcaagtggaattgttaatgctgctaaacaggttgacctgaacgatcctgttgttgttcagttgcaatgcaccaatgtacaccaacgaaagaggattcttaacgaaagtggaatgactttaatcactgcagaagatcttgatgatactgcatataaaccagtaaaagcatccagcatgtaactgtagtgtattaatctgaagttcttttttttact

SEQ ID NO: 19220 - DNA, 319 bp, Sorghum bicolor
  Clone ID: LIB3480-032-P1-K1-E10
cggacgcgtggggtgcttgggagcgtgagcgactactgcacgcaccacgcgcactgcaccgtcatgatcgtcaagaagccaaagcacaagcactgagatactatatatatgtgtcttggattggatgtcaagcggctcgatttcagatctgtgtatcttaactatttatattagttgcgcgtgtcagcatgagaataaaatgctagctacgtgtgtgcctagagtaatgacatatacttcatccagtctcaaatataggtaacatctagccagatttgtacgagacaaactattctaattttaacgagcaatgtttatc

SEQ ID NO: 19221 - DNA, 184 bp, Sorghum bicolor
  unsure (1)..(184): unsure at all n locations
  Clone ID: LIB3480-032-P1-K1-F3
cgtctctgtcttgctcacgacacgagcgcttgcggcggctgcggcagcgcaaggaggcgaccatggggcactccaacgtgtgtaactcgcgctccaggaactactttccccgtagtttgacaacgtcnatactgtgcaaacccttgcgttaccccacttaatcaccttctaatacattccactt

SEQ ID NO: 19222 - DNA, 307 bp, Sorghum bicolor
  unsure (1)..(307): unsure at all n locations
  Clone ID: LIB3480-032-P1-K1-F4
gcggcgaaaaggaggcggagtgagtttccggcggcgatttcgccggtcatctccctctccggcggccgtttaagtgtcanatagcgtgatggaccggtgaatcaccgtgcggctgtgcatagactaggtagtgtgttatctaggtctagggtttgctggggaggtgtcatcctcttgcggctttgtcttcctggcgtcnctggcgaggcgttggctgctgtggcgcaagggaataagttttcccggtcatgtccacgctcccttggcggtctctatagtcaagggtgggattggggatgtggggatc

SEQ ID NO: 19223 - DNA, 453 bp, Sorghum bicolor
  unsure (1)..(453): unsure at all n locations
  Clone ID: LIB3480-032-P1-K1-G11
gtttgcccggtgttctgtgggtgcttcctgattcctacattgatgtgaaaaacaaggactatgggggtgacaagtacatcaacggtgagataattccctgcacgtacccaacctaccaaccaaaggagcggagaacatccaagtatgagagtagacggtatgagaggcgaagagatggccccccagcagccagcaggaaaccaaggcaacaggctcctcagactgagtcagcatcttcataatgagttttgcaggcatttatccacatacttactaaaacaaaagagcacgcctaattctgtcactttggcactntagcaccacacatacaggcaggacaggcagatccatcatcatcatcaggccaaaatgtcacgcggtactgtccaagcagcctgggcagcttgtattgtatctggatcacgtggttgtgtgtgctgatattttgagcta

SEQ ID NO: 19224 - DNA, 436 bp, Sorghum bicolor
  unsure (1)..(436): unsure at all n locations
  Clone ID: LIB3480-032-P1-K1-G4
cggtgggcgagcatggaacgtangaggagccggcacgccttgttgctcttctcggcagtcatggcgtccctcgtctccggctcgaccggcgggatagaccacatcgtcggcgccggcaaagggtggcngatgccccccaacaggacgtactacgcggactgggcgagcgccaggcagatcagcgtcggcgacaagctgatgttcctgtaccggagcggngcgcacaacatcgtggaggtgccgacgcgggagctgttcgacgtgtgcagcatgcacaacatcaccaaccggtaccagaacgggccgaccatcatcgagctcacggagcccggccagcgcttttacttctgcggcgtcngcgagcactgcgagggtcggcagaagctcgccataacgtgcttctcgtcccggcgccggtcgccgacacggacgacga

SEQ ID NO: 19225 - DNA, 272 bp, Sorghum bicolor
  Clone ID: LIB3480-032-P1-K1-H1
ataaaatctaagttatagagttctatgggctatgtcatacgccatcaagtgaatcaagaggtatttagaattataggttatactgacaaaggtcttcctatattgtcatcattaattcgaggtatgaagaaaaattcttatgatttcgtttgtagtgttaattttaatttggcttgtgcaaatagtattttttgcagtgatcatgaacatttcacatttgtaacataatttttgttgctatgccgaatttttcacaggatgcattttctgag

SEQ ID NO: 19226 - DNA, 153 bp, Sorghum bicolor
  Clone ID: LIB3480-032-P1-K1-H12
gcggacgtgacactgaacatactcgtcgccgggcacgacgacgggcggttgcatgaacccattgaggacactggggccggcagtggcggacgagaactacaagcagctgacgatctacctgctgggcccgacgctgggcgcgttggcggacgc

SEQ ID NO: 19227 - DNA, 308 bp, Sorghum bicolor
  Clone ID: LIB3480-032-P1-K1-H7
gaaattgcttgtcagataactagttcctctccagtagatgacaaagctagcgaatcttctggatcaccagtgaaggatactcctgacgctggagtcagattgcaaggatcagataactcggctatggcattttctgcgctcccacttgttgatgaagcacctggaacaagcagcagagcagctggcatgcctgtggcatgtgattgcaatgacttgaaagaggatgttccactagacaacgctgaaagcaccgggaacctggaggagccgacggatgaactcactcttgtggacacggatgctgtcgt

SEQ ID NO: 19228 - DNA, 200 bp, Sorghum bicolor
  Clone ID: LIB3480-032-P1-K1-H9
cagtaagcaagcagaagcagccaacggcagatatgctagcagcgtcgcaataatagtgctcgcgcctgcgtgtacctggtcgtgctcctcctggccgccgtcgcggtggcgccgctcacgacggtcgtcaactcaatcgcgcccgcacgatcatggaggtcaggtccatggagtaatactcaacaggcccgctccgatcg

SEQ ID NO: 19229 - DNA, 184 bp, Sorghum bicolor
  Clone ID: LIB3480-033-P1-K1-A12
aagcaacattacttctgagtcctatgcagaaaagtatggtccatctagcggttcttttgaacaaacgaattcacacgcccagtacggagctctgtacatgcaacccagcattcaacaaatcataatgacataaaccaaccttcgttatcattgcctacaacagcttcttatgactgataaatct

SEQ ID NO: 19230 - DNA, 290 bp, Sorghum bicolor
  Clone ID: LIB3480-033-P1-K1-A6
atctacagccgatctcagtgctacttaaacacaccgatacgatgtatagcctcatggagaagggagcatccacccgatcgtaaagccgatggtacagagcactaccagcgctcatctgtctattgtgcctgatcccctgcgtgcacggctggtcgttcatccggccgctcgcgcacctccgacgtgcacagtcgctcagtactcgcatctatctacacggatggcgattcgtgaggcgctctcctaaataacaggttgctgacggccgcttgcctccaggcgctatctcc

SEQ ID NO: 19231 - DNA, 463 bp, Sorghum bicolor
  Clone ID: LIB3480-033-P1-K1-A8
gtcccgcttccgcagccagccaacgcaacccccgaacccaaaaccctaccacggcgcccatggcctcgccgccgccgtctcctgcgccgcaccccacttccgcagcagccgcagctgcggtgggcaatggtcacgccacctccgcttcgccggtggacgcgctcttcctccagaacctcatgagccgcgtccagctccgcccgcccttcctcgacaccaactcattcctcacccaggaccttgacgacttcctcctcaacgagttcgccgcgctatccgccgccgcaggggcgtcggatgatgacgaagacgaggaggatgaggacggtgggctcgctggcggtgagggctccggggaggcgaggcggcggcggatgctggcgagggaagaggcgaagttggagaaagagatcctgcggatggtgctggccgtggaggccgaggacaagcctaagcccaattc

SEQ ID NO: 19232 - DNA, 147 bp, Sorghum bicolor
  Clone ID: LIB3480-033-P1-K1-B1
ctcccacaactcatacctgatacttctagttgcgaacccaatcgaggagaagccttcctcgaacgtgcagatcatgcgcgggagagcgtgatgaagatgggcgaagaagaatgtaccaggccataccgtacagcgcctgccggtcgt

SEQ ID NO: 19233 - DNA, 368 bp, Sorghum bicolor
  Clone ID: LIB3480-033-P1-K1-B11
atgtctctctactgcgctgcggtccatcagcagaggagcttatggcatcctaggtcatggacgacaactactgcatcaccggcgccgtgatgtcatcttgtgatgcgatgactgacactcagaatactgctgatggactcttatcctatgactggtgaggtggcttgtctgttttctttaacattatcatcatcatctctttagctgactctgcttttcttttggttctccttaagtttgattgtatgctttatttgttgtctttgtagttttatatttatgagtttgtttttatagttttatgtttctattttatatatttttcactttgtacttatcttatattttttatgtttaattttttttta

SEQ ID NO: 19234 - DNA, 355 bp, Sorghum bicolor
  Clone ID: LIB3480-033-P1-K1-B2
cagcagccaccgtcaagatgcccgccaccttcgttgtcaagactagcatcctgaccaaggaccagatcctggtcccggagacccttctcaagaagcgcaagtcctctgagaaggaggctgccgacaaggctgcccatcgtgagacccgcaagaaggagtccaagaccaagcgtgagcagatcttcaagcgcgctgagtcctacgtcaaggagtaccgcgactaccagcgtgagcagatccgtgtcgctcgcgtcgccaaggccgacggcagctactatgttcccgcccagcccaagctcgtcttggttacccgcatcaagggtatcaacaagatcgaccccaagaagcgcaagac

SEQ ID NO: 19235 - DNA, 389 bp, Sorghum bicolor
  Clone ID: LIB3480-033-P1-K1-C11
ctgggcagatacgcgaacactcacgcagacacacacagtgcaccttcgaaggcgctgcagaggcgagcagatctcgcctgattcgattctacaatgaatcccatgcactactacattatcaaacttctgcttattggcgattctattgtcaggtaatcaggctcgctcttcagatatgcatgggatatcacatctgtacagttacatcttctcacgcaggagcagattttaaacagcagccagtgcagccagaacggatgaccatatgacctgataaagctgttcacgatcaccgggagcagtatttgattaaggctacacgctaacacctgccggtcggtgaccacattcttgaccactaactggcaagctacaactgcagtggtcct

SEQ ID NO: 19236 - DNA, 225 bp, Sorghum bicolor
  Clone ID: LIB3480-033-P1-K1-E10
acgcgtccgcggacgcgtgggtcttagtagagagtatatatttctgtgggcagcgttcaggcaattaatatgtgaggtgttaacaatgctgttttgccctcccaagtctctacagtcgctctagaggaagcaaaaaagactttacctggtgattagtatgaataatgaacgcttaggttcacttcagagttccgagatctacaggaaatggctaaccgcatcaag

SEQ ID NO: 19237 - DNA, 466 bp, Sorghum bicolor
  unsure (1)..(466): unsure at all n locations
  Clone ID: LIB3480-033-P1-K1-F4
accctctccgttcgtagttgctctaatttggtatccccaaggcccaatccaaattttcacttttgtttttgctccttttgtgatttaaagcttaacagatgacctaaatcctacttcgatcgttctaattaacccgtgattgtctagcaagacaaacagatataagatcttcaagctgttctttgttgggttgcattggtagatttgacagtgtaggtgtatcttgtagcaaaagaaggatctgctgtgctccttgtcatgtttgatatggctaatttatattcttcggcaatacagtataggtagaatgtgaatttataacatggttatccagaatccaagtaggttcatgcactntgctgtgtgtggtccccttgattcattgaagaaagtaataaattccgtagttttcggagtcggtggagtttctaatcatttcttttcgatatttggtttctgaccagct

SEQ ID NO: 19238 - DNA, 373 bp, Sorghum bicolor
  Clone ID: LIB3480-033-P1-K1-F6
gactgcggctagactacaggcggcacgtttacatgcagccagcctgccacgcgctagcatgcgtctagagagatctaatatcaagtcactgaccgtcaattcacagcgcgtcgactgacaacaccctgactgggcccaccttgacggccccgaactacatccccttgtcgcccgttggcgtaacagcagctagggccgtaccgatcaggctcgcaaacagcggcgcagcctgcatgggcactggcacactcgctgatgcgacgcaccctgcgccggcgcagtgatcgcgacgcgcgtcgggaccactcccattgcgagcgctatactggccagtgctctagctcccgttcctttctttctcgtcacgttcgtc

SEQ ID NO: 19239 - DNA, 421 bp, Sorghum bicolor
  Clone ID: LIB3480-033-P1-K1-G12
cccatgcccgtgcggtttaattgtagcagaggatggctagcctataggacacagcgatgccgatgaggcggaggagcacgaggtccgtcgccccttcgccgaccacctctccgtcgccgtctggccgccgagaaccgcagcccccgtcccggcttcttccccagaggaagttttcccaggtcctgggcgaactgccgtccgccgtcgtcgacgcccaccgcgacggcgctccccgtccccaggatgacgacgcggacgaaatttcggccatcgagttcgacggccgcggcgagtacctggccgccggtgacaacgccgggcgcgtcatcctcttccggaggaccgacgactgctacggtgacggcgacggctcgctgttgcgggctcgtgccgagcttgagcgcgctgatcgtgcctgcgg

SEQ ID NO: 19240 - DNA, 148 bp, Sorghum bicolor
  Clone ID: LIB3480-033-P1-K1-G7
agaaccgattatgcatgttcactgatgatgtaccggggacagctggagttgctctagctagcgcctacttggagctggagagcacatggccctcctctccaggataggacgaatcaaaagatagtcggctgtgggagctgggagtgct

SEQ ID NO: 19241 - DNA, 392 bp, Sorghum bicolor
  Clone ID: LIB3480-033-P1-K1-G8
cttaaaagaactttctggagagatcccatgggagttggcatcattagattttctttcaatgttgaatctatcctacaaccagctgcagggaagaatacctgagtcttcacacttcttgacattctccgatctctcgtttttaggaaacattggcctatgtgggtttcaagtgtccaaagcctgtaacaacatgacaccagatatggttcaacatcagtccaagaaggtatcaatagacattatactattcctttttgttggattgggatttggtgttggattcgcaattgcaattatcttgacatggggaatctcagcgagctcatccttacctttacaatccacattgttgaggataatgttccatctccaataatatgtccaactacttc

SEQ ID NO: 19242 - DNA, 411 bp, Sorghum bicolor
  Clone ID: LIB3480-033-P1-K1-H1
cactgatccaagctgtgaaggaaaagggacgaaaagaacacagcgttgccaagcagtcggcccatgacaaggacaacctaccgtgcttccctaggtcaaaccctggacagcaaaaacaccctctttgccggtaaattccaacaacggggccaggtcagggtctatcacatatctcaagcggctattcaacaagcaagaacatggaaatagaagacagacttgaaacaaaagggttaatatagctattgcatgcttcagtcattatatagaggagttctagcacttgtgtatctccatgcggtgccctttggtgtccgtcgtatatactgcaatatacacaaaatcagatccatgagatgttgacatgtcttctttgattatcatgagttcttctgaatcgctatactatct

SEQ ID NO: 19243 - DNA, 430 bp, Sorghum bicolor
  Clone ID: LIB3480-033-P1-K1-H4
gttatagatagtgagcggccgacctaagaccatctgaaaagagcggaggggctagaatgaatgcgcactgctgtgggagacacatgctaactcgcaacggatcgtatgctaggctaactgatgcgcatatggtgtggagtcatactccaccacgaggacgagaagcccaacacaatgacctgcggaggtgaaactgcgttccatgaagaaaatcatgcccttcaaaaggtgcttactaatcaagatcatggatgagcagctggtatatagcggcgagaacgaaatgctgtagatctgcatgtatgcatttacggagaactggcgttggagagagaatacttttgcgagcattgcatacgattgtgagaccagtgcaacacttacacaggaaattaatgccacgtttgctgctgaggacaatccgactgct

SEQ ID NO: 19244 - DNA, 442 bp, Sorghum bicolor
  Clone ID: LIB3480-034-P1-K1-C11
ttaaaagcgaggagtggcgtgaagaggtaagaaataatcattattgctacaaaggaaagcctagggtaaagactggttatgaaattttcatggcaagcttggatattgaaagcaatcttgataaggttactctaccattcatcatagtccatggcggtgacgatgctgtaactgaccccacagtaagtgaggctctatatacattagcgaagagcaaggacaagacattgaagttgtaccctgtgatgtgccattcctttgacttcaagagaacccaaaggggacattgatattgtgtttgcagacatcatcaaatggttgaatgagagggtaccgtcaatttcctaacctgggatcctatagtggtttacagttacaagaacaatgttgttagccaacaaacattgagtatttgatactacacatatttaattttagagag

SEQ ID NO: 19245 - DNA, 377 bp, Sorghum bicolor
  Clone ID: LIB3480-034-P1-K1-C9
gtccatacaagctctctctggttactaagcttcagcaggttaacctgtcttgtggttgttgaggctcgaggtgagctagccgccatggagtgcggtaatgacagtcacaatccctcgaacgaccacaatgtatagcacggaaggtacctcggtggctacggccatgatcccgccggttacaatgttataccaaccgtgccatacgcttccaagcatgtacaagggatcaaatctccacttggcgaggacaaggcttcaggtgattacaataaaattgcaaacttgtctttagggaggagatagccgttgccatcatgaatgctgcgcctgcagacaagaagctaatgatgatggacgactccttcaactctgtagct

SEQ ID NO: 19246 - DNA, 459 bp, Sorghum bicolor
  unsure (1)..(459): unsure at all n locations
  Clone ID: LIB3480-034-P1-K1-E3
gaaaatcaaaagggaagtacgcatggtttctatgagatgtacgcaagttctacttggactggcatgtcaagtcttatggttctccttgactggtttgatttccctcagcaggagtgcacgctgatatcaagctgtggaggtggtggtgctggtcggcagacgcattgtggcattcaacatggtagcgacggtgggcaggtggcctaaggccatcctgccggcaggcgcattgtggcattcaacatggtagcgacggtgggccggtggcgtaaggccatcctgccggaatggttgttgtcaggcacagactgaggcgccacaggattgctttcctggttagattagagataaatcaaattggtgcttgtgcatgattttattagaggtatcaattgttactttcaaaaacaaagaggtaccaattgtttggtctactttatatntaatctgtattatgtt

SEQ ID NO: 19247 - DNA, 124 bp, Sorghum bicolor
  Clone ID: LIB3480-034-P1-K1-E5
atgacactgagctaatcatagatcgcaagcgaaaccacatagggagcaaagctaacatacacagacatagcgatgcatatcatcttgtatagagctacctaaagagaacacaccggccgaaaag

SEQ ID NO: 19248 - DNA, 249 bp, Sorghum bicolor
  Clone ID: LIB3480-034-P1-K1-E7
gtgcatgcgagcatgcacctattctatggtggcatctagatccaattcaatgttcgtcttcttacagcgcgacgcctgcgcaaaccgctgcgttgcccaacgcactggtcatgcatcagattcatcgtctgccagctcgggtcttaccgaagaggcctcgagctatcgcacacgcaacaatcgcacagcctgaatgggcaatggtacgcgccctagtccagctcattaagcgccactggcgtggtggat

SEQ ID NO: 19249 - DNA, 200 bp, Sorghum bicolor
  Clone ID: LIB3480-034-P1-K1-F1
catagatatgatcacaggaccatacaaactcgttcgacggtgtgaagtgactgcaattcttatactgtacgggctgccaaggctgttaactggctcgattttggctcatgagatgatgcatgcttacctccgacttaaaggataccgaaccctgagtccaaaggttgaagaaggcatctgtcaagttctagctcatcttt

SEQ ID NO: 19250 - DNA, 410 bp, Sorghum bicolor
  Clone ID: LIB3480-034-P1-K1-F5
ccaaaccccctcgccgctgcggccaagggtttcacccgccgcggaaagcattgcaaggtgccgagggatttctgagtagaggagttggagagccatgggcactcttgcttcactggtgcctttcttgcacttgctggaaaggaccattaatcaactttcaaattggaggtctattgcttcttaacttttcttgattggggggcttgattaagcaattcttccattttttgcttgtgtggatattggtggtttcttcaagtgagcccaatgcacaaaaaaactcggcacacaagtccacatattgctctttcgctctcggtgtaccaaaacagcttaaaggcagatgacatcttgagcgctgtgttcgagttgtcaatgtacaaccattcaaaagggacatatcatggatg

SEQ ID NO: 19251 - DNA, 413 bp, Sorghum bicolor
  Clone ID: LIB3480-034-P1-K1-F8
gaggtctacggcgtcgacgccgttgagcggatgctgcaggacttcatcgctggcaatggcgccggcgccggcgccgaggccgacgcatccagggaccgtgcctccatcgacttggccagccgggacgtcgacagcaacgacaccaccgctcagcaggcgcgccaggttcacgctaagctggatggcaacggcggcgctgggactgggaggaacgacagcagcagcgccggcgacgcgaagaacaacggctccaggagcggcgacgcgaagctgccgccgccgctgggaaaggaggcgaagcccccgcaggtagcgtcggcgccggggtcgtcgacggggcggatccacagcgacggcgtgctaaagatcctgatgcaaaagatgcggtcgctggagctgagcctgtcgacgct

SEQ ID NO: 19252 - DNA, 149 bp, Sorghum bicolor
  Clone ID: LIB3480-034-P1-K1-G12
tcgcaagctcttagggactcgagcattgcgggctacatgtcgagccaaaagactattgagatcaacccagagaaccctatcatgggtgagctccgcaagcgcgcttaggcccacaagaattacaagtcggtcaaagatctcgtgatgct

SEQ ID NO: 19253 - DNA, 289 bp, Sorghum bicolor
  unsure (1)..(289): unsure at all n locations
  Clone ID: LIB3480-034-P1-K1-G6
tcctcatacncctcatagtgtaggtatttaccctctttgcttcattatcttcttttacaacttttggtctgccaaaactattcagttcctacttaatctctttgcataacatgcatttttctcaagctggcgtaatatcaataaagcccaaactgatctcccttctcaacatttgatacaactgaattgccaatgctacattccctttagcagcactttaagctcctcgcttgtggtggttactcacagcgtgacctctactctttccagccccctatttccctatcct

SEQ ID NO: 19254 - DNA, 387 bp, Sorghum bicolor
  Clone ID: LIB3480-034-P1-K1-G9
aaaaaaaaaaaaaaaaaaaaaaacaatataaaaaaaaacaaaattacatacacaaaaaatacaaaaaaataaaataaaatatagtgtgacgggaaataaattaacataaccaaaaatatacaacaaaaaaaactaaaaaaaactctaaaataacaaaaaaaggggcgcctttttttaaataaccaattttttcatcccgtgtattaccaaatttacctttttttttttgcccctcaaaacaaattctcagcccccttttttaaaaacactcgccttggaaaaccccttttttccccaattttatgccttttacacacaatactttttttacacttgccagtaataaaaaaaacgccccaccttatttctttcctaaaaatttcccca

SEQ ID NO: 19255 - DNA, 405 bp, Sorghum bicolor
  Clone ID: LIB3480-035-P1-K1-A2
caataacggattttcttaagagaactctattgtgatcttcgacactccattttgtcctcataggtcttcattgtcgagaaagaaaatacttttgtgcttttaattggcatctaacagatctcatcatacacttaattatttgttaaagttttgtcaagtttatcatgttttgcagtctaacacttatggctgtactaatatctgttgttactaataattttccttcttttatttgcaactaaaaagaaaagctccctatgtgtgggatatgatactactgagtcaattgaatggactatgaccagtcttgggttcatttaaggagttagcagtgtacttaggaccccccaatactgctgatctgctaggacatatacaagtcaaaaagcttattaatccctccaa

SEQ ID NO: 19256 - DNA, 350 bp, Sorghum bicolor
  unsure (1)..(350): unsure at all n locations
  Clone ID: LIB3480-035-P1-K1-B6
gagcatacgaagaactatttagctcttgaagataatgaaatttgtcatattaaggatggtagtgtctcgatcctcaagtttgacccgcacaaagagaagccagcatctgtgcaacgagcattgtctgttcttgagatggaagttgagcaaataaagaaaggaagttatgaccacttcatgcaaaaagaaatccatgaacagccacattcattgaaaacaacaatgaggggtagactgaaagatggtggggttcttctaggtggactgaaggaatatctcaaaacaattaggcgctgtagaagggtggtttttattggctgtggaacaagntacaatgctggcttaactgc

SEQ ID NO: 19257 - DNA, 455 bp, Sorghum bicolor
  Clone ID: LIB3480-035-P1-K1-B7
cccacgaaggccatggacccgggcctcgtatatgacctcaccgccggtgacttcatcccgtatctatgcggcatgggcctcggcgaggaccggatacgcaagatcgtcgagccggcgcaccacgcctcgtcgtgcgcggagaccggggagatcgcggcgaaggacctgaactacccttccatcatgatcgtcacgggcgacgacgtgcggcaggtggagtcggaggcgaagcggacggtgacgaacgtgggggagcgcgaggagacgtacagcgcggaggtgttcgctccgggcgtcgtcgtagcggtgaacccgtcgactctggcgttcggcgacattggccagaagagggacttcgttgtcacggtcaagaaggcggcgaacacgccggccaaaggcgtggtcgagggggagctgaagtgggtgtccgagaagcatgtcgtgcggagccccat

SEQ ID NO: 19258 - DNA, 430 bp, Sorghum bicolor
  Clone ID: LIB3480-035-P1-K1-C11
gttgataatccttcatcagggtctcatgagactggtcaccatgaagagggtttgctgattgacctggggaatgaccatgatgcttttggggaagcttcagaaagcacagatgcttccgcatcttctgtacctgcatcagatcttctgagtatcgatcagcttcttgaaacggttggtgcagaaccagcacctcaggctggagtagtgtcagcagacattggattcaaggatatgactagccactgcgaagccctgacgatcgggaaacagcagaaaatgtccgccttcatgagcttccagcaaagcgtgcaagcgtctgggcttgcaagcagccaacccaaccagatggagttggaccttttccaagacccgcagttgcctcaagccgggacacataacacgaacccattcgctgatgacaggcttcaag

SEQ ID NO: 19259 - DNA, 298 bp, Sorghum bicolor
  Clone ID: LIB3480-035-P1-K1-C9
agaaaacacaagacagggccatggaggttagaagagccaagttgcgagtgctcgaagcattcacagaggagtgcacacctgtagtacatcgcaaaaatgcacacactagtacctgggggcggcccctcgggattaaaaacaaggactaaaaattcctccccaataaattttttgtttaccaggatttttttattctaaaatcttatcggccattttgggtttgttcacttcctggagccccccagcaaagaaaaaccccccgggaaaatcaattcccatttaaagggcgctgggcggt

SEQ ID NO: 19260 - DNA, 401 bp, Sorghum bicolor
  Clone ID: LIB3480-035-P1-K1-D8
ccacccaccacccccgttggtcttggtctcggtctcggtctcgtctcgtcggccaccgccacctccgccgccgatgcgggtccgtctccagcacctccttttttggattcaaatcccaactcctcattccctcgccaacacttgcctccttgttggattcctcctcgtcgatgtagcatcgaagccatcacgcctatggagcggcggcaagctcaactgatggccaatacgccaatgctgcacagcaagtttgtccacctcaagaagctaagtattgctgttaccgcatggagaagctaagtattagtcttagtgcagtgacctgtactccggcctatgattatttttctctagtttcctttcttgactcttgccctccttggagacactggtcttggatg

SEQ ID NO: 19261 - DNA, 136 bp, Sorghum bicolor
  Clone ID: LIB3480-035-P1-K1-E1
cggttagcaagttacgcggagcgtctacagcatccagactcacacacgcacggacgcatcatcctagaggagctatagcgcgccatgcactcaattcactccccgttcacttactgcgggatcactggaggaaccc

SEQ ID NO: 19262 - DNA, 136 bp, Sorghum bicolor
  Clone ID: LIB3480-035-P1-K1-E6
cttccgaccgcacctcctcacgcgctcgctcgccttcgcttcgtcgccacggcgagccccaccacgccgccgatcggggcgccgtcagcgctgccagcggcagaggcggcgcccgatccgatggacgcggaggtgg

SEQ ID NO: 19263 - DNA, 246 bp, Sorghum bicolor
  unsure (1)..(246): unsure at all n locations
  Clone ID: LIB3480-035-P1-K1-E9
ncgaaaatccacgacgaagtacctgtattttgttaggaaaccgataggcagaaattatccggactgtacttctgacaagagcgtgatttgtttgttactactactcctacgtcctaccgagagagtttctttacaatagctgaccatgcatctaaaaccgatgcgtttttgtttttccatggtactgtgcgcgttcagattccaacttcacccccccattgtttacaaacacccgtgcgacntatt

SEQ ID NO: 19264 - DNA, 330 bp, Sorghum bicolor
  Clone ID: LIB3480-035-P1-K1-F9
cgacatccggttcaacgacttcgacggccccatcccgccggagctcttcctcaagccctacgacgccatcttcctcaacaacaaccggttcacttctggcatcccggagaccatcggcaagacgaaggcgacggtgatcgtgctcgccaacaaccagctcggcggctgcatcccccggagcatcggcgaggccgccgccacgctggaccagttcatcttcatcaacaacagcatcactggttgcctgcctgtcgaaacggggctcctcaccaatgccacggtgttcgacgtgagcgacaacgccctcacaggctcgatcccgccgacgct

SEQ ID NO: 19265 - DNA, 232 bp, Sorghum bicolor
  Clone ID: LIB3480-035-P1-K1-G9
cgacgccaggcaccgtggcttgtattggcagtggactgggccgacgttattctgatgaactgccgaaaagcgtggattggcgagagaaaggagctgtggcgccggtgaagaaccagggggagtgtggctcttgctgggcgttctccgccgtggcggccatcgagggcatcaaccagatcaagaacgggaagctggtgtccctgtcggagcaagagctggtggactgcgacac

SEQ ID NO: 19266 - DNA, 296 bp, Sorghum bicolor
  Clone ID: LIB3480-035-P1-K1-H4
gtctccggctgctgatcgaggactacccgtacgccaccgacgggctgctcctctgggacgccatcacgcggtggtgcgacgcgtacgtggccatgtactacccgtccgaccaagccgtgcagggcgacacggagctgcagtcgtggtacagggaggcggtgcagacggggcacgcggacaagcgcggcgcgccgtggtggccgcgcctgtcgacgccgggcgacctggcgtcgctgctcaccacgctgctgtggctcacctcggcgcagcacgcggcgctcaacttcgggcagtac

SEQ ID NO: 19267 - DNA, 178 bp, Sorghum bicolor
  Clone ID: LIB3480-036-P1-K1-A3
actagttctagatcgccagcggacaatcgcgatctagaacgactaccgccgtggcgggcaagatgcgcagggcgctcaacatctcggggagctgactgacaacatcctggcgctcgtggacaagttctcgagacgctcgccacctggcatccggcttcacgcggtctggcgccacccg

SEQ ID NO: 19268 - DNA, 239 bp, Sorghum bicolor
  unsure (1)..(239): unsure at all n locations
  Clone ID: LIB3480-036-P1-K1-B4
ggcgacganagacgagatccgctccgggccggcggcgagtaggatcgccgggcgatgccggtgacggactaccagggctcaacctcctcgcccttctgcttcggccgctcgctgctctcgctcctcanggacaccaccaccgcaatcatgccgtcnggcgaggaagccgacgtcgaggcgttccagcgccacgtcgcgtcaacgctcgcggagctgctgcccgcggcggacgccggtgc

SEQ ID NO: 19269 - DNA, 275 bp, Sorghum bicolor
  Clone ID: LIB3480-036-P1-K1-B8
gcgctagcttccttcttgtctcccctccgtcaagcagtgtcactctctatccccatggcgaagatcaagatcgggatcaatgggtttgggaggattggtaggcttgtggcgagagttgctcttcaaagcagcgatgtttagcttgtcgccgtcaacgaccccttcatcagcaccgagtacatgacatacatgttcaagtatgacactgtccatggacagtggaagcaccatgatgtcaaggtgaaggactcgaatacccttacttttggtgaaaa

SEQ ID NO: 19270 - DNA, 460 bp, Sorghum bicolor
  unsure (1)..(460): unsure at all n locations
  Clone ID: LIB3480-036-P1-K1-C11
gcgctcatctggtaccgccgcgccgactacacggcgtacgcgttcaacacgaggccgatggcgcgcagcccgtgccagaagcccgccgtgtactacatgtcgtcggcgcggcgccagggcgggcgcggcggggagaccacggtgacgcggtacgagcggtggcgccacccgaacgagacgcggcccgcgtgccggtgggacatagccgaccccgacgcgcatctcgatcacatcgtcgtcctcaagaagcctgaccccgggctctgggacaggtcccccaggcgaaattgctgcagagtggtgtcttcgcccaaggatggtggggagaacggggagaagacgatgaccatcgatgtaggcgtatgcaaggaaggcgagttcagccaagtagcaggagcgtgagctttgattagagacagatgaagataggaaggttcanattcttttcttcttcttcttt

SEQ ID NO: 19271 - DNA, 435 bp, Sorghum bicolor
  Clone ID: LIB3480-036-P1-K1-C2
gcgagcccatggctagcagtggaggagatcagtcctgggcgctcgccaagggcgaagaagttcagcagcaggagcatcgggtttctgagcggcacccaggctagccagatgtcagcgtggcggacacggagcgcgtaccaccgtggcaggagcaccccgctgatgtgcaagaccacgagcaccctcgcggcggtcatggcacagatgctgtcccaccgggccacgcacgtctgggtgacggacgcagaatctgaggacggcgtcctcgtcggcgtggtgggctacaccgagatcttcaatgctgccaccaggagcacctgcgcgagttcgacaacatcttgatgcaccacgccgtgctgtacagtagactgtacttggttgatctgttggtgattgccgccagtgcacaacgttgcactgaactggacaatgtac

SEQ ID NO: 19272 - DNA, 244 bp, Sorghum bicolor
  Clone ID: LIB3480-036-P1-K1-D10
gcgcggacgcgtgcggtatctacatcatcagcagccgctcttctagatgctcccttattacctcctccttcctacgacatagtggctctggtgtagtaccacctaacaacaaactactcgccgttttacaacaacgtcactactgagacaaccctggtaccacacatattaatcttgttgcacatcatcctcttttcagctggtggaataataacaaagaggccaccaatcatcgttcttaaca

SEQ ID NO: 19273 - DNA, 370 bp, Sorghum bicolor
  Clone ID: LIB3480-036-P1-K1-F7
gcgggctaacctatggaatagatgtcagcttactgatatcacagacgcagacatatgcaatcagaatcagatgtcagattactgacatgatagttcgctactgatatcgttcctctgacaagtgcccaattatcagaagaccaacatcaaccatctgacatcaacccaccgacactccgaccagggcgagcctagaactaatttcttattgttcggagcgctctaacgctcctttctctcgagtgcctctatgtactacatgtctatgcttttgatttcaaatcgtcttccttcgctagcagccctgttctgctcagcaaaactttgtgtgacttttaagtagtaaatgcctatgtacataggatgtatt

SEQ ID NO: 19274 - DNA, 228 bp, Sorghum bicolor
  Clone ID: LIB3480-036-P1-K1-G11
tctagggcgaccctggcttactcctccttcctgcgacatcattcttctattatatcaccaccattctataatctacccgccgttttacaacaacgtgactactaaaacaaccccgttgccaaacaaaataatcttgtagcacaatatccttttttcagcatccgtcataacaaagaagaggccaccaatcatctttcttaacaacagttgagcctcaataacgaataa

SEQ ID NO: 19275 - DNA, 209 bp, Sorghum bicolor
  Clone ID: LIB3480-036-P1-K1-H4
agcagagctgcagagggcactgccaggagcaccgatggatcaggggatggagctgaggggatgcgtttgtcggatcaagagctcggcacttgagcttctgtccatggaggaggatctgacgactgatctggatgatgacctgtgggatttggtcaggagggatctccagctaaaggccaccttcctgtacattgacctgaaccgtgtga

SEQ ID NO: 19276 - DNA, 287 bp, Sorghum bicolor
  unsure (1)..(287): unsure at all n locations
  Clone ID: LIB3480-036-P1-K1-H9
gcgcccacgcgtccggttgaattagcaatggctatcaatgcctccattcaatcagctattgcagagggagtacccaatgttcaggcaaaggcatccactcccaacaacaatggctggagtatccctccaagtaattctcacaacggatggggaccatcagtcactcctgcaccatcaaagacgagtggccaatcccaagcccgggtagatgccccaagcagcagcagcacgtacaatggatgggatgtgcctggaacaagctctngtcaaagttcatcaaaacccca

SEQ ID NO: 19277 - DNA, 190 bp, Sorghum bicolor
  Clone ID: LIB3480-037-P1-K1-A4
cgccgtccgtcggccggggcgtttgtcgccgggccaacacgggatctcggcgctgagtggcgcggcgccgacggcgtgagggaccggttcctggagatgatgatcatcgacggctgcttcgtgctggaggtgatgaaggccaccaaggaggacgggaaacgtaatgtcagtgactacgcgcccaacgacc

SEQ ID NO: 19278 - DNA, 319 bp, Sorghum bicolor
  unsure (1)..(319): unsure at all n locations
  Clone ID: LIB3480-037-P1-K1-C1
caaagactgcgccaggtgcacaaaggcgagtaggggctagtacagatgcctcagataacatcatatctgatacagacaagatctgtatgcagctatttcttgatattcaggagtatgcacgaaaccttcgtgcgatagaatagatgcgagagaanatgattctacagagctctatggagtgtgttgccccaaagacaaacagagacattcagtttgatgtaagaatgtgcagatataaaaatgcacccgagatcttagatgagggtatctgatgtgtcttggttgaagactatgatgcatcatagatgagactgaattt

SEQ ID NO: 19279 - DNA, 190 bp, Sorghum bicolor
  Clone ID: LIB3480-037-P1-K1-C3
agagaacccaggccaggagagaggtgaggcacagagagagagagagaacagagaagggggcggaggaaacccttttcttcgccctcgccgacgccttctgctttcccggtcgcgtctacttgggggttctgccgtactcacttgaatgcgccggagagttcttgcgtccgggcgtggcaatccacacata

SEQ ID NO: 19280 - DNA, 281 bp, Sorghum bicolor
  Clone ID: LIB3480-037-P1-K1-D5
cccacgcgtccgccggcgcagtttccgacagagcttgcgacagccgcggagctctgcggggagctgtattgggagccgtccactgagctgagctttccatggatgttctcgaggattgtcgcacttataggcgctccgaccgcctgggctcgcacggttgcatatacatggaccatttcattgatccacttttttgggccaggtatgttcaagagcaatgtacagcttcataatatgcatgatatcgcttacaagacagcataccagattatgttcacgat

SEQ ID NO: 19281 - DNA, 197 bp, Sorghum bicolor
  unsure (1)..(197): unsure at all n locations
  Clone ID: LIB3480-037-P1-K1-D7
cgccaacaaggtccgcatcgtgcgcgcgggtgcggtgccggcgctcgtcgaggtgctccggtcgggcgcgtcggcgcccgaggcgcgggagcacgcggcgggggcgctcttcgggctggcgctcaacgaggacaaccgcgccgncatcggcgtgctggggcggtgcccccgctctggactgtacgtcccggccagta

SEQ ID NO: 19282 - DNA, 368 bp, Sorghum bicolor
  unsure (1)..(368): unsure at all n locations
  Clone ID: LIB3480-037-P1-K1-D9
accgccacctcgtcacccttgtcgggtactgcatcgccggctcctcccagcgcctgcttgtctacgagttcgtgcccaacaataccctcgagtaccacctccacgggaagggcgtgccggtgatggagtggccgaggaggctcgccatcgccctcggctccgccaagggcctggcttacctgcacgaagattgccaccccaggatcatccaccgtgatatcaaggcggccaacatccttttggacgaaaatttcgaggctaaggtcgcggatntcggacttgccaagctgaccacagacaccaacacgcacgttttcacgcgcgttatgggaactttcgggtatttggccccggagtacgcgtcgagc

SEQ ID NO: 19283 - DNA, 392 bp, Sorghum bicolor
  unsure (1)..(392): unsure at all n locations
  Clone ID: LIB3480-037-P1-K1-E1
caaggttagggtttactcgtgaggcctcctgctccccctgccgtcgccgtcgtcgtcttcatgggacactccaacgtgtgggcccaacaataccgtgaagtaccaccttgaatgcagaggtctgtcncggtgtagcgcataactcctcacgggcttgatccggaaagcacggggctcatgtgctggcatgcagtgtctttcgcaagcatcgccaaggacatcgggcttcatcaagtactcgttaaagcttgaggagctccaaagcatgacataaatggaggcatggatgggaacctaaaaaatggatgtacttctaatataaaactatgtaatgaattggtttggccttgagtggatgaagttgttgtattcctcaattttcaatgctactt

SEQ ID NO: 19284 - DNA, 311 bp, Sorghum bicolor
  unsure (1)..(311): unsure at all n locations
  Clone ID: LIB3480-037-P1-K1-E4
ctttcaggagaccacttcttagtgctgatccagcaattactgtacaccaaatacagccaactgataagttcatcatttttgcatctgatggactctgggagcatcttagcaatcaggaagcggttgacatggtccaaagtagcccacgtaatggaattgctcgaaagttagtaaagtctgcaatgcangaagcagcanagaagagggagatgcggtattcagacctcaagaaaattgatcgnggggtgaggcggcacttncacgatgatataactgtcatttgtggtggttttcgattcaaaatgccatga

SEQ ID NO: 19285 - DNA, 373 bp, Sorghum bicolor
  Clone ID: LIB3480-037-P1-K1-E7
gtgaagccccgggagcggaacgagaggtacgtgaacgccgtgatgaccatccccaagggcaccctcttccccatgtgcggcatgaacctcgccttcgaccgcgacctcatcggccccgccatgtacttcggcctcatgggcgacggacagcccatcggacgctacgacgacatgtgggccggatggtgtgttaaggtaatctgcgatcacctgggtttgggcgtcaagaccgggctgccctacatctggcacagcaaggccagcaacccgttcgtaaacctcaagaaggagtacaagggcatcttctggcaggaggacatcatccccttctttcaagccgtcgtgctggccaaagacttcgacaccgtgcaaa

SEQ ID NO: 19286 - DNA, 139 bp, Sorghum bicolor
  Clone ID: LIB3480-037-P1-K1-F2
tggatcggcacagcagcacaagatgtacccgagcgagtctttagaggcgtgcgtgcgtgcgtgtgtgtgtgctattgctacggcgtacggcgcagcattagcagcggcagtcatgagcactgggcgcgagagcaccacc

SEQ ID NO: 19287 - DNA, 432 bp, Sorghum bicolor
  Clone ID: LIB3480-037-P1-K1-F7
cgagcgtatcccctctcccatcctctcgattcgattcgagcttgcttctagggttcttgaccccgctccaccgtctcctatggcagacgaagccaaccgagcggccttcatggagctgcagtcccggatgatcgataccaccgcgaagatcaagcagttacaaacccaaatgcgttctaaggaaggagaaaagaagcgtgcctaccttactttggaggaacttcgccaggtgccagatgaatccaacacctacaagactgtcggaaatgtgtttattctggagccaaaatcagttctgtttaatgagcatgagcaaaagcttcatgacagtgagaagtgctatagcttcaaaggctgacaatccaagaatacccttgagaaaccataggggcggaaggggaaaacaacaattaggggaggctgcttttaaca

SEQ ID NO: 19288 - DNA, 129 bp, Sorghum bicolor
  Clone ID: LIB3480-037-P1-K1-G1
cccacgcgtacgattatatgcatcatggatgcttctgtctgcattgtaatgtgttcttttatcagaggcatagttgtattttaagttattgtagtaaactgagataggattatgattgggatgctttaa

SEQ ID NO: 19289 - DNA, 139 bp, Sorghum bicolor
  Clone ID: LIB3480-037-P1-K1-G3
gaaggacgtgaccgacgtgacgttgctgaactgcttgctcaagaagaccactaacggcgtgcgcattaagtcgtacaaggacgccaagtctgtgctgacggcgtagcatatgaccttggagaacatcacgatggaggag

SEQ ID NO: 19290 - DNA, 298 bp, Sorghum bicolor
  Clone ID: LIB3480-037-P1-K1-G8
gagaacagcctccgttgtcctcgcaagcctactggcggcgctcaaggtggtcggcgggacgcttgcagaccacacgtacctgtttctaggcgccggcgaggccgggactggcattgccgagctcattgctctcgagatgtcaaaacacgctggttctccgatcgaagagtgccgcttcaagatctggttgatggactacaagggcctgatcgaggcgtcacggatagactcgctacaggcgttcaagaagccgggggcgcacgagcacgagccattggagacgctgcttgaggcggtg

SEQ ID NO: 19291 - DNA, 271 bp, Sorghum bicolor
  Clone ID: LIB3480-037-P1-K1-H8
cgatcctcatccccaagggcgactacctcgtcgggccactcaacttcaccggcccgtgcaagggcgacgtgaccatccaggtggacggcaatctgctggcgaccacggaccttgaccagtacaagggtaactggatcgagatcctacgcgtggacaacctggtgatcaccggcaaggggaagcttgacgggcagggccctgccgtgtggagcaagaactcgtgcgctcagaaatacgactgcaagatcctgccaactcgctggtgctggac

SEQ ID NO: 19292 - DNA, 228 bp, Sorghum bicolor
  Clone ID: LIB3480-038-P1-K1-A7
aaaaaaaaaaaaaaaaataaaacaataaaattagaaataaaaacaaaccaacaataaaagagaacaccaataaaacaaacattgatatggggagtccttttaataagaatactacggggcggcctttttatgggaaccacctttatttccgcgggcttccaacgaaataatttttttttagggccaccaaaatacaataatctgcccgccgttttaaaacacccattt

SEQ ID NO: 19293 - DNA, 273 bp, Sorghum bicolor
  Clone ID: LIB3480-038-P1-K1-B1
aacatcgcggccgctcgtgtcctggctcgacaactagtgcgagatacaggagccgattcgttgacctgatccgtcacatgagccgcaccatctagatgaacgaactgaaggtctgactatacgtgggaggatgcaggggagttctgagtcggagaaagcgcttgcgagagtacaatctagtatctatcggattgtctgaaactatgatggtaactgttttgtatcgtgtatggtgtttgagcattggatggctcatataatggctgatatact

SEQ ID NO: 19294 - DNA, 209 bp, Sorghum bicolor
  Clone ID: LIB3480-038-P1-K1-B5
cggacgcgtggggccgttcatgtccgtggctgcctgccctccgtcggagcaggcggcagcacgcgttccccgccgcagcagcagccatgggccagtgctgctccaagggcaccggagaggccgccgccgccgccgtcgagtcggcaccaaaggcgcaggcggcaagccgcagcgcgtcgtccgcgaacaacgaacgtccgttctcgtcg

SEQ ID NO: 19295 - DNA, 233 bp, Sorghum bicolor
  Clone ID: LIB3480-038-P1-K1-C10
gcgcggcgtcgaccgctaacggggccgagccccggcggcgggcgcgggcgcgggcgcgggcggcggagcacagcgaggcgtccacctcgggtctgctggcgccgccgtcgcagccgcagcagcaagaaaggcaagggcaggaagcggagtcgtcgttcgggggcaagaagcgagggaacaaggtggcccctgagcccaaggagcttgaggagaggaccgtcgcgctcccgtcg

SEQ ID NO: 19296 - DNA, 354 bp, Sorghum bicolor
  unsure (1)..(354): unsure at all n locations
  Clone ID: LIB3480-038-P1-K1-C12
agacgacaacgacgaagacgaagccccatgcagcatccaccggcaagccacccgaacctcctaggacgacgatgacgacggggaaaggggccaggtccatcccgccgtcaccgccaggcgccaccaccggcgcgcgcgagcatctacgacacgtgtgcgcgtgcgcgacgggttcggccccgtggtgtcggcggcggaggagcaagtgcgcagggggtncgcggtggtgaagcgctcccgggacccgtacgccgactcccggtcgtccatggtggagatgatcgtggggcggcagctgttcggcccgccggacatggagcacctgctgcgctcctacctnttcctcaacacgcc

SEQ ID NO: 19297 - DNA, 339 bp, Sorghum bicolor
  Clone ID: LIB3480-038-P1-K1-C2
gttaaactgctgttgttcccaaacgcacttaatttagatgttgattgcacatccttgtcagggctgtgctcgtcccttttacgggctctgtcacctctccagttctcatgatgaccattaacaaggtcggagaagcttaagttcccatagaacttacttcctccatcactaacagcatcttgctggggtctaacattactaacaccaacagaagtatttacagtaactggaccatttgacaggaattctgcacctctggaagcactcgctgagccattctcatatacaaccgatggcaccgaagacgtgctcgcttggttggctctacatcagacactg

SEQ ID NO: 19298 - DNA, 488 bp, Sorghum bicolor
  Clone ID: LIB3480-038-P1-K1-D10
ctaagtttcaagcagtagccattgccatccaaagatctggcttcaagatcgtgttgctactaaggcttgtacctttacttccattcaacatgttgaactacctgttatctgtcactcctgttggtgttggagaatacatgttggcttcttggttgggaatgatgccaatcactcttgctttggtgtacgttggaacaacactgaaagatctatcagatgtgacacatgggtggagcgagatctcgactactcgatggattttgataatatctggctttgtattatctgtggtcttgattatctgcatcacaaaaattgcaaaatcatctctggagaaggcattggccgagaatggagagctggatgtaggaacatcgcagctttctgtggtagcctctccctcggatctgcaacaacctcttgtaatcaagattgacacatttaatgaagatcacgagaagtaagagtggtgtgtttacaatccctga

SEQ ID NO: 19299 - DNA, 520 bp, Sorghum bicolor
  unsure (1)..(520): unsure at all n locations
  Clone ID: LIB3480-038-P1-K1-D11
cagactcgaattcgaatgagtttcatattcggcttgagggagtttatataccaccagaggttcacactcgttgcagtcgtccacacaatctgtatgttcagtttaatgcctaccaagtagagtctggttctctcttcctaccaaatagagtctggttctctcctcctaagagcatctccaagagattagccaaatttaccaatttagttattctctaaaatagatttgacaaaaaaaatactagtagagagcgaacgtccaaaagtcaaggtgggatcgagagttactgaatttagagagttatttacaaactgttgngaattttttttaataatagtcaaatttacctttngaaaaaatataattattaaatattttaatttatattnatttattatttatattaatttatattttatttatattatttaattttttattttttttttttttgtaattattttaatttttattttttaatttacttttattttaatttttttttattatttatattggg

SEQ ID NO: 19300 - DNA, 292 bp, Sorghum bicolor
  Clone ID: LIB3480-038-P1-K1-D12
aacaaaaaaagaggtactgatcgttaagacgacaatacatgatatcatgaaccaaatgattcgggaacttccaataaccaatccagtatacctcatgctaggcacatcatttggttcctcagctaaaggaacagggcttaaagctcttgaatttgccctctccatctgggacaggggtgatattgttgggttcacaggagatccaggttacaaggaatggacaaggtacttttcagaggtcagaaagggacacacttcactacatgctggtaaaaattcattcaccgatgcg

SEQ ID NO: 19301 - DNA, 164 bp, Sorghum bicolor
  Clone ID: LIB3480-038-P1-K1-D4
gcatagcgtctaggactacttgcgtgcgtacgccggtgaccggtgccgatcccggtccgccttctcgcgccatggccgagatttgctgcgaggagattaagttgactcccccggcttctgttttttcatcactgtgcttgcctggggtctctctaaggtggata

SEQ ID NO: 19302 - DNA, 308 bp, Sorghum bicolor
  Clone ID: LIB3480-038-P1-K1-D7
gtgttgatgctacatacattttctgaggccatgattcataagcatccggtctccgcgatcactgatggggaccttgctatgcagagagcaatcaggttggtgtggccgaattcatcgcataggctctgcatatggcatattgagcagaacattgtgcgcaatgttaaagatgatgttgtgaaagatgaattcaagagtttcctttatgattgttggcccatacaagagactgagacaaaatggttgcaatttttggatacgcataacggtaccaataaggacgtatggtttgtgtataactctgatac

SEQ ID NO: 19303 - DNA, 407 bp, Sorghum bicolor
  unsure (1)..(407): unsure at all n locations
  Clone ID: LIB3480-038-P1-K1-E9
agcctcggccgtgccccaactgaccgcaatggcggaggcgctgctgctagcgtgccacctcgccctctctttcgccctcctcgccgcctccctctcccacctcctcgtcgtcgccgtctcccacctctcaccttcctccatccaccaccaccacctnctcctcctccctccgctgctcccgctcctcccgctcccgttcctccctcctccccacctcccgctgctccgcgcgctcctcctctccctgccgctcctcctgctcgcgcgcgcggccgacctcctcgccgcctcgttcccggcctcggacctccaggcgcacgcgctcgccgtcgcgcgccttctccttctcgccgcggcggcggctttcctcgcctcgtcgctctccgcctcggcgcccaggggcacga

SEQ ID NO: 19304 - DNA, 501 bp, Sorghum bicolor
  Clone ID: LIB3480-038-P1-K1-F1
cttggcacctaatcagagtgcaggtactatgccgaatcgtgaagtgttgtcagacagacatagcgtcctcatcactgcgtccggattacaaactccagagttttcatttcctcgctcttcaattttatacctgcctttttgcctcgaggacggaccttccgagacactgcgacaatgcacttgtccaccctccagaaaattatttacacgagctagctgcgcaagatcacatccaggcgtacatacgcacgggctagctgcgcatgatccagccatccgagctagctgcgcgagatcagcagctgatctatggtgctcagcatcggtttcagaattcacatttattttttgtagatatataagctagccttttattttgaagataagagatattggtctgttctctgcacccctgtaataatgaaacacccggaaccagccgacaaagggaaagaatgagaaagactgaaacaaggatctttatggattcttcgatctatg

SEQ ID NO: 19305 - DNA, 124 bp, Sorghum bicolor
  Clone ID: LIB3480-038-P1-K1-G11
gaaatatcttcatgtagccatattttcctaaacatgcacaaatggcttcgatgtcattcacatgtgtttgatttggatattactagctattacctgcattaaaaaaactgaccagcttgttgca

SEQ ID NO: 19306 - DNA, 491 bp, Sorghum bicolor
  Clone ID: LIB3480-039-P1-K1-A12
gtcaagaggacatccctgcactggtggactgtctgagcagggagaggctggtatcggcctcggctggccgagtccattccgtttctctcacgtcgaaaggtgaagtttggacctggggatcgggcaggaatggcaggctaggtctgggcagctccattgatgaggcggagccatgtcttgtagataccctggaaggggtggaagtcttgcaagttgcagcagggatggaccataatctcgtcctggtcgccgagtaggttggcatgttggttcactgaaagatactattattgttagttgtatgggggatcatgatctgtctgaagaaatggaagttgacgccattttttctttctcgaaggagtatggccagtaagggtgatgtgctttttttttctcaagagatggtgtggatgcgcattgccacttgctagacagcatgtgatctaacatactcccttttgtagcattggtcctcttgaaaagagatg

SEQ ID NO: 19307 - DNA, 266 bp, Sorghum bicolor
  Clone ID: LIB3480-039-P1-K1-B11
cccacgcgtccggttttttatttttagtttttttttttattatatttaagtttacatacgcatgcatccgatttaaaagaaccaagattgcgtaacctaacatgaaaccactaaccttctttatacaacgacctgaatgcaaaaaacctggcgttacttaacaaaatcgcgacggagaacatcctggtgtttcccgatttaataatcttgaagaggatcgcacctttcgcacttggcaacaattgcaaaaggtgcatggcgaatgg

SEQ ID NO: 19308 - DNA, 336 bp, Sorghum bicolor
  unsure (1)..(336): unsure at all n locations
  Clone ID: LIB3480-039-P1-K1-B3
cttcaaggagcggatgaggagcagcaccagcgcccggcccagcgccgacaggaggaggcgcaactggaccgccggccactattcggagtcggagcggccgtcctcggcctccgccgtcttcctgctcacggaatcctgacgccatcgttattcgtactgattgctcttctagctgagatctccaaaacgaattacactagtgttgcggaatgggatgtacatcgtgcgtgcggattgaatgaagcgacactggaatcaatttgttttaaaaaaaaaaaaaatnaataaatataattaattaatatattattatattaaaaaagggcggccggtcgc

SEQ ID NO: 19309 - DNA, 341 bp, Sorghum bicolor
  Clone ID: LIB3480-039-P1-K1-C3
ccatgacctaccttgccgcggatcccacggggtctgcaccatggcggtgttcggttggagcggctgcagtggtgagcgcgcatgggtggccgtggtatgcgcgagcacatgttgctacagccggcggcatgggcgcagacttctccacgcaagcactcctgaagacctggccgcgcctcttacttttcccatctggccctgcttgacatcaaccatggagaccgctttcttcatatggcggcgccccttacccccttcccaactggaggcgcacccccttcttcaacgaacatttttttacccaaccggcggatttattgcacaatgagtgtcctgttctt

SEQ ID NO: 19310 - DNA, 284 bp, Sorghum bicolor
  Clone ID: LIB3480-039-P1-K1-C5
cacacctgctaacgcttccactactcgtcgttgctactagctgtcgtcacgtacgctatccagtgacactgctgttcgtccagcctgagcgctgagagatacgagtacgacactcgaatcgatcggtaaataataccaatggcggcggcgccggtgtcctcctctgccgcttccgcggcggacagcagggaggagatcgtcttcttggacgtggagaccattgcccttccgctcgtgctactagagttcagcactttggttgactactatagcatgactgatga

SEQ ID NO: 19311 - DNA, 261 bp, Sorghum bicolor
  Clone ID: LIB3480-039-P1-K1-D1
ctcacaacctgcacgagccggagtgcccgaccgacgtcgagcgagccatggaagagaccgaagctgctgtgaagctatgcactgaggagccggtgaggacagtgcgcgccgactgcggacccatcgagccgactcagcccatactgcctgcagctgcctgaccgtgaggtcgtggacttccagctagacgcgtgcttgcaaagacttcgcccggactggtgccaggcgtacgcgttctggggccgtgcaagcttacagctg

SEQ ID NO: 19312 - DNA, 324 bp, Sorghum bicolor
  unsure (1)..(324): unsure at all n locations
  Clone ID: LIB3480-039-P1-K1-D11
cgcttcctgccgccgccggagtggcgaaagggcggcgaccccgaggaggacaggctcgacgaggaggcgctgcangagtacgtcagccggtgggccgacgacaaccgcgtcacctacagcgagaacctggtctgcggctccgacgagatggtgggcatcatccgcaagtccagcccggcgtcngacctgctgatcgtcggccggcgggccaacggccccaagtcaccgctcacggtcggcatctcggactggagcgagcacctggagctcggcgtnctcggggacctgctcacgtncacagactntggatgccaggtgtcaacg

SEQ ID NO: 19313 - DNA, 160 bp, Sorghum bicolor
  Clone ID: LIB3480-039-P1-K1-D12
cccacgcgttcgtgtctctagcacactagtgagttctagactacacaggccatggtagccttggaggttaaggcataagagatcgggctgaggagctgcatcgaatcgatcgcgtagacctctatatagaagagaggctccaacgcgcagggcgacctca

SEQ ID NO: 19314 - DNA, 444 bp, Sorghum bicolor
  Clone ID: LIB3480-039-P1-K1-E1
gatggagctgaggttgatgcataaagtttcgttgtatgccagagccaatgaagtcagcacatgttggggatgcatcctatttggtttgtacagcagaactttgcctagggttgggtgcattatatctgcatttgtttcaagaaaatgagtactagcatttcttctgctaaaacaagatgctgctgatagatacagtgggtggtttcccaacggtggaataaaaatccaagatgaaaggtgactggttatcagagagtaatgctctgaaaagggccatggtgtggatacaagctatacatatggaacctcagaagctaataatctatgcttttattgccttgtaaggacatgatgcagttcttgatttctggactaccgttgcatgtcttgattcttgggttgccgacaaaaggagaggggttcaggctgacagcaacgacaaga

SEQ ID NO: 19315 - DNA, 206 bp, Sorghum bicolor
  Clone ID: LIB3480-039-P1-K1-F6
atcaattcctttcaatcaatgaagagatcaacaagcgagcactgcactgttgctactaggtagatgactacattggactgctactcctgcgagtgcttgctactagacggaggtcgcatagactacattcttcgtcattgactcatgctgcactaccctcaccatccaggatggcactgactgtaactacaccaaactatacgtca

SEQ ID NO: 19316 - DNA, 373 bp, Sorghum bicolor
  Clone ID: LIB3480-039-P1-K1-F7
tcggcctccctcgctcgcccgcacagaagaatagagaagccggctagcgcggagtcccaacacgccagcgccggtcatgtgggtggagactgagcggaactgcaccgagttctacgaggtcttcagtctcaactccatgacaccgcgctcacgcataccctcggactacagggctctgtccccggctccgctgacgtcgaagactccttgacctagtgctcgtcctacgacttgcccgacgtcgaccgcaagcgcgcctcctcctactccaacccataccgctcctccgcggtcggcgtttcctgcgacgctgcaccggcactcaacgcgcgggtagtggggtggccgtcggtgaggttgcaccgcaagaacg

SEQ ID NO: 19317 - DNA, 487 bp, Sorghum bicolor
  Clone ID: LIB3480-039-P1-K1-G12
ggaacgcggacacgggctccgtggccacggcggccgggcacccgcaccggcgggtggtggtcgtcaggaggcggaacaacgacctcgccgtcgaggagaaggagagctgcggctccaacgacgtctccgtcgtcagcttcgacggctcctccagcctcggtgccggtggcgcccgcagcggcgggctcagctgccataagccgccgggcagcagcaagagccggctcaagggcggccggagcttgccgcgccggaagcaggtggcgttttaggagcaccaccgctttcaggcaagatcacacaaggtgagcaagaaggtgcaccagcgagtggagcaggagccgcacagggaccgactcgacgccggcggtttcgaaccttccacggattactgaaacggacggacactgagcctggagtccacctgctttgtacatagatttggaagggatttgcagctgacgatttgttgttgggcttgcatgca

SEQ ID NO: 19318 - DNA, 308 bp, Sorghum bicolor
  unsure (1)..(308): unsure at all n locations
  Clone ID: LIB3480-039-P1-K1-G7
aatacgtgtgctggccatgctgattgacacgaaagtttgtcatgagagtctagctagcttgcgaatgtggcaggcacaaactgacatgagaagcatcagcgattgatacgaatggtgatccagcagcatcctctgagagagttactgtctctaactaaagaaagncatctatcgattagctacagtgggtctggacgtctaggggactggaactgtggtgcgcacacatgtggtcgctcaagcattgtatgatatacatgacgcagttattgcatggcctttacatgctgatgtgagtatagattact

SEQ ID NO: 19319 - DNA, 111 bp, Sorghum bicolor
  unsure (1)..(111): unsure at all n locations
  Clone ID: LIB3480-039-P1-K1-H12
actcacactgacagggacactcgggttggagaagcttcttgtanaatntgacaggaaaaactttaacacaactgttaatgcactcacagagcctattgatatatatagtga

SEQ ID NO: 19320 - DNA, 364 bp, Sorghum bicolor
  Clone ID: LIB3480-040-P1-K1-B10
cgcacgcatacgacttgttgtacagacaatggccaccgtatcgactatggcaccaatgatgctcgcacatattatggaataggggaaagaggactgtcaccacgtccatatgggataggttccaggaagacaggttattacgcaaaggatcacaagtgctgacagaacatattcaataacaatataccagcagagcgctggataatctgcaaataccataagacctgaaagatcagtcttgcatggtttatcaaatacaggtggtggcattactgacattgtcggcgccccattcagatcaacttgctctatcctaaagacacctgaaaaatcttttccgtaagtgaatacaagttcgccacct

SEQ ID NO: 19321 - DNA, 228 bp, Sorghum bicolor
  unsure (1)..(228): unsure at all n locations
  Clone ID: LIB3480-040-P1-K1-B2
gcgtgtgtgtgcagtgcagtgcctgatgcgcgcggcatacgcacacatgaatgngcttgcctaattgtttttttactcttcctttactctgtgcctggggctccttatgtttatgtatctgtaacatacacgtcaaccaatatagtgcgtgtgtatatgtcacatgttggtcacttataaacttgtgttgataaataaaaagtaatagacaccaatcattgtctttta

SEQ ID NO: 19322 - DNA, 343 bp, Sorghum bicolor
  unsure (1)..(343): unsure at all n locations
  Clone ID: LIB3480-040-P1-K1-B3
cggacgcgtgggggacanctgtccttggtgacaaggagcagcttgtccatggaaccacagccaccatttgctcaccacaacctgtcggtggactaggaaccggatccttccttatttctcttgactgtggattgttccacacaaccatagtctcctctgatggagaggtgtggtgcttggtaatggagagaggtctcggactgtgcccacatgctatctttacggcagtagctgaacgggatgctttctattcaataagggtacaggctactgggacacacgcgttcacgtttcatggaacaccgcagatcttctgtgtacccgcacacacttctctacattc

SEQ ID NO: 19323 - DNA, 402 bp, Sorghum bicolor
  Clone ID: LIB3480-040-P1-K1-B8
ggcagggaggacttcgaggagcacatgcggcggctgggccggctcaaccaccccaaccttctgccgctcgtcgcctactactaccgcagggaggagaagctgctcattcacgactacgtccccaaccggagcttggcgaacctcctccatggcggcggagagggctgccggatgaataatgcggcggtgcactgggcagctcggctgaagatcgtcaagggcgtggcgcgggcgctcagctacctgtactacgagctgggcatgctcacggtgccgcacggccaccttaagtcgttcaacatcctgctcgacggccactacgagccgctgctgacggactacccgcttgttcccgtgatgaaccaatcgcacgccgtgcagctcatggtggccttcaaggcc

SEQ ID NO: 19324 - DNA, 388 bp, Sorghum bicolor
  Clone ID: LIB3480-040-P1-K1-C10
cccacgcgtccgcatttccctgggaatacatttaactggacaaaagctccaggatgtcgtaatccattgcaagagtgatgccaatgggatggatcctgaacatagggcgagtagaaagtgtgttccttcacaacatactatgcaagagctagagtagcgaggatgattgctccaaaaatcttgggaagagaaatttgttagataatatcatatctcctatggtctatctggtattcttgtatcagattgttgcctcaaaaagcagagacgccatggcgaccttgctgtgtattctaaattggtgctttggcaaaagtttgcctgatgtctctggggatgataaaacatttttgtaggagggaacaacctggcattttgatttttgagt

SEQ ID NO: 19325 - DNA, 470 bp, Sorghum bicolor
  unsure (1)..(470): unsure at all n locations
  Clone ID: LIB3480-040-P1-K1-C5
ggccgcgcttttttttttttttttgtatgcatgtaatataataaccatacgaaaaacaaactgaagttgccaaaatgtgtaacccatcagtatgggtaactcgtaagctcacattttcgatgtttcgtcatcacaacaaaaacattactcacttataaacacccccaatttacactgccacagccacagccaccaagtagccccaaggattgataatccacggtccaccgtccacatattttagctccttacatgcaaagtgcacgaagctactgcatcatctgtgtggccttccacattcgaacacacacctgcatgcccttatcattgctcctcggcctcctcctcctcatcgtcctcttcgtcctccgaagaagacgacgagtcgtctgaatgatccgattctttgtctttcttcgggtctgggtcggcggcngcggctgcaggtggagcaacaagggccggtggat

SEQ ID NO: 19326 - DNA, 371 bp, Sorghum bicolor
  Clone ID: LIB3480-040-P1-K1-C7
aaaaaaaaaaaaaaaaaaaaaaaaaataaataaaaaaaaaaaaaaaaaaaaattataaatggtcgccccttctaaaaagtaaccaatgatacgggcgcatacatactataataataactcatatttaatgggcgccgccaattcaattacaatccccgttacttttacacacccttggactggcaaaaactttttcatctcccaactcaaacccctttcgccagctgccgttttacccaacatgccttaataaaacccggctctcaccaaatttacttccctaacaataaatcccccttactggagaatgggacataccccaaagcccctcacctagctcctctcacaaggttggctccccctgaaagtcc

SEQ ID NO: 19327 - DNA, 163 bp, Sorghum bicolor
  unsure (1)..(163): unsure at all n locations
  Clone ID: LIB3480-040-P1-K1-C8
gctgtcgctncacaacaacccgcagagccagcccacgctcgtgccggagctagcgctcccgacncaccccctgctacacaagctgggcgcgcacactggcgcgcgcattgagctggaggtcgagaagcacgctgagcatcacggcggcgctcgctatgcctgc

SEQ ID NO: 19328 - DNA, 181 bp, Sorghum bicolor
  Clone ID: LIB3480-040-P1-K1-D10
gtactagatactgaacataccattctctagtagcaaagattgactgcgcatcgatccgactcagtggcatcctgcacgtgctgcctagctgtactgcaacgtccacccatctacaacttggcgactgataaaacagcgatgatcgcgacacaagagtgcatggcgctcatggatttttgga

SEQ ID NO: 19329 - DNA, 276 bp, Sorghum bicolor
  unsure (1)..(276): unsure at all n locations
  Clone ID: LIB3480-040-P1-K1-D5
tccttgaccggtcgcctagggaccgangcgtcggcgtcgactagctggaggcgnggctgctccggcatgtcgnctcccggctggacgccgtcgggcggagggagatggcccggcactacagggacctcaacggagccaacacgctgctcgaattcttcgcagactagagctagggggcaacttggttttgtagggttgtaagcttcaaactcctttctgcttaatgaaatacacgcttcggattgtgttaaaaaaataaatccgaaacttacaatg

SEQ ID NO: 19330 - DNA, 290 bp, Sorghum bicolor
  Clone ID: LIB3480-040-P1-K1-D9
gaacatagagacgaggcatacgttctagacgagccaagagtacgtgcaccagcatgccactttatggacttgtgcatcgggctacctagctgaaatgcaagggccgtgattccacgacgctgcgactgataaaactgcatcgctagcataacaagtatgcatgacactcatggaatgttcgatagctgacatagctgcgaataggcatgatatgatcagccgttcgaacagtggcgcatgctgaatggcgacatgcacacgcgctgtagctgggcatctagcgcaccaga

SEQ ID NO: 19331 - DNA, 282 bp, Sorghum bicolor
  Clone ID: LIB3480-040-P1-K1-E11
gcgatgcttgatatagtgattcacaatgcacgaattgaagggcaacttgactctggtattgctgatatgaaagctaaaagtgtggaaatgagagaatcaccaaagactgttcatgttgatactgcgtctggtgctaggacaggattatatactcttacaggtgagcgtggagtttcttggggaggtgccaataccattcttggagaaaggttgaaagattaaggaggttcttctagtgaggggttctatgagtccagaaaagaatgggtggggggaatacac

SEQ ID NO: 19332 - DNA, 316 bp, Sorghum bicolor
  unsure (1)..(316): unsure at all n locations
  Clone ID: LIB3480-040-P1-K1-F11
gcaaagcccacagcagagaggcaaacagcagagagttgcaacaaaaagttcgttcagctcctagcctcctaccttctgtgcgttgctctgcgaggaggaggaggaggaggaggaggaggaaggaaaggttgatttgatcgagcagcatggcgccgctgccacagccgtggggccaccaggtgctcacgcttcttctgctcgtcgtcgccgcggcgaccgccgcngctgtcctggtgagagcccaccactagaagtgcaacaacccgtgccggaacccctgccgcgagccgtgccttttctcaagcccttcaccacc

SEQ ID NO: 19333 - DNA, 224 bp, Sorghum bicolor
  Clone ID: LIB3480-040-P1-K1-F7
gcggggagagccaagacgaggatggtgttcgtgatgaacacgctcatgcggctggcgtgcctcttcatctcggtggccttcatcgggctgacgtacttaatggactggcttgaccactgctggctggcctgtggcactatggcgattggcaccatgatcatgctcaccaccctcgggttcatgtgctactgcatcatcatacacaggctgccagagaagaacac

SEQ ID NO: 19334 - DNA, 362 bp, Sorghum bicolor
  Clone ID: LIB3480-040-P1-K1-G3
gcttgaggcgaggggcgcccgcttacaagatacaaagttaacttcccgtgccatccatgtccttagtgcgttataagctggaccaaactggagtgcagggtggccacgtgtctcaactcgcggactcgcaaaatccttggcgttcctaacttaagacgggctacatacattccaccattaccatgttacctacatgatcagaggccacgaccgcttcgacgttaccaccactgcccacactggaatgccaatcgggtgctaccttgtacggaccattaaagtctggaacgttagtaagccgccccacgtgtaccgatcacttgccagggccctgtcggcccgtcctttcgcttatctacctt

SEQ ID NO: 19335 - DNA, 298 bp, Sorghum bicolor
  unsure (1)..(298): unsure at all n locations
  Clone ID: LIB3480-040-P1-K1-G4
ctcgaattcgactcggaccctctgccttagaggtatacagacatggctgacccgacctcgtagcatatatctgcncaaacaccgcacccgacgtcagtgcagcangctgccgtggcggacggacgcgaggacatgcatggctgtgtccgtggccggacgcttagatggccgttgctgctagattgcctttcgcgcgcgagctccataccgaagaccgctgcatcgagtgctcttaccaaaatgatgttaagaggcatgcgaggtattacatggaggctgtcaagaaactacagtctta

SEQ ID NO: 19336 - DNA, 304 bp, Sorghum bicolor
  Clone ID: LIB3480-040-P1-K1-G9
gcgcgggtacctgctctacgggccgcccggcaccggcaagtccagcctcgtcgccgccatggccaactacctccggttcaacctctacgacctcgacctgtccgaggtgcgcctcaactcggcgctgcagaagctgctcatccacatgcccaacaagtcgatgctcgtcatcgagggcatcgactgctgcttcgacgacgctgccgcgtcgaggaaagccgtcaaggcgccggagctggtcgacgacctgggcatggaccccgactacacatcggattcctcggaggacaactgggcccagcag

SEQ ID NO: 19337 - DNA, 326 bp, Sorghum bicolor
  Clone ID: LIB3480-041-P1-K1-B11
gtgcatgcgactagatatcttatatatagagctacctaaattcaactgactggccgtcgacatacaacggactgactgaaaaaaccctggacttacctaaattaattggcttgaaatacatctttctttagctagctggagtaataacaaagaggcaccgaccgatcgtccttacaaacagtcacgcagactgaatggtgaatggcacgctccctgtagcggttcattgcgcgcggtgtgtgtgtacttacacccagaccgatccattcactagcgagctacctagcgctcgtttcgtttgctttctttcctttctttctaggcac

SEQ ID NO: 19338 - DNA, 167 bp, Sorghum bicolor
  Clone ID: LIB3480-041-P1-K1-C7
gtagctagatagagttatagctgctgtcgtcatcgtcggcggctgctgaagcgacgtaacctgttcttagaggataagataggctagcagagagggtcatatagcgaggatgtaggttgagatcagcaggcgtatgacgaggatgaggcaggagatatcatgcgcca

SEQ ID NO: 19339 - DNA, 439 bp, Sorghum bicolor
  Clone ID: LIB3480-041-P1-K1-C9
ctggctttgtattagatcaggagcagacttctcaatcacagactgaacctacaactggagaagtgtcaaatttgacacgttttaaaaagaattttgtctcacttataggtgtttgctatccatggattcatgcaactaatgaaggtctctcatttgcataccagctcttgtatctgttggatgctactggattttatagtccagcactgcatgtgcttgggcttcatgtttgtcgtgctactggacaagagctgatggaatcatcttctaggatatcaaggattagaaatcgtgaacttgagagactttgtggtcctccatggttcaaggctgtgcaacgagtgtttcttagttgtgtgtacacaactctagattatgcacaaaccggtttaattgctgcagtcttctttttcaagatgatggagtggggtatcaatct

SEQ ID NO: 19340 - DNA, 509 bp, Sorghum bicolor
  Clone ID: LIB3480-041-P1-K1-D7
cccacgcgtccgcggacgcgtgggaaaaaaaaaaaaaacaaaaacaacaaataaatgctacaactagagacacaatcagctgatgagagtccttgatttgcttgctacaaacagcatgcctactttggaaagatgccgcttgcttgtaacaatctggcgtgaacaaggcgtttgtcactttctatgtaggtggcgacgcttcaagaactatggttgtagctcagcggtatgctaacctatactttactgtgtacggaactgaacacacgtgccgctgagcactggtctgttcaacgacggtgactagagcgggcagtgctaccgcatctactgcgactaccatacggacccggagttctgcatccatgtcacgtctgtgaccatcacggtcaccaacctttgctcttccaactacacgctggctatcgaccatggcggttgttgcaaccatactcgctggcacttttagattgtcgatcccgctactctcaagatttatatcgaccgta

SEQ ID NO: 19341 - DNA, 395 bp, Sorghum bicolor
  Clone ID: LIB3480-041-P1-K1-E10
ccaccatgaagcacctcgtcctcccctcccctctccctctcctcctccaccgccccaccaagtcccatctcctccaccctcgccgccgcctcgtctccatccggaacgccgcatccggcggcagctccggcgaacccacccctgccgcggatacggccaccgggacgtctccgccggccggtgccactgccaagcccgccggcgtcaaggaccgcctgaaggcgaggaaccagtcccgccgggtccagctggactccccaccgccggaggtggtggggtgccgaagaggaagcccgccgcgtcgtcgtcgtcgtcgtcgtcgtcccctgcgccgaaaaggaaggagaggcggaaggagtgggaggggatgagcgtgggcgagaaggccgcggagc

SEQ ID NO: 19342 - DNA, 379 bp, Sorghum bicolor
  Clone ID: LIB3480-041-P1-K1-F10
caatatcgcattgtaacccaagaagccggtggaagaacttgtgaaactgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggttataaaaaataaaaaaataaaaaacaaaaaaataaaaaagggggggggttttttaagggaaacaaattttaattcccctggcggggggttaaaaacttttttattgggaaaacaattgattttcccaggtgaatgttttaaaaagaaatgtttgtaaaaaaagttgggttaaaaaaaaaaaaggccttaaaaaaaatcctttttaaaa

SEQ ID NO: 19343 - DNA, 419 bp, Sorghum bicolor
  Clone ID: LIB3480-041-P1-K1-F3
ctagttctagatcgcgagcggccgctcgcgatctacaacgacgacggcggcggcgggcaagatgcgcagggcgctcaacagctcgcaagagctgactgactacatcctggtgctcgaggacgagttctgcgagacgctcgcctacctgagcataccgagctttcaccgactgctcctgtcggaccacgccggatgagtgccatggtggatgcccgacgcctagcgcccagtggggaaggtcttccccggcgacaagggtttcaagccggacgtgactgtggccaaagacggtagcgggtacttcaagaccatcaacgctgcgctggccaaagcgccggcgaagagcgccttcatttacgtcatgttcttgaagggcggcacgttcagggagtacgtgttcggttccccggacgtgacct

SEQ ID NO: 19344 - DNA, 445 bp, Sorghum bicolor
  Clone ID: LIB3480-041-P1-K1-G1
aaaaaaaaaaaaaaaaaaaaaaaaaataaaaaaaaaaaaaaaaaaaaaaaaaaaaaaaaaaaaaaaaaaaaataaaaaaaaaaaaaaaaaaaaaaaaaaataaataaaaaaaaaaaaaaaaaaaaaaaaaaaaaaaggggggggcggttttagggaattaattttttcttccgggtttttccgattatttatttttttttatggggacctgattttaatttattggccgggcttttaaaagggttgtgtggggaaaaacttgggctttcccaattttaatggatttagaacaattccccttttggctatgtggataattaacaaaagggtttacaccaatcctttttccaaaaatttggccacctttattggtttttgggccccccctttagggggtcctttaaggcggggggtgggggggtttacccacaggttgacattttta

SEQ ID NO: 19345 - DNA, 169 bp, Sorghum bicolor
  Clone ID: LIB3480-041-P1-K1-G2
acgctcgatcaaagcccacgccgagaacaccaaccacacaaaaaagggaaaaacgccgcgacgagccgacgagctctactttccacttccggccttgggcgaccgtgacgagcgactacgaccacaggaacgatggccgtttcctgcctctgacaccgacacctggttc

SEQ ID NO: 19346 - DNA, 473 bp, Sorghum bicolor
  Clone ID: LIB3480-041-P1-K1-G8
agcatatggaaaacaaggagaagtaagagaggacgagattgttgctgcagccaaggcagccaatgctcatgagttcatatctagcttgcctcagggatatagcactattgtcggcgaaagaggaacacagctctctggagggcaaaaacaacgggttgctattgcaagggccatcttgaaggacccaaaaatacttctactcgacgaggcaacaagtgccctggatgctgaagctgagcgtactgttcaagatgcgttagaccaagtgatggtcagcaggaccaccattgttgtggcgcaccgactgtccacaatcaaaggggcagatatgattgtagtcatcaaagatggtaaagttgccgagaagggaaagcatgaatacctcgtgggcaaggggtgggtttatgcatcgctggtagaactgcactcgaagtcagcataaggatatatggggacttacaagggggtcattt

SEQ ID NO: 19347 - DNA, 234 bp, Sorghum bicolor
  unsure (1)..(234): unsure at all n locations
  Clone ID: LIB3480-041-P1-K1-H12
acgtgttaatgaaactcaactcatagactcaggctgacacggtcagttgcaagttacaagtagcccgtccctggcacgcacgcacacagcgtgaaccaccaccacaaggctggcatggtgatgaacgggctgtccatcagcgtgtacgcgccggagacggtgggttgcgcggtggtggacgcgtcgggcgcctgcgcggcggccacgtncacgggcgggctcatgaacaagatg

SEQ ID NO: 19348 - DNA, 277 bp, Sorghum bicolor
  Clone ID: LIB3480-041-P1-K1-H7
gtacggcgacagcagtacctgcaccgctagtggagccaccacatcgtgcacttgcacatcaagccccacaacatcctgctggacggcggacttcaacccaagatctccgacttcacaccggccaagctgtgcccgcacaaggagagcaccaacttcaggtccatgggcggcacccggggcaccgccggttacataataccggagaggcttctaacgcatgccgtagccaacagtaccagcaagtgcgacgtgtacaggtaccgcactatagcgctgc

SEQ ID NO: 19349 - DNA, 406 bp, Sorghum bicolor
  Clone ID: LIB3480-041-P1-K1-H8
ccggaggaccccgaggtgttcgacacgctcagcgccgtggcccggcagaaagagctgtgcgtggtgatcaagatgtactggggtgacccgagggagaaggtgtgcgacgccgtggaggagctccatctcgagtcgctcgtcatgggcagccgtggccttggatctgtccaaaggattctgctgggaagtgtgacgaattatgtgctgtcgaatgcatcatgccctgtgaccgtcgtcaagtcaaagtagtggctggccttcccagcaatatgaatctgcaattaagcttgacaaacccaaacaatttgcccgatactattgcaccttactttcagctgttagcactccacaatttggttgatctctagttgttgaactggacatgttttgttttttttttgtggcg

SEQ ID NO: 19350 - DNA, 337 bp, Sorghum bicolor
  Clone ID: LIB3480-041-P1-K1-H9
atttctcagaccagtggaagggcgttgtccaacaaaaggagcttggcaaatactgtaacggtgactgcctgtgttaccgaggatccacagcatgacagcagtcttgctgccattttggacgacctttcgtactcagcgagcttgagccggatggttctgcacagagctgttcaatgttgcatatcggtttatgtcatgcgatatgtttactgcccatcacggtccatttttcagacctgccttcctgtttcttttagctaccaaagaaaaagaagcaggtagttccgtagttctttagtcacttggttattttctagcgtaggctggcagttgcttc

SEQ ID NO: 19351 - DNA, 497 bp, Sorghum bicolor
  Clone ID: LIB3480-042-P1-K1-A6
cggacgcgtgggaaaaaaaaaaaaaaaaaaaatataaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcctttttaaagaatcaaagtttatttacccttttttgcaacgtaaaagtttttttatagggcaactaaaattaaattaattggccgtgttttaaaaacgtcggaattggaaaaaccttggctttaccaaattaaatcgttttgaaaaaaatccctttttccccagttggctaaaaacaaaaaaggcccgaaccaatcgcttttccaaaaatttgcccaccttaaatggcaaatggaaccccccttttaccggccaataaagcgcggggggtttgggggttacccccaggggaaccgttaaatttgcaagcgcttaaacccccgttcttttggtttttttcctttct

SEQ ID NO: 19352 - DNA, 558 bp, Sorghum bicolor
  unsure (1)..(558): unsure at all n locations
  Clone ID: LIB3480-042-P1-K1-B10
gccgccgcggtggcgccaccggcggtcgccgtctgcgttccgaagggtcacagcaagccaggggcgccggccaaggcgaaggcgaaggcgaagcccaagccgaagccggcgccgccgaagccgacggcgatcccgatcgcgcctggcgccgacatcgtgcggagcctgtgcgtgaagacggactaccctgacctgtgcacgtcggccatcacgaagcagccgcagccgcagctgcccgccgggaagcggctggacggcgccggcgtgctgcggctggccatgtccgccgtgcgcgccaaggccgccgaggccaaggccgcggcgggcgcgctcgcgaaggaccccaagacgcagccgctggcgcgcaacccgctgcaggactgcgtcgagtccttcgacgacatcgcctacagcctcgaccaggcccagaaggcgctcgccggcggcgaccgcgacaccacgggcaccatgctcgacaccgtgcgcaccgacgtcgacacctgcgaccagnggttcgaggagcgcaagcagctcacgccggtcatgtccaagcacgac

SEQ ID NO: 19353 - DNA, 557 bp, Sorghum bicolor
  unsure (1)..(557): unsure at all n locations
  Clone ID: LIB3480-042-P1-K1-B9
cagagatgatgatccgtggccttacacaagtgacctgggaacgtgtggacgtatgctttcataagagctggctaagatacaatgctcataataacatacaggtaaggctgtaacactgaagccatttgtggacaattcttctagtacagttgcacttcatacttttaaccatcatgagatttatgctacaacaaaaccaccaattgggagttcaactgctaagtaatatgataacttatctgttaggcagctgagaaaaaaaattacatactattattgttactactacctgatcagtagctgtgaacttttcccttgatgtatattacacttcctttttcagtagtaacagacagaacttccttgtatcgctacatgatttacattatcgtaataaggatgtaggattgtagtttcagggaagtctaagcactccttttggctttgcaatggtttgcaggttaggatccatccaattaattcagatggagaagatgtcatataccatatgatagacaattttgtagtctagacaagtagactatntctgatgaata

SEQ ID NO: 19354 - DNA, 560 bp, Sorghum bicolor
  Clone ID: LIB3480-042-P1-K1-C11
gtgaactggcaagggccccaagcaagctatcgtctgcattttctggtactcaggataagtgtgcagcatgccagaaaacagtgtacccgctggagaagttaactttggaaggcgaggcctaccacaagagctgcttcaagtgctcacacgggggctgcatcctgaccacctcctcctacgccgcgctcaacggcgtcttgtactgcaagatccacttcgggcagctgttcatggagaaggggagctacaaccacatgaagaagaagagcacgtcccaggaggtgctgccggacttggctgccgaggagcaacctccgcaaccagcggcaccggaagatgagaaaggagaggacaactaggagcaagcgatgatccatatatatcacgcagacagaagtttgcgtctgccatttttctttacgacgcttctttattccctcctcttttcttttcttaatctttctgtgaactcggtttgtcatcaagctgtaagtgtaccagatgccctcgttacgtctgaggctcatgacaatggcaattttggcatggagctgtgttag

SEQ ID NO: 19355 - DNA, 546 bp, Sorghum bicolor
  unsure (1)..(546): unsure at all n locations
  Clone ID: LIB3480-042-P1-K1-C3
naaaaaaaaaaaaaaaaaaaaaaataaaaaaaaaaaaaaaaaaaaaaaaaaaaaaaaaaaaaaaaaaaaaggggaataaaagaaaaaaaaagggagattaaaataaaaaaaaaaaaaaaaaaaaaaaaaaaggggggggccgttttaaaggttcaaagtttacttccgcttgcttgcaacgtcatattttttttttggggccacttaaataaaattaattggcgggcgttttaaaacgtcgggattggaaaaaccttggcttaccccaattaaatcgctttgcagcaaatccccttttcgccggttgggtaaatagcaaaaaggcctgaaccgttcgcctttccaaaaagttgcccatcttaaatggcaaatgggaccccccttgtaccggccctttaagcgcggggggtgggggggttacccccagttggacttttaaatttgccagcgccttagcgcccgttcttttggtttttttccttttttttttggccattttggccggttttccctgtagagttttaaatgggggtttcctttaagggt

SEQ ID NO: 19356 - DNA, 561 bp, Sorghum bicolor
  Clone ID: LIB3480-042-P1-K1-D11
ggcggcggagggtcctctgctcctgcaacagcgccggcgtcagagtcgcgcgctcacccagggagcgctgcggcgtcgttggtggacgccgacgccctcgactgcgtcgtgtgttatctcccactgaagccccccatcttccagtgcgacgtggggcacgcggtctgttcacgatgccgtgacaagctccaggccacgggcaagtgccctgtgtgtagagccgtcgccggcagataccgccggtgccatgtcatggagcaactggtggagtccatccgcgtcccatgcgcatatgctgcccatggctgtgccttgaggctggtctactatgatcaagaaagccaccgcttggtttgcgagcatgcaccatgccactgccctggtgaggcatgcagctttgtaggctccatggctgcgctcctggaccattgcagcacaacgcacaaatggccatgcatcaccacagtcaagcccaatgatgaggacgaattaaccatctgcctccatgatggcttcaatttcattcttgctgattgctccacagacaacaagaatcaaagt

SEQ ID NO: 19357 - DNA, 557 bp, Sorghum bicolor
  Clone ID: LIB3480-042-P1-K1-D6
gttcaacatgacgtccggcggcggcgcgcagaacttcaaggtgcaggcggacaacttcgtgtgcgcggtgctcccggacacgccgttccaccaggtgttcatcaccccgggcggcgtgatccacctccgggacggcgccaacacgcagtacgtgacgagcacgtcgttcctgttcgtggtctactccgacctgctgctgcggacggggcagtcggtgatgtgcgggaaccagcccgtggcgccggcgcggctgcgggagttcgcgcggcagcagatggactacctgctgggcgccaacccgcggcacagctcctacgtcgtgggcttcggcgccaactcgcccacgcagccgcaccaccgcggggcgtcgacgcccgtgctgccacccggcaccgacgtcaactgcgggctcagcttcggggagtggatggcgcccgacaggcccaaccccaacgagctcaccggcgccatcgtcggcgggcccgacaagaacgacggcttcgtggacaagcgcggcaactcctcctacaccgagccatgcacctacatcaactcgc

SEQ ID NO: 19358 - DNA, 556 bp, Sorghum bicolor
  Clone ID: LIB3480-042-P1-K1-E11
ccgaggcgtgcttcacggagcacgacgtcgccttcgccaaccgcccaaggctgccctcgcaggagctcgcctccttcggcggcgccgcgctcgccgtgtccagctacgggccctactggcgcaccctccgccgcgtcgccgccgtgcgcctcctctccacgcaccgcgtcgcgtccagcatgtgccccgtcatctccgccgaggtgcgcgccatgctgcgccgggtgatgagccgcgcggcggccgacggccgcgtccagctcaaggacagcctgttcgagctctccctcagcgtgctcatggagaccatcgcgcagaccaagacgtcgcgcaccgacgccgacgacggcgtgtcgcccgaggcgcacgagttccggcggatcgtcgacgagatcctgccctacctcggcgccaccaacccgtgggactacctgccgtcgttcctgcgccggttcgacgtgctgggcgtcaggagcaagatcagggacgtcgtcggcaggagggacgccttcctgcagcggctcatcgacgcggagcgccggaggctgcaggacga

SEQ ID NO: 19359 - DNA, 555 bp, Sorghum bicolor
  unsure (1)..(555): unsure at all n locations
  Clone ID: LIB3480-042-P1-K1-E5
cctcacctccgctcgccttcctcacagctctcaagcgtcttcggcctgcgtccgcctccacgccatcgccgcgagctgcgtccgcctccacgccaagcagcgtcgctcggagaccgcgtcgccaccctccgtcgcgaccttgccccgcagcgtgtcgccgaacggccacaccttccccgcctccatcgacgtcgagcgagcccacgaccacgccgtccacgacgagtctccccgaccgcaaccctgagccacggagccgcactccttcgcctcaagccgtcgtcctacgcaccgggccggagccgacggcgaccacgacgccaagccaagcaccgcggcaccgctttgagcatctcctgagccgacccgaaccgcccagccggcgacgtcgcgttctgccggcaccggcccctgcctgcaccaggcaatctgcctccatcaagccttcggatcataatggccaataatatggtatcatattggtgcgcaactatatttgataatttcaaaggctctgttgtacgctngggtgatgaaaagcatttttacggcaat

SEQ ID NO: 19360 - DNA, 152 bp, Sorghum bicolor
  Clone ID: LIB3480-042-P1-K1-E7
gtgttgttgaactactggtttcctcagacttgtgatgaactagaaatatcgttggacttagtgatgaacatgtgcttatgtatgtgacatgtatgttatatatatgtgagagattcgtatatcgtggttattgtggcaaatgtgttaatatt

SEQ ID NO: 19361 - DNA, 554 bp, Sorghum bicolor
  unsure (1)..(554): unsure at all n locations
  Clone ID: LIB3480-042-P1-K1-F2
gagtttattgatggtaggatcgaatcatttgatgttgtgattcttgccacaggttacaaaagcaatgttcctttttggttaaaggaaaacgagtttttttcacagaaagatggatttccacgcaggcgaaatgaatggaaaggaaagaatggcctttatgctgttgggttctcaagacgtggtctacttggtgtatcaatggatgccaccaaaattgcagacgatattgtgcagtcttacaataacatatgatatctgattattttattgataaatttagtcatcatcatttgagacttttgtaaatatatgtactggtctatgtacataaattacaacaggtggatatgctagagaacaaatattagactagcttatctatcaatgcactcatcatatagttcacataggctagtacatgttgcatttttgaggctcaataaaaatagtcgatagaattaattttttctttctattttttggcaaacattgtaagttgtttttgttactattaatcaattataatggtaatatntatcattatatttatggac

SEQ ID NO: 19362 - DNA, 164 bp, Sorghum bicolor
  Clone ID: LIB3480-042-P1-K1-F3
acgtgcattcgagcgtttggcgtttatataaagtgagctaaattcacttcactatccattgttatacaacctattgacttggaaaacactgaatttactcaatttaattgacttgtaacaaatacctctatttccagcttgaataaaagcgaacaggattgcac

SEQ ID NO: 19363 - DNA, 509 bp, Sorghum bicolor
  unsure (1)..(509): unsure at all n locations
  Clone ID: LIB3480-042-P1-K1-F4
aaaaaaaaaaaaaaaaaaaaaaaaaaaataaaaaaaaaaaaatattttttaaaaaattaaaaaannnaaagggggaatggtgtgtaaaatttaaaaagtgtttttttaacaaaaaaaatttattttattttcattgtaaaattatatatatagtaaataattatctttatccttttgattctaaagacttttcttactttcacatatcaatgcctcccaccaaaatctcatacaatattttacaatcatacaatatcatctcatatctgattattatataaatacctttacacttctcctttccaaacatttttactatctatactgctctatgtatctaaattataacagttatatatactatataacacatcttaaactagcttatttatcatttcattcatcatttacttcaactattttccttctatttttcttcccttcctttctactcaacatataccgttttacctctttaacttttataattggtcctccttatagctttc

SEQ ID NO: 19364 - DNA, 619 bp, Sorghum bicolor
  Clone ID: LIB3480-043-P1-K1-B12
cccacgcgtccgaccagttcttcttgtaccagctgctccgtgggatgaagtacattcatgcagcaagtgtcttccatcgggatcttaagcccaagaacattctagccaatgctgactgcaagctgaagatttgtgattttggccttgcccgtgtttcattcaatgacaccccatcagccatattctggacggattacgtggccactagatggtatcgagctccggaattatgtggctcctttttttcaaagtacactcctgccattgatatttggagcgtagggtgtatatttgctgaattgctcacagggaagccactctttccagggaagaatgttgtgcatcagttggatcttatgactgatctacttggtacaccttcagcagagtctatctccaagataaggaatgagaaagctcgacgatacatgagcaatatgaggaaaaagccccgggttccctttactaaaaagtttccagggatagatcctatggctctccatttgcttgaacgtcttcttgcttttgatcctaaggaacggccaagtgcagctgaggccctgacagatccatactttaatggattagcaaataatgaacgggaacccatagcacaacc

SEQ ID NO: 19365 - DNA, 432 bp, Sorghum bicolor
  unsure (1)..(432): unsure at all n locations
  Clone ID: LIB3480-043-P1-K1-C2
atgcggcggtggccagcaacgcacagacgttctccggcagcgccagcagtgtggcgttgcggccacccggggcgccgcccatgctcgccttgccggcccctccagcgggaggcagcagcgccgcagtaggtgcagaccctttcgcggcgtcggcgttggtgcctccgccgacgtatgttcagatgtccgacatgcagacgaagcagcaacttctgacgcaggagcagcagatgtggcggcagtacggcaacaacggaatgaatcagggagccttggcaatgctacagcagcggccaaaccagaatcagcagttcctacctcacacggngcacaattactcagggtatcgaacttcttagatcaatcatctgcaaatgtggttttccacattccagcgttcgaaacaaaaaatgctcggggcatcagatagtc

SEQ ID NO: 19366 - DNA, 595 bp, Sorghum bicolor
  Clone ID: LIB3480-043-P1-K1-D1
ttccagcgctcatcagatagctactactgagctcgatcggatcgtgcacagctagctgcgtgcaccccagcgcgcgttcagctcgctcttcgcggtgctctcggtcgtcgtctccgtcaccggtcgctagctcagcctcctctcgatcccggccggtcttcgcgcgccgcattccctctctaattaacgacgatgtcgagccggaggtcccgcgcgtcggtgtcggaggaggagatcaacgagctcatctccaggctccagacgctgctccccagcgcgcgccgccgtggcggcagcgaggcgtcgacgacgaagctgctcaaggagacctgcagctacatcaagagcctgcaccgggaggtggacgacctgagcgaccgcctgtccgacctcatggccaccatggaccacaacagccccggcgccgagatcatccgcagcctcctccgctagctgaagtccgtcgtccgtcggcgatccgctgtctccatggacgacgacctctcgtcgatttagctagctctcagcgtaatgctagctgatcgagtgtaccatatagcagctgaatatatacctaaggacgccgatcgacgag

SEQ ID NO: 19367 - DNA, 244 bp, Sorghum bicolor
  Clone ID: LIB3480-043-P1-K1-D3
ctctaaatgcccattaagacccgccctggaggtggtcattaaccgcatgacctgtagagtttacagcacactagacccctacacttgccatcgctctattgcttgctccttacgatttctgccttttctttgtaagctgttaagcagggtttccctgttaagctctaaataagtggttcacttcagggtctccactaaaagcttgacgagactgatacctcaaaaaacttgacatcggcgatga

SEQ ID NO: 19368 - DNA, 151 bp, Sorghum bicolor
  Clone ID: LIB3480-043-P1-K1-D4
cggacgcgtgggcgcggaagttgttgtttgttttacttcttttgtacggcttgcatttcatcaggcaccaacaaataagactttttgctccgatcatcaccgatgtgatcgattaattaataaccggtcttctcaaacaattatttgattc

SEQ ID NO: 19369 - DNA, 128 bp, Sorghum bicolor
  unsure (1)..(128): unsure at all n locations
  Clone ID: LIB3480-043-P1-K1-E3
gtagcatgcccgacgtcatgagctctgtctatacgtgtcacactgaaattcaaattcacttggaccgtcggtatttacaaacccgtcgnntgactgcgtgaaaactcctgggctgttaccccagactg

SEQ ID NO: 19370 - DNA, 542 bp, Sorghum bicolor
  Clone ID: LIB3480-043-P1-K1-F2
gtaaaggcccacacgtcgagtctacatagagatctcgacgtgtgcagcagtcttctatcatctacaagactctggaacccacgggaatgaacgggaggccgagtgggcccgggggtcggaagctcgaccttcacattatggagccgccctatgccaggtgctacagaggcaccgtcatgctgattgctcgccaccacctgctacgtatgcactgttcgatactatgcaggatctttttcacactcgggctagtgctattcatgttgcctgagaaagtcacatgtaagcagcctcgcgtgggacaatacattcatagcacattgtgcgagcacatgctcattgttatggcagcacgcatacctattgacatgtaagtagggagcttgctactattcttgcgagggagcgccaaccctgattaggcgccagcgcactcaatggctgctgcatcacgtatggcttggccgtatgcaatgtcgatgctactaccatcatgggtggaccttgcacatgtgcacgcacccatttgcaccaagatcttg

SEQ ID NO: 19371 - DNA, 418 bp, Sorghum bicolor
  unsure (1)..(418): unsure at all n locations
  Clone ID: LIB3480-043-P1-K1-G9
cctgggaccattgatgagagagcaataaataagaaaagagttcttagcccananaaaaaaaaaggaagggtaaataataaaaaaaaaaaaaaaaaaaaaaaaaaaaaaaaaaaatataaaaaaaaaaaaaaaaaaaaaaataataaaaaataaaaaaaataaaaaaggggggggcctttttaaaggatcaaagtttacttacgcttgattgcaacgtaatattttttttttaggtgaacttaaattaaattaattggccgtggttttaaaacgttgtgattggaaaaaccttggggttaccaaatttaatggttttgaagaaaataccttttttgcaagttggcttaatagtaaaaaggcccgaaccgttcgcctttccaaacatttgctcactttgaatggcaaatgggacgccctt

SEQ ID NO: 19372 - DNA, 468 bp, Sorghum bicolor
  Clone ID: LIB3480-043-P1-K1-H2
gtacagaaaatatagacataaaatccacaaactgttgcaaggaatattcatgtgaatcggccaaacaaactcgggcggcctccttataaggattcaaccttacacacacctccatgtcatgggggtcgcccttttataaggacccacaattttatatactttcctcggacttgaaaaattttttaactggtaacaaaaattcataaccccaccaagattattacacgagtacgtcctgctataaccgggtatggaacaaataaaaagcccttaactgatatccctatttaacgagttggtcgtatgacaaaggaggaggtactcttcctgtcttaacaaattaagcgcaacgggagagtagattatcacccccctgattacctgctcttaaaatcgtgctattgtgcggttattccacattcttcacgatttttctttcaaggttcgaaagctccactcttttagctt

SEQ ID NO: 19373 - DNA, 430 bp, Sorghum bicolor
  Clone ID: LIB3480-044-P1-K1-B10
aagaagtacgtcggcgaggacgacgacgcgtcgtcggcggcgttcaggtggatgatcgaggagatcttcttcctcaacggcgcgctccacgtcggggacatggtgccgtggctcagctggctggacccgcacgggtacatcggcaggatgaagcgggtggccaagatgttcgaccggttcatcgagcacgtcctgcgcgagcacggcgagcgccggcggcgggagggcgacgcgttcgtgcccaaggacatggtcgacctgctgctgcaactcgccgacgaccccggcggcctcgacgtccccctcgaccgcgacggcgtcaaggcgtccgttctggagctcatcacgggcggcacggacaccacgtcggtgactgtggagtgggccatgtcggagctcctgaggaagcccgacgtgctgggcaaggtga

SEQ ID NO: 19374 - DNA, 509 bp, Sorghum bicolor
  unsure (1)..(509): unsure at all n locations
  Clone ID: LIB3480-044-P1-K1-D6
ggcggaagcacgtgtcgttcggcgacctgagcttcgcggagtgggcgtcgttcctggagaggttcgagcagcagctgccggcggcgctcgaggacaagaagcgcgctgggttagggacgtcgtcgtcgtcgtcgttctgaccggagctgaccatactactacatactagtgaaccacaaccaccataaccaccaccaccaccatttgcatgcatgcgtgcgtgcgtgcttccgtggacgcaagatctgtacacgtgtgcatgccagcttgacgggtaacagagcttgcatgtgcatgtagctactgctgctagctccatctggatgcctttttgttgtgtctgcgtagggtacgacaagccgaaggccgtgtaagaggagacgatccatcttgtacggtggcatgaagtgcatgcatgctgtagggaagctgctctggaacacccttccaaagaagcggacgtgtcgggcaatgccttccgatactttgaacaacaacgactcttnctc

SEQ ID NO: 19375 - DNA, 511 bp, Sorghum bicolor
  Clone ID: LIB3480-044-P1-K1-G10
ggaacctacacctggaccatgaacaacttccctgacattgtcccagtccgttctcctgcatttgaagctggtgggcataaatggtacatcaacatgtacccacttggtgaccaatgcagcaccaattcactttctctctacttacatctgcatgatctgaacaagatccctcttgagactggaatggtgattgaactgactctctccatcttggaccagaagcatgacagacactacacagttacaggtcgctttgtttttggagttgcagcaaagaatggctggggatggcccaacttcgttcctctcaagacactcatggatccatttagctgctatattgtgggagcaaactgtatgctgaaggcagatgtcaccatcatcgggtcatccaatgacggttagacacggatagacctttgatggacttgggaaggaacaatggctttggcgacttaaactattttcagagacacctatatataatgcatatgtgatatgtgatagtaat

SEQ ID NO: 19376 - DNA, 441 bp, Sorghum bicolor
  Clone ID: LIB3480-044-P1-K1-H4
ccggcggggagctgttcgaccgcatcgtgcggaggggccactacacggagcggcaggccggcgagctggcccgcgtcatcgtcgccgtcgtggagtcgtgccactcgctcggcgtcatgcaccgggacctcaagccggagaacttcctcttcgtcggcaacgacgaggaatcgccgctcaagaccatcgacttcggcctctccatgttcttccggccaggcgaggagttcacggacgtcgtcgggagcccctactacgtggcgccggaggtgctgaagaagcggtacgggcaggaggccgacgtgtggagcgctcgcgtgatcatctacatcctgctctgcggcgtgccgccgttctgggcggagacggagcagggcatcttcgagcaagtgctgcacggctcgctggacttcgagtccgacccctggcccagcgtgtcgg

SEQ ID NO: 19377 - DNA, 461 bp, Sorghum bicolor
  Clone ID: LIB3480-044-P1-K1-H9
cccacgcgtccgaccctgcgctgccgctgccgtgccaagtcgccggccagcgaaaccggccagtactcgatcggcgcgcgcgcgcgagccgccattattggattggattaggccgccgctcgagcttgccggccggcccaggctcctcgcccattcccggcgaggctaactcaagcgcaaccaggccagctggttattgcattggagatgtatcctgatgctgcgccctacgaggcggcgcccggcggggtggtggtggcgccggtggccggcctattccccggcgccggagcgtcgagggagtggtcatcgggcctcttcgactgcttcgacgacttcgacacctgctgcctgacgttttggtgcccgtgcatcacgttcggtcggacggcggagatcgtggaccacggcacgacgtcttgcgggacgagcggggcgctgttcgcgcttatcgagtacct

SEQ ID NO: 19378 - DNA, 634 bp, Sorghum bicolor
  Clone ID: LIB3480-045-P1-K1-A12
ataggctgtttcgccctattgctgatcaggagtatctgaaaacccctagtttctggacttggtcgcctttgaatgtgatatgactggtattgatcgcctggcagtgggttctgagtttctctgaacataatgaaaatgctgtattgcctttggcttcactagacattggagtttcttttttacatataaatcaaatcaaatctagggaacataaactttggggtttcctttttgttatatactattatatataaaaaaaatactatatataaaaaagagttgttcacaaaaacagagagttcttccacttcttctgaagtgagacttacagtatattgttaggaaaatatgtgcgaggttgtggctttcagtacaaagtgaactgtggtctttagttaggtttggctgatatctgtgggatttcgccgcattgaaatggttggagatgaatcctaggatatatattatttgttgactctgatgcaaaagtatttgtattagttaaactgcaggaaatatcaaatgcaaacacttgactaagtgctatcctgctattttttctaattcagtatcaaatcatataatcagtgattccgtaaaaccagatacattttgttcatgctagatactcaat

SEQ ID NO: 19379 - DNA, 516 bp, Sorghum bicolor
  unsure (1)..(516): unsure at all n locations
  Clone ID: LIB3480-045-P1-K1-A6
cgaatccaaggagctactacaagtgcacgcacccggggtgcacggtgcggaagcacgtggagcgcgcgtcgcacgacctcaagtccgtgatcaccacgtacgagggcaagcacaaccacgaggtccccgcggcgaggaacagcggcggccacccgagcaccgcggcggcggcgacaggcgcgggtggtggtggtccgcggaggccggagcacacgtcgtcggtgcacgacggcctgatgatgaggcacctgggcggctgcggcgtgccgttcggcctgccgctgcagccgcctagcagggacccgctggcgccgatgggcaactacccgacgtacccgttcactgccctcggcggcggcggtggcagcggcggcgacggcggcctcacgtcgctgccgagcttgccgatggccacggngaacctcagcgccgtggaggggctgaagctcccgatgctggcaacctcgtcgcccctgcaccaccagcacccgctgctgaagcaaccgcaggcgatgc

SEQ ID NO: 19380 - DNA, 598 bp, Sorghum bicolor
  unsure (1)..(598): unsure at all n locations
  Clone ID: LIB3480-045-P1-K1-A8
gcgctccgccgccacctacttctatctgctactccggccaggccctcgtgtggcactacccgcgcccgccgtcttctccttgccggcgcgttcgcctccggngagggtccttcaggacaggatgtcgattactctgctggcgtcacaaattctgggtctgcatatcttggtctcttcgttcgattgcttggcttggacaatgactcacgtgatagggaacatgctgtttgcacgctctatcagtactcccttggtggaaggaagagcgtcgatgagataatgcaattccctggctgcattgttctcatcattagcctcctgaaatcagagtccattcctgcctgtgaagcagctgcaggtcttctgcgtaacattacatcagttcacatatataggaaggtggctggtgagagtggagcaatggaagaaatcattagtcttctctgtaaatctacaataacccctgagattctagagcagtgtttgtgtaccatttggaacttttctattgatgaaaatgggaggtacaagattctgaggagcgatgtcctaatgaaagatgtagctacctagatgaagaagacataaaagtcaaaga

SEQ ID NO: 19381 - DNA, 628 bp, Sorghum bicolor
  Clone ID: LIB3480-045-P1-K1-B10
aatcaaatagagcagcacaacatatatatataatatcaaatctgactacatcacagcacaaacatcaaattcaagttccatcatcaaatttacaaattcaaaagttctatcataacaagcttcacaagtttgtcaaatccacaaattacactctttctacagatctaaaaatccataaaaaaaatctaatatactagctagctagaactgcaatcaaaatccatcatcgaagagcaagaaatatgatccttgccttacaagctcaggcttgtagaagatcaatggtgtccgcgtcctacatctggctcagctctagcaacaacagatctttggcttcctgtgttcagaggcgcaaaaaaatgagaactcaacagcagatctccagcgaccaaatccttggcatatatacttcctttttgtcaaaatatgacaaatatatttgaagaactgatgcaacttgctctggcagctatgtagatacaactaaaattgccttttaattatttttcacaccagatagtaatccatacattgaaggcaatgaatatacaattttagtagaaaactaacaaatagatgacgacaaaggtgcagcttaacacgtaattttcaagtctaggatggcagc

SEQ ID NO: 19382 - DNA, 230 bp, Sorghum bicolor
  Clone ID: LIB3480-045-P1-K1-D8
ctgcacacacacacatgcttgcgaagctgtatctattcatatatgagataacctaagttcaagacaacgtgcacaacctgacaacgcttggactgcgaaaacagtggcaggacccagctgcatctggtgcaaaggcatgcgccatgtcacgggctgcttaagaccaaaaaggccacgacccagcgctcttcccaacagagacacatgctgaaggccgaatggaacacacc

SEQ ID NO: 19383 - DNA, 630 bp, Sorghum bicolor
  unsure (1)..(630): unsure at all n locations
  Clone ID: LIB3480-045-P1-K1-D9
ataaaataaaacggggacctcgatccggccggttatctttgtttttctttcttatttgcaaacaaatcgaagatctgttggagattcatatatggaggcagcagcaggttcaggatcagggagcgccgccgccgcagcgcggggccgccggggcttgtggccgtgcggccatcctcgccctcctttcgccgcaccgccgccgccacgtagcagctcggcgccccctcggcgcaggcacgattggaacccgcgggagcagaaggcggcggacgcgtttaccggngcgatactggactgcgtgcacgcgtacatggccctgacggaggaagatataagggaggagtaccgccgtgcaggaaagctcgataggtacgacgacccggccaacgacgagctggggaagcgcatcgccagggtcatcaagaagtacccgccacctccaggcgtcttcggcgacgaccctgacagatacctcaagctcctcgaggacgacgacgaggactagatggatccatcagtcgccggccgaaataaacagttntaggtcggtctgagtgacatcgggctcttcttcgaactaaggccttattatttagtttcaaaaaaaattcaaactttttcattgtcata

SEQ ID NO: 19384 - DNA, 471 bp, Sorghum bicolor
  unsure (1)..(471): unsure at all n locations
  Clone ID: LIB3480-045-P1-K1-E4
gattacgaagcaacatcacggcgctgtcttgagaagcatctatgaggtcaaacttggtaatgtgaataaaactcatataaacaacctggatagaaatagctacacatacgattagacgattagctgatgtgtgcttacaaatatcaaatcgaagaaaatggtcacgtaaaacattgcacgacacgaaatcaatctcagaagaaggcgaaggctcccacggcggcggcgcagacgcgcgccgcagccgccgcgagtacggcgggtgcgttgctgacggcggcgccgcccgcggtggcttcagcgcctggcggagcggngacctctgtcggctcggtcatggtggccccgttgggcgcgccgacgggcgcggcgtcctcgtcgtcgtcgacggtgtcgtcgtcggaggctgccttgtcgccgtcgaaggaccccagcggngtctgcgccacgggggtcaggatggtgggcttg

SEQ ID NO: 19385 - DNA, 642 bp, Sorghum bicolor
  Clone ID: LIB3480-045-P1-K1-F4
tgacccccgagatgagggcggcggtgcgcaacggcgccaagcacttcccgacggcgatcgtgaccggccggtgcatcgaaaaggtctgcggcttcgtaggcctcccggagctctactacgccggcagccacgggatggacatcaaaggcccaagctccaaggaggacaagacggtcctgctgcagccagctcgcgagttcctgccggtgatcaacaaggcttacagagctcttgaggagaggactaaggacacgccaggggccagggtggagaacaacaagttctgcctgtccgtgcacttcagatgcgtcgatgaaaagagctggagctcattggctgacaaggtcaaggccgtgctccgggacttccccgagctgaagctcactgagggcaggaaagtcttggagatccggccgtcgatcatgtgggacaagggcaaggccgtcgagttcttgctcaagtcgctcggattcgacgacagcaccaacgtcctgccggtgtacatcggagacgaccggaccgacgaggatgctttcaaggcgttgagggagagaggtcaaggcatagggatccttgtttccaaatgccccagggagacagaatgcttctactctctccaggaccccactgaggtcatggagt

SEQ ID NO: 19386 - DNA, 603 bp, Sorghum bicolor
  Clone ID: LIB3480-045-P1-K1-G1
agagcatcgcgcgcatcaaggacgagttcaaggacgcgacggggcaggcctgctccacggcgtgctgccgtcggtggacggctactacggcaactgcgtgtaccccgtgggcatcacccggtccagcaaggccatccgtgaggcgtcgcttccggaggtggtcggcgtgatgcgggaggccaaggaggcgctcaccacgcgcttcacggactggatgcgcggcggcgccaaggacgaccactacaacgtgccgctggactacggcacggtgacggtgtcggactggagccgcgtcgggttcaacgaggtggactacggcttcggcgagccggggtacgtcttcacgctcaacgacgacgtcaacatcgtcgcgtcggcgatctacctcaaaccgcccgcgcccaagcgcggcatccggctcatgctccgctgcgtcgaggaacctcacgctgcggcgttcgccgacgagctcgccaagttcgcgtagatcatggttgttattgggctattggcttagctatggccatgtgtgtgtgtgtgtgtggcttatctatacttcactggtgtcatacgttcatcgtcaacggcattgttggatgcaaa

SEQ ID NO: 19387 - DNA, 544 bp, Sorghum bicolor
  Clone ID: LIB3480-045-P1-K1-G3
cccacgcgtccgaaaaaaaaaaaaaataaaaaaaaaaaaaaaaaaaaaaaaaaaaaaaaaaaaaaaaaaaaggggggggggggcggcctttttaggataccaaagtttaccaacgtgtgtatgcgacgttatattttttatatagggccccaaaaattaaacacagtgcccccttttacaaaactgcgagactgaaaaaactctcgcgtcacacattaaaaacgttttagaacatatccctttttccagagttggtaaaatagcaaagaggcccacacatatcgcctttcaaaacatttgcacactcaatatggaaaatggcacgcgctctgtagcggcatataaagcgcggcgtgtgtggtgtatacgcacagtgagacctatacattcgccagcgccatagcgcccgctttttgcgcttttttccctccctttctcgccatgtttggcgtttttccccgaaaagctaaaaatggggggctctttagaggttacatattaagggctttacggcccctagaccaaaaaaatcttgttgggggag

SEQ ID NO: 19388 - DNA, 492 bp, Sorghum bicolor
  Clone ID: LIB3480-046-P1-K1-A4
aaaaaaaaaaaaaaaaaaaaaaaaaaaaaaaaaaaaaaaaaaaaaaaaaaaaaaaaaaaaaaaaaaaaaaaaaaaaaaaggggaaaaaaaaaaaaagggggcaccctcatataaaaataccataaataaatagggggcgccccctcttggggtcccattttttctgccccttgtttgctcatttttgtctttttttttgttccccctaatttcatttcactccccgcgttttcccaccttattgcctgggaaacccttgccgtttcccaccttattcgtttttcaaaaattcccctttccgccgtgttgtttattaagaaagagccccttactgatcaccttccccacccttgtcccgctctttttgcctctggcgcctccccttttcccccccctttacccccgccgttgttggggggttccccccgccggtccctttccttttgcccgtcccttatcccccgttcttttggttttttcccttcctttttt

SEQ ID NO: 19389 - DNA, 159 bp, Sorghum bicolor
  Clone ID: LIB3480-046-P1-K1-B2
gcggtagatagtgagtttgttctgtgttttactatggttattttttgggggttttatatgtactcttatattatgtctgtgtgcgatttttgttatgagtaatgtcatcagtacacacatgaaaagagtgatgaagtggctcagaatttccgtccccac

SEQ ID NO: 19390 - DNA, 617 bp, Sorghum bicolor
  Clone ID: LIB3480-046-P1-K1-C3
gcgtccgggatgtcttacaacaccgccggctcgtccggcgaccaggcggcgttcccgacggagaggaagcacgggctggggggcatgatggggtggggcgtgctgatgcccatcggcatgatcaccgcgcgctacttccggcagctggacccgtgctggttctacacccacatggccatccaggtgtgcggctacgccatcggcatcgcgggcatcgtcctcggcttccgcatcaacgaggacgggctcaagaacgtggacgtgcacaaggcgctcggcatcgccgtcttggccatggcgtctcttcaggtgctggcgatcctggcgcggccggacaagacgttcaaggtgcggcgggtttggaactggtaccaccacaacatcggccgcgcgacgatcctgctggccatcggcaacatcttcctgggcctgtccatcgcgcaggaggtcagcgcctacgtcgtcttctacggcgtgttcgtcgccgtgtgggtggtctccgtcaccgccttcgagatgaagcggtgctacgccgacgacgacttgacgtcggtctacgccgagccgtggcaaacggcgatgcgtacagtcagttcggttcattccgagaacaacag

SEQ ID NO: 19391 - DNA, 200 bp, Sorghum bicolor
  unsure (1)..(200): unsure at all n locations
  Clone ID: LIB3480-046-P1-K1-D5
gttatacaacatcaccctccatctttttagatcctactttactaacnccttcatcctacttcataatttttctttggggacacctaaaaaaggggtactacccttcattttataacaattaattaataaaaaaatcttcttaacaaacaaaatattcctttatcaaattatacttctatcaccatctatattaacaaata

SEQ ID NO: 19392 - DNA, 694 bp, Sorghum bicolor
  Clone ID: LIB3480-046-P1-K1-E5
cggacgcgtgggcaacacgacccctcttggatgtgactgcctatgttgacaaaatggagctgaaaaagccaattcgcgtggacactgatttgaagatagctggagctgttacttatgttgggcgctcgtcaattgacatacagattgaagtgactcaggttgataaagatggtgataatcagtctgatcccattgcattgaccgctaacttcacctttgttgcacgtgattcaaagactggaaaatgtggttcagtgaaccgactttcacctgaaaatgaaagagagaagcatctatttggagaaagagaagcacgagataagatgagaaaaaggaagagagaagaacagaagggaggacttgaaaacgggatacataagctccgtgctgaggctgagaggctggatgcgttgctcgcagagggtcgggttttctctgatctgcctgctttagctgatagagatagcatcttgatgaaggatacccgtctagagaactctcttgtatgccagcctcagcaacgaaacttgcatggtcgaatatttgggggtttcttgatgcaccgagcatttgagcttgccttctcaaccgcatatgcttttgttgggcagagaccttggttccttgaagttgatcatgttgacttcttgaaaccagtggatgttgggagactttctttcgattcaaaacatgt

SEQ ID NO: 19393 - DNA, 196 bp, Sorghum bicolor
  Clone ID: LIB3480-046-P1-K1-F5
gtttgttctaatatacatctggggagccatgcaagggatccacgcatccggcatcccattcccaactgccccgcaacgctctaacattttctttttattgtagatttgtagtcatattcgatctggtaaaggtagtatatattatatgtatttattttttattgcacaagacaaaaacaatggcagtatggtatcc

SEQ ID NO: 19394 - DNA, 719 bp, Sorghum bicolor
  Clone ID: LIB3480-046-P1-K1-G3
gctggacgcgcagccgcgttcgtccgtggtcctgctctgcttcgggagcatgggcaacctgaccctgccgcaggtgcaggagatagcggagggcctgcaacgcagcgagcaccggttcctgtgggtgctccgtggcccgccgccagccgggtcgccgtacccgacggacgccaacgtggaggagctcgtcccgggaggcttcttggagaggaccaaggagaggggcctcgtgtggccgagatgggcgccgcagaaggagatcctgtcgcacccgtccatcgggggcttcgtgtcgcacggcgggtggaactcgacgctggagagcctgtggcacggcgtgccgctggtgacttggccgctgtacgcggagcagcacatgaacgcgttcgtgcttgtggcggccctgggcgtcgccgtggcgatggaggtggacaggaagcggggcaacttcgtggaggccgcggagctggagcgcgcggtgcggacgctgatgggagggtcggaggaggggagggaggcgagagccaaggccgcggaggccaaggccgcgtgccggaacgcggtaaaggagggcgggtcgtcttgtgccgcgttgcagaggctgatgcgtgagattttgggacacggaggggcgtgaaccgtgaaggctttctacgagcatgttccgtgtgatctctgctttggccgtggggatatgtaccaatactagagaattttgt

SEQ ID NO: 19395 - DNA, 515 bp, Sorghum bicolor
  unsure (1)..(515): unsure at all n locations
  Clone ID: LIB3480-046-P1-K1-G5
ggtgtcgccgccactggaaaaattttctccgatctcttccctgttttatcgtggttagatctgaccacgatgaagaagtatggagaataaatttcatatcagtttttttcattcttcgatggtagaaagaagaagaagaaagacataagaaagaagaagtctcaactccgcctacatgaatgttggccgtcgttggttggacatctgttctcaggctttttgcccagtatttgtttgtgcggccatccatattgcaaagtgttgtataagtttggttttgagatccggagctattcacagcttgagaataatttagataatttttattctaaanaaaaaaaaggnnaaaaaaaaaaaaaaatgagttgaaaaataaaaaccaaaaagaaaaaaaaaaaaaaaaattaaaaaaaaaaaaaaataaataaagggaaaatatgggggggggtccttttataaggacccaaatttccgggcctgggaaggcaatgttctttctctttttagggcgccct

SEQ ID NO: 19396 - DNA, 730 bp, Sorghum bicolor
  unsure (1)..(730): unsure at all n locations
  Clone ID: LIB3480-046-P1-K1-G9
cccacgcgtccgcgccgatcgacggtgagcaggcagcagaattagcggagcgccctccgaggagacatgctacccgatctccaccgcaacctcctccgcctcctcgtacgaccgtccccagcaggcgcagcacggaggccggaggcccggcggcgccgaggagtcccacgggtcagctgcagggtacggtggaggcggcggcggcgggtacgcggtgtccgggcggcctcatcagcctcataaggaggagacccacggctacgggaggaagggacacgacgacgatgacgagcagcaggcgtaccggaagccgaagccggcgtacggggacgaccacgaccacgagcagcaggcgtaccggaagccgaagccggcgtacggagacgacgacgacgacgacaggaagcccggctacggccggaagaagaaaggacacgacgacgagtcggatgacgacgacgacaagagaaaaccacgttacaagaagaaggacgacgacgactccgatgacgatgacaagaagaagcgttacgagaagaacaaccgtcgccgccacgactacgatgattgagcccttcagtctcatatacatacactaatcatgcgttatcatccnctcgagctgcatctcccttacggtagtaaaataagcaaggcttgggataggattgaaccataacagtccttgctttttcaaagtggacggcctactaactttttttttgttctt

SEQ ID NO: 19397 - DNA, 680 bp, Sorghum bicolor
  unsure (1)..(680): unsure at all n locations
  Clone ID: LIB3480-046-P1-K1-H11
acaaacacctgagctcactcggagtcggccactctcaccggccgcggcgcccgcaagtccgcagtcccctcgaggcgaccgcatggcggagccggagcgggagcgggcggcggaggagtgggtgaggcggaagaggggcaggaagaggcaaggggagaggcagacgagcgaccccatggaggtgctcggggaagatgtgatggggcgggtgatggagttcctggacgcgcgcagcgtggcacgatgcaccgcggtctcctgcgcatggcgcggggtcgcggccgacaaccgcctctgggcacctaagggtggacttgtagataccacactacgtgtagcccacagtacaccttgttcatttggctgataagccatgacaggaagtattgttggctgattggcccgcgcgctggcctcccaactgcgacctcgtcggcaataatgacgaagctgctgcagcaactcatgccaaagtagtagcagcagatgtggcagtagtcagtaccatgccttgcagtactagccgaagccggatgctatgccttccccggtgtcagcgtcggtggcggcagcgtggcatgacattntgaaatttcgtgaaagatttgttttttntttaaaaaatttctgaagaatttgtgaacaatttgacatatatttctttgatgtttgtattccat

SEQ ID NO: 19398 - DNA, 521 bp, Sorghum bicolor
  Clone ID: LIB3480-048-P1-K1-A11
cggacgcgtgggttttattttcgtctatatttaatactccatgcatgcgtttaaagattcgatgtgacggggaatcttaaaaaattttgggtttttgggtgtaagtaaacaaggcctaagtatctgaatgtttctcttgaagtcatcaggttatccacctaacacacttttgtatgctatttcttaagaataagaactatagctgattttagaattgtcgatgtgatggtgcctgaaaactagaacatgcccaaccaggagaccaagacaagacatagtcaagtgcagtgtgtttcaagtgtaggagatagtacactcaaatgcttgagtgccttgtttcagtatggtcgttagctgctttagcatgcatttggctcacttggtagtttctttctgtgtgattgagctactgaagtcgatgcaagtgcctgtaggctatatagcctgaggtgccagaaatatgtggataattgaattgaatgctattgtggaaagtgatatgttgataggcgttttttttt

SEQ ID NO: 19399 - DNA, 310 bp, Sorghum bicolor
  Clone ID: LIB3480-048-P1-K1-A2
gcgcgtacggttctactaaaatactaaaatatagcgactcgccgccagaaaaataaacaaaacgtactaaaacacgggcggggactctaagggtcccgtgcatgtcttcaatggctaaccaattcgtcgttcttatctaccaggctctcacaatttatccactgcaccttgttctgcaacctcttaacctataacaccctattgttatcgacctcaaagaccctgaggtgcatacctagttaaacaaccttgctttatctacttatgtccattcccgtctctactgcctatcaaacccatcccttatttg

SEQ ID NO: 19400 - DNA, 522 bp, Sorghum bicolor
  Clone ID: LIB3480-048-P1-K1-A4
caaggcttgggaatcctggtgggaagaggagcaggaacatttacagtccacaggtctactgggccgtttctgggaaatcatactatctctcaggttcttcatattccaatacggtatcatgtaccacctgaatatatctgctggcaacaaaagcatctctgtttacggtctttcttggctggttattgttgctgtggtgatggtcctaaaggtggtatccatgggtaggaagaaatttagtgcggatttccagcttatgttccggcttctcaaattgttcttgttcatcggatctgttggaacactggcagttcttttcactgttttgcatcttacagttggtgacatatttgcaagcttccttgcatttgcacccacaggatgggccattctgcagatatctcaagcaagtaaaccggtgatcaaggcatgtgggctgtggggatctgtgaaggccctctcgagggggtacgaatacctgatggggatcgtcatcttcgtcccagtggcggtgctggcatg

SEQ ID NO: 19401 - DNA, 555 bp, Sorghum bicolor
  Clone ID: LIB3480-048-P1-K1-B8
gtttgggacacagtggctccttccagtggttcatcgtcatgtgtaggcagtactcacctcatctcaaatgggccaccaattgctatgaaatgccatgaatacctttgctatatcgctgctggacctgaagtgacagcgattgacttgaggacaatgaagaaggcttctgttctttcactccacaaccatagaatactttcttgtgagatgctgccttctgaatggttaatatgtactggcacgaaagacaaggctcttctgtgggacatccgtaaggctcaagaactcccaaacacagtggcggaaatgcaatcaaatggcccagtgacactgcttcacttggatccatacaaggtggtgaccggagtactgtcggacggcgaggtccatgtctggaaaacccagacaggggacttgctgaacacattgggctttggcgaacctgcaggcgtgcggagcacagtgtcagccatggctgtggatgggtgcaggattgccatggcgggcaggtctccagaaggcagcgtgttgcactaccgtgacttttcgacgtct

SEQ ID NO: 19402 - DNA, 500 bp, Sorghum bicolor
  Clone ID: LIB3480-048-P1-K1-C10
atcgaacttgttacttgatcttattgttctcggtatctcttgtatgtaccctactacttgtttgtaaatcatgagctttttatgtttagctgttcctggaaagtttgtttttccatcttatagccccttgctatccttctgtgccctatggtttagagtttaaattgacaaatgtgttctataaatattgatcacgataatgatgcataggcttggcagcctcttgatttatttttgttgatataccaaattatagtttgattgcatcttattttactgtggagatcgacaaactgaggttttgtgggttttttttaacgcaatggcagctctgcctttcaagtaggaagaaagtggtattgattttcgaagtacttctgtttcatcttgactcctaaagactcttcatgtatgccatgtgccttatatttcacatttctttcctattttgcttaagccgatccgttccttcgtttggtggatgagagcaaacttacagc

SEQ ID NO: 19403 - DNA, 498 bp, Sorghum bicolor
  Clone ID: LIB3480-048-P1-K1-C5
ggcaatcgcggtggtcgcggctgaggtcgaggatttgtacccgcgaagtccactgctccatcgacctccatatcaacagacacaaacacaaatatgcatttggagcctttggcggaggttgaagaccataacgaggactttgatatgaatgctgaaatatcagttagtgtgccaacaaatgatgatcgagttacgaaggaggttggagatgatgtaagtgtgccttcaagtccttcgaaagcaactagagggcggaaaggaaagaggtctggtgtgcatttatccccttctaaggtcaaggttaagtgtagattttgccataagagttatgcataccaacaaggtggagcaacttcacagctgaatcatcaccttagccgctgcacacagtttcagaacaagcttgctaaggctaaacgaatacttgctcaagattctgaatgggacatgtatgagaagattaggccaattctaagagagatggctggaagcactact

SEQ ID NO: 19404 - DNA, 327 bp, Sorghum bicolor
  Clone ID: LIB3480-048-P1-K1-D9
aaaaaaaaaaaaaaaaaaaaaaaaaaaaaaaaaaaaataatataaaaaaaaaaaataaaaaacaagtagagtgggaaataataaatgataaaatagtgttaaataaaaaaataatggctggccgtttttgtggaccaaagtttacttagctgtccttggaattacatagttttatattattgtagcgtattccattttattgaattggctttttaaaccgttatgactggaaaaatcttgctttttaccaattttagtaatcttaaaagcattttgccccttttacatgttgccttattttaaaaaaggcttgtgccgtatttcttt

SEQ ID NO: 19405 - DNA, 338 bp, Sorghum bicolor
  Clone ID: LIB3480-048-P1-K1-E9
cggacgcgtgggaaacaaacaatataaaaaaaaacaaacttacatacaacaaaaaaacaacaaaagtggaggggaaataggggcggccgctctttaaattacctaagcctacgtacacctgcagtgggcggccgttttaactgttctagtctcccttactcgtcattccgtggccattccttttctatagtgggccctgaataaaccctgctgccccccattttaaaccttttgaactggaaacccctttgcctaccccacgtaattccccttggacccaatcccattttcctctgctggagttataccaactaggcccccaccgttaccccccccca

SEQ ID NO: 19406 - DNA, 384 bp, Sorghum bicolor
  Clone ID: LIB3480-048-P1-K1-F11
cacaaatctgaacaatctttaatttgacatgacactagacgcagcttcgacaacgcctcatgatcggggtggctgagacgccgatgccacaacggggagggagcgtgggcgacaagggagtgtgctggaggtaggtgcagtgggtagagcggcccatagctgttgcacctgacgatcttggtccgagatggaagagtgttagcaataggcgccctaatgggctgtatgggccggtgcggttaagcaccgtagggattaagatagattgataaggcaaggatcaccgttgattgggtgtttctataaacccttagggatccttgcctatatatgtacccctgtacccccttgatcaattatctaatcccgaggctaattgctctc

SEQ ID NO: 19407 - DNA, 368 bp, Sorghum bicolor
  Clone ID: LIB3480-048-P1-K1-F7
aaaaaaaaaaaaaatataaaaaaaaaaatagataatataaaaaaaacaaatctaaaaaaaaaaatgggggggggttctatatctataaaatataaagttcatatattcgctcttctgtcgccttattttttttatacttaaactctaaattcattgccctgtccttactttttcaccttctggcataattaaaattgtttcccatttcaattttattatcagttcatttccattttctctttttcgctatatttttaataaagttaaagtcccttacacttccccatttataaccaattttaaatcttaaattgtaatggttccttaccttttaattaatattatgccctgtggttttatagcttttc

SEQ ID NO: 19408 - DNA, 431 bp, Sorghum bicolor
  Clone ID: LIB3480-048-P1-K1-H2
gaagtacccaaggtaaagaataggctcagtgttatctatgtttctgcttgttatattgttcataagaaccaaacacacaggctgtgcatttgcatgtgaatagacggaacctcctgctgaggcttttaaaaaaaaaaaaaaaaaaaaaaaaaaaaaaaaaaaactctagtgataaaaaaaaaaaaaaaaaaaaaaataaaaaaaaaaaaaaaaaaaaaaaaaaaaaaaaaaaaaaaaaaaaaaaaaaaaaaaagggggggcggttttaaagaataaaagtttactaacccttgaatgaaacgtaaaatctttttaatagggccaccaaaataaaattaatgggccggggtttaaaaaccggtgaactggaaaaaccctggggtaaccaaattaaattgctttgaaaaaaatccccttttcgcaaggtgggg

SEQ ID NO: 19409 - DNA, 570 bp, Sorghum bicolor
  unsure (1)..(570): unsure at all n locations
  Clone ID: LIB3480-048-P1-K1-H3
cccagggcaaagggcggtgagccagggctcaccgtgttcagtgatgcagacatggcgggtgatgtggatgggcggaaaagcacctccggggtgttcgtcttcctaggagcagcgccggtagcctggcaatcactgaagcagaagacagtggcactgtcaacctgcgaggcagagtatgtggctgctgctacggcggcatgtcaggcggtctggttgcggcggctgctgaaggagctcactgggaaggagtctcagccgccggctttgctggtggacaatcagccggccattgctcttgccaagaacccggtgctccatgaccggagcaaacacatcgacgtgaagttccatttcctcagggattgcgttgatggaggacagatcaccatcgagtttgtcgacaccggcaggcaactcgctgacattctcaccaagtccctcggacgcctcaggtttgttgagctgaggaagatgattggcatggatgaggtcaaggcttancagcaggattaggggaagaactgtgagacataatctgcagctaaacctttctgttttggtaatgatcat

SEQ ID NO: 19410 - DNA, 502 bp, Sorghum bicolor
  unsure (1)..(502): unsure at all n locations
  Clone ID: LIB3480-049-P1-K1-A6
caaacctctgtacaagctgtctttcagtgctaaagatgatacagctgaagccaacttttttggctatgatgaagaatctcgcaggataatacgtcgaaacatcgatttcatgctcagacaagctaggactactgaagggctaccacaacatctgatgaatcttattacaagaaaatatacgtttgtgcctacacaacaaacaattggagttcaaccgaccgttgatattgcatctcctgctactgcttcgacacctgcacctcctattgttgctgacgacacaccggagaagcaacctgataacagtacacaggcaaacagaaaattgatccccaaagctttattgccgtctttaaatactattggcaaggaaacgaatgacgcctgcaccatagacaaagctactgccgtattagaccaaagctttaaaacaagatccgacgacnatttgctaaagactatgtgccccacttcgcacgataaaaccgagaaagaagcacta

SEQ ID NO: 19411 - DNA, 301 bp, Sorghum bicolor
  unsure (1)..(301): unsure at all n locations
  Clone ID: LIB3480-049-P1-K1-A9
caatacatacacacatatgtttttttattgcatgcgtgtttgcaatggacctttccatgcccctggtactttttaacctggctaatggggttttcctgtaagtggcacaacacatactacacgtcatcggtcctcaaacgtgtgagattgtctgcatgtatatcactggtcgatccctctaatccaaattgtaacttattttggtattctagatgtatanaatttactatgcatgtggattactctagacatagtatgtgtttaggtgtatagcacaagttatgcacacataaaagctaaa

SEQ ID NO: 19412 - DNA, 431 bp, Sorghum bicolor
  Clone ID: LIB3480-049-P1-K1-B12
attatggtcccagtttgatttaaaaaaaaaaaaaataaaaaaaaaaaaaaaaaaaaaaaaaaaaaaaaaaaaaaaaaatataaaatgaaggaaaggaaaattatataggggataatataaaaaaaaaagaatattattaaaaaaaatataatattaaataagattaattaaagtaaaaaatataggggggggctttttaaggggattaaattttatgtccctggggttgcagattatttttttttttttggggcagcaaaattaaattcacgggcgcggtttttaaaaattctttgatgggaaaaccttggttttcccaaattttaatgctttgggagaaattccctttttgccagggggtttttatagaaaaagggcctccatgaaagtctttttaaaattttggccaatctatatggttaatgggcccc

SEQ ID NO: 19413 - DNA, 259 bp, Sorghum bicolor
  Clone ID: LIB3480-049-P1-K1-B2
cccacgcgtccgcccacgcgtccgcgccgcgctgcctgcccaccctcgtcgtcgagctggcgctccagacgcacgcgctgctccgcgagctcggcaacccagccggcgcgcgcatcgtgctcgagaccgagcgccgcgcggtctcgctctgggagccaggcgacgccgcacgggctacgcgcggcagaagcggaggtcaggcgctaacgctgctaggcgagcctgcctgaattcaacgttatgatccttgggccggcgc

SEQ ID NO: 19414 - DNA, 259 bp, Sorghum bicolor
  Clone ID: LIB3480-049-P1-K1-B6
actatttatatattgttagctttctttctagatgttacaattttacttacgcgcgcatgcgactttataggtgttgtatagtttcagagaatttaattcaatgaccaaagttaaaaacgggggcggtgggttaaaaggacccaaacttaacttacccggcttgcaacagataaactttttttagcgggcaccaaaaataaaacgccgggcccgctcttttcaacctacggtttgggaaaacctgtggcttaccaaactt

SEQ ID NO: 19415 - DNA, 469 bp, Sorghum bicolor
  Clone ID: LIB3480-049-P1-K1-B8
gaggccggctgcagagaagtgcattctgtgtatcacggacctgagaatcctgttgctgaagatgaaattcacatgcagcagactgttccagatatgtctggcaataaaattgcatcatcgaacccatttcagaccaagaaccttcagagtgacattgatatgagcatattctttggacagaaggtggacaagaagcaagaagatagatttcccagtgttcttcaatcctagttcacacaccttatagaatcagcgagttctgtatagacaaactgttgatccacacagtaagtttcagggttcggaaatgactcacggaaggagctcatttcacacacgcgaactgcatgagcaagcacttacatgcgtctaaggagttcctctgtgtccatgcgctcatttaaaggcatctcagtttttataggctgtctgaaatagtgatgtacccttcacccattactttcttagt

SEQ ID NO: 19416 - DNA, 486 bp, Sorghum bicolor
  Clone ID: LIB3480-049-P1-K1-C12
ctagttctagatcgcgagcggccgctcgcgatctagaactagtctccccggcatcaagatcagcggcaacacgtccaggttcccctacacgcacggcgccggcagccggtcggcgctgcggatcacgcgcatcgtctcggagagcttccggctgggcctcccgggcgcgcggtggttcgtgatgggcgacgacgacacggtgttcttcccggacaacctggcggacgtgctgtcccggtacgaccacacgcagccgtactacatcgggaacccgtcggagagccacatccagaacctcatcttctcgtacggcatggcgttcggcggcggcgggttcgccatcagccgcgcgctggcggcgcagctggcgcgcatgcaggacggctgcatcgagcggtaccccgcgctgtacggcagcgacgaccgtatccacgcgtgcatgtcggagctgggggtgccgctgacgcgccacctgggctttcacca

SEQ ID NO: 19417 - DNA, 239 bp, Sorghum bicolor
  Clone ID: LIB3480-049-P1-K1-C7
gtggctagctctatgcatgcatgcatgcatggtgtcgcggctgtttcttccttcgttcatttctactgatccatgatccatcgattgcgcacccccgtaccactgctgatgatatatatgaggtgtatgtgcgcatccaaatctctcattctgtgttctgtacgtacgtgtcgaagactatattaaaaatgataatgaacagattaaatctatggccggctgctttatggatgcatggg

SEQ ID NO: 19418 - DNA, 593 bp, Sorghum bicolor
  unsure (1)..(593): unsure at all n locations
  Clone ID: LIB3480-049-P1-K1-D2
ctccgggatgagctccctggcctacttcatgtccaaggacaccatagatcacttcaacaccattgttaagcccatcgtctacctctccatgttctacttcttcaacaacccaaggtcgtccatctgggagaactacatcgtcctcctcgcgctcgtctactgcgtcactgggatcggttacaccttcgcaatcttcttccagccaggctctgcacagctgtggtctgccttgcttccagtggttttgactctgatagcaactcagcagaaggacacgatccttgccgatctgtgctacacaaagtgggctctggaagcctttgtcattgcaaacgctcagaactattccggagtgtggctaataacacggtgtggctcgctggtcaggaacggctacgacattgagcatgaggctctctgtataggggtcctcattgctaatgggatactcttccgctgtgtagcattcttctgcatggtcaccttccagaagaacttaaaaagtcaaggaaaacccnccatgaactttctatgcccatgtagcaggtccgtttccttaatttcagtgtgataggattgtagattagactccc

SEQ ID NO: 19419 - DNA, 448 bp, Sorghum bicolor
  Clone ID: LIB3480-049-P1-K1-D3
tgctggcttcggtgttttttctttcttttgattaatcttgttttcgatcagacgcatgtgacggcaccagctggtcttgtgtgtaagtctattcttggattcaaaaaaaaaaaaaaaaaaaaaaaaaaaaaaaaaaaaaaaaaaaaaaaaaaaaatatattaaaataaaaaaattcggtaaacttatatgagaaattttagataaccaatctctgtatatctataaataagattagataatagataaaatatacataaaaagggggccctctttaaaaaaaaaaaacttaaaaaccacgttagttacacataaaaaatttttataaaggggcaaaaaaaaaaaataaagggaccggggttaaaaaatgtcttatttaaaaaaaacagattcgtaaacaaataaaaatatcttttaaaaaaaaatccatttttttaaaaagtggggaat

SEQ ID NO: 19420 - DNA, 600 bp, Sorghum bicolor
  Clone ID: LIB3480-049-P1-K1-D6
cggacgcgtggggccggtctggcaatttcaagaacttccagtgcccgccggggcactacaacgcgctggcgtcgctcttcttcaacaccaacgacgacgccatccgcaacctcttgagcgccgggcggtacgactacagggagttcggcgtgtcgacgctgctcaccttcttcaccacggtgtacaccctgggcctgctcacctacggcgtggccgtgccgtcgggcctcttcatccccgtcatcctggcgggcgcctcgttcggccgcctggtgagcacgctgctgggctcggtcagcggcctcgactcggggctcttcgcgctgctcggcgccgcgtctttcctcggcgggacgatgcggatgacggtgtcggtgtgcgtcatcctgctggagctcaccaacgacctgctcctgctgccgctcatcatgctcgtgctgctcatctccaagacggtggcggactgctttaacaagggggtgtacgagcagatcgtgcgcatgaaggggctcccttacctggaggtgcacgcctcggcgtgcacgcgcagcctggtggccggcgacgtggtgtccggcccgctcgtcactttctccagcg

SEQ ID NO: 19421 - DNA, 331 bp, Sorghum bicolor
  Clone ID: LIB3480-049-P1-K1-D9
aaaagaattctgtgtaccgcgtgttttcttgtaccagcagcaagctgccacaagctcttctgtccttgtatcagcaatgtttagggcctgtttagacagcgagagctaattgttattagctagctaaagatagcaaaaatccaccccctagcccatccatccaacagtgggctactgtaggtgagctaatcttttgcccaaacctctaactagttgttagccagttggttaaccttatactagccccagccatccaaacaggcccttacatatgttgtagtgtcaaaaaagattgtggtccaaggcataagatactggaatttttgttgtt

SEQ ID NO: 19422 - DNA, 470 bp, Sorghum bicolor
  Clone ID: LIB3480-049-P1-K1-E4
caccaatgcgacactgcttacactggctctgtgccaggctatattatgaggaggatccactgcttcgccatgtggaaccgtcggtgactacattccttgagctggacatagtaaatctggaaggtgacaatgaattcaaatacacccactcacgtgatcgtcagtggcatattgatacactcatcatgtagatgaaagatcagtaatctcccgaagcacaaatgaagcctgtctacaataattggactggaataccttttatgttcatggagggcattaatatcatgcccttgcagaggagagtttcccacgataacggaaataacagtaacatatgaaccatgttgggagactaccaaatatttcgctttcatcacagacatatttcgctgctctgtttgtggtgtaccattctggcgcacaaaaggatccagattatgcttactattggacagagaattgtatcttct

SEQ ID NO: 19423 - DNA, 528 bp, Sorghum bicolor
  Clone ID: LIB3480-049-P1-K1-E7
gcggcagtgccgccagcgggccggccgctgctgatgctccggcggcggcgggggcggcgtcatcatccgacgggccctctggcgcaccagcgccatcgtcgtctgattcggcctctggcgcaccaggaccgtcgtctgatggtgggtcgtccagcgctccggcgccagcgggcggcgacgacgacgacgatgccgattccgacgacgggtcagcttgagcgtacgtgagcgatgatgacgcgcgggtttgcttggatcattaggtgcctactccaagacgatcgacgatccccttcttcccattgcatttttttttgccgtccggccgttttcctcttgacaatgtataatgataataacagtggatgatcgatcctacgtacttacgtacgtatttatagctagatgaaagtgtctgtgtagtgacccatccatagacgatgatgctgacagatcgcacgcagtctccttagtcggctgatccattataacaataatgatatcaaggctttcatgtttttttattac

SEQ ID NO: 19424 - DNA, 335 bp, Sorghum bicolor
  Clone ID: LIB3480-049-P1-K1-F6
ggagcggctgtgcgtgcagctcggcgacgccgaggtggaggcgctggagctcgcccgcgcctaccaggcccaggtccaggcgctcgccgcggagctcgccgccgcgcgcggggccgtcgcgggcagatagatcctacggagtagtcgactagtagctatagcgcgcagtgcggcgggatggatccattttggtcgtcgacggcacggcatctcgcggtgccattgctgccggcgtcgtctttgcagtgcagaggcatgtaaacttagagttgactttttgttgaggcaaatcaaatctatacaactgaatgaatcaagcgggattggattactac

SEQ ID NO: 19425 - DNA, 305 bp, Sorghum bicolor
  Clone ID: LIB3480-049-P1-K1-G11
cggtcgcgtgggtgtttattgtggctaaaaaaaaaaacaaataagaaaaaaaaaaataataggtggtaggtgttgtatagtgagaggtataaaaaattaagtggttatactatatagaaaattggtaaatggtaatgtagtataaaaaaataataatttataaagggggcgccctttttaggggtcccaagcttccttcccttgccttgccacctattcccttttttttggggcccccaaactcaattgccggggcgcctttttacccccgctggaccgggaaaaccccggctgtacccaaatta

SEQ ID NO: 19426 - DNA, 561 bp, Sorghum bicolor
  Clone ID: LIB3480-049-P1-K1-G4
cccacgcgtccgccctcctctcgctcgtgccagagccagactgcccagccaccacaccattctttccccattagctctctaagctaagctagcgtcgtcgtgtcttagtagcttgcaggctcacctgctgctgattgagaggaggagacgactgaattcagcaccagctagccagctagctagcagaagatagatggcggcggaggaggccaagaaggtggaggttgaggccaccaaggacatcgccgaggagaaggccgtcgtgccgctgccgccgccgcccgccaagctggccgacgacgacgactccaaggccatcgtcgctgttgtcaaggacgctgctgagaaacctgcaactattggaggttcaactgaaagagatgcttatctcgcgaagattgtatcggagaagagactgactctgatcaccgcctgggaggagagcgagaaagcgagagccgagaacagggccgccaagaagctcgccttcatcacgtcatgggagaacgcgaagaaagcggagatggaggccgagctgaaaaagatcgaggagcaactgga

SEQ ID NO: 19427 - DNA, 208 bp, Sorghum bicolor
  Clone ID: LIB3480-049-P1-K1-G7
gaaaaaaaaaaaaaaaaaaaatataaaaaataaaaaaaaaaataaaataaataaaaaaaaaaaaaggggaagaaaaaaaaacataagggtcggctggtttaaggtttccaggcttaaattctccagcctaacgtgtcttacttcttctatgctgtcacttaatttcaattacctgacctaaattttacaccgtcaattttggaaaaac

SEQ ID NO: 19428 - DNA, 521 bp, Sorghum bicolor
  unsure (1)..(521): unsure at all n locations
  Clone ID: LIB3480-049-P1-K1-H6
ggccgncctggcgtactatcgccgcacggtggagcacaggaagcttggcgacgagctgcgggtgctggcgtgcgtgcactcgcaggcggacgtgtcgcccatgctggcgctgctggacgccgccagcccgtcaccggcgtcgcccgtcgacgtgtaccttcttcacctcgcgccgctcgtggggctcaccagctccgtgctccgcgccttcaagcacggcgaccgcaactgcgtgccgtcgggcggcaccgactcggagcgcatcgtcaacgccttccagtacttcgtgcagcagcgggccgtggggtccgcgtagctgctcccctacgtctgcatcgcgccctacgccaccatgcacgacgacntctgcaacgtcgcgctcgagaagcgcgccatgctcatcgtcgtgccgttccaccagcgcctcgccatagacggctccgtcgagaacaccacggccagcggcggatccgtgcaggccgncaacgtcaacgtgctcaactactccccttgctccgtcg

SEQ ID NO: 19429 - DNA, 399 bp, Sorghum bicolor
  Clone ID: LIB3480-050-P1-K1-A3
ggatgctaacttgatcttaggggaagcacattcctcaaaaatactagagaattctgaacacaacataaagcctcgaagctttgatgtggctaaggttgacgaaattcttaaaacacttgctggaaagacattgtcctacaagatgtttgcacgtgatacgcaagcttcacgaagtgttgggccacctacagaatgtttcatgttccattcccgagctgcagtggccaaactacattctgctaatgaggattacaaagaaggtatgatggtcatgtgcgttgagctagttgcgaacaggtttctgcgcaagatggtcaggggtcttgttgccactgccataagagaggctgctgctggtgcttgtgacgatgctttgctgaacctaatggaagccactga

SEQ ID NO: 19430 - DNA, 453 bp, Sorghum bicolor
  Clone ID: LIB3480-050-P1-K1-B2
ggcagtcgtcccgctcaacgccgacgtgtacgtctcccccgacgacaagccatcgtccggcgcgttccggcctgacatcgacgacctcatgacggacatggtcaagttcctgcacgaccacggcgcgccattcgtcgtcaacatctaccccttcctcagcctgtaccagagcagcaacttccccttcgagttcgccttcttcgacggcggcaagaacatcaacgacaagggcggcgtcaactacgacaacgtgttcgacgccaactacgacacgctcgtgcacgcgttgaagaaaggccgcgtgcccaacctcaaagtcatcgtcggcgaggccggctggcctaccgacggcaacaagaacgccaaccttaagctggcgcggcggttctacgacggccttctgaagaagctggccaagaacgaaggcaccccggtccggaagggcaagatgga

SEQ ID NO: 19431 - DNA, 531 bp, Sorghum bicolor
  Clone ID: LIB3480-050-P1-K1-C6
ctctgtggctctactgccgtacgtcgggtaacaagattgtccgtgcttatgctaaggatcactattttgatgttgtcacaaatgtcgtgggtttggctgctgctgtccttggtgatagattctactggtggattgacccaattggtgcaattgcccttgcagtgtacacaatttcaaactggtctggaacggtttgggaaaatgcagtatcactggtaggtgaatcagctcctccggaaatgcttcagaagttgacatatctggctatcagacaccatcctcaaattaagcgtgttgatacagttcgagcatacacctttggggtgctttactttgttgaggttgacatcgagctcccagaggacttgccacttaaggaggcgcatgccatcggagaatctcttcaaatcaagattgaggagctccctgaagtcgagcgagcattcgttcaccttgatttcgagtgtgaccacaagccggagcattcaattctcagcaagctgccgagcagccagccttgatcccaacgca

SEQ ID NO: 19432 - DNA, 556 bp, Sorghum bicolor
  Clone ID: LIB3480-050-P1-K1-C8
caaaatgaaattcatcgttttcgcacttttgtttgtcggtgcttgtgtcgccgcacccgaagtatcatcattgagtggagctgcaaatactataacagatgctgcaaacggcgtgtgcggtttaaccgatagcgttttctcatcaattgtaagcctattgcaaaacctcgccggaatcgcttcgcaattggttggcacagccggcgctgttccaaaaactgtttgcgatttgctttcacaagctcttcaaattattcttaaagtcattgtagcagtgccagctgcagttttagaagcattgggtcttccatctgctctggtaaaagaagctttggctattcttgagtctgttcttgggtaaagtggaggagttggagtaaatggaggaatatctagaataactggaaaaattaccatttctaactgattttaattcagacaattcttttgaactccttatcaatttgagcttaaaatggaataaatatcaacgacttgcgcaaaatgttagttgaagatcaataaaaatttcatgaattaaatgctttattcatgt

SEQ ID NO: 19433 - DNA, 383 bp, Sorghum bicolor
  unsure (1)..(383): unsure at all n locations
  Clone ID: LIB3480-050-P1-K1-D2
cctgaaatggagcctgagcaggctgaccctcaaccatcacctaagcaggaggattcggaggatgataaaaaggggaaaaggcagcgtgaacgcgacgagaggagaggggagaaggaccgaaaactagataagcatggtgatggaaaggagaggaggcgagacaagcacgagaggaggcacgacttggaggacaggtcaaagcggcacctgcgccgctcctgcttactacactccttctccgntgtcttcctctactggttttatgtgatctcataacatgccctgctccagatccaccattccttccaccattctgctctctaccttctaccacccccttcgtccttccttgctttcccgaacaataaatagcagtagctgca

SEQ ID NO: 19434 - DNA, 229 bp, Sorghum bicolor
  Clone ID: LIB3480-050-P1-K1-F2
ctcacgccggagcagagtcgccgcgttgaataagcatacgtgccgttctgcaagcagcttccaaacttacagtcccgggcttacgacaacacgacttatcttataccgatcaactactttcaaaccactgccagccggatacatacctacatactgaaaaaactgtcatgttaaccaactataactatctgctaatcatgcgcatattttaacatgtgtgtgcacacac

SEQ ID NO: 19435 - DNA, 406 bp, Sorghum bicolor
  Clone ID: LIB3480-050-P1-K1-G4
agaaaagggactggggattctatatcaactcgtgttttgttcactgccagtcgctaaactcgttgacttggcactctccaacttctcccagagtcaacaataagagcattgcagaagcagttggagactggttctttgacagaagagaggtgaaggagatagattgcgaatacccctgcaacccgacgtgccacaacttggtgttcgcaaaggctttcaagatttgaagttttggcatcttcttttgctatggttttgttgtaaaattagaaaaataaacttgttattatcctttcttgaacttactttggcaagtgataccccgaaaatcatatacttgatgtatacaaagtatagttgtataaagaatatatatatcagaactatccaatgagcatttatagtt

SEQ ID NO: 19436 - DNA, 177 bp, Sorghum bicolor
  Clone ID: LIB3480-050-P1-K1-H1
gtcgtcgctagcaagcgatcctctacatcatgctcgtggcgctcgtcccggcatactaggcctccttcgtgctcggcatgcgccgtctaacgggcgtctccacttatatcacctcactccagtgtattttgtttattatttttttctttatattttttattgtctcattacctttga

SEQ ID NO: 19437 - DNA, 449 bp, Sorghum bicolor
  unsure (1)..(449): unsure at all n locations
  Clone ID: LIB3480-050-P1-K1-H12
aataaaggtaagcgtggctggttgtgtaatgcaagtgatgctactctacatgcttgggtgttcaagttcttatgtgacaaggaaggcattaacctttgaaggcttgtgaggttggctggtcatattttgtgccatgtcgaagaacttagctgggtgcttattttgcttgtgatcatgacttatggtggctgatcatattgtgtgcccagaaacttatttatgtgcttagtttgattgtcgtgaagactgatggcatgttggatgtgtgctcactttgcctgggctgtaatgagccatgcttggctagttgctgattntgtaattagtattgtaatataaatctnctaggcttaaaccttctacatatatgtatatatatgttggtctctgnnnaaaaaaaaaanaaaaaattaanattattttttaaaattaattttaaaatttaatat

SEQ ID NO: 19438 - DNA, 334 bp, Sorghum bicolor
  Clone ID: LIB3480-050-P1-K1-H6
cttgaatcctttaacaaggctgcagctgcgcttaggggttcggtggatgcggataggctgagactcatggatacctacagcctctcgttcttgagaccggacggtcacgttgggccttacagaacaccctatccctttgcaaagggcagcacggaatccactcccgttcaaaatgattgcttgcactggtgtgtgccaggccccattgatgcgtggaatgatcttgttatgaagatggccctggattgatgaaaaccctattatggatttatatggtgtgctcttatggagtataagtagcaaccaagtgggcacaaaaaagtggccggtttgg

SEQ ID NO: 19439 - DNA, 573 bp, Sorghum bicolor
  Clone ID: LIB3480-050-P1-K1-H7
gtgccaccaaagagcaatagtagatttttccacaaagggagatcaatctttcaagaatcccacactctagctgatcaacatggccatcatgaggagtctgacaagcaaactcagtgctcaattagcgcaactggatctgatgtgtctgacagtgttatctttagtcacacaaatggtgctggcttgaaaattaggagcatctccagtgatgatcctgatggctttgacactccacggagcagaagttcttgtttctctttcacccatgagccagtaaaaaaggttgaaaactgcgatgttcggcaataccttgggaatttcggaaggggaaacagtagtagagagatgaaagagacaaggtcaagttatgttgctgatgactatgcctcacagaaagttaatccggacttactaaaggatatggtgacctttcagaatcgaatagaatatggaggcctcgttatatgtaacattagaacattctgacaatgaatagagccactgtccaaagaagttaagtatattatgatgtaattatgaaaaagactaccattgtgcaatttttttaataat

SEQ ID NO: 19440 - DNA, 460 bp, Sorghum bicolor
  Clone ID: LIB3480-050-P1-K1-H9
ggcgctgtgagcatcttggatgcacaaagagtgccgagggtcgcactgatttctgcatagctcatggaggtggccgccgctgcagcaatgaagggtgcaaaaaggctgcaagaggaaaatctggcctttgtattaaacatggtgggggaaagagatgccaaaaagagaactgcacaaagagtgcggagggacagtctggcttttgcattgctcatggaggtgggaggcgctgcaaacatgaaggttgcacaaaaggtgctcagggcagcactagtttctgcaaatcccatggtggtggtaagagatgcacatatccaaattgcagcaagggtgctgagggcagtacgctcttctgcaagggccatggaggagggaaacgctgtgcagctgaaggcttgccaaagagtgtccacggtggcactgagttctgtgttgcccatggaagtggaaagcgatgtgt

SEQ ID NO: 19441 - DNA, 552 bp, Sorghum bicolor
  Clone ID: LIB3480-051-P1-K1-A1
gtgaggaaacacactctcaggtgaagcaaatgcatttaattgcaccactggacaaacagttctccatcctatatggtcttctaactgatcatatttctgaaaatgttgactacaaggtgattgtattctgtacaacagcaaaagtaacaagccttgttgctgagcttctgtctgagttgaagttgaatgtacgtgagatccactccagaaaacctcaaagctacagaactaggatatcgaaagaatttaaggagtcaaagggtctcattcttgttagctctgatgtctctgccaggggtgttgattatcccaatgtcacactagttgtgcagttgggggtgccaactgacagagagcaatatattcatcgacttggtagaactggtcgcagaggcaatgagggggcaggagtcttactattggcaccatgggaagaatatttcttgaggagcatcaaggacttgcctatttcagaggcaacacaaccattaattgatctggacactaagaaaaaggtcgataaggcgcttgcacatgtggaggttaaagaca

SEQ ID NO: 19442 - DNA, 584 bp, Sorghum bicolor
  Clone ID: LIB3480-051-P1-K1-C1
ccaccaaaacatgactcagctgacatttctgataatttcaagttgttggccaagcaatatttccttgattgtcaatcgttaaatctcatgttcagtgacccagcagctggaacggttatcgacttagatgaggctatgcgatcaaatctaggtccaaactcatcacatgcaacaaacagtgattgtcaagctacctttactgatcttaaggctggtactcaacgcggtagtcaagatgggaattttataatgcagaggagttccccagaggatactcaatctggactaagtgatccctttagcgatatgtcccttgagatagaagacttgattatcccatggagtgagcttgttctgaaagagaaaattggtgcaggttcttttggtactgtgcaccgtgcagattggaatgattcggatgtcgcagtaaagattctaatggagcaggacttccacccagagcgtctcaaagaatttttgagagaggttgcaattatgagaagtttgcgacatccgaacatcgttcttcttatgggtgctgtcactcagccacctaacctttcaattgtgactgaatacctgtc

SEQ ID NO: 19443 - DNA, 503 bp, Sorghum bicolor
  unsure (1)..(503): unsure at all n locations
  Clone ID: LIB3480-051-P1-K1-D1
gtcacggccccccacgttcccgcgaggaggagatcgagcaaccccaaggaaatggcgccgatctccagatccacggcggttgtccttgtgatgatggctgtcgtcgtcgccgtgctcgccgccgcggctaacgcccaggcccccgccccagcacccgctaccagtgacggaacaagtgtagaccagggaatcgcctacgtcctgatgctggtggcgcttgtcctcacctacctcatccacccattggacgcctcctccgcctacaagctcttttaaaaaaatcatccgctttgtaatttggcgctaattgagggtgtcattaacggtgtttgattaatcgatcgatccagtttgcaccacaaccagaaaagaaaaaaaaactatgcacacatcttatccttgctacttctaggacattttcgccctgtctttcagtcggngcgaggtctgaaggagccaaatttattgcaaatgactcattagggggagcgatttttttcgtt

SEQ ID NO: 19444 - DNA, 576 bp, Sorghum bicolor
  unsure (1)..(576): unsure at all n locations
  Clone ID: LIB3480-051-P1-K1-F4
tcttatcgcgagcgctgccctttttttttttttttttttttttttnnnnnnnatttttttttantggtgggggctgttttattttggttttttttttttattatntgggcccccccgaaaaaatttccctaaaataaaatttccccaaaaaaaaaaatgattgacttggtttttttcattacgggtggaaaatacccgattttttcttcgacttttttatttgcgatgtacaatttgtctaaaatacttaatttcaaatttttattggtggggaattcttttttccaaaaaagttgtccattgatctttgcaaatgcatttggagattatacttacaatctggaaactccgttgacggcctttatatgataacctttctagtttcctgggcgctttatgccgtgtttttttttaaaaatcatcctggtttgttttttttaaaaaaattgtaaactttgtttcaatattttttttaaattaatattttatttttaggaatgaatttttttatttttttttttttgacccccctttttttatatttaaaaaatttataacaaacaattttcctatttg

SEQ ID NO: 19445 - DNA, 162 bp, Sorghum bicolor
  Clone ID: LIB3480-051-P1-K1-H9
ctaacattctgtgtacagtggtggactgacggaccaacaaggaggtggacggcctttttgttgttgctgtgtttgatgtattactactagtagtttttttctcatcttttctggattggatgctgcctacccctcactctatgatgaatctattatctatct

SEQ ID NO: 19446 - DNA, 490 bp, Sorghum bicolor
  unsure (1)..(490): unsure at all n locations
  Clone ID: LIB3480-052-P1-K1-A3
gcttcttgcaggctaacaccctgcttcttcctaggccctatggtgatggtcacggtccgagagtgtcagaagagagcaggcaagccactgttgatctcttcttgaaggcagctgggtatttggattgtgcagttcatcatgtactcatacatataccacctgaaagaagaagagaacttccagtagatctggcagagggaaatcttaaagctcttagcttgcaaggtcttggtcagggagttgatatgcagcttggattagcaattgagaacccaaaggcaacattagcagtaaaacgacgtttagcttgcgagatgatcaaatgctggaaacaggttaaggatagcatcccagagcttcctctgtcagatggatggnggagaaaacatgctctatntgtaaaatggaaatatgttgaagctaaggctgcagcatactatttccacggattgattcttgatgagggggagactgaaaaatcacaagagac

SEQ ID NO: 19447 - DNA, 303 bp, Sorghum bicolor
  Clone ID: LIB3480-052-P1-K1-A6
cggacgcgtgggtaatatataaaaaaaaaaaaataatataaaaacttaataaaaattaaataacattaaaaatgctaggtgattaaatcaacgctatacaataaaaaaccaggtcgtcccgccttttttttttttttcctcccccttttttttttttttttccccccgtctttttttctttttccccttggtgggtctcttcttgtatggtcacattacatttgctgtgcctttttttttcttgtgtgccccgctttttctcaatcagcattctgtttttcatttgttatggcttgagctgac

SEQ ID NO: 19448 - DNA, 570 bp, Sorghum bicolor
  Clone ID: LIB3480-052-P1-K1-A9
ttcgccatcctcgtgctgatggcgctcataacaaccttcatcacgacgccggtggtcatggcgatctacaagccagcacggcgtgggccgccctacaagaaccgcgccgtggagcgcgcgaacccgcacgacgagttccgcatgatggcctgcttccacagcacgcgcaacatccccaccatcatcaacctgatggagtcgtcgcgcggcacgcggaagcgcggcatcaccgtctacgccatgcacctcgtggagctctccgagaggtcgtccgccatctccatggtccacaaagcgcggcgcaacggcatgccgttctggaacaagcgacgcaacggcgacggcgacggcgaccagctcgtcgtcgccttcgagacgtaccagcagctgagccgcgtgtccatccgggccatgacggccatctccgacctgcatacgatccacgaggacgtggtcaccagcgcgcaccagaagcgagccgcgctcatcgtgctcccgttccacaagctccaccagatggacggccacatggagtcgcttggcgaccagtaccagcacattaaccagcgc

SEQ ID NO: 19449 - DNA, 299 bp, Sorghum bicolor
  Clone ID: LIB3480-052-P1-K1-B4
ataaaaaaaataaaaaataaaaaataaaataaaataaaaaaaaaaaaaaataaaaaaaaatatataaaaaaaagagagggggtatattgagaaaaataatacaaaaaaaattaatagtaaaaactaaaacgtgggggggtgtttttagagtttcaagtcttccttccctgtgcttggtacgttatactttttttttcgggtaccgtaatttcatttaattggccgccgtttatcaacgtttaaagtggaaaaaccttggtgttcccaaatttaatccctttagaggagatttccacttt

SEQ ID NO: 19450 - DNA, 506 bp, Sorghum bicolor
  Clone ID: LIB3480-052-P1-K1-C10
gtgaacacgacggtggcgtggtggctgctgaccacggtgccgcacatctgcgagaaggagctcctcccggcggggagcccgtggacgtgccccagcgaccacgtcttcttcgacgcgtccgtgatctggggcctggtcggcccgcgccgcatcttcggcccgctgggctactacagcgcgctcaactggttcttcctcggcggcctcatcctcccggcggtcgtgtggctcctggccagggcgctgccggggcacgcctggtggatcagcctcatcaacctgcccgtcgtcctgggcgccacggccaacatgccgccggcgtcgcccatcaactacacggcctggtgcttcgtcggcaccgtcttcaacttcttcgtcttccgctaccgcaaggcgtggtggaagccctacaactacgtgctgtcggcgggcatggacgccggcgtggccatcatgggggtcgtcatctacttcgcgcttgtcggacacccgctcgactggtgggg

SEQ ID NO: 19451 - DNA, 356 bp, Sorghum bicolor
  Clone ID: LIB3480-052-P1-K1-D10
aaaaaaaaaaaaaaaaaaaaaaaaaaaaaaaaaaggacggacgatatagtaggagacaatctaacttacatagagcatgcttaggtaggggctgctgtttatttgaggtctaagttaatttaactgtgcgtgcattgtcataccttttgtataggtaaacttaatttgaattcactgtacttaatttgaaaaagatgggactgtaaaaagctggccttatcccaactaaatcggcaagaatcgcattcccttatagtcagttggcctaaatgggaaaaggcccgctccctgtggcttcccttaaagtaccccagctgtaatggctaatggcacgcaaactgctacattacataaag

SEQ ID NO: 19452 - DNA, 593 bp, Sorghum bicolor
  unsure (1)..(593): unsure at all n locations
  Clone ID: LIB3480-052-P1-K1-E1
acgagcaaacttagcggttggtggagctacatttgtaggcgtctagcaggctcttgcaagatacaggatgaagaaggacatcattaatggtgctgctgctggttttgctgctggtgctgttttgggtttcagagttaggagcttccggacagcattcttttcagggtctgcactcgccttgacatctgtactgctggatgtcaccggaatgaaaattactgatgaagaagaaaaaggcaaccactagacaccctgtgaaatggaagagcagtatctgtatcagaggagtcccatctcttaagaaatgctattacagtagtagtgttgggatggagaagagtttcttgtccattgatataggcacgcgaacgtagtatgttcataacagaggtagtagcctagtagattatatacttcgcagcggtcctggtctgaagcctaaacacatgtttgcagagtactttccgccattttcatctggcgctagtttttttttctgaaactgcaagtcgaagtcactggttagactgttcaggtaccatcaggttccaccaaattctggatctgtgctgcangtngccttttaaacattt

SEQ ID NO: 19453 - DNA, 263 bp, Sorghum bicolor
  Clone ID: LIB3480-052-P1-K1-G2
gcttcacactaaacccaggagctgacagaactttcagttgggttagtgctcactcctaaactaggtattgtgacaatgatgattatggtggtcaatggttggatgacacgacaaacaatggtgtgatggtaaatgatgaatacacaacattggttttcactaatgcccctgtacaatatttcttatcacttattatgcagatgtaacatgtgatggattttgcattgcggtactgtcaaaatgaaccgacatgagatgccaca

SEQ ID NO: 19454 - DNA, 576 bp, Sorghum bicolor
  Clone ID: LIB3480-052-P1-K1-G4
ccttcctgctcttcaagctctggcctttggcagcagccaatcgcctgtttcctgtctcttcttcccttccggtggtctcgcgtcagcaggtagctgcgcctttttttttcccccccttttcacgctcggtggggataagaccgtggcgtcattgccaccatctcaccaccgcaagcgcaagcatcatcccgggctgccgctaccggcggggcaacagcgttgccttgctctgcctccccccctctcgctcgatccgctgttgccctgtccctgttgatcgctcgcttagctttgtctatctatagactatatatatataaggcagaacaagcagcgcgcagtggccatgtcgtccgacgcggtggccgccaggaagggccggttgaagcagcgctacgacaacgagttccgcctcgtcgcagggtgcgtgccgtaccgggcgaacaagaaggacgacgagctaggcaacccgtgcagcagcctcggcgtcggcgacgaccacacggcggaggtggaggtgctcatgatctccacgcctaaccggaccgacatggtcttccccaagggtgggtggga

SEQ ID NO: 19455 - DNA, 540 bp, Sorghum bicolor
  Clone ID: LIB3480-052-P1-K1-G9
atgcatttagcgaaacgggtcaactatggaacagtccattgtacgactggaaagctatggaagcagatggcttttcatggtggacaaagaggattaaacgtgcccttgatttgtatgatgagttccgtattgaccatttccggggtcttgcaggtttttgggcagtcccttctgatgcaaaagtagcactggttggaagctggagggctggaccaaggaatagcttttttgacgcgctcttcaaagctgttggtagaataaatataatagcagaagacctgggggtaattactgaagatgttgttcagctaaggaaatccattggggcccctgggatggcagttctccagtttgcttttggaggtggttctgacaaccctcacttgccccataaccatgaaatggatcaagttgtgtacactggaacacatgataacgatacagttcttggctggtggcaaaatttgccagaggaagagaagaaaattgtgatcaagtatctaccagaagccgagaatactgacatatcatggacactga

SEQ ID NO: 19456 - DNA, 525 bp, Sorghum bicolor
  Clone ID: LIB3480-052-P1-K1-H8
cccacgcgtccgcccacgcgtccgggaagaggaagcggcgcgcgcaaccgtcgccgtcgcggaggcacaacctcgtcgtcgtgccggaaccggcggtctcgccggacgcagcgtaccaggcgtcgccgagcgggacgaactcgtacgagctgtcggggaccaagtcgtggttcacgtacgacgagctggtggggatcacgggcgggttctcggcggcgaacgtgatcggggaaggagggttcgggaaggtgtacatgggggcgctgggcgacgggcggcgcgtggcggtgaaacagctcaaggtgggcagcggccagggggagaaggagttccgcgccgaggtggacatcatcagccgcatccaccaccgccacctcgtcacgctcgtcggctactgcgtcaccgagaaccaccgcctcctcgtctacgagttcgtggccaacaacacgctcgagcatcacctgcacggaaaagggctacccgtgatggattggccgaagcggatgaagattgcgatcggagcgg

SEQ ID NO: 19457 - DNA, 434 bp, Sorghum bicolor
  Clone ID: LIB3480-053-P1-K1-A8
aaaaaaaaaaagagagcaaacactataaaacgaaaaaaaaaaggcagacccgtgcaaaaagatacaaaatcacgtggcgtaatgtgcgccgatgtagatgtactcaccttacatccacattcatgtgactggacagcccttgaactgcgcgaccttgtgaaaaccctggcccgacccaacttaaccagctggctggaaaaacccctttgtcgcccagctgtattttctaacaggcccgcaccgttcgacctgccggagacttgcccagcctgcccgcacaaagggccgcgccctgtaggggcgcattcagagtggccaatgggctggccacttgccgggcgccctatacacttgccatgtaccgatacccctctacttgcccgatccctttgcctttgtcgttacgtacgttggttttgctctatgacctctat

SEQ ID NO: 19458 - DNA, 311 bp, Sorghum bicolor
  Clone ID: LIB3480-053-P1-K1-B1
catgcacgcttgcatgtgacgtattgtgtcatctatagtgaaatcactgtccaacgtactgcacggtgttgaatagcaaaaccactgggtaaaccatctcaatagccaagtaaatcatctcgctttagatagctgttgtgatagctgacaggctagcgcagagggccgtaccgatcagtcttgcaaactgaagggcaaacggaacgcgcactgtaacgcgccatgaagcgcggcatgaagcgcggctactctcatggtgacccgtacagtgaccagtacactagcgagcgctctagcggctgttttttctg

SEQ ID NO: 19459 - DNA, 421 bp, Sorghum bicolor
  Clone ID: LIB3480-053-P1-K1-B3
cccacgcgtccgaaaaaaaaataaaaaaaaatacaaacaaacctaaaaaaaaaataaaaacaacaaaaaaaacgagacaaaatcaaaaaacagggaaagactgccacaaaataacaaacccatttgacataaacaacggcgcccgccacttcatcttatccaaatgtgtcgtcccttttcttgtatccacattttcttacattttgacaccctaagatatccttttttttcgtccatttaaaaccgattcacattggaaagcctctaccctccccgattttgtatacatccggcctttcccctttttactcccatgcggtcaactcccctttccccccttggggtgtcttctaaaagggtttcacaatctgcctttttatagaggccccccttctggatccccatttacctcccccttttt

SEQ ID NO: 19460 - DNA, 402 bp, Sorghum bicolor
  unsure (1)..(402): unsure at all n locations
  Clone ID: LIB3480-053-P1-K1-C1
cccacgcgtccggtaaagttgtcgacgnaagagtggtacatgacgcgtaaagactgaagagtggtagacagtggtgttttgagggaagcattgtggtgttttacagcagcagcatgggtgctatttttgtgcttgttctatggtgaaatggttcctatatcctgaattgctagctgaatgcagaatgcttattaatttaagcttggcagtgatggcttccgaatgttgtagctgactagaaaccaggatgaggaatgagcataacttatcttcctcacatgctattaggtggctctctgttagggaagttgcattgagatcgaacttaaactttgatttcctaacctttgtgacgtgctccgacttaagaacttaacaagattggttatagtttttggtgtt

SEQ ID NO: 19461 - DNA, 512 bp, Sorghum bicolor
  unsure (1)..(512): unsure at all n locations
  Clone ID: LIB3480-053-P1-K1-C4
cttatgctgctattggtggcaaatatgtnggaagtgacagatttgtggggtgaaatgaaacttctggctagttcaagttctatgaaatttgatcaggagctcttagactctctgttgtattgctttgtgagaggtggtttcttccttcgagccatggaagttatagacatgatggagaaaagagagatgtttatagacaaatacaaatacaagtccttgtggcttaaataccacagaacattgtacaaaggtaaggctcccaaggtgcaaacagaagcacaactaaaaaggagagaagcagcaatacatttcaagaaatggattgggttgacatgagagcaagagattcaactcaagctatatgaactgatcaggaattctttgattatctactgtatggatggatcttcacaaattccaaaaaatcgtaattgtggagtttgttagaaggtaatgtgtttttttctatttggcatttttgtgtagttcctgcttgaaaataagtaatccaa

SEQ ID NO: 19462 - DNA, 515 bp, Sorghum bicolor
  Clone ID: LIB3480-053-P1-K1-C5
cttcgtcttccacctctttctgcggtaccgcgaggcggcatggacggcctgagaggtctcgcgccggggcgcgggcgcgggcgtgggcaagggcggacggtgccgcccgaatggaccggcgattctgggtccgggcagggcgccggccccggcggctcgtggagttacagctgggggcggacatcggggcccggaggcggctggggctacggccacggctcggcgcagggccccggcgccgcgtacgggtttggcttcggcagcggtggtggaggaagcgggcgtggggggttcgagttcagcttcggcggccacgatggcggtttcggctggggagccggcggcgggtcgtttggggttggaggagaccacggcagctggagcgcgcggggtgggctcggcggcggcggcggaaggcagcggccaccgcgaggaggccgcggtcgtggcagcaactgaagaaggccgattagcatctggggcagtgtactactgctaacctgtataatactcta

SEQ ID NO: 19463 - DNA, 473 bp, Sorghum bicolor
  Clone ID: LIB3480-053-P1-K1-C6
ggcccgggcgccaccgcgcccgccgcgcagacgccgctgctgctcgaccgccggatgaccccgttctacgccgtgacggtggacgccgtgtacgtggccggcgaggcgctcgacatccccgcggacgtgtgggacgtcgaccggaacggcggcgcgatcctcgactccgggacaagcctcaccatcctcgccaccccggcgtacagggccgtggtgaccgcgctcagcaagcacctcgctgggctgcccagggttaccatggacccgttcgagtactgttacaactggaccgacgccggcgcgctggaaatccccaagatggaggtgcacttcgccgggtccgcgcggcttgagccgccggccaagagctacgtcatcgacccggcgcccggggtgaagtgcatcggcgtgcaggagggctcgtggcccggggtgtcggtcatcggcaccatcctgcagcaggagcacttttg

SEQ ID NO: 19464 - DNA, 622 bp, Sorghum bicolor
  Clone ID: LIB3480-053-P1-K1-D11
aacatcgacaaggggctcggctccggcgtcatcctggacaccagcacgtcggtgacgtcgctggtgccggaggcgtacgagccgctagtggccgcactcgacaggcacctggcacacctgccccgggagagttttgcaggcttcgagtactgctacaggtggaccttcaccggcgacggcgtcgacccggcgcacaacgtcaccatacccaaggtgacggtggagatgaccggcggcgccaggctggagccggaagccaagagcgtggtcatgccggaggtggggcacggggtggcgtgcctcgccttcaggaagctgccctggggaggaggaccctgcatcatcggcaacgtgctcatgcaggagtacatctgggagatcgaccactcaaaggccacgttcaggttcaggaaggacaagtgcaacacacgtcatctacacaccagcaccggaggagaagtcaccaacaatggcagcagcggtggaaataatcagcaggccaatggcggcaccagcagcgatgccccctcctccttctccaccgtcgtgcatagcgtcaattgatacgtactcatcgatttgatccatcccttccctgcagcactacactacactacaccga

SEQ ID NO: 19465 - DNA, 623 bp, Sorghum bicolor
  Clone ID: LIB3480-053-P1-K1-D12
ccattttctagccaacctccagcaagaggggtttttctcatgacgttgcaacatgcccctccatcacttcataacacaaaggagaagaagttcacagattcttttaagagtatgattgccacttgtctcattaaagacccaacaaagagaccacctgcaaaaaagctattaaagcacccatttttcaaaagagcaaagtcagaccataatgttgtgaaatgtatgctaaataaattgccatcattggctgagcggatgcaatttataaaggaaaatgaagcgttgcaagcagataaaaaacctcttgataattgcaaagagaaagcatcacaggaagaatatagaagaggtgtgagcgaatggaattttgatattgcagacttaaaagcacaagcggcattgtaccccgatgagaatgaagcggaagactttttacggtttctatttgaacttgacattgttgatgaaactacccagttaaaagatattagagcacaaagtcactctataaatgatgataaaatgaatgttggtgatgatggctcaggaaaatcaaattcaacaagtccgatgtctttatctcaaagtgtgaaacagcttgataaaggaagtctaatgacctt

SEQ ID NO: 19466 - DNA, 303 bp, Sorghum bicolor
  Clone ID: LIB3480-053-P1-K1-D6
gccaaaggtggcgtgccactacgagaggatcatgtctgtctcccactgcgacgctaaaccttactactgggcgctctagataaagcggacgggctccgtgcgcgcacaagaataccaactggatgatcaacatacagaacggcgaaacctcctacaccgtgcgcttcctacgggcccacgcccttgagctccaagaaggtaccatcctgattccaggggtacacgaacgtgaccgccatggtcatctccacggaggcacgccacggggtcagatacagcctgcagcgggcgctgaaggacagc

SEQ ID NO: 19467 - DNA, 139 bp, Sorghum bicolor
  Clone ID: LIB3480-053-P1-K1-H11
gtcccgatcccggtcgacacgcgtcgatgaatatcggatcagcgagcagagcccgcgtcagcctttatctctagatcgcgagcgggccgccctgtgtgttttttttgcgaggggggagcaagtggatcggtacgccgac

SEQ ID NO: 19468 - DNA, 393 bp, Sorghum bicolor
  unsure (1)..(393): unsure at all n locations
  Clone ID: LIB3480-053-P1-K1-H12
acacgccttcgttctagatcgcgacggccgccccaactnggcgccgcttcttcgtctttgtcaagcgcatgttccagccgggcgcactggactcgtgcccggggcagttggaggggaaacccaccgtgtggggcgcgctatttatccgcacgtgcaccatgccctcgtcaaacaaaaccactgattttggtcccctgcgcgcggtgtttgtttttattgttttccgggggcggggggcccaacctaaagccctgctttttttttttggggaaagaattttccccccaaaggggttttccttaaggtggggggccgccaaaaaaggtggccttttaaaaaacggcccccttttgtttccaacaaaaaaacccggggcatttgccacgggaattt

SEQ ID NO: 19469 - DNA, 566 bp, Sorghum bicolor
  Clone ID: LIB3480-053-P1-K1-H2
gtaaaaccagaagctcttgcagcacttgcagaggtctgcagtatgcgctttgttcatggagtaagtacccggactggattgatgggaatagactaccctactgcttcatggctttccagggattgtcgctacagggcatatacagtgatctctgtagatgatctctacaatccttttgcatcaatgtactttggtgcatcttacttggcatggttgtctcaatacgaaggaagggagcaaagctacgaattcattgtccaagcttatcttgggggaccagagaatgttagtcttcaggagactgggcctttttggaaccaattccttgagtcattaacacagtatcaagatccaaagaaggaccataatagctgctgtattttgtgaagttgtctggtacgtcctccgactttggttactgaagattccctcccaagggttcgggtattgacaagcaattttcttgctggactacacgaggtacaggggtaacaggggctgtcagttcgtacatacaatttggtcgctggtgccctgctcatgtttaaaccatgattgatctcgtc

SEQ ID NO: 19470 - DNA, 597 bp, Sorghum bicolor
  Clone ID: LIB3480-053-P1-K1-H4
ggtaaataaaccctactatttgtctggtctttcattaaaaaaaaaagaaaaagtgagtttaaaaatcccgcatcacaagtttgcttaccttaaagggttcattgtcactccggaaggtaatgtttgggacatcatgtagccaaaacggaaatcctctgcatggaccaaacaaaaggtattcagcatttgttgaggtaatatccagttttattttacttagatgttatttagtcccttaaataattttttgtgatgcttctctaaaatattttaggtcagcgagaatatatgctttatttgtatttatttcattcatacccatatttccattcggactctatgaagggaccaatcctgaggcttacgtagaggccttgagcttgaatttccttgatgaacctgacaagatcatatcttccctcgaagttgtactggtgaaatgataccatttacacatcttagtacttggcgtctcactcacaggatatttttcaggtgctttgacaggtgttcatatgaaaatgagaagagcatctacctggccctgcacaggctcatgaacattccagaatacataggcaacggcgtgcactgacc

SEQ ID NO: 19471 - DNA, 544 bp, Sorghum bicolor
  Clone ID: LIB3480-053-P1-K1-H8
gacccagagactggtgaatggcctactgctatgcaagtttggagggctacataccaaaagcctgatgggacatggactattccaacgggtgaagaaataatgaccaaactagatgaagttgctgggacacatcaagaaaagatttcttctgcacccgtgccaatagtggagcattttgcactagttcttggtcgaaagccaaaccattcacgtggtgttggcattcgtgctgtaaacagagtcgccgaggaaaggatcagattgcaggcacaaatcgaggcttctgaacagcgtgaagctgcagctcgagcacgtgcagatgctgctgagcaacgtgctgaggctgctgagcaacgagcacaagctttggaaggccaggtctcgacggtggtcgaaacaaatgcacagttacaagcagagcagcaattccaacgtgatgagcttagttctttgcgtcaaacacagagtggagaagttgcacgtctagtgaaagagcaacttgatcgacaaatggctgatttctttgcacacattcgttctggtg

SEQ ID NO: 19472 - DNA, 565 bp, Sorghum bicolor
  Clone ID: LIB3480-054-P1-K1-A11
cacgggaagctcgcgcacatgccgctgtcgtccaagatggacttctgcgagttctgcgtcgcctgggcggggacgaacagcaagctggacggcgccgacaagcagcgcctcccgcccgcccccgacggcggcgcggagaaatggcggcgggtgccgctgccgtgggagctcttccagccggtgctgcagatcgtggcgcactgcctgctgggccccacggggtcggacgagctgaaggcgcaggccgcccgcgccgcggagtgcctgtattggagggccacagagacggtggacgcgcgcgcggtgctggccaccaggagcctcgtgaggctgtcgcagatggtggaggagccgatcccggagccgtctttctctggcgccatcgagaatatggcggagctggaggccatgagggccaacattctcaataacacgaagtgatagcagcacacgcagagtaaagctgcactgatgaatggtgataacggattctggtatgatatacttttatttatttatgggtagcattacatctgacaaccggatagaaaaactccaatctccc

SEQ ID NO: 19473 - DNA, 543 bp, Sorghum bicolor
  unsure (1)..(543): unsure at all n locations
  Clone ID: LIB3480-054-P1-K1-A5
gggagaggaggaaaaagcagcgagaaagaaagggtcctcgagcaccacctgtcggatcgacgaaagcagcagggaaagatagggggaggaggaggagaagaagaaagcagagggaatggaagccgtggctttcaggcttgcagaggccctcggttcggctctgcgctgcgctgcgctgcgaggctccgtgcatggttggagaccaccagtatcctattcgatccgtcgtcgcaggcctcccctccctcccgctcgccatggctttttcccccccgcacccccccaaccaggaggtcccatacttgctgccgggccccggccgcaatcaacgtacagagctaaaaaagaaaaaggaatctagaagcagagagggaggcaggcgatcgatcgatcggttaccgagcacgaaggaggcggcgaccatgccgccgtgccggcccctggtcgccggccggttcctccagtccacgtacccctnccaccgttccgcattccgcgcgcccgtcttctgcaatttcatcaccacgaacaaatcgatgagca

SEQ ID NO: 19474 - DNA, 522 bp, Sorghum bicolor
  Clone ID: LIB3480-054-P1-K1-B2
cccagtcatatatcgagatatctaggcatataacattgtgttagacacagagttcaacgcagaactctcagattatgtcttagctaaagcctgtccaactgccgatacaaccgatgtttacacacatgtcttggctcctgatgtgtatgctgatgcatattccattgcagcaggccttctatctggacaggcatatgtatatagctatgtcgataggttgcttgaattgctcactgaatgaatgaccctgagtaaatcaatacctggctttgagccaaaccttgttcactgcgtcagaccttacttgagcgacaagttcagactatagcgcataatgtacacgatgctgggcagacagcttgcaagacaaggcgcaaatgccagtgcaagcatcgtcttgcgcttcatcttccgagacatctagctggacgctactatgtctcatgctttgtaagagctgttacaagtactagatgccctacatggtgcaccatctccattagcctgcatattgacagattt

SEQ ID NO: 19475 - DNA, 432 bp, Sorghum bicolor
  unsure (1)..(432): unsure at all n locations
  Clone ID: LIB3480-054-P1-K1-C1
gccgtgcacggctaacgagaccgtcatcgtcgacaagctgagcggcgtatacgatgcgtgggttgccgccgacaaattcctcacggaattactgcctccagctgaggtcaagggtaaagataaggcgtcaaagaagacggagaagtaatatctatccgtccgtggatcctttagccctatttcgcctttttttccgacaattttcatatgcatgcatgggattttagtatgtttttaataatgaccgatcgatggtctgtaaccggacacttgcactacgtacgctagctggttctacgtaaaattcttgatgtcttggttcccaaaaaaaattattgatgtcttgatagctttgactactgttattttatatagaatatttatcaaacatggttcacgtatagtacttcaaannaaaaaaaannnaanaaa

SEQ ID NO: 19476 - DNA, 423 bp, Sorghum bicolor
  Clone ID: LIB3480-054-P1-K1-C10
aaaaaaaaaaaaaaaaaaaaaaaaaaaaaaaaaaaaaaaaaaaacaataaaaaaaaaaaaaaaatggggggcggttgtttaggacccacttttacgtacacatgcatggcctccccttttggtcgctctcttttaacttcaatgcttttgcctgggcgtagttttcctataacggtatttaaatataacccttctgttaaccactttactcggctttcatcaaatacccctttggcaaacccttgttattccccaaaggaatcatcccctttcccttccctttttttccacctaatgaattgcgaaaggtgcccgccctgtaccatttccccaacagctgggcatttgttttgtccactgaccctgacccttacacttgccatattcccctggccctctcctttttaccccttcctttccctt

SEQ ID NO: 19477 - DNA, 481 bp, Sorghum bicolor
  Clone ID: LIB3480-054-P1-K1-C6
cgacgagctcaggaaggccaccggcgacttcaacccggggcagatcgtcggcgagggcggcttcggcgtcgtctacagaggggtcatcgacggcgccgtgcgcaaggggtacccgcccacggaggtcgccgtcaaggtgctcaacccagaggggctccagggcgacagggagtggctgacggaggtgagctacctcgggcagtacagccacccgaacctggtggagctcatcggctactgctgcgaggacgaccaccggctgctggtgtacgagttcatggccaagggcagcctggagcaccacctgttccgccgcgcctgcagcctgtcgtggacgacgcggctggccatcgcgctgcacgtcgccaggggcctcgccttcctccacgggcccgaccgccccatcatctaccgggacttcaagacctccaacatcttgctcgacgcggaattcaacgccaagctgtcggacttcgggctc

SEQ ID NO: 19478 - DNA, 563 bp, Sorghum bicolor
  unsure (1)..(563): unsure at all n locations
  Clone ID: LIB3480-054-P1-K1-E5
gcctctcgtatcctcacgcaccagagatctttcggccccgacagcacgcagtacgccgccgtgcaccgcgcgcagcagccgccgccgcagcatgcgctgaacggggctagagtcattccggtctcatcgccgttcaaccacaacaacaatccgatgtttagggtccagagctcgcctagccttcccaatggtactgcgttcaagcagccgccttttgccatcaacaacgctgtgcccagttctactgtgggtttctatggaacaagggatgcggtgaggccaaagacggcacaactgacaatcttctatgccggttctgtcaatgtattcgacaacgtctccgccgagaaggctcaggaactcatgttcttagccagcagaggatctctcccaacctcagcccctgtggcccgtaaaccagaagctcctattttcgctccagcgaaagtcgcagtgcccgaggttttgcctgcaaagcagatgctatttcaaagaccgcagcatgtttcgtcgcctccatcagccatctncaaaccaatccctggcatcttgcaagctgcaac

SEQ ID NO: 19479 - DNA, 431 bp, Sorghum bicolor
  Clone ID: LIB3480-054-P1-K1-E8
caacaggtcgctcatcgagatgtccgagatctgccgcacgctctccaacatggtcccttacgaacatacccattgattttttttttccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaagaatcaaagtttactaacccgtgcatgcaacgtaaaaatttttttatagggccaccaaaattaaattaacggcccggcttttaaaaacttcaggacgggaaaaaccttggctttaccaaattaaatggccttgcaacaaatccccttttggcaagttggcgtaaaaaaaaaaaagcccgaacggaactatttttcaaaaa

SEQ ID NO: 19480 - DNA, 465 bp, Sorghum bicolor
  Clone ID: LIB3480-054-P1-K1-F1
tgcctctgagtaggatatccaggatgccatcctcattcatggccccagcaataagcaactgcgagtgcgaggagttatcagtccccaatatattcttgttggcattgacaaatcaggtggccgaattggtctgctatcgtcgaagtttatgcttcaggctatcagcgtgcttcacatcgttcatctaagtcataaatgcatacattatgttattaagggctcaagatcatctgaagttgagggcttgtggaaaagtcctcctcaagaattctcttatctccagtatcctcaagagggatggtgatgataaaattaaaattgtagacctatatcccacacatgacaagaatgaaattagaaccattgagaaatgggttttatcgtacctggaccatgacatgacacttaaggtgaggtggctgtgaagagattgttgttggtggcacgctaggagcaccttgaaat

SEQ ID NO: 19481 - DNA, 462 bp, Sorghum bicolor
  Clone ID: LIB3480-054-P1-K1-F11
ggcagcacaaactgtaaaagatgcaggacaaaaaccttgtgaaatacacgaaccgatgagtcggttcggagggctagtgaatatatatgaagtggatttagacagtcataacgatgatgcaatgtaatactggggatatataaacagcggtggcactacaacttcaaaaaaaaaaaaaaaaaaaaaaaaaaaaaaaaaaaaaaaaaaaaaaaaaaaaaaaaaaaaaaaaaaaaaaaaaaaaaaagaaaaagaaaataaaaaaaaaaaaataaaaaataataaataaaaaaaaaaaaggggggggccgttttagaggttcaaagtttacttccggggggtgggaaggaataagtttttttttggggccccctaatttaattcaattggccggggtttaaaaacgtggtgattggaaaaaccttgggtttaccaaattaattcgttttgaagaaaatccccttt

SEQ ID NO: 19482 - DNA, 536 bp, Sorghum bicolor
  Clone ID: LIB3480-054-P1-K1-F12
cgctcgtcaccgtcctcatcggcttctacgacctctacaagaacgtgccgctgctcaagtcggcggcggcgcgcatctgcgggccgctcttcggctggatcgagacgtgggacatggtgaccaggatccagtacttgggcaccatcctcttcctgcgcaacctgcgcaagtgcctgcagagcctcctggcgctgctgcgggcggcgcgggcattggtccgcacggtggcggcgccgctggcccaggccgtggggcccctgctggcatcctgcgcccagctgtggggcctgctcagcgcgggcctcgcgccggcgtgggcgctgctggtggacctggcggagctgctgtgggcgcccttcgacctggtcttggacaacgtggcggggtgcctgtggccgctgctgcaggtggcgctgctgccggtgagagcagcggcggcgctggcgggctgcgcgggctcgctgctgtcggtcacctacaacttctctaaggacatatgggagaccatgagcagcatcttcgagctcaaccacatg

SEQ ID NO: 19483 - DNA, 622 bp, Sorghum bicolor
  Clone ID: LIB3480-054-P1-K1-F6
atcaggcaaaacttcccatattgaaagcttcaaggacaaaacaatagcagatggggtgttctttcttgagctcctaagtgctgtgcaaagtagggttgttgactggaacatggtgaagaagggggaggatgaggacgagaggaagctgaatgcaacatacataatcagtgttgctaggaagctcggttgcactgtcttcttgctgcctgaagacataatggaggtgaacccaaagatgatcctcacccttactgcaagcatcatgtactggagcctgcagaatcaagggccttaccaatgtccaggaccacaggatgctcttccagaggaagaggaaggcgaggaggaagaggaagaagaggaggatttcgaaggaggggtcgaagatggtgtctccgaaacgaccacttgataaaaatgtcatggctgactaagcattcacggttaagttactggtttatcaagggcatttatgaaatgctgaggcaaagaaatccaagtgagctgcaaagaagaaagttttgggtaacatagctgatttcattctttgcatgccaaagacaactagcagaattcaagtttgtttagtaggtaacagtgcgcacaaaattgacagcctaat

SEQ ID NO: 19484 - DNA, 550 bp, Sorghum bicolor
  Clone ID: LIB3480-054-P1-K1-G5
cccacgcgtccgccctgacgcccacgacgccgatgtggacgtgttgctccggcagacggccgactacatctgcatcctcgagctcaagctgactgtcttgcggagggtctcagccatctacggggtgtgatttggtaggatcaccttcgttgttgccgcgctggcaccttcgtcgtacgtgctccactgcgacgtccacgcaggatttgaggttttgagctcaaaatctgttgcggttgtacattcaccaaggggaggaggggagaatatttcttgccggctcatgtcttgatgattgtgcccctcatcagtagtatgtttgtggctcctatgtgaatggtacatatgggagttagtttggatccaatatgtgtggtgcatatggcagttagtttgcaggtgaacccaagccattgtcatggtcagtggtgtttaccctgttggcttgaaaaacaaggatccccactggattttggttttagtcagtttatggagttgttcctgttcagctttccttttaaagatcccatgaatgaactagttattgctc

SEQ ID NO: 19485 - DNA, 149 bp, Sorghum bicolor
  Clone ID: LIB3480-054-P1-K1-H10
ctcacgctctccaattatgtttcttattaagccatcctctacactcctagaaataacaatctaggggggggtttattaacgagagcggcatacaccatctatagctccattatcatcttcgtctccttcctcctacttcttctgttctt

SEQ ID NO: 19486 - DNA, 173 bp, Sorghum bicolor
  Clone ID: LIB3480-055-P1-K1-A1
caaaattccatgggacagacacaagccagaatgtgactcattgtcacattcgagccgaaggtcagaagatcaggatgaatgtggcttagttgacgcgctgacagcagcaataacacgtgttagaatatcagagccgaagagaagtcggctctgtagccctgcaattaccattc

SEQ ID NO: 19487 - DNA, 320 bp, Sorghum bicolor
  unsure (1)..(320): unsure at all n locations
  Clone ID: LIB3480-055-P1-K1-A6
ggagctcctatgctttgcctccaacacctcgacgaccctacccctctgctgctgcgtggccttcttcgtctctctccttttcttgcttcaccgccgctatggtggcggcaagtcaacgtcaaatactaagagcaagggccgccttccccctggaccaccggcgctggtattcctcgccaaattcttggccctgcggcgatcgatcttcgacctggcccctctgctccgggacctgcacgcgcgccacggccccgtcatctccgtccacctcttcaccacgctcgtcttcgtcgccgaccgccgnctcgcgcaccgggttc

SEQ ID NO: 19488 - DNA, 241 bp, Sorghum bicolor
  Clone ID: LIB3480-055-P1-K1-B12
gggagcggacgctcaggtgggaggccgagatcaagtcccccgacgacgacggcttcgaccgcaagtggaagtgggaggccaagggcggatcttcctccgccggtgccagaaagctcaagtggggcgccgcggtcaaggggaagggatgtctcgagccctggtcccagtcctacacctgggaggaggacttcaccgccagcgacagcgacgacgaaaaagaggagcgcgcggctgacaagac

SEQ ID NO: 19489 - DNA, 287 bp, Sorghum bicolor
  Clone ID: LIB3480-055-P1-K1-B7
aaaaaaaaaaaaaaaaaaaaaaaaaaaaaaaaaaaaaaaaaaaaaaaaaaaaaaaaaaaaaaaagagagaagggataatttttgggggggtaaaaaattaaatggtaaaatttatgggggggccttttttgaggttccatgtcttttttcgcttgtgtgcggccctttattgtcttttatagtgtctcctaaattcatttcattgtccatttttttatatcttgtgttattgggaaaattttgggtgttcctttttaaatgtttttgagcgctaaaatttttttaac

SEQ ID NO: 19490 - DNA, 108 bp, Sorghum bicolor
  Clone ID: LIB3480-055-P1-K1-C4
gttcagttgatttatggcaaatctattcaaacagatgccatggcatcttgttgctgttgtactgcaataatactgctacaatataccggttacatcacccgaaggtct

SEQ ID NO: 19491 - DNA, 462 bp, Sorghum bicolor
  Clone ID: LIB3480-055-P1-K1-D11
cccacgcgtccgagagagaaggagctgctgctaagatgctgcagggtgaaatgacagaagatgagatcagtgaagaagatggtctcgatgaggatgaggaatggtcttcagatgatgatgagaacactgaggaaattggctctactgacgagagcgatgaagatactgatgagagcagtgaagtccaaatgttgcagggaactgggataactgaagaggccaacgaagatgcctctactgaagatgatgatttcagtggtgacctaccaccagaatttgacaatatcatgatattcagtgatgctgaaactgagagtgacattgctcctccagtgctcgaggaaaaccaggctgctgttgcatctgcaaccaaaactgcaaagtctctggatgattctgccatgagttcagagcaagaaggtcctgaggttgacaacattgtgaagtccctggatgagttca

SEQ ID NO: 19492 - DNA, 318 bp, Sorghum bicolor
  Clone ID: LIB3480-055-P1-K1-D2
ctccaaaccgcgtgtcagtatcacctgcagcatcaggatccaagggcagtgccgaagctaaaataaatccgagagggatgcaatgcatagatttgaatcataagcatgatcgaattttaactctattcactgatatttaaaatttttgtgggtgcatctacatccacgatcttacactgctacgagcaagaattttgagggagctagagaaatagtattgagggaggtgtggccgtctaggccttcgtcatagcaattatagtttaacttaatactgctacgagcaagattttagcatcaataattttaattttaagc

SEQ ID NO: 19493 - DNA, 257 bp, Sorghum bicolor
  Clone ID: LIB3480-055-P1-K1-E12
aaacaatccagcgagcacaggcacacacgcacgcaccatggctcgcgatatcgccctcgccgtcttcctcctcgtcgtcgcctccaccgccgtggtgttcgccgcggagtccccggctgcctcgccgaagcattcggcctccacgccatcgaaggcgcccagcgggtcacccgacaagtccgacaaggcccccacggcgtcgcctgagaatgctgccgcgacgcccaaggggacccccgccaaggcccctgcagcgg

SEQ ID NO: 19494 - DNA, 216 bp, Sorghum bicolor
  unsure (1)..(216): unsure at all n locations
  Clone ID: LIB3480-055-P1-K1-F5
gccaaataatcttgctaaggtcctgattgaatgcagagtattttttggagtttaggaatggttttgtgaaatactttggttttggagtaacatgaagtgtttggatgcnnaanaaaaaaaaaaaaaaaaaaaaaaaaaaaaaaaaaaaaaaaaaaaaaaaaaaaaaaaanaaaaaaaaaaaaaaaaaaaaaaaaaaanggggcggccgttttaaaa

SEQ ID NO: 19495 - DNA, 329 bp, Sorghum bicolor
  unsure (1)..(329): unsure at all n locations
  Clone ID: LIB3480-055-P1-K1-F6
ggttcgtgcattcccgacaattttccttcttaactctacagtgcgtgtgcgttatcatggatctcgggccatgaattccctcgctgtgttctataaagatgttacaggcctgaatcctgtgtcattggacgccacatccctggagagaatggaggatacagttactataattgatcacgacaaanagactgaaaaggaggattctctgttatcatgggcaagatcaccagaccgggtacttcatcaagatacatgtcttgcattggctagctcctttgtcctcttgaggttgcttcattttctttcttccaagataatgcatgtattga

SEQ ID NO: 19496 - DNA, 365 bp, Sorghum bicolor
  unsure (1)..(365): unsure at all n locations
  Clone ID: LIB3480-055-P1-K1-G10
cggggagcggaggactatggccgtagccggtcgcggcgggcgcggcaccgcgctcctcctgcgggccctcgcggcgccgaggccttggcagctcgcgggggcgggcgcgcggtgcatccacgaggggccagacaccatcgaggagctgctggaccggcacctcgtgaagaagcccgcggcggtcccggacgaggagtcggcggaggcgcggcggcggctgacgagctcccggcgggaagcgctggcgctgtaccgggacatcctccgggcggcgcggctcttcgcgtggcctgacgaccgcggngtgccgtggcgggaggtgctgcgcgccaacgccaggcgcgagttcgaggagggcccgcggg

SEQ ID NO: 19497 - DNA, 430 bp, Sorghum bicolor
  Clone ID: LIB3480-055-P1-K1-G12
agaacttcctgttcgtgaacaagtcggaggagtcgcctctaaaggccatcgacttcggcctctccgtgtacttcaagccgggggatcggttcaccgaagtggttggtagcgggtgttacatggctccagaggttctcaagagaagctatgggccagagatagacgtgtggagcgctggtgtcatcctgcacatccttctctgtgggttccctccgttttggggagactccgatgagaaaattgcacagtcgatactacggggagtaataaacttacagaaggatccatggcccaaggtctcccagagtgcaaaggatcttgtcaagaagatgcttgacccagatcctagtacacggttgacggcaaagcaagtccttgagcatccttggctcaagaatgctgataaggcttcaaatgtgtcactcggaga

SEQ ID NO: 19498 - DNA, 328 bp, Sorghum bicolor
  Clone ID: LIB3480-055-P1-K1-G4
cccacgcgtccgtagaactagtcgaaggaggtcgccgtctgccaaaaccttgaccaccccaacgtcactaagttcgtgggcccgtcgatggggacgtcgcatctgaagatccccaagaaggggtcgagctccttcagggcgaacgagtgctgcgttgtcgtggtcgagttccagcacggcggcacgctcaagaccctgatgtacaaccaccgggacaagaagctttcctacaagaaggtcgtccggctcgcgctcgatctcgccagagggctgagctacctgcactcgaagaagatcatgcaccgcgacgtgaaggcggagaacatgc

SEQ ID NO: 19499 - DNA, 236 bp, Sorghum bicolor
  Clone ID: LIB3480-055-P1-K1-H10
ccagaaccagatgctattagtgagtccataagtactttgaagtttgccgagcgtgttgccactattgagcttggagcagccaagtcaaacaaggaaggaggagaagtcagagagctcaaagaacagattgcttgcctcagggcagcattagctaggaaagatggagatcatgagagcatacgaagcactcaatcaagcccagacatatatagaatgattatgggtaatgcattaac

SEQ ID NO: 19500 - DNA, 371 bp, Sorghum bicolor
  Clone ID: LIB3480-055-P1-K1-H11
gttactttttccaggtatgccaaagcctgtggtctcttcccaattgttgacaaagataaggcacaaagtgcgctagagaagatattttctttcaatgtgatgaagttcaaggatggtacaaggggagctatgaatgggatgtggccagatggcactgtggacatgtctgcaatgcagtctagggagatatggccaggggtgacatatgcactagctgcaagcatgattcaagaaggcatggttgagcagggatttaaaacagctgaagggatctatcatgctgcctggtctccagaaggtcttggatactcattccaaactcctgaagcctggaacaacgacgacgagtacaggtccttgtgctacatgcg

SEQ ID NO: 19501 - DNA, 227 bp, Sorghum bicolor
  Clone ID: LIB3480-056-P1-K1-A11
cggtcgcgtggagagagcggctagagtctggggcgagtagttcttctgcttcttcttcgagagagctcgccaggatcttgagcctagagtggtcccctccgtctacttcagttatgagctgacaatcccaccattgttctagtgagctagcatatatatatagtataccactctagctacgtactagcagatccagccatatatatattctttcgtccgcgcctagc

SEQ ID NO: 19502 - DNA, 243 bp, Sorghum bicolor
  Clone ID: LIB3480-056-P1-K1-A6
cagtaaaagagaagcttcgttggacgtttagtcttttctagggggatggtcctgccacattccacagtttttttgcttcggggttgtgctttttgcttgtttggttgctaggctctaggtcgaaggtcttttttcgtcaggggagatgttgcttgtcttaggagcccttggacaagaacgaaaggttttccttacagctgctacgaggtttgaccaattctatttcagttttttgcaggggcc

SEQ ID NO: 19503 - DNA, 411 bp, Sorghum bicolor
  Clone ID: LIB3480-056-P1-K1-A8
tcggtataggccttcatatccacctatagagtcgtgttactccctctcgttctgtatagtgttccaagatatatttaaagagttctattagagctagttctgaggttagagcagttttaagaggctgtattcttagggacatagagtcttgaaagcggtctttcccaaagagcttaaagagatcttgcagagtcattgtttctgagtgaggttttgatgtagttcaaagatgcacaaaagttaagtttccttgacatcaaagattccactggtatcgaagattatgtattgtgacggtctctgctatcacttgcatgtggtaaagttcggattctcctttagattcctttaaggagagatgttgtagattaagatgtttttgtattcaaagaagattttagagctcccctc

SEQ ID NO: 19504 - DNA, 423 bp, Sorghum bicolor
  unsure (1)..(423): unsure at all n locations
  Clone ID: LIB3480-056-P1-K1-B1
ggtacagaccgccaaaccacatgagcttcagaagaagttcttctggttaaaacgcctgcgtatacctggggctcagtatgaagtccaaatctctttcaagacacgtctggatatggagtgagctatagtcccaagctccttgatgcctctcagaaggccagatatttttctcatcatcaagtttgaagagccgagactgattctcagaacttgtatccattaggcaatttcgtatgaaaaccagtttttttttaggaaagatttcgatataagtagctgctaattattcatagccttcagaaattgcagcatgttgccatgacaatgctacagattgccttgattctcgaaactttgttttgtactatttccaatgcagtttaagcagtcatcatgattcaagcctttntttaaatncataaa

SEQ ID NO: 19505 - DNA, 294 bp, Sorghum bicolor
  Clone ID: LIB3480-056-P1-K1-B10
agagatcggtccgatcgtgggctcggagagctgtcgcctctgccgccgccgccgccgccatcggcggcgtcagcttagggttagtggtggccgaggggtgtcagccggctccggccgcctacgctgccgtcgtgatcggaggctccttcgaccggctgctcctgggccaccatctcttcttgaaagctgctgcggagctggcgagggagaggatagagttcggcgtctgcgacagacctatgctcgccaagaaacagtatgcctacctgatacatcctatcgagtagcggatgc

SEQ ID NO: 19506 - DNA, 582 bp, Sorghum bicolor
  Clone ID: LIB3480-056-P1-K1-B12
ctagtcgttgctcccgtagagtgtcgtcgccgcgggagctcctagctggcgtcgttgcgcgtcgcggcggtgttagcgttagtgagccttgtgccgtgtggtcgtgttcgcggcgaggtccctcgagggccggccgttggtgtccttcctctgttcctgctgctccgggttcgtcttcgtggtgctgtcgctggtggtgtcggtgttgttcgtcgcctcgctaggttccctggtggtcttgttctcctagctgtcggtcgccgtctcgagcgccggcgtctgcgtcttcgccttcctggtcttcccggtgatgtatgtccccttcttggccttgctgcggttcgtctggcgcctcgtggtcttcgtcctcttcttcgccgtcgtcgtctagctgtcggaggtcgcgctcgccctctagccgcgtgcgcgctgttttagctggggtggtgttgtttcgatctcccgctcttgtttttttatgatctaggctagggttttttctgttttactagtagggttcctcggttttccaggtggagctcctttcttgtactttttggttctaggttctttttttttttt

SEQ ID NO: 19507 - DNA, 406 bp, Sorghum bicolor
  Clone ID: LIB3480-056-P1-K1-B4
gctcgtcgtcgtctgcttcgtcgcgctcgagtagcgcgccatgctcatcgtcgagccgttcctcctgcgcctcgccatcgacggctccgtcgagatctcctcggcctgcggcggatccgtgctagccgccttcgtcttcgtgctcttcttctccccttgctccgtcgccatcctcgtcgaccggggatgcctctccgtcgtcttcgccggcgccgcctccgtcggcttccctcaccgagtcgcgctctacttcctcggcgggccggttgtccgggaggctctcgcgctcgccacctacttggccgaggacgcgcccatcggcctcaccgagttccgcttcctgccgccgccggagtggcgttagggcggcgtccccgaggaggtctggctcgacgaggtggcgctg

SEQ ID NO: 19508 - DNA, 345 bp, Sorghum bicolor
  Clone ID: LIB3480-056-P1-K1-B7
aaatcctaggagcccaaatagctggctctacccaagagagcagcaagagtcccctcctgctagcaacactaagagtaccacagcaagaggcctaagaaggtagggttcagctgattagggaagtatgcttggagccagtggaggaggctctgatgctaccttcttgactcaagttttgcaaaacccaactatgatgcagatgatgcaaaacattatgtctaatcctcagtccatgaatcagctgcttaatatgaatccaaatgtacgtaacatgatggaatccaatactcaaatgagagaaatgattcagaatccagaatttcttcgccagtagacgtctcctga

SEQ ID NO: 19509 - DNA, 220 bp, Sorghum bicolor
  Clone ID: LIB3480-056-P1-K1-B8
agccgtatacgtaaatagtttcattgagcaaaagatacaagttagtcgctagctttctgaggagtacccatcattatctgtttgggcttcgatttttcttcgtgagcggaccaccactccatcactcatatctagaaaaacagttctttttttctttttttttgttcccacgacaaaatcactagagtagctctccggcaaacatgactctagatcgcga

SEQ ID NO: 19510 - DNA, 516 bp, Sorghum bicolor
  Clone ID: LIB3480-056-P1-K1-C12
ggagaggcgttctattcctagcgccttattttcctgcatggcgcgccgcctggtggtgctgcgcatggctgttgtgctgcttctcgccgtggccgtcgtcctctccttcgtggcctcctccgccatggcctcctcgtctctgccgtcgtgcggcggcggcggcggcggcggcggcggcgtgctagttgccccgtcgccgccgtctccgtcggtaggtggcgtcgtcggcgtcgtcttggtgctgctggtgctggtgttggtcttggtgttgctgttgctgttggtgttggtgcggctggtggcggcgctgtaagcggcgctagtagtgttggccgcccagctagagctgctctagttcgcgctggcgtagctcctggtggcgtcgtccttagggtctgggtcgtacttgggcttcgcccgtgagttcttggtcgggctcttcctgctgcgcgcgcgctacggcgtggcgcccgtgatgtgggtctggttgctggcgcggcatgcgcggcgctggtc

SEQ ID NO: 19511 - DNA, 239 bp, Sorghum bicolor
  Clone ID: LIB3480-056-P1-K1-C4
gccgtcatcctctctttcttctgctagcgccggtgcacgccggcgccggcagggccgccttaagcgttcgtcggtggtgtcttctgatggcatgggccgggtcgccgtcgttctgcgctgctagtatgcttgccattcatgtcgagtttgcttctctagagcttagcttcgtcagagtagtttttttttttttgtcgccgctctctgctcgttcgatgcttgctcttgtacgtcgtcgt

SEQ ID NO: 19512 - DNA, 325 bp, Sorghum bicolor
  Clone ID: LIB3480-056-P1-K1-C5
acggccgccctggtcccatgctacgactagtcctagttctccggcatcgggtccagccatcgagtacgccgagagcgccctcaagagagctagagctcgtcgtcattggccattgctgctgcggaggcatcaaggcgctcctctccctccaagacggagcacctgacaacttccactttgttgaggacagggtcaagataggcttccctgccaagatgaaggtgttgaaagtgttcgcttcggagccgttcgaagaccaaagctacattctagagaaggaagccgagaaagtgtcctaggagaacctcaagacctacccattcgt

SEQ ID NO: 19513 - DNA, 542 bp, Sorghum bicolor
  Clone ID: LIB3480-056-P1-K1-C6
acgccatctcctacatcaacgagctccgcggcaagctgacgtcgctggagtccgataagagatacgctagctagcgctgatcagagagcgctcaagaagagtgcgcgtcgcgcggcctcccgcgcacgccgaggggctcggcggtctcgacagcgggccgcgctgcctcgcggaggagatcgacgccaagatcctgggtctggaagccatgatccgcgtgcagtgccactagcgcatccacccgtcggcgcggctgatgtcggcgctccgagagctggacctggacgtctaccacgccagcgtctccgtcgtctaggacctcatgatccagcaggtcgccgtcaagaaggccagccgcttatactcgcaggaccagctcaacgccgcgctctacagccgcctcgcagagccagggtctgccttgggcaggtattcaaggagagctcatctcgcctgaggctgccggttagggacgttactgttactgctattcaccaccggacttttcatcttcgtcaccttggttacaacacgttagccag

SEQ ID NO: 19514 - DNA, 406 bp, Sorghum bicolor
  Clone ID: LIB3480-056-P1-K1-D10
ccctcatctgtaagaaggttactcactagagtcattatttaatcctcctaggcgtcatgagcctgtcgcttttagttcttgtttaggagagagcagtttctagatcctgcttcgtttatagctatatttcctttgttcgagagatgtgtggtatattgtttcatattatccgtcttagagtcttggtatatgctttgctctaagtccttgcttagcctgatgtctttctcaaagctgctttccatgcacatgtgttactgcattttatctatgcttcacatgctttcctgtatgctcggtagcgcttgtttgcctttcggtcttaccagtatatcccactgtacatggactttgtaccactcttcgaagagtcttgctagttcgttttgtcttcttatggagtctt

SEQ ID NO: 19515 - DNA, 211 bp, Sorghum bicolor
  Clone ID: LIB3480-056-P1-K1-D12
tcgggatttctgcctgcccttggtcaggcagagagtccttcgctgagctgatgttcttgttcgacttcatcttcttgtctttcttgttcatgtgctgtgtctgcgtctccttcatggtgaggccttaagcgaagcccctgagagatcctgatggatgtaggtttcttaggactgggctatggagtcttcgtcgttgtctttagcatgttgc

SEQ ID NO: 19516 - DNA, 261 bp, Sorghum bicolor
  Clone ID: LIB3480-056-P1-K1-E2
atggtctatagggcgggcggttttgaggttccatgctcacgctcgcgtgcttgcgacgtcttgtactctgctttcgagtcacctttttccagtcctcaggccgcagtttttcttcgtgcgtgtctgggattaccccggcgtttccctgctttgtcgccttgctgctcttccccctttggcctgctggcgttttagcctagaggcctgcgcctttcgccctttccaactgtcgcgctgcctgtttggcctttgggtcgcgcc

SEQ ID NO: 19517 - DNA, 364 bp, Sorghum bicolor
  Clone ID: LIB3480-056-P1-K1-E3
gcgtcgctcttagctctcagctgcccagtcccgtcgccggcctcctcctcgtctccatcgtcatctgcttcacggccgtcgtcgccgactctgcccgtgtgtctgcgccgccgccgtcgtccgccgcctagccgatcgaggagtatgcggcttgctgctagacgattatgccctagaggagctgcgtgttgctatctatcttcgcctagaccttggcggagtcgttagcgattttcgccgggcccgagctcgccgccgcgtagctctagagcgattcctgcatcacggagagcgcctaggtcgtcgtcgaggccacgtccttagccgccgccgcgtaagcagtcgtagtagcgctcttcgtgct

SEQ ID NO: 19518 - DNA, 509 bp, Sorghum bicolor
  Clone ID: LIB3480-056-P1-K1-E4
gcgtcagggagagagcgagcagcgctgccgtcgtcgtagctgctgcggcgtgcgctgcctgttcgggctggcgcgctgctgctcggaccggctggcggcgtgccggtgcctcaagagcctcgccaactgcgtcttgagcgtctacatgggctccgtcgcctccatccccggctagtgcggcgtctccgagcctttccccatctgcatgtccaccgactgcaacaaggtcagcttaatgatgaaatctaccacgtaagtacatacctgtgcacgtgatgtagctagctagcctggttatattttattttgttgtgtggtttcattctggaagatttattgcatgctgtatctatatagtattatgtaaccgagtgcatcatgcactgtgctcatatacatggatatatatatatatgtatgtgtggcttgcagagcgacctagctagcttctcgatcatgtgctcatgcatgtatgcggatgatgtgtgtgtgtgaacagcttctacact

SEQ ID NO: 19519 - DNA, 468 bp, Sorghum bicolor
  unsure (1)..(468): unsure at all n locations
  Clone ID: LIB3480-056-P1-K1-E5
tcgcagccgccgccgcttcctcggtagtcgaggaggtggagtccccctagttaggagcggcgcctgctccggttccggtgccggtgcccgtcgtcgtcgtcgtcgccgccgctgctgccgtagtcgtcgtggtggcggtcttgttcgtgtcggtggtgttgagtgagcgttcttgttgctcgtggcggtcgtgttgttagtggcgttgcggtagttcctgggctgccgggtgttgtcagcgttggtagcgcggccggagtcagtgctgccgcgtcgccgggaggtggtgcggtgcttcgtcgtctttgtggtggcgcgctcctagctgctggtgtagcgccagtgctgctaggtcttggcgctcgtcggcgccttcgtgtccgtcatggactccttgtaggacgccgnagtagtcgccgccggctagccgctgctccagttccagtagtcggccttttacctccttgc

SEQ ID NO: 19520 - DNA, 465 bp, Sorghum bicolor
  Clone ID: LIB3480-056-P1-K1-E6
tcgctttttttttttttttttttttttttttttttttttttttttttttttttttttttttttttttttttttttgggtttttttttttttttggtttttgttttgggttggttgtcggcttccgttccctcggtcgcgtggtggtccctccttttttgtggggcgggctcctttttttttctcggtggggcctcctcggtcctttccctgctcttcttccctgcttgtggcttattttctttttggggatccctcccccgccgcccttttttggtcttttcccctggtctccgctctttttcccgcggcgtcttgtgttgggtgttgtggtgtttttttttcgcccgttttctgtctccgagtcgctctctttgctcgcccctttttttttcgccccccgtttttcttgttcgcgtgcggccgctcttgttgttccttgctttcgttcgccgtgcttgcgttcg

SEQ ID NO: 19521 - DNA, 477 bp, Sorghum bicolor
  Clone ID: LIB3480-056-P1-K1-E7
agcctagagccatctcagtatcggctagagattttcttcatggttatagcctacagtatttatagtttacatcctgtaagcttcaacctggttagttttgtaaggtttttagtgttttatcttttggttgatcttttggtcttttcggttgttgtggttatttgctcttttcatcgttaggctagagtggttcgtgtagttctggagtagagagaagctagttatagcttctcagtctcagccataaggtataagatgtgatttagccaagagtggtcttcattcgttggtaccctatattatatttcaagccattttcctccataagaagttagtagtccctttaggctggttccttggttagtttgtggaggttccttcgtttttttttagtgctgttcccaatatcgttcctccattttagccgtttttgctagggtagttgtggccaccttttatagagtttcctgttttgcc

SEQ ID NO: 19522 - DNA, 341 bp, Sorghum bicolor
  Clone ID: LIB3480-056-P1-K1-E9
gcgacatcccgccgcgtggcctttccatagagcctccaccttcattaggctactccacctccatccaggagaagttccgccgagtgagcgtgctgttcactgctatgttctagaagaagagctttcttgcataggttctctggtgtgggcttggatgtgatggtgttctccgaagctgagagcaacatgtatgatctggtgtccgagtaccagcagtaccaggatgcctctgccgttgaggaggctgtgttcgaggtcgtggaggttggcttcctagtcgagtaaagagttctggactctggacagccactttttagtacccctctctggacctggttttt

SEQ ID NO: 19523 - DNA, 576 bp, Sorghum bicolor
  Clone ID: LIB3480-056-P1-K1-F6
cagaaagtttatcttttattcaagagcggcagcttcccaagctatcagtagagagctgagtaagaagctgaagatagccgtctccgcatagcagcctagtcgagctagaagagatagtcattgctctcctgacataacctagcatctaagcctagttagtctagagtagacattctgctagctagctagtctaccgcgtttgagctctggaagagagtgcttgctgctacattgaagaccttgctagagactcttgagcgtcaaaaggtgattgttgcattcattgagatgtaattgttgataagctagcgtttgtttcgtaggtagttgcatacaactctgaaagagttcacgtccatgagaaatagtcttgcgtgcgatggtagtgtgctggtgtttgcatatgccagcatataacgattctgggtgtaacatataacattcttttattcttctttttattcccttgttgcatcatatagagcctttgccacgtaggtgtgctgcctaattgtcaatcccatccctgatatggtctatcatggatggtcagtctgctgagtatttgcaatataa

SEQ ID NO: 19524 - DNA, 462 bp, Sorghum bicolor
  Clone ID: LIB3480-056-P1-K1-G10
aaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaagggaaaaaaaaaaggggggcggttttaaaagttaaagagtgggggaaagggggtaggtaacaaatttagtcaaccttaaaaagaggggggggcgctttttaggggaggagtttaaaaggggccggcagggggtattccttgttttttgggggggaactagattggttttgggggcgcggtctttttatgtgggttttgggaaaaaggggcggtggccacaatctttgggaccgggagacatgccagtttgggaaaggggggggtttttgatagggggccttatggggggccctcctaaaaaggcccccctcttttgggggttagggtgggccccctttagggggttttttttaggggggggggggggg

SEQ ID NO: 19525 - DNA, 493 bp, Sorghum bicolor
  unsure (1)..(493): unsure at all n locations
  Clone ID: LIB3480-056-P1-K1-G12
cctcatcgaaaagatgaagaacctcctcagagagcatctagctctgagttagagttttcttgagaggcaggtaggattataggttctctacaggttcctctggtcccaacattcatcatcccgccttcatagagtccctagagctcctcacctcgctggttagcttacattttcttgttcctgggatccactttcctgaaaagaatctgtttcgatcttgtaagaggaactgtaagattttttgaaagtaggattacgttgactgacatatctggatttgagtttcagaaaaattttgcttggactgaccgcttgagataggtatataggcattgttgaggcttaagcttcccttttcgttctttttctcagctaatgtacacactttttttttctgtctatctggtgtcagtgctgagacttatgtggcatctgtcctggcagtacattttgagtgttcgngaaaaaaataatttattaaaataataataaa

SEQ ID NO: 19526 - DNA, 541 bp, Sorghum bicolor
  Clone ID: LIB3480-056-P1-K1-G6
cgagctctgccgattcagcttcatcgagctctgcccctcctccggcgttctcttcttcgcccagaggctgttcgaggggttgttgagcgttccggcggccggtccggtctgggttctcgctgttccgtccggaggtgttcgcgcggcggttgctgctcggcgccgtacgcttgtgcatgccggctccgtcggtggtgctgttcgtcctcgccgtcttgctgtccgtcctcgccttccggcgctgggtgccgccgctagggtagggagccctgttcctccgtcctctgctcatgggctgcggcccgttccttgggctggctccggcccccgagtactctttcctcgtctacgctgctcccgtcggtttctacttctaggagggcctggcgcccatcttcctggtggtgcttgtcgagttcctccgcgcgatgcccggcgggtccggcggcgtctagtccttcgccttctacgcgccggtgctgtaggctctgtcggtcgcctagtgctaggggttctcggtcgtgctgtacctggtctcggt

SEQ ID NO: 19527 - DNA, 464 bp, Sorghum bicolor
  Clone ID: LIB3480-056-P1-K1-H10
agagcgtcttaggttcggctagccgtcaggcgccggccccgtcgtcttcagtagcgcgtgcgggtacttagatgtgttctagagcccccttcttctgcttgggcgcgtgcggcttcctccccttcttcttagtcagcctcggctgtggctcctgctttgagatcttgtgcgtctagcctgccgagtgctccggcgtggctgtggtggtgctcttctcggtcttgttcttcgtgcttttcgccgccttcctcttagacctcgccggctcggctttcggtgccttggccttgtaaggcgtggtggtgtagctgcgctaggcgggcttcttcgtcttgcttttccgccgggtctagtgcttgttcggcgtttaggtctccttcctcgtggagtaagggagcttccccttctacctggcttagctggtctagtttgtcgttggcgtcagtgtcgttgtgggggtggtc

SEQ ID NO: 19528 - DNA, 483 bp, Sorghum bicolor
  Clone ID: LIB3480-056-P1-K1-H2
ggagagttttccctcccagagagagcagagcttcgagctggggtggttacgcttcgagtagcgtagagatctcgagttgctctatgtgattaaaggctaggtctctttcttgagcggagtcattgtcattgtctgctccttgcctgtgccgccgctgcctgtctttgcaagccatctgggcctcctactggattccgcttaggggactgatgtgtctttcgtcgtcggcggagtagagttccatgctcaccgtgctgagctcgcagcccgatcaccggtcttgtaagcggagctctttggcgctatggctgtcgccgctatgccttccttcacgctgctcgatttcgagcctgctgcattcagagttatgctccagttctagtacacagttgcctagccttaggatgtcgagctaggagaccctctcactgagttgttgttgctttggctggttgcggctgtccgttttgctctggaccgtct

SEQ ID NO: 19529 - DNA, 277 bp, Sorghum bicolor
  Clone ID: LIB3480-056-P1-K1-H3
acagcccatctagccgcagcgcggagagtggggcgttcgctctcctagccgagcgtccttcgcctccctccgttagcgcccgccttcggtcgcgcgtttccggggggctgagtgagtgtgtgagagggtgggtggtggttgggtgtggtcgggtctggatgctcgggttctagctgatggcgtggtcgtcgtcggcgcaagcgcaagcgccgtcggagcagctttgcgtaagggcggcggccgtcgtggcagcgcgccaagggatggagtcgccgct

SEQ ID NO: 19530 - DNA, 339 bp, Sorghum bicolor
  Clone ID: LIB3480-056-P1-K1-H5
gagaccgcgaaggaaccgttgtcgtgagacggtggcggtggctccttcgaggttagtggcggaaggatcttgatctgaagtcttcctcccccttcctccagtcctggatctgatctaagccctcctcttcttctatctactccttctcctactgctcctctagatctaaaggtagaggaggtggcttgggtttcagagagatagggaggcgcatttctcccgagtattattaaggtgttctccagatattgcagcatgttttcacttgttgtttcagtagagctaagcttctggcaagctctcgggttcaaatttcaccattgctgcaatagttctctc

SEQ ID NO: 19531 - DNA, 260 bp, Sorghum bicolor
  Clone ID: LIB3480-056-P1-K1-H9
gacccttttagagagtccagagcttcatttagagagtcttcatgactacctatcgagagctggggtcttcgctagctgggttcctgttcgtgctggttcatttatatgtgtgtatgctggtgaggtcattgatgtgctcagagttaatttgaaagatagcgaagatgattacatttttcaaactgtatgccctggtgagatatctttaataaggtttagtggtcctgtaatgttaggtgtagtaagctcatttgtatcgt

SEQ ID NO: 19532 - DNA, 355 bp, Sorghum bicolor
  Clone ID: LIB3480-057-P1-K1-A10
ttcatcggttgcgtgtaatttccacacacaccagatccaactccaatccaatccaagaagagaaaacacgcacaccatggccactcctccatccgtgctccgcttcgtagccgtactgctcgtcaccgtctacctccgatccaccgccaccgacgcccgccacgagaagaccacccacctgcacttcttgctccacgacacgctgagcgggaaggacccgagcgcggtgctgatcggccgcgccggcgggcgcgacccgaggccctacgttctggtgtcggacgcgcggtacgtggcgcgcgagcacggcgtggccgtgaccaccgtcgcgtttcggcccgaccgcacccgggtg

SEQ ID NO: 19533 - DNA, 209 bp, Sorghum bicolor
  Clone ID: LIB3480-057-P1-K1-A12
gctccaatacccactcaccaccagattcaacgcgcgactccaacccaaccgaccgggccgcaccacgcattccgcacctgcgtcctgtaccagaatctcctccgcgccgcccgctccgcgcgccgtcgcgagttcgcgtgccggccggcagaccgcgcgcggcggcggcgacacgagggagccatgactggacaaggggcggcgccacg

SEQ ID NO: 19534 - DNA, 283 bp, Sorghum bicolor
  unsure (1)..(283): unsure at all n locations
  Clone ID: LIB3480-057-P1-K1-A4
cgggacggcgattatgctgacgcttcgacaaccgcggacatgtgcgagcgtcacggtcacaacatctagggagccgctactacgctccggngagcaagtnntctacatcagctgtcatgctcgcccggagcactacgcgtgcgcggacgagtacaaaacatgccggacaacgacactccgctgcgagcaaggtcagtggggctcgccgctgagcggcgtcctgactcgcgacgtgcgctaaaaatgaccatagcaaggccccaggcccctcagtgttcggatt

SEQ ID NO: 19535 - DNA, 471 bp, Sorghum bicolor
  unsure (1)..(471): unsure at all n locations
  Clone ID: LIB3480-057-P1-K1-B11
gagacagggaccttctccaagaaatttcaaggtggagcatcttcaaccaagaccgaccaggcaaaggctccgagcaagctatcatctgcattctctggaactcaagataaatgcgcagcctgccagaaaaccgtgtatccattggagaagatgacgttggaaggcgagtcttaccacaagagctgcttcaagtgctcgcacggnggctgcatcctgacaacctcctcctacgcgcgctcaatgggatcctctactgcaagatccacttctcgcagctgttcaaggagaagggcagctacaaccacctcatccagacggcgcagaccaagaagaacgaggctgcggaggccgcaccggaggcaccggcggatgcaagcgcggctgagccagaagcagcgtagatagcagcaaacgcaaagaaaaatagagccgngtgtgtgtgtgtgtgtgtgtgtctatcttctatatata

SEQ ID NO: 19536 - DNA, 548 bp, Sorghum bicolor
  Clone ID: LIB3480-057-P1-K1-C5
cgtccatccaggccttgagcagtcccatcacgacggactccacctcgaagggctccatgtcgcccacgacggtcttggcccggccgtcgtcgcagtccgccgcgtcctcggccgtcatctgcgccagggccttctccagcctgctcgccgagtggagcacgcggacgagctcgtcggtgaggatggtcaccttggcgaggtactggctcagcacgacgccgaagcagccgtgcagggtgaccgcggacaccgccaccggcgcggggtgccaccgtctcagcaccgggctgaagttcctgcgctcgaacatggccagctgctccgtgtccctggcgagctgcatcaggacggacccagggtcgctgtcgcggtcgatgatcacgctgtcggactcgccgaggtgccatagacttttcacgtctggaggaagaagatgatgtgttattacttgatcatgtcaagaagcttgcaagggaagggcatctcgacgccataattgaccggtacctgaacaacaattaccacgggcaggagggggagatgatgat

SEQ ID NO: 19537 - DNA, 184 bp, Sorghum bicolor
  Clone ID: LIB3480-057-P1-K1-E3
ctcaaccgctgctcagagcgacgacacagactcggtccgtacgtttgcccgcacgcaccgttacagatgttcagtcgaggaacctaatttgatttcaatggccactatcaaacaacactcaagactgccagttgatcatgggccgctacaggatgggccgtctactagattgcggcacctttgg

SEQ ID NO: 19538 - DNA, 582 bp, Sorghum bicolor
  unsure (1)..(582): unsure at all n locations
  Clone ID: LIB3480-057-P1-K1-E9
cgtcgcgccacttctgtcacgtaacacgaaaccatccttctaaaccaaactacagatagagcattagagctcgtgtcagagaggcaagcacaaaatggcgttccacagaacaatgacccggtgcctatgggcaggcaagaacgcgggcgcagccattcccaagcctcccgctccccatcccccggcacggcggtctgtgccggccgtggacgactgcccgacgctcgcattcctgcggcccaagccgaccgcggtcggctacgccaccgcgaccgtcccgctcccggcgcactgcttccccgccctccccgtcggcgaccacctctttcaccgccacggagccgtccttcgagggcttcttccggagccgcttcgcgtccaagcagcgccgtctcatgcgggcgcgcggcttcgacgtccaccgctacaacgccctgcggaaacggcaggggctccttcctctcggcgaccctgacgcgtacgtgtaggcacgtcagcgatgtacaatagctagcaacacgtcggcccccgggaccggacgaggtcngcttggctcgtgcgtttgccagggggcacacgtgt

SEQ ID NO: 19539 - DNA, 535 bp, Sorghum bicolor
  unsure (1)..(535): unsure at all n locations
  Clone ID: LIB3480-057-P1-K1-F9
gcgcacgagttaagaaggtagtactgtagtggcgtaggagcccagttggtctatgatctttctctgctggggaaagagaagaacatgagaccgagcttataatcactcacacactagtgtatagggcttcggcttgcctgatactgtcccaatggcagaacggctcttgtgcatggagcacccatgggtctctgcttttggcattctaggcaacatcatctccttcctggtgttcctcgcaccagtgccgacgttgcttcgcgtgtaccggaagaagtcgacggaggggttcagctcggtgccgtacgtggtggccctgatcagatgcacgctgtggatcctgtacgcggtggtgaagaccaactcgagcccgctgctgaccatcaacgccttcggctgcgtggtggaagccacctacatcctgctctacctcatctacgcgccccgggccgtcaggcttagggcgctcgccattttcttnctcctcgacgtggccgccttggcgcttatcgtcgtcgtcgtcgtcgtgctcgtc

SEQ ID NO: 19540 - DNA, 425 bp, Sorghum bicolor
  unsure (1)..(425): unsure at all n locations
  Clone ID: LIB3480-057-P1-K1-H2
gcaagccacatgaatgccctgtctgtactcaatatttcacgcttgatgtgattgggcaaggaggatctccagatggacatgatgatgacgatgaccatcaccaccaccatcactaaggttctgcagcgcatggcaataaaatgcagtgccaataccattttggccacagccttgtgaagctgtgcagaacttcagcctgttggccttgtagtgttcagtagacctgaccatgtcaacctgtttgccaattgccacacagctaggaagctggaacatcacgtggtttttgttacatgatccttacagaaactcggctatataaataatgggattcattacacaacggtgcccttttgctattcaacaacgttctgttgaaacaagataaaagaaaaacttatttatcaagatgattatatatanta

SEQ ID NO: 19541 - DNA, 179 bp, Sorghum bicolor
  Clone ID: LIB3480-057-P1-K1-H9
gcgtacattcaagatcttgatcaacactcgtgctgacacatctacatgaaagacctcactgctaccggtgggtggcggcatgactatcaccgatactgacaccttttcaatatactagaaggggactatatatagcaacatgtttatttacatattggacatacaggatatcaatcttt

SEQ ID NO: 19542 - DNA, 111 bp, Sorghum bicolor
  unsure (1)..(111): unsure at all n locations
  Clone ID: LIB3480-058-Q6-K1-A11
ggcctagancgcgagcggacgcgctagcagagccaagctgaccttcgcgagcatgcgagggaacgagcgccgtatagggcgacttaaactcaactcactggcacgatgcac

SEQ ID NO: 19543 - DNA, 250 bp, Sorghum bicolor
  unsure (1)..(250): unsure at all n locations
  Clone ID: LIB3480-058-Q6-K1-A5
cccacgcgtccgagcgagaactcgagagagggagacaacaaccgnccatggaccncggnnnggcggncnnnnactcngcgaatcagagggaangcaaagagaacnnaccgannncgnncatagggcgccngannnngancgagcngncncggatcncgagnatatcagcctattgtgtacttgtattctatttggatcgcccgtgtagcattatattgctatgatttcgtgatctacaggttcaatctcg

SEQ ID NO: 19544 - DNA, 130 bp, Sorghum bicolor
  Clone ID: LIB3480-058-Q6-K1-A7
cgcagagagtcgtgaatggggcttcaacaccttctaaactgacgaggcgatgcgaaccgccaccgagggcgtgaactgaaaggagctcgacggccgaaacatcacagacaacgaggcacagacccgctgc

SEQ ID NO: 19545 - DNA, 431 bp, Sorghum bicolor
  Clone ID: LIB3480-058-Q6-K1-B9
gccgacatatacactactcaaaataacaatcgagggcggacaagagaaacgagagcggaaaaacaacatggagagctcagaggatcaaggaggactcgctcctactactagggggtggccttcgcaggcgccgccgaggtccgccgcgtgcgtgagctgatcggcgagaacgcatggcagcacacatgcaaccagacgcactgcaagaagacaagccagagcttgacaaaactcgggaaggtgacaacaacaagggagctcctgatacccccatgcgccgagggggggataaggcgaaggaggccaaaaggagcgtggaccaaaacacggggagatcctaagagggaagggcgacggaccccatactgagctcataaaactccgggggcgagaacgtaacgcacacgctgaccgatacagagaacagcgcc

SEQ ID NO: 19546 - DNA, 615 bp, Sorghum bicolor
  Clone ID: LIB3480-058-Q6-K1-C5
gccgcactgtggccgatttgtaacccgagcgcacaaaggaatctgaggacccacaagacaacgccctcgtgcagtccctcctcttcgccggcttcaagggctaccgcctcctctaatgacgacagattgccattcacgcaatagaagtggcaggggttagcttggaccgatgaggaaaacaataggatccaatatctgctgaaggagatagatgacttcctggtcctcggcatcacaccttcagtggacaccgaggtgagtcaggcagctacagcaggagcatggggacgaggacattctactggagtacatgagacatggaaagctgctttggtttgtcggtccgaaaagacaagtttgtcattggcacaaccctataccaatcatgtgtttatttccgtataactagcatggcttcgtcaattgaacgcatctgctatgtcagcctctgtttcccttctagaggacgagtaagaagatgcagcaccttaggatgggaagagccattgagacgcatgtgcctgctgatgctgatggtcgtcagtcgacacccccgggcaaagtggatttcaactgtgagctgctactgtgcagcaatgatgggaggcagcagtt

SEQ ID NO: 19547 - DNA, 546 bp, Sorghum bicolor
  Clone ID: LIB3480-058-Q6-K1-D12
gcgcagggagacagaagcccagggacatgaggcacatataattggtactgagcacgggtgccgctgggtgagcgcatctaccatgaacaagtgcagaagaccacacagaggcgattagtagaggccgtgcatcctgcaagaaaagagccggcgaggataaccataggagagacgtaagcgatgcaacgatggacatatctacaaacggagctagatggtgcatgctataaggacctcaagagattacaagaaaatggcaggaaaactactctactggtgctagatatggagccagcatattcgactgtggagatgttgcgcaagctcccacaagaagttgacaagactggaactgccaatcccaaaactgcaaatgctgctgctactggaaatgccaaaactgcaaatactcctactagttcggatgatcgttacactgatgcacatttgatgaggattgcttctaatgtgttcacatacattggcatggcatcagaaaccccgagaaatactatccccaactcttgggtccactgacagggccac

SEQ ID NO: 19548 - DNA, 519 bp, Sorghum bicolor
  Clone ID: LIB3480-058-Q6-K1-D2
tcagttgaggtttagggctgctgttagatgggcctgcttacaatgcctgtgttagacagggcactcttatttggtgtatttgagtctggatgcttggactggccaataatgtagtagggagatgagcttttatcagtcaacggcattgatgtaaggggtaaatctgcatttgatgcttcattcatgctgcaaggtacaaaggagacgtttgttacaattaaggctaagcaccgtgactgtggtcctgttgagtcaatgaaggtgcacagacaactggttgttagaactgcagttttctaccgtttggacaaaagagaaaatgatgattcatctgttgggtatattcacattacagagttcaatgcattggtcaaaaaagatttgcgctaaaacgtctacagaattcaggcacctgctatttctttctggattcgagggacaatcttgttggatcagtgcaagctagaatcgagatagcaaagctctttctgaataaaggacacacggccattttatact

SEQ ID NO: 19549 - DNA, 305 bp, Sorghum bicolor
  Clone ID: LIB3480-058-Q6-K1-D3
gcgtatgtgctgctcaactgccagaggcggcctctcccgaggcgtctgcctctgtgcgccgtgctccgtaacgtagcgtgagacctgcatgggaggaggactctgccgcagcatcgacggacgagggggccatcctttgtgcgaccgaccatggagacaaaggctggaccttgactgacgggcggagctaggccgcctggtgcaaacgacgcggacgaaacaagtccagcagcgcgtgctaggagctcgtcacccgatgataccgggggcgcatgcggtgacagggggatcgagccggaccactc

SEQ ID NO: 19550 - DNA, 538 bp, Sorghum bicolor
  Clone ID: LIB3480-058-Q6-K1-D6
gagaatgcggcacaggtgaatggggagctgaaagagctgctgctgttactgaaggataagtacgatactgtgcttgagaagaatgagaaactggagggccagatggttgctctgtccacttctttgcagtccatgaaggaagagttgctcctgcagaggattgaagatcaacctctgctgatgctagcgcaagagccttgagaaggtgacaagcaagaagccggtgcgaacaatgctttggtgtgtgcaggcaacgagctgactgatgctgatgccgacgatggcagcttcagcagcaatcacagtgcctgtggtgacaagaagatggcgctgaggaaacgtatctgcatgcgggagggagcatgccagtggccaaggtctgctgcttccggtggcacggccggcagccctgggaacctgccagagccgctgactcccggcgcggatctggtcatcgccgacttcgacaccatgatcaatagccttgcgccaccgtccatggatgagtacctgctggtcgatggtcttcccacgccga

SEQ ID NO: 19551 - DNA, 544 bp, Sorghum bicolor
  Clone ID: LIB3480-058-Q6-K1-D8
cggcgtccaacaagtcagaggcgtcgccttccgaggcgcccgcctccgggtccggcgctgcgtcacctagcgagagcggcgcgtcggagaaggcccccaccggtgcccccacggacgcgtcggccagcccttctgcgtctccgtcaggagacgaagccgccgcatcgcctgacagcagcagcagtgccgcctccgaagaaccttccgccagcagcgagtccagcggcgctgccgaggagccgtcgacggctgagtccggcggcgcatccgccgacagcccgcccgagccggcccacgcttcggactcgccagcggagtctcctggcccggccgctgatcacgagggcggcagctcgagcttgggtgccggcgtcggcgcggccgtgctggccgtggccgcggcctccgtgatgctttctttctagacggccgcggtggctctgatggccggcatcagagtctcagatgagcaattctttgggaatctgtatttatggtggtatgcatgggaatgggagtgtcgaccactacgctgattaggagt

SEQ ID NO: 19552 - DNA, 421 bp, Sorghum bicolor
  Clone ID: LIB3480-058-Q6-K1-E1
gccgccagctcaacctcaaggtgctagagcacgcgccgtgcaccacggccattctcgccgaccgcccgttccggagaagcggcaccagcttccagctgccgatcaagatactgacaagcaaccagggcgacgagaaggtgacgacccacgtcgccgccgtcttcctcggcggcccggacgaccgcgaggccgttgccgtcgcctgccgcctcgccaagaacgagtccgtcaggctcacagtcgtccgcttcgtgctccgcgaaagcacggacgaccgcgtcgcgacgacgagcgccgacatcgacggggatgtgtccgtggtcgtcgacgacccggacgaggagtgcgtgtcggagttccagcgcgagtacgtggcgaaggagcgcgcggagtacgcggagaaggcggtgacggggcccat

SEQ ID NO: 19553 - DNA, 394 bp, Sorghum bicolor
  unsure (1)..(394): unsure at all n locations
  Clone ID: LIB3480-058-Q6-K1-E10
gaagaaaacaatnaggnacaacatcaaagtagcatcatcatattcattatgagaaaagttacatcatttatcggtttgtgggcagatgttaatgatcttctctataaactctgtctatggtagctcgacttaggacaaccttagatccttatattataggatggagggagtacatgtagtactcatcctgacctaaatgcatagtactagatatcatgggctgaaacatggcgaccaaggtctattcatgtgttaaagctagaggagtcatccttgctcttattattcccgtttcttctttttctgtcactatttgggatgagagcaatcataagagaggcgattgtagtcactacaattttttacacgaattttagtcactacaattatagcc

SEQ ID NO: 19554 - DNA, 564 bp, Sorghum bicolor
  Clone ID: LIB3480-058-Q6-K1-E5
gacaccgactacaacgacgatgcctccatcggcaccaagatcaacaggaggaagcctaatcgcggcctcgtcggcgacgagaagcggggccggtccgagtgccctgggtgccggaggccgttccagccgtaccaagcactcggggtgcaccgcgccagccacaagcgcataaacagtaactgcagaatcgccaaggccgtcgttcgaccaccaaccggagcaaagcgtcgagaccaacacctcctggtttagcacggggtcgccggacccgaactacggcggcgctgacatcgctcccactgcggtggtggccttgaaggcgaaaccgcacaagccgatcaaattcgagtgccccatctgtttcagggtgtttggctcggggcaggcgctcggtggacacaagcggtcacactcgatcgccggcgagctctatgagcgcgcacatgctgtcgaagacgatggcatgggtgacgatgagcaacctctggtctctgatggatttcttgatctcaatctgccagcaccaggagttgaggattgaaagtttgcatggatggttcgagt

SEQ ID NO: 19555 - DNA, 350 bp, Sorghum bicolor
  unsure (1)..(350): unsure at all n locations
  Clone ID: LIB3480-058-Q6-K1-E7
aaaaaacaaaagaaaaagaaaaacaagaacaaggaaggacaacaatgaagaaaaagaaagcaaagagggagagaagagacaaaaaaaaagaggggcggccggacaaaaagacccaaaccaacgnacgcgagccggcgacgaaaaccaaccaaaaaggggaccccgaaanccaaaccacgggccgggaganaacaacgagacaaccggaaaaacccggcccggaccaaaccaaagcaccaggcagaacaaccccccagcaccagagggggaaaaagcaaaaaggcccagaccgacagccctncccaacaggggcgcagccggaaagggaaagggaaccccccctgtatcgg

SEQ ID NO: 19556 - DNA, 561 bp, Sorghum bicolor
  unsure (1)..(561): unsure at all n locations
  Clone ID: LIB3480-058-Q6-K1-F2
aacatacaaantatgtcaattatcaatcactgccgcagcagccactactgtcggagcagcagattacacctagcatggcatttggacctcacatggcacaccgccccatctatacttcaacgactggtatggagccttatgcgtatggtgcccactcaggcagtggcatctaccatcagcgctgatagcatctcctccctattcagttgcttgcctatgcagcttagcagcaaacgtgaagtggtgttttaacctcgtgcagactaagatgtgctgccatatcccttttaagacagtacctatggcgccagcaatattctccttttaaaaatttcttttaggtaccagctattatctgcagtaaatcaggacgtggtgtgcatctgaaacaagtttcatatacctaactatgagatcatggcagtctgaatttgaaccgaacactactggaaacttaaaattctattttctgtcggtatttctattacacataatttttctattttcctgtcttgaacttggttttcttatcaagatatttcaacacagaaatattatagg

SEQ ID NO: 19557 - DNA, 279 bp, Sorghum bicolor
  Clone ID: LIB3480-058-Q6-K1-G10
cggacgcgcgggcgcgcgagcggctacaacctaggttcctagttcaagtgcgcaccattgctacgcacgggaaaacacatcttgtcggcgcgcttgacaatagtctaccgcgtcctgcagggcaccgagtggtaaaacaatgacctcaccaaactgaatggcttctcacgacagcgcatttacgccaggggttgcattagcggacacgacctcagcatgcctagctcacagaacacgagccaaaccagaacaacgaatgggaccccgcctggaacggcg

SEQ ID NO: 19558 - DNA, 199 bp, Sorghum bicolor
  Clone ID: LIB3480-058-Q6-K1-H4
acgaagagagtaaaattgtgtgtaacgtgtactggacagtcatgtcgctcggtaaaccagaattactgacttatctctggctcaactctgccaatgtaattgggcgagtgctacactcctgtcgagatgttgaatacatagcggaccatttctatcatgagcagagccaccaccatgtcctttctatcgctctacaacg

SEQ ID NO: 19559 - DNA, 212 bp, Sorghum bicolor
  unsure (1)..(212): unsure at all n locations
  Clone ID: LIB3480-058-Q6-K1-H9
cccacgcgnccgcgagcagcngnncaaggagaccgggagnnacaacaagagcnnccaancacaancacccgcggagannacnccggaaaagggggccccngagcngaccagancaccaagcaaagcggcaaggangnnnncaggaacacaagacaagngngcgacnggcaggaaaaccgcananccccnngagaagggaacagnngaagaaa

SEQ ID NO: 19560 - DNA, 154 bp, Sorghum bicolor
  Clone ID: LIB3480-059-Q6-K1-A8
ctttgatggcgagcggtcgttctctctgttccttgcttcacttattagctagcccatatttcttttcatttctactcccccatgttctattctgctggaacaacttacacggcagagaaggggggcaacacgaaatcatggatatactccatga

SEQ ID NO: 19561 - DNA, 459 bp, Sorghum bicolor
  Clone ID: LIB3480-059-Q6-K1-B11
ctcctccgcgcgccccttggatcccgacggcggcggcggcggctccccaagctcgcacacgggagcggccccctggatcccgccgacggcaacccctagatcccgacggcggcagctacccaaggtcgcgcgtggtggtagtcgcgtcttccctgagctcgcgcccggcggaccctcctcctcctgctcctcctcctctgcgcgccccttggacccctacggcggaggtggctccccaagctcacacacgggagcggccctctggatcccggcgaccgcagcccccaaatcccgaccgtggcggctacccaaggtcgcgcatggcgtttgtcgcatctccatagagctggcgcccggtcccttcctttgttgcaaaactgaagatccctaattcagtaattgattacagattctaaaaaacatctctggcaggagtacggaagagcaatgatggcagga

SEQ ID NO: 19562 - DNA, 609 bp, Sorghum bicolor
  unsure (1)..(609): unsure at all n locations
  Clone ID: LIB3480-059-Q6-K1-B7
ctagaattgcgggttggcatatgttctgttcttatagaaaaataaaaccaagttaaagcgacaacaactagaatttagtttacccgttttaaaaagccatggatctagtttatactcacagcgatatgatctccaccatggcactttgacttgtaagttcaatttaaatatactactaatctaacactattctctactaaaaaacaattttcagaggtgccttgattttttttagacgtggttttatcggtagggcacggtggcctggcctgaggacggcgttggtgcgttttcttgttttccttttttcggttttcagtggcgggctcatgttgttttggatttctagggaggctagtttgagaacctgcctctacaaaatactctatttgtagcaacacatgcttagtaatgtttggagcagccaccgctaaaaatcgtttagctgttgttgtaaataggttctatggtagtgtaaatagaaaaggctactccctccattctttntttaactgtcattcagacatatcgaggagccaaagttgtacaacactgaactgtgaattgtggcctttcaaggtatgtaatattccatttatctcttgagct

SEQ ID NO: 19563 - DNA, 533 bp, Sorghum bicolor
  unsure (1)..(533): unsure at all n locations
  Clone ID: LIB3480-059-Q6-K1-C1
gtgctcctgtgctgcaagaacgggagcaccggtcgctaccgcacgtctactacctccctcgattgacggccaacatcatgtgcgttgggcagcccgatgaaggtggctactagatccgggtgaaggacggcgtgatgctcgtccgagacgaggagatgcggctactggcaaggatcccttgtgtcccagggcgtctgtacgtgttggacgccaccatcgcacggccagtgtgccttgcggctcgcgacgtcgaggatgcttgggtatggcacgcccggttcgggcatgtcaacttcgctacgcttcgcaagatggcacgtgacgaactcgtacgccggctacccctgctcaaccaggtggaacaactctgcgacgcgtgcatggccgggaagcaacgtcgtacgccgttcccataaaaggcattgaagcgctacaccgaggctctccagctgctccacggcgacctctgtggcccgatctcgccgncaacgcctagtggtaaccgctatttcctccttttggttgatgactac

SEQ ID NO: 19564 - DNA, 475 bp, Sorghum bicolor
  unsure (1)..(475): unsure at all n locations
  Clone ID: LIB3480-059-Q6-K1-C2
gcgacgcgnccgggcacgaacgggaggacgggccgaggccgcacaacaactaccccgcgcgaaggacgggcaacaccaagcccgacgagcaaaccggggaaaggagctacaacaacccggcgaaggacggcangaagcccgcgcgagacgaggagaagcggacaccggcaagganccgaagcgtcccagggcgngagaccgtgtcggacgccaccaccgcacggccagngngccgagcggagagcgacancgaggatgccagcacatggcacgcccggtacaggcatgtcaactacactacgcttggaagatggcacgtgacgaagctcgtcgccggctacccatgctcaaccagcagggacaactctacgacgcacgcatggccggaaagcaacgtcgaccgccgttcccataaaaggcatagaagcgctccaccgatgctctccagctccttcacggtgacctctgtggtccg

SEQ ID NO: 19565 - DNA, 279 bp, Sorghum bicolor
  unsure (1)..(279): unsure at all n locations
  Clone ID: LIB3480-059-Q6-K1-C3
nccagaccgcgagcggccgcgcgagaggagccaagcggacgnacgcgagcatgcgacggcagagggcgggaacagcgacgccnagaaacaaaacacgggccgaggncncacaacgncgngacagggaaaacacgggcgccacccaaganaagggcanggcaacacagcccacggncgccagccggcgaaanagcgaaaaggcccgcaccgancgcgcnggccaacaggggcgcagacggaaaggcgaaagggacgcgcccagcagcggcgcagcaagcg

SEQ ID NO: 19566 - DNA, 458 bp, Sorghum bicolor
  unsure (1)..(458): unsure at all n locations
  Clone ID: LIB3480-059-Q6-K1-D10
atcggagcgcacctgcacgcagacgcgaaaaaacggaagcccgtcaaccggcccggggncggncgcaccagagacggctacgacaggccagacggacagaaactnccccgagacgagaaacgccncgcngacggggcaacagnagacgctaaggaggagcgaccngcacaccaagagacaatcgttccttggcgtttctcgctcatcattttttttaatatacaagcagcaaaagtagaatcttgctacatcaaggcatgcaattatatggtacaaaaatagtgagtagatgttaactcaaacagttgctcagtgactagtatcagattaaatactcctaggcgtcgaacagaggaatcgaattatatgtgctgggctacaagaagagtttgaagctctcgatgtcataagaagtccgatcaaattgagtattgaacagaaatgcttgtaaggggatg

SEQ ID NO: 19567 - DNA, 286 bp, Sorghum bicolor
  Clone ID: LIB3480-059-Q6-K1-D12
aaaaacaaaaaaaaaaaaacagacccacccactgaaagggcggcttgacaggaacatcgccggtctggctgtggcggctctttgtgcgcgacacacgagtcaaacacctatggaaaatgctgacctggacgatgcgcatgcacctgcggtccagacgcatgtagcaaccaacaatttctactcactataatgaataccagggacataatacttgtaaccatcccgtaattgattgtgagaggagcgtctcggagatcgaacttggctatcccaaccgtgcgacata

SEQ ID NO: 19568 - DNA, 384 bp, Sorghum bicolor
  unsure (1)..(384): unsure at all n locations
  Clone ID: LIB3480-059-Q6-K1-D4
agccggacgacgcggccancgaccacgncaccgnaaagggcnacgcggcgcgcgacgnnaaggccgncgncacggancggcgcaaggggnacgggggcccngaggcgnggcccnaacnggaggaagggggcnccnaccaggnngngcaagagaggcncnncgagaacgaggagaaggagaaggagaagaaggaccagcagcngcngcnggagnaacaccaacagcaggaaggccagcaaggggaggaagagcggccncagcaccaagaaccaacagcagaagaggaagcggaagacccnangnncaaagaaccacaagaaaccaaancaannncaaangaggcaccagcagagaccaagncagcagaaaaggaagnggaagacc

SEQ ID NO: 19569 - DNA, 377 bp, Sorghum bicolor
  unsure (1)..(377): unsure at all n locations
  Clone ID: LIB3480-059-Q6-K1-E8
atcaaatntacctgtttctgcttcatggtatataaactttcctagtatctatgaatcgcaaatttttaattcaaatattacagtgtattactttcctgtcctgttaggctgatggcactggtgagagactgtagaataatatttttcctttgtgatattattacagtgctgtctctcctagttatattacaaccatgtgatatacctgcatcacatattaatcattcatcactatttcttcaatgaacttattttattaccactttccttaaaatctgtactgcatgactctagtttgtttctcaacatgaatgattctttactatgctatctgcagatcattatgatgtaaaaatgccttgccatttgattctctc

SEQ ID NO: 19570 - DNA, 128 bp, Sorghum bicolor
  Clone ID: LIB3480-059-Q6-K1-F12
cccacgcgtccgagttattgctgcttttttgggaggatgatggcgtagtatttaaagaatatttcacacacctactagtaaattttgtaagcttgtagccccttgcaaaggattagttgaaggcaagg

SEQ ID NO: 19571 - DNA, 206 bp, Sorghum bicolor
  Clone ID: LIB3480-059-Q6-K1-F2
gtgcatgcaaggtgacagcgcgactatagtggcagccaaatacaatgcacagggcgcccttcgacaacgcctggactggaaaaaccaggccgctacccaactgaagcagctcgcagaacataccactttagccagatgacgtcagaacgaagaggacactaccgatcagcacaccaaacagcagcgcaacctgaataggaacaaga

SEQ ID NO: 19572 - DNA, 478 bp, Sorghum bicolor
  unsure (1)..(478): unsure at all n locations
  Clone ID: LIB3480-059-Q6-K1-F6
agccnaccaangctagcaaggaagaaacaaaacgaanctcgcatccgaatataccgcnaatctngaccgggtaaaagtgtgcacagctagctggtgctttagatgtctttgtttttgtacagagtagaaattgcacatagatatcttctcaacgtacattacattgttgcaacaatagtaccttttttggaacaatgcgataatacttggtactatcacatataatgcgagaagagagattagtactagaaattacaaaatgcatcacaactaaaagaaataatattcatttctgattataataaaaagaaagatgcttgcaataagcaatctattgggaaaagtgcatgcatatgttaaaaaccaattcatgttaagttcaaaaaatgttctatatatgtttgcccattatctagatatcatgttattataaccaaatatcaaacttaactgtgcagagaagtatatgccgaggagt

SEQ ID NO: 19573 - DNA, 505 bp, Sorghum bicolor
  Clone ID: LIB3480-059-Q6-K1-G11
gagaatcttgaacagcatgttctgaaggactataagagtctacttggaagatattgccatgtggaactccaacggcgtcaatgggccaaggactaccctacacctcactgcgacgagcttaggagcctgtctgaggcatgaaatgtgcatatgtgattagtttgatctcccattttcgtccatggaagaatatcactcatatttgcaggtgcaacataggaaattgtttcgggcaaaaggaagagtacggtttctagtccgtctggttgtgatttgacaaccaataactggacagtagtgctgtgttataacagtaaaatcatatatgtttataattcacaaaattatatgtgtttatgcaattgatactattcgcttggttgataagccatggctgaaagtacataagctcaagcgaacagagcgccagagcataaaagccttgtttacatgaagagatggctggtgaccaaccgattgaagttgcggtgtacgtggccatggt

SEQ ID NO: 19574 - DNA, 497 bp, Sorghum bicolor
  Clone ID: LIB3480-059-Q6-K1-H10
gaataactctgtatgagcaaagttctgaatttcttcctacactgggtaaattgcctcacctccttgagctctctgtgcaatggatgagaggcgttcggcacatttcaaaggaattctgtgggcaaggtgatacaaaaggcttcccttcattgaaggatctagagtttgagaacatgccaacttgggtggaatggtccggagtagatgatggggacttctcttgcctccacgaactcagaatcaaggaatgctttgagttgaggcatcttccacgtccattgtctgcatccttgtcaaaattagtgatcaagaactgcgataagttagtcaggctgccacatcttccaaacctttctagtttggtcttaaagggaaaacttaacgaagagttattttctgacctgaacttgccattgctgcgagcgttgaaggtgtctctttctcacaacatagagtacgtcattcttagccagaacctgccactgctagagatcctt

SEQ ID NO: 19575 - DNA, 462 bp, Sorghum bicolor
  unsure (1)..(462): unsure at all n locations
  Clone ID: LIB3480-060-Q6-K1-A12
gccanccaaggganggagcncgaanggagagcagcacaaacaagggcangnaccangcccnaaaggagaacgncgcaaaggagggannnggaggccnnnanaagggccacngccccnncgnggagaaancggccccagcgggagccgngacaaaagcggcanaagaanacancgcagacaggacagggagcaaggcaggagnngagngaaancagggcggaccaaggagccgncaggacaccaagacgaaaacnanggcacagccnggacacgganggnggccagcccgccaggncaaacgngaagngcanacaacaccgagagagcnganacangcaaagcccaacaaagaaaagagcngnnnngnncacncnaanccnaaccccaancgccnaaagngcgcggagggcaaacgangccgngcaaaacaaggcggagcaaaacaaacaaagngagcgcgac

SEQ ID NO: 19576 - DNA, 341 bp, Sorghum bicolor
  unsure (1)..(341): unsure at all n locations
  Clone ID: LIB3480-060-Q6-K1-A5
cggacgcgngggcggacgcgngggnnngcaagggcnangcccncgacacacnncacaagcaccngggcgacnncggggcaaccgggngcancacaccgaancagggagcgnnggcaaaggagcaacacggcaagcnncacgcacaggcgcgnccaaangccgncgcacnggnggaggccgacaaccacacagaccacgaccnggggacggcgccggggcggnangacgggaacgngnacccggcacngnangaggaggcgcggaaggacacccngaangagacggnggngccagagggggaccaagagnaccnccggcccnggcgcaagcagcagcncaag

SEQ ID NO: 19577 - DNA, 205 bp, Sorghum bicolor
  unsure (1)..(205): unsure at all n locations
  Clone ID: LIB3480-060-Q6-K1-A6
ggacgcgcccggcagcggcgcanaaagcgcggcgggggagggggacacgcgcagcgngaccgcgacacgggccagcgcccnagcgcccgcnccnancgcanacagcccgncccaacccgccacgnncgccggcnngccccgccaagcacaaaancgggggcgccccncaggganccgaangagagcangacggcaccncgacccc

SEQ ID NO: 19578 - DNA, 309 bp, Sorghum bicolor
  unsure (1)..(309): unsure at all n locations
  Clone ID: LIB3480-060-Q6-K1-A8
ggcgaccagcaggaggagagcaccaacggccgcaacaagagcgacangcaccgcgagcccacgcgcccggacggcaaccgcaggaccaacgcccacngcaacaacccgggcgccgacgccgncagcaccccggcaccagcgcccgacggcaccgacggcgccgaggaggagcgcgccggccaggccacggacccgagggacgagagcgaggaccacaagaaccngcacgagcgccacacgnacgaggccaaggagccaccgcgcgaggccacgaagcaggacaccggcaccgcgggaagaacacacaca

SEQ ID NO: 19579 - DNA, 284 bp, Sorghum bicolor
  unsure (1)..(284): unsure at all n locations
  Clone ID: LIB3480-060-Q6-K1-B10
gaaggacaacagccaggaggagcaggagcaagagaccgcgcaaggacagcgaccagacacagagcgcgcagggaccgcgccggcgaggggcggagccagaacgacggcaacgcagacagccagcgccccgccaacccgcacggcaacancaaggaggccccgcaggccgccagcgcggcgcngcncaagcagcnggacnccgacaangacgacgagcagnaaagaacacanacgggggacgacgaccaccgnggncggcgcggacaggccgcgcaaaaccacaa

SEQ ID NO: 19580 - DNA, 573 bp, Sorghum bicolor
  Clone ID: LIB3480-060-Q6-K1-B12
ggcgaaagaagcaacattgaggaagtcatagcaaaatatgcgcagctaacccctcaagagagagctaaaaggaaattagagagcttagaagccctaaagaagactttcaagaagctagaccacgatgtaaatattcaagacttcttaggctctgggggtcagacagtcgaggagttatcaggccatctcggttcattgcaatgtcaaatggcagaggttcaaaagcgtctcagttattggagcgatcctgagaaagttgagaatatcgaccatataagagcaatggagcaatctctcaaagaatctctaaaccgcatccaaatccataaggagaactttgcaaagcaacatctgatcggcctacagtgtgctgctgcccagttccagaccgacatgcagttgcctctaggactgaccggtgagccgggcccttcgtcctggttccaaaacggcggtgccgatgggcaacaagccatgatgctaccggacgactccagcctgctccatcagagagacattgctggttgctcgacgagcacgtcactgccgggctacccaggctacttcagcatg

SEQ ID NO: 19581 - DNA, 258 bp, Sorghum bicolor
  Clone ID: LIB3480-060-Q6-K1-B8
cccacgcgtccgatatggtcgcctcgctatgccatctcaaaatggatggtatgccatatatagtgatggatttccatcatggtatcccatgatgttacccaaaaaaaaaacacaaaagaaagactggagcaaaagaggaacagcgcggctttagctaatgggcattgcttcggagctccagctgcggtggctagcttcagggacacacagatcacgagctgttaactacatttccaagaacatcactgcgaataacac

SEQ ID NO: 19582 - DNA, 343 bp, Sorghum bicolor
  unsure (1)..(343): unsure at all n locations
  Clone ID: LIB3480-060-Q6-K1-C11
ctagttctagatcgcacacggncagccgcgagacaaaactatgactaccataaggaacaacacattgggcgaccctgctaccgagagggacccctagattagcagacaggagtggacagcgatactgttgctgaccccttgagtaataaagaagatgacacagccacactagaaggacaccaccgcggcttaaaccagatgacactgcaacacacagaaggacacacaacggcgatggacaagcgattgtacagaggcacaggggcaacacaagagcgagaggcacaggctgcgaacaaaagaaacgggagctctgaaaacgtatgctgaccttgatagcagc

SEQ ID NO: 19583 - DNA, 447 bp, Sorghum bicolor
  Clone ID: LIB3480-060-Q6-K1-C4
gactagctctaaaaaaaaaaaaaaaagggcggccgccctttcttattttcgcttgcatgcgacgactttgctattattaccacgtgcaatttgcagacaacttgccacctgaaaacatcattattatatgaaaaggacacaggggaagctcgatcctagctatacttaatgcgccattcataagcggctggttgatctcccatagcagggagacacggacacctcgacctaccatttgcccatgctgaacacctaaaggcacgcgctcttgcccatggcaatcaacggatagaccctggacaggacgcacatcttgacccctgctccaaagatctcaataaccgaccgttctatcaaggttctcagtgatatcttcccaacggaaatgggcgtgtcaacaaaagctgcaaatggcgggcggcacaggggggggctcagaaacgactt

SEQ ID NO: 19584 - DNA, 546 bp, Sorghum bicolor
  Clone ID: LIB3480-060-Q6-K1-C6
gattgctcaagggacacaatggataacactgatacaagcgctcgctgcaaagccagggggtccaccacatgtgcggatcactggaatagatgatccagtttcagagtatgctcgtggtgaaggtctggaccttgtagggaagatgttgaaaagtatgtctgaagaattcaggatacctttggagtttacccctctgcctggtatttatgcaactcaggttacaaaagaaatgctcgacatcaggccaggcgaagctctcgctgtcaacttcactctgcagctgcaccacaccccagatgagagtgtggacgtgagcaacccacgggacgggctacttcggatggtgaaaggtctgtctccaaaggtgaccacacttgtggagcaggagtcgcacaccaacacgaccccgttcctgatgcggttcaccgagaccttggactactactcggccatgttcgagtcgatcgatgcgaacctgccacgggaaaacaaggagcggatcaatgtggagcagcactgcctcgccaaggacattgtgaacatcat

SEQ ID NO: 19585 - DNA, 240 bp, Sorghum bicolor
  unsure (1)..(240): unsure at all n locations
  Clone ID: LIB3480-060-Q6-K1-C7
gcgnacctngctcccaccctctcaatcgataagggagttggtacgttactcatagtgacttatcaggtgacgaatgccatcctcggcctccttcctgctcacaatggcaggagtggcaggatggaccgctgtcggaatgcgcggtaacagtgtgaccttgacggtcggtaagggcactacctccacgtgcacgcatctagtcattgtagtcaagcttcctattcatgagcttgccatcag

SEQ ID NO: 19586 - DNA, 429 bp, Sorghum bicolor
  unsure (1)..(429): unsure at all n locations
  Clone ID: LIB3480-060-Q6-K1-C8
nnccnnccncccacagcaaaaccacaacggagancgaanacgcacanaggacggcanacacaggcgcgcaaaagaggccaggggccaacgaccacncacaaacacacaaacagcagcagcgcaaaaaccngggcngcaagcacaaccagcgcacgnagangggcagcccggacaccacncagacagcaccggaaacgcaaagggaacccaggagaacaaancaagaccnggccgcacacgcacaccgcgcacacagacccagcaggggcangcaaagaggaccagccaaccaccnncacacccanagnaaccgccgccaacacgcacncggggngcagaccaaaggcacacacagcggaccggnaggaccaagggcggaccaacnccncacacccgncgcagccggacgcaccacggagcagcaggacg

SEQ ID NO: 19587 - DNA, 582 bp, Sorghum bicolor
  Clone ID: LIB3480-060-Q6-K1-D1
cgctcgtcaacttcagcttcgccttcaacttcttcaactcggaggccgccgtgtgcatgccgtccgacaaggcgctcgtcaacttggacgacagggacaactgcctcggcgcgctgcgaccggcgcagaagacggcgctgcagtgcgcccccgtgctcgcgcgccccgtcgactgcagcaagcatgtgtgcgctggctacccgacgcccggagggccaccgtcgtcggagaagccgccgtcggtacccgagaagccgccgtcggtgccagccaagcctgctgcgccggcgcccatgcccaccccgcatacaccgccggatgtatcaccggagccgcttccagagccatcgccggcgccggcgccggcgcccatgccggtggcgacccctaagacaccaccggcggacgattacgtaccaacaccacctgtaccggagaagtcagcaccgcctccaaagtctgtcccagagacacccgagcggccaaaggagccaccgcctgaggtgaagcctccggttgtcgcctcgccgcctccggcaccggtgaagtcgtcttctccaccagcgccagtggcatcaccac

SEQ ID NO: 19588 - DNA, 306 bp, Sorghum bicolor
  unsure (1)..(306): unsure at all n locations
  Clone ID: LIB3480-060-Q6-K1-D6
aaaaaaaaaaaaaaaaaaaaaagaaaaaaaaaaaaaacaacaaaaggggcggccgcgcccaacaagccaagaccgcaaacaacggaggngagaggcagaacaaaggacccgcngacgngcaccgcaagaccccngccagagagggaacncgcggccacaaccggggaggcaaaanacaacgggngggaagcaaagaccaccgaggncccgaccnagagangcangacgcccagaagccagngccccgcgggggaaccaagcaagacaaccgcacagacagccccncgcaagacgggggcagaacca

SEQ ID NO: 19589 - DNA, 577 bp, Sorghum bicolor
  unsure (1)..(577): unsure at all n locations
  Clone ID: LIB3480-060-Q6-K1-E2
atcatagcggagaattngccagaggactcgtctaggaacagcctcgagaagatctttggcgttgtcggaagtgtgaagaacatcaagatatgccatccacaagagcctagcactgcaagggcttccaagtccgacacgctagtgagcaacaagatgcacgcacttgtggagtacgagacgtcacagcaagccgagaaagcagtggagaagctgaatgacgaacggaattggaggaaagggctccgtgtccgcacagtgctcaggcgctcgcccaagtcagtgatgaggctgaagcgggcagacttcgaccactttgtgggctccgacgacgactcgccgcactcctcccagatgtcatccgactcgccaacagcagactactctgctgccgaggcggcggcggcggcggcggcggcagcagcagctcatgctcacgctcacgtgcagcagcaccaggaggatcagcagcagcagcagaataatggtggcagcaagcaaaaaggctgggctcgaggacgaaggacgacgaaactgcacatcacggcgccgcagagcccgcagtcggcttccgcgggca

SEQ ID NO: 19590 - DNA, 350 bp, Sorghum bicolor
  unsure (1)..(350): unsure at all n locations
  Clone ID: LIB3480-060-Q6-K1-E8
ccggcgcctggccaccggagagcacgacaccgacccngagcggcccggncgcggcgggctcggccgccggcaccagcgacgcggagggcgggccgaagaggccggggaagagcacggcgagcncaacggggaagcccgcggcggagcgggcggggccgacgacgacggagaagnnggagcggaggacggaggggaggggcagcgcgagcaggagccggngcgaccgcaccncgccgaacacggaggccagccggccgggcgccggcccgccgancgccgccaccgcgccgccgncggacgacaccgccgccgccgccacgcgaccgaccggcaacgggagagcggagcgg

SEQ ID NO: 19591 - DNA, 435 bp, Sorghum bicolor
  unsure (1)..(435): unsure at all n locations
  Clone ID: LIB3480-060-Q6-K1-F3
cagggagcaaagaacggcgcgacagcgggcaccgcgggggcgagccccacgnaggaaggcagccagcggcagagaggggcgaaggccaagcggaacgacacagcacaagcacagaccaaanccgcagccggnatccagggcgcanccaacaccgcagacaaaacgcaccaacggaacgcacgacaaaacaccacngagaagcgggacaagccaacncgaggcacagaggcaacggacaaggagcacnagagcgacagggaaccgcgggccccacaagcagcggcaccaccngccgcngcggacaagcaaaagcacgggggccagccacgcaacccaaaggaagaggagcaaagacaagcgaccagaaggacccaacgancganccagaccaccaccaagaggaaccagaacaaaacaaggcgccaccgggggaac

SEQ ID NO: 19592 - DNA, 541 bp, Sorghum bicolor
  Clone ID: LIB3480-060-Q6-K1-G10
ctagttctagatcgcgagggcgcccttttttttttttttttttttttagcagtaaaattgccccaagggacgttatcctttttgttttccttcggtaatcaggtcatcatcgcttgcaagccaagcgaaacaatcacacgaagaaaaatcctcgatcgagcgcagcgcgcgagcctacacgatacacgtgcgccagccagccagccattggggcccttcccaaaatgtttgcacaaccccaccaactctacctcgaatttacagcaccatccccgcctccatgtatgtacaggcatcctcgatccttcggttacaatacagtaatctactaaggaccaaagcgcaaaaggagctagtccgatccgaccgcctagaactccgtcgagaactccgacgaggaggacgactccgacgcggacttcgtcagcggtggctggtgaaggtccttgaaatggcccctcacgtcgaacccctcgccttccgcgaggtcctcgtaggctggcggcgggatgtagggcggccgggacacctccgtgagcat

SEQ ID NO: 19593 - DNA, 368 bp, Sorghum bicolor
  unsure (1)..(368): unsure at all n locations
  Clone ID: LIB3480-060-Q6-K1-G6
cccacgcgtccgnnnnnnanannnncgcgngcggccgcncnngngggttccaaacacacgaacgaaaagcgcgcaacagggaaaacacaaagaggggggcggcgaaaaacaaaaacaccggccgacgaaaaacaacgagggggaccgggaaaacgcggggcgggacccaacccaagcgccgggcagcacaaaccccnnacaccagccggcgaaaaacccaacagggccgcacggagcgccccncccaacagangaacaccccgcanggccaaagggacgcgccccagagcggagcagaaagcacaacggggggggagacaacacacagcgcgaccgcgacacccgccagagcccaagcgcccacccca

SEQ ID NO: 19594 - DNA, 353 bp, Sorghum bicolor
  unsure (1)..(353): unsure at all n locations
  Clone ID: LIB3480-060-Q6-K1-G9
cccacgcgnccggccgcgnccncgnccncgccgccgncgccgcgggccggcnccnccnccccgccgccgcggncgccaccaccggggacgacggcagnaagaagaaccacccggcgaagggcagcggggcggagaacgngcccgaaccggncgagcccggcaaccccgccacnnncaagaacnccgcnncnacnganaaaaccanngagaaggggaagccgcaaaacgaggncaaananncaaccncaacgggcacccggaaacgcccgacancngnggagagacnnccnngccagcaacgggngacnncgccaaacncagcagcagacgggaccaggaaacacgccaccggg

SEQ ID NO: 19595 - DNA, 353 bp, Sorghum bicolor
  unsure (1)..(353): unsure at all n locations
  Clone ID: LIB3480-060-Q6-K1-H7
nacaactcatgctgaaaataatgcacctgaggtggcctgtggcatgccctctgatctgcagaagcgtggtggggtgctggacttccagattcagttgtttaccatataccatacaattttagttatttctatgatttgtgattggggccatgacagagatcttgtttagattaagtcatgtagctggtaggttatgaacaaaagagaattactgataaattttctgtacaaggggtggtcatttcttagtggtgctgactttgagaactaatacaagtatttgttcattctaaaaaaaaaaaaaaaaaaaaaaaaaaaggggaaggggggggcaataaaaaagaaaacaaaaa

SEQ ID NO: 19596 - DNA, 448 bp, Sorghum bicolor
  unsure (1)..(448): unsure at all n locations
  Clone ID: LIB3480-061-Q6-K1-A1
ggggaagagaacagcngaaacncnnaccanggannaccaccgnggngcnggngncgaggggagaanggcacgcanannnaacacananggcccncgnangngnnnagaagaaggccgagnngnnagcaacnnngnngcacaggcnnngcggaaacaaccaangacagnnnanggnganggaaaacagacncgaagnnnncaanangnnncagaacnggnngangggnnnggaacccnaanggaaagcgaccanannggaccnnncaacnnggggaanccgggngaannaacaangcnggaacnngcacaggnnggaaaagaaacganngacccaggnngcgcnngggagnncaaacccaacacngcagaagaaccacacangagaaaaccngacannncnaaggccaaancncnnctcaanngggagcccaaagnnncactaaaacaa

SEQ ID NO: 19597 - DNA, 354 bp, Sorghum bicolor
  Clone ID: LIB3480-061-Q6-K1-A11
atagcactggcaggggagggatcacaattgatgatgctagatcaaccacacgcggatctgaccacctctctactcgttaccagccggccaccggagttcatggcgcgaccgtgaataccgcgcaaagctgcgaaaacccatgggcctcctagctgagctgctgcgaaccacatgcacctctcggctctggggacataccgaagaggggcggaccgatcgctcatcgcaacagaccgtcagtctgaatggcgacatggcacgctcgctgtactacccattaaaccacacgactgtgctcgttacgcgcacaatgacctcatcacttaccagtgccctagctgccactcctttctg

SEQ ID NO: 19598 - DNA, 348 bp, Sorghum bicolor
  Clone ID: LIB3480-061-Q6-K1-A7
atccgggtcctcttcgacgcagtcgccctcggcaaacgaccacacctcgctcatcgcacagtgttccaccaactaccaccaggttctgacccgacgtttcaactcacatggcgagcgtgtgtctgccaacagacgctgtcataaactgcatgctcacaatggacctgacgtcatgctcgctctggacgacccacgccaagagatctacaggctccgcgtcatgaactccattatacaggcgtcgatgacttacgatgcactgccactactttacgctgagggaggtggaggctttccacacgctggaagactgctacgactcactcgacttccacgtgcctgcctgcc

SEQ ID NO: 19599 - DNA, 478 bp, Sorghum bicolor
  Clone ID: LIB3480-061-Q6-K1-B4
aggtaatctcagaaacaaatctgcaagtataaagatattcacatatatagcccatggctgctgcccctgcccccatgcccatgcatgcagactcagtcccagtcaagtcaaatataaccacacgtctcctgtgcaaaaccaacctgagagcccgaggtgtcaaagatgaccctcaggctcttctgctggtagttgccgaagatgttggtctaacactcggatttcaggggcgccatggcgaggcacacctgcgaggagtatctgctgacgaagtagagcacgctccctgagtacacctacaccttcacaccggcagagaacactagctttaggctgggcacctggacctctctgagcccggtcatgttgaaacacgtgtcgaggatggacaaccccggaacctgtcgatactgtgcgaactggctcaggaactcagccttgacggcgttgcagatagacgggacgaggctcgtgatca

SEQ ID NO: 19600 - DNA, 583 bp, Sorghum bicolor
  Clone ID: LIB3480-061-Q6-K1-C9
ataccgacttgtggagaaggagcaaccagatggcatgatggcaaagaaaataaggccttatctgatggatcttgatagtacaaatggaactttcatcaatggaaatcgcattgagcctcggcgctattatgagctatttgaaaaggatacactcaagtttggcaacagtagccgggagtatgttttgctccacgaaaattcaacagaatgagtctcgagaaaattcaacagaatgaggattaaagcggccaaccttttttgctgtatgagaaaaatacagcagaaacatggggcgttgcacgtttttcgtatttttacactggagattggtcagcttgaacttctggcctgtgatttcttcacaggtatttaagcctataaggatattttgtgaaccaacatgtatggctattgtaatgaaagagagctagctgcctgttgcagatagccttggatctgatttgtattaaagcatgttttgtaccgctggcattcacatttggcatcggaggcagctgtttatggatcaataccatagtgatcttaatgaagtataatcatggatttagtggtacaataattt

SEQ ID NO: 19601 - DNA, 492 bp, Sorghum bicolor
  Clone ID: LIB3480-061-Q6-K1-D12
gcagcaggctgtcatccccgttgaagctctgtctgcctgcctttgcgctcctccatcaaatgattcgattcgccctgcctcgcctcgctcgcccgccagattcaattcacccgtcacggtgatcgggaccggtcagtgctatggttggttagggttccggtgattgatcccaacaacctcgatggtgcatctgctgagcttgggaagtggctggccatggctcctgcgcgtcgcgcggcggcgatggcggtcaagctagaggcggaggagttcgggggctgacgagtgcgggcgccaaggcagctcacctgatgcccccgacgtgcctctgaaaccacaacaggtcgatccggggttgtggactctccaaaaattttgtgtgctccattggcagacagctggttagcgagctggtctcgccatgtttaatgttaatcaggggagcttctgttggactttttggcgaaaccctataacctctgggacaggaga

SEQ ID NO: 19602 - DNA, 431 bp, Sorghum bicolor
  unsure (1)..(431): unsure at all n locations
  Clone ID: LIB3480-061-Q6-K1-D3
ctgaactgctgatgctaaaaaactggatgcttgtatgctccaaagccaagatggagataccaattcagtatactgttactttggaacaatcttttctgggcatttgtaacgagccgctgaattgcaagaacaccgcacctggtcgattataggcatgccaaagaaggcacctgcggaggcgctatacagttcggttagctggttgagtggtttatgtttctagtgtatgtggagaatgtaatatcttttcatgattggaacatcttgcccgttatttgtggtggaaggtttcaaggttgactactttgctttcatcgcgcttgatgctgagctcatgtctgacgagaaatgtanggattggttcggtcagtatgtatttcactttggaaaggaacaatatatatttttctgctatggtgatggttgaattt

SEQ ID NO: 19603 - DNA, 458 bp, Sorghum bicolor
  Clone ID: LIB3480-061-Q6-K1-D4
cccacgcgttcgcacgcatccacaaagaagaatggtgtcgaaatttgcattcagtgctctggtactgctcatggctgtgtgtggcgagcttggacatgccgtgccgctcaggcgtggtttgagtctcggatggatgaacggcatgaagggaggagcaccaggtggcatgcagccatctgatactaagcttcttgcgggagttggaaaagaagcgaacgtttacaaaagagcagatgaagcaaagttcattggcgccgtgccagcattcgtgaggccgccccgcattccaccatcctaatttggcattcatctcgagtattgcaagctgagacgatgtcaagcgaacccaagtcaagtatactagaatatttatgtcaagtgaacccaagtcaagtacatagtgtcagcttgcaacactacgtcaagtgtacttggctaatataaattaaaaaatttta

SEQ ID NO: 19604 - DNA, 385 bp, Sorghum bicolor
  unsure (1)..(385): unsure at all n locations
  Clone ID: LIB3480-061-Q6-K1-D8
gcaaacagggaagcagagcaagagcnagcnccnccaggggggaaaggagaaancagngacaagannaaccnngaaannnngacccagcgacgngaancaggnncccaggacagaaaanaccgnggacaaannnngcagnacncccngganaagcnncggaaaccggcnncnccngcgaaggaacccgagaagaagaagagncanganaaannngnngggagaannganngaaggcncngaancnaannanagagaaacaaanncannnngnncnnngngnancaagggnnngcgcnncactanggaggaannagaggcncnaaaagcagaagncaanagagcacgcanccaacnannggaaccaangancaagggaccaggngga

SEQ ID NO: 19605 - DNA, 364 bp, Sorghum bicolor
  unsure (1)..(364): unsure at all n locations
  Clone ID: LIB3480-061-Q6-K1-E8
aaacaagaagccaaaaaaagcagcaagacaaaatatagcgagaagacaagaagaacggcccagaacagcgaaagaaaaaagagcgagggcgganggggccacaaagaaagaaannggcagagcaaaagaanncanagcgaaacaaccggaaggggagacggggcaagcnacggagacgggaacaanncangcaggagaccnncngaggcgcngccgcncaacccnagggaggaacaancaagccgcnaaggcagcccaggaggcagancagcgcncagaggaagccgccanaaggaggagcccaaacccaanngcagcagcgggcaacgagaagagaacccaacncncagaggacaagaagcca

SEQ ID NO: 19606 - DNA, 479 bp, Sorghum bicolor
  Clone ID: LIB3480-061-Q6-K1-F6
ctgcggagagccacatcatggaactaaccatgaccatacagcacccgcaccactgaccaagcgaggctatgaggggcatccgcacagaaccgaccgatatggacatgctcgcccgactaaagaaccaggcagggacgcgtacacaccagatggagggtatggaaagcacgagcagcaaccaccacaggcgccaccaccacagcagaaagaatgaggatggcacgagcggaccatctacaaactggtcgcaaagtacctggcagaaactgtggtgcatcgacatgagaaagatggcgacggtaagtagtggtatatcggcccaacgatcttgaacacgtagacagcggacgaacagaatgtgagcaacgcccagagtgactaggggcgcagccgtaataactggatgggacatgaagccactgttcgagaagtcaacacacaaggattaacgtcacgcccttattgctggaatcttggag

SEQ ID NO: 19607 - DNA, 404 bp, Sorghum bicolor
  unsure (1)..(404): unsure at all n locations
  Clone ID: LIB3480-061-Q6-K1-F7
cgccgctccaccgagagagagaaacaagcccgccagccagccagccgaccgacctcaggnaagccgccgccgccgccgccgnaccagnaccgccaccaccaccgcaagagcgaagaggagangaagangaggancctctncgccctgggcgncgccgccgcgncgggcaccgcggngctggcctccaccgaggccgccgccggtgccgccgccagtggcgccgccccgactgcctccgaagtgtccgccgccggcgccgaggcccccggtggtgccgccgcagcaaggggcgccaccgccgccggggggcccggcgcagccaggggngcgcccggcctcgccggcggcacccccgacggcgggctgctttttttcccttcccggctactaccttcactaagcgg

SEQ ID NO: 19608 - DNA, 174 bp, Sorghum bicolor
  Clone ID: LIB3480-061-Q6-K1-G6
cgcactcacctgtctccatgctctctcgtctatcctatatggtgcctgtctcacgccctctgttctacatactgcagctactcccgcagcccaaagacactaccatggatcgagaatctcacgtgtactcacccgcatactactccctgtactaccatggtgctatcccactca

SEQ ID NO: 19609 - DNA, 522 bp, Sorghum bicolor
  Clone ID: LIB3481-057-Q6-K1-D4
tgaaaaaaaaaaaaaaaaaaaaaaaaaaaaaaaaaaaaaaaaaaaaaaaaaaaaaaaaaaaaaaaaaaaaaaaaaaaataaaaaaaaaaaaaggggaagaattttttaaagtggacgcggtttattatatggggggtgtgggggggtataattttttgttgtggggactttgttggttttgtgggtgtgcccggggtttttacggttttgggccctcggtaaatccgtgggggttcgcctgtttttttcggggtgggggcactttctttttttggggtgtggcgttttttgtaggggggcatgacttttcgcttttccggtggttgggcgcgctgggggggctatggtttccggctttgtaagggggtattatgcgggggggggggtggttttccccatggggtggctgttttttttgcgtgggatgtatggcctggtctttccccttggttctcttttttttggggtatgggtgtggtttttttaattattttttttggttgggggctccttttgggggtc

SEQ ID NO: 19610 - DNA, 672 bp, Sorghum bicolor
  Clone ID: LIB3481-057-Q6-K1-D5
gtaatccaaagctggcatggtacttgcatattgggggaaaaggtgaaggcatataccgttcttatggccctttgcatggtaattctgttttcttgcaatgccgtggagggtggagcatacatgaggcatgaagcactttctcgcaaaggtctaaaagaacaaagaaagctagccactattagtggactgaatccttcagttagcaatttgtcaggtcaggcatctagcaacgttaatggtgtgaacaacaataactctgaaagcacaaatactaatatgccggacgccggtacagcttataccccgatgacttccactaccacagattcccaccatgacctctcagttgatcagtaccgcaggattactcacaacaatgagaataagccgtgatgaaggattcatatgtcagggcactcagtatcaaccatgcataagaatctatggatggaaccatctatctagtttgcaactttaatcgtaattaagttgtacttgtgtgtatttctagaacaaacttgtattataagatgcctactttgtgtaacaacggtatatattttccatgtactatgaatccatctcaagcagtggattctcaaggttttcctatgctcatgaataatgtaccatatatatttggactagtacaaataaagcatgtttatagtc

SEQ ID NO: 19611 - DNA, 615 bp, Sorghum bicolor
  unsure (1)..(615): unsure at all n locations
  Clone ID: LIB3481-057-Q6-K1-E1
gtacgccggcccacgcccgnaccgccatgcgcgtcgtgtccggccgctccctgctgccaccggcctcgtcgagcgacggcgacacgacggcggcctgagacgtcgccgtcgtcgtcgtcgtcgtcgtcgcgtcgtcagttcggggacatcgctgtgcttaacaacgcgctggacggaggagcccacgatcgacagcgcacgcgtgggcaccgcgcaggggttcggcgtgcgcgtgtccgagggcggcgtcgtgtcgcacgtgaccgtgcacctggtcctggatgccggcgagcaccgggggcagctccgtcacggtgagcagccgcatcgacgtggaggagaaggtgcgcgagtcggtggtcgttggcgacactgggcgttgccggttcgcgcgcgggtacgtgatcaccaggaactacaactacgaccttggccacggcggagtcgccgagttcgacgtctatttgctcaactaacttccttgacttgaaggcatttgatttgtctgtataagcatcaatctcaacatatatcgtacgtacgcaaatttttttaccgtgtaataactgtccatatggtgtttactagtatacgctgaagcatgcatttgagttg

SEQ ID NO: 19612 - DNA, 621 bp, Sorghum bicolor
  Clone ID: LIB3481-057-Q6-K1-E4
gtttggcaccatgaattgtagtgtttatcctgttctctgcaatgcagtaggggaagaaacatggaagaaaaatataaagtaagcagaggcaatattttgctcatctctctgtcattgtaactgatgtcggatagatttatgaacatagaatttgcaaatgcattctttccgcccaacatctatttgaacatatataaacttcctactccactcttaatttacatgcatttagaaacaaatgatatgtctatgttaaagttggagcattataaagaatctgtgtgtagttttagtatcttgcttgaatctatgctggttccagtatattgttgtgatctatttttatcgttaatctcatgtgccacctagacctactatgaattcttggcataggaaatgtcaacgagcgacatgcaagggtcatttggaggtctgcaagtacttggttgaggaactaggatgtgatgatccaaatatggttgcaagtggaggctcatgtgaaggatctttttaggtcttttgtgcttatagaaattgtgcaacaccgtttgtggcctgtttgcacagtcagcctgctggcagcagtgtgtagatgtgtcatcaatgttttttgttattctt

SEQ ID NO: 19613 - DNA, 442 bp, Sorghum bicolor
  Clone ID: LIB3481-057-Q6-K1-H3
tcttaattaagagcctaggaatttgttttatctgcagtgtgcatcttgatgttagaaatgttgtaccaattttttttaaccagtgttttaggccttgtttagtttgcaaaaaattttgtttttgcctactgtagcatttcgtttttatttgacaaacattgtccaatcacggagtaactaggctcaaaagattcatatcataaattacagggaatcttgaaaaattttgcgaactgaacaaggccttgtgttgagaatgtggggaaaggagcttgtcagttgtcacggtgataaattcctgccggctcagccagctcagtatcgatagtgatgatgagtctattcagcgacatgcatgcggatttgctgatgtatttttctattaccgacaacatttgcaattttgctcgatagatgaaaaaatataataaagtcttattgc

SEQ ID NO: 19614 - DNA, 581 bp, Sorghum bicolor
  unsure (1)..(581): unsure at all n locations
  Clone ID: LIB3481-058-Q6-K1-C2
ngattagtatgtcatccaagatctaaaacttcaaacacaatgtgtgttgcagataattagaagccctgcccataaagacttcctcaagctccagaagctcgggctggcgccacgtcgccatgcaacaacagatgttagtggccgatagcatgctagcagcacggccgtgacactatgctattgctgcacgggcaacctatgtgtgcgccagtcgccatgccaagttcgtctgagtccgatgcttttgctcacggtcccatcgtttggagcagccccgatatccttcctgcagccagcagtggcaagtgccttctttgttcactcttcagttttttaagatagcgttctcacgttgttaaatcctaaatcgtgttctcgatacatagataacgagtgatcggaatgtgccatttttcttttttatgctagaaccacaagaccattttgaaaagctgaacaggctctgaaagttccaaagctatattgtaacacaggttcaatttagtaaaattgcatactagggaatgtaccagattatcattaattatatatatatatatgctttattttgattctttctc

SEQ ID NO: 19615 - DNA, 648 bp, Sorghum bicolor
  Clone ID: LIB3481-058-Q6-K1-C6
cccacgcgtccgggtcctaaaagctcgcgcaacaaccttgcctggctgcctgcctctaataagctgcactagctagtcgagtagggacaggatcacaagataaggcacatgcaaccttctgctctttgcagcggtgtcaaacggccgcggaagaaggagcgcttctgcatctcaatctgcagccacgatttgcaacggtggagccacgatttgcagctctgccgctccggctccggcgaagaagcagcacagccgcagctcggccgaacacggccctaaggtatccgtccacacatgcactcaatctcaaccattcaatgcactgcatcgatagatccacgtccacccacccacttatatgcatatatcttaactgttagatgtatattattatgcatttaactattttttatctatatttaatgttctatgtgacgaaaatctgaaaatttttatttttttttttaaaaaaatatacaattcacatccttggcaattggcacggcgattgacgagcactacatcaatcggcgaagatccgggggaggcctggccaaagccgctcatctctccacaaatcccgctgcatgtttctgacttccttctaatcactgtaccaggaatgtcgtgcgacaagtgttatgcatc

SEQ ID NO: 19616 - DNA, 540 bp, Sorghum bicolor
  Clone ID: LIB3481-058-Q6-K1-E6
ttggattctgttcctgctaaagaatcccagcatttaataaggaattgtttccatattatttgggatattgccaagcagaatctagtgtaccatatgatgattctatgaatttgcgcaatgtcctttggttagcacctttgccatcaaatgagacaaaagcttggttagcaccaggagcattagttgtcttggacgcacatcctgacggaattatctatcaagagatgatacgtgactatgttcaaattgtaagaacaatatacgaagatgatcttggggaggttgctgttgatgtcaattatctaaatgtggcaaatgcagctcctatagatagagttttcatttgctgaaattcttttctgagaagcagacgtcaatgcattatcctaatgtccaccaaagcaatggtttgttcccatgatgactgctgtgtatttcacacgtttatttgattaattaaaaatgctcaatgaaacaatgatttgatgtaaagttttacagtatattgttttgtatattctgtgtactttatattgattg

SEQ ID NO: 19617 - DNA, 598 bp, Sorghum bicolor
  unsure (1)..(598): unsure at all n locations
  Clone ID: LIB3481-058-Q6-K1-G5
gngggcgcccggcccggcgccgcggctggcgctggcgctggggccggggacgacgacggcggcaaggcggaagtcggaagggccgtggcggagagcccggtgctggtggtggggcggcgcgggtgctgcctgagccacgtggtgaagcggctgctgcaggggctcggcgtgaacccggccgtgcacgaggtcgccgacgagtccgcgctcgccggggtcgtcccggccgccgacgccgccgcgctgcccgctgtgttcgtcgggggaaagctcctgggcgggctcgaccggctcatggccgtccacatctccggcgagctcgtgcccatcctcaagaaggccggtgccctctggctctgattttaatcttagtctatcgatcagcagcgtatttctcctttccttttttttccttttccccccaccttccagaaatgatggcgtcgtcgtgctttaatcctggccgttggatcgatcgagtaaattacatcacatcgcggcggatgcgttggcatagtaggactttgattttctttttctttatttacttttttaattaggagaagcaaaaaaaaaagaacatgaggattctaatcgc

SEQ ID NO: 19618 - DNA, 665 bp, Sorghum bicolor
  unsure (1)..(665): unsure at all n locations
  Clone ID: LIB3481-058-Q6-K1-G6
ccccgcgtccggnaagccagcaggccaccgaggcgccggcggcagcggcgccaaccctggaagccaggacgtgaggcggtgcttctccatggggacctacgagtacgtcatggacgagagctcccttctccgcgtcgccgtgaagccgccggagaaaaagcggcccgcgactcgcatgccggggcaccgtgttgccatgtcggagtgcgactgccactccaagcgggaaggcttccgcgggttcgatgcgccgcccaagcagcagcagcagccgtcgtcgaaagcggcggtggacaagaaggagagcttctccatctccaagatatggatgcgcagcggcggggcgaggaggaaggacgtgtcctccggcgcaatcgctgcgccgtcgtgctcgacctcgcgccgcgcgtcgtcgttccggctcccctcggcgctccagcgcacggcgagcgacgtcggggtgacagcaacggcgttggtcgtcccgaagcgccgggcggacgtggtgagccccgtgacggagtccgagtacaacgtgtcgacgtgggacaagagcgccagcggcagcgtcgtggattgggacgtcgagtccgccgccggcggcggccatggcctcagctccagagccgacgaggcgccgtccttcgcccggcggacgctgctct

SEQ ID NO: 19619 - DNA, 577 bp, Sorghum bicolor
  unsure (1)..(577): unsure at all n locations
  Clone ID: LIB3481-059-Q6-K1-A2
gcaggnaaatgaganaaggtaggaatgtatagcaacttccatttgctgtcagcacacgccttgatttattggacacatgattcatccaatctgggacttttcaggaggtgggcagttgtaacctatttccagttgtaatttcttcaaccttgatctggaaggccaccaataggaattcttctgcgactttaaagccaggactcggcagccacaaacatgagtgctaactttcagggaaggatgctgtacttgagcatttttcttttacttattagtgtagcattttaacctttggtgtgaaacaatagtattctagcagataattaatttttctgatttgttggaggtcaatttatttcatgctaagtttagaattttttgtttgttccacgaatgatcacttagatgtgtgggtgaatttgagcattgatgatataatggcaacttagaattttgaaactcccgtatcaacagacggacaaatactatttacatatgtactcgaacttgtaatgatggtatgaagataaagtgaaacttatttaaaaaaaaaaaaaaaagggcgggtcgttttaaa

SEQ ID NO: 19620 - DNA, 529 bp, Sorghum bicolor
  unsure (1)..(529): unsure at all n locations
  Clone ID: LIB3481-059-Q6-K1-A3
ngacagnctccgcctccagcctggatgaagtagaatctcaagagcgccaaacagcgctgaaggtggattccagctgcccacaagaggagacgtgcacactagctagaactagagacttggcaagggatatctataaggctccgagtatggagtgccatcagaggtttcactagaaaggcaaagaggggggacctgcaccattgacgaatcagacccagcagaggttgtggcccatcgagcgaggtacttgcttaagaatggtttcggaaattacgacatgggagagaagaactgtgaagactctggactgtactgcaggacggggctgctgccaggtgaggaacctggcattgggactagggggcaagcttctgatgccatgggtgagactggggctgctattcactacactccggttaagctctgggcagacggtgcgctcggcaggggcactggcacagttgggatggacggcgctgagcagaacactactgacataggagtaaggaaggacggagcaaaagtggaa

SEQ ID NO: 19621 - DNA, 251 bp, Sorghum bicolor
  unsure (1)..(251): unsure at all n locations
  Clone ID: LIB3481-059-Q6-K1-D3
ngaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgggccggttttaaaaggatcccaaagtttcacgtcccgcggcgcttgcgaacgtatataagctttttttttaggggccnccctaaatattaaattcactgggcccgccggtttaacaacacgtggggacttggga

SEQ ID NO: 19622 - DNA, 434 bp, Sorghum bicolor
  unsure (1)..(434): unsure at all n locations
  Clone ID: LIB3481-059-Q6-K1-D4
ggctaaccacaggnaaacagcaagagcagctgagatcagctgcagtcgaggcggatggttcttcagaggaggtggtccatcccagcactgcataaacggggggagcttctggctgactcaggcaattgaaccaggaacaacaaattcggtgaggcatccagggattctgcgtgtttttgttagaacgatgcaggatgcacaaatgcatgtatgccttttttttacgacctgaagaaatagtcgtcctggctcctgtgggccttcatgttgtgcgttattgtctagcaatatgtgtgcatgtggcttaggaaaagtagtagaatgtagtttggtaattacatttgtagagttttcaatactatacaatgagagagcagatagattgtaaagaatggcaacgaccgcaatggagagatctctttgttcatctgtgt

SEQ ID NO: 19623 - DNA, 653 bp, Sorghum bicolor
  unsure (1)..(653): unsure at all n locations
  Clone ID: LIB3481-059-Q6-K1-G2
ggcggccaatggttcntaacatttattggaaggaagcatgaggatgtgctcactggagagtctaaccatctttacggattgcttgcgcagtcgctgaaatccctagttgatgagggtcttgtggacaagngaaaaacttgagtcattctatctaccaatgtattcaccatcggttggtgaagtggaggcgatagtgaagcaagttgggttgttcaacatgaatcatgttaaagtattcgagataaattgggatccctacgatgactcggaagaaagtgatgttgtgcgtaacagtattaggagcggtgagaacgtcgccaagtgcctacgagcagtgatggagccgctggttgcaagccaatttggagaagccatactcgacaagttatttgaagagtacgctcgccgtgttgccaaacaccttgagaatgagaaaaccaagcatgctgtgctcgtcctgtccatgaagaaagcaatacatgtgtgaagtgtgttctttctcactctcgctagttattatcgcaggctactagtagttctccaggaaattccgtatgtatgcttgtgtgtacatgtgtgtgtatttagtgtactctatgccatgcatggtgtttatgttatcttccctggctattgaatctgtacgatggtga

SEQ ID NO: 19624 - DNA, 577 bp, Sorghum bicolor
  Clone ID: LIB3481-059-Q6-K1-H2
cagctgccttctcgcataccccgccgcctgcccgctccacgcttgccacgccggcctcgctcgcttctcctccagagacgcggcgcgcggcggttgcagcagccggcatggaggccgcggcggcggcgccgcatctcctgcactgcagcggcttcggccgcgtcgcgcacctcccggcgctccccggtcgccgccaacgccgccgccgaggacagttcccacgcgtccgcgccgtcgccacggagcccaagccgtccacctccaccaccacctcctcctcctcctcctcctctcgcgacaggaccaggagccgtcatgacctctccgacaccaggttcggagatgtgtccaaggagatccagcgcgtgcgcaagcagatggagcaggacgagcagctcgccacgctcatgcgcggcctccgcggccagaacctccgcgacgagcagttcgccgacgacaacgttcgtctccgcctcgtcgaggtagaatctgcggacaacaatgaggggctgccttttgtggatagccctgaaatcatatcagcttactggggcaagcggccgagggccgttgccac

SEQ ID NO: 19625 - DNA, 395 bp, Sorghum bicolor
  unsure (1)..(395): unsure at all n locations
  Clone ID: LIB3481-060-Q6-K1-A3
accaccagggcgggcancancccacaagaggaggagacgcnccacaggggggcgaccacaaagaggacgacgagcacaagaaggaggagcacaagaaggccgaggagcaccacaagaaggacggggagcggagggagggcancgnggagaagaacaaggacaagancaccggcgagcacggcgagaagnccggcgagcacaaggacaaggaccacaaggagaagaaggacaagaagaagaagaaggagaagaagcacggngagggccacgaccangacggccacagcagcagcagcagcgacagcgacggagcnncccccnngccggcaagcnacgccgngcgcnnncanacgcangagcaggnggaacangagccnggagnaggaaacanacca

SEQ ID NO: 19626 - DNA, 503 bp, Sorghum bicolor
  unsure (1)..(503): unsure at all n locations
  Clone ID: LIB3481-060-Q6-K1-A4
gtccggtggggcgacgccgccgtggncgcggcactcggcgcgccggtccggctcgcctgccaccacgcggctgcgacgacgacgacgccattgaccgggcaggacgacgaccccaccgccgcgctggccggctccacgtcggacgccgccggtgggtccagcgtggcaatatgaggcggggaagcacgagggcagttctggtattgtacatgcccatgtgcgccacgggtctaagtatgttgntgtgtatattaaagttaaaccacgccattagcgccggctaatcttggcgggtgggccatggccgcggccctaatggtggctggaggtgagtgggtggtngntgtcatgcatgatcgatatggtaccctngtattgtagtttcatttnattatgcgccattgtagatgcttgagctncacagttgcttgtaaatggaggtagtagttgtagtactataaaaatgatgtggttacatgcatgttataccaaacatgatgtga

SEQ ID NO: 19627 - DNA, 477 bp, Sorghum bicolor
  unsure (1)..(477): unsure at all n locations
  Clone ID: LIB3481-060-Q6-K1-B1
cgcactgccactcagccacaccacaccaggtcatggccggcgtgaactccagcgtcgtcggactcaagcccgccgcggcagtgccctaggccgtcgncgccgccgcctcgtcgcaggcgaagcgggtgcagctggtcgcgcccgagggccgncgtgccgngctgttcggcctggcgggcgtgttcgncgtnaccggcaccaccggatcggncaaggtcgggatcattgatgagtaccttgagaagagcaaggtcaacaaggagctgaatgacaagaagaggttggtcatcagtggtgctaattttgngcgcgcttacactgttgagtttggtaggtgtatgttgttttacaatttgagtgggtgttaggattttggtaagtagaagaaagtgttttttatgattgatgattttgagatcgtgtgcgaggggaaggagaagtttaagtgtgggtgnagagttttttggaagtggggtg

SEQ ID NO: 19628 - DNA, 672 bp, Sorghum bicolor
  Clone ID: LIB3481-060-Q6-K1-B4
ccgccctttttttttttttttaaacatggccaagtcataatccccttgttttttcaagcagacactgagtacactgtactttgaagcatccaaatgggcttacaacatttacttgattgctggcacgcacagtagtatcccaatcgaaagcagtcccagcatgctcaagttgctgggactgacactagattaaccacaactttgtaattaccctgtgaatctcctagctaaataactcaagttgtaactgattgttattggttggcgtcatcattttcatcatcagagtctgagtcacttgcattgtatcctggacgtttcatgccaaccctcaaagctgaagacctgaaccttgatgccctatccatccattgttttcccttgtactcgttcttcggggttccgtaacccgagaagaacatctgcgctacaagcacctggttggcgatgtcccctttgcgcgcctacaagctgatctgccaagcgcatgtttcttgcccaccatggttttcttctggagcgaagaagtttattaagcgcattctcgatcctaatcctgatacgaggataacaattgcagaaattttgaaagatgaatggttcaaaaaagatataaaccaccacgttttgaacaaggcgaagagttagccttgagatgtcgatgctgcattc

SEQ ID NO: 19629 - DNA, 649 bp, Sorghum bicolor
  unsure (1)..(649): unsure at all n locations
  Clone ID: LIB3481-060-Q6-K1-D4
gnaacatcagnatctgctgatgcttcttcatgcccattcgtagctggtttattccctcctctcccacaggagacagcaaagtcttcaaaattttcatccattggatcacgttttaagctgcaacttcaatctctcatggaaactttgagctctaccgaaccccactatattagatgtgtgaagccaaataatctccttaagccagccatttttgagaatacaaatgttatacagcaactaagatgtggaggtgttcttgaagctatcaggatcagctgtgctggataccccacaagaaaaacattttatgaatttgtcaatcgttttggtgtccttgctcctgaagttttagaagggagcaatgatgataagattgcgtgccaaaagattttggaaaaagtgggtctggagaattaccagattggaaaaacaaaggtgattctgagagctggacagatggctgatttggatgctcgtagagctgaagtattaggaggagcagcaagaatcatacagaggcaaatatgtacatatattgcaaggaagcagtttgctgagcttaaaagatcagcaatgcagctacaatcttttgtcagaggaaccttggcccgtaagtgtatgagtgcatgaggaaggaagcggcagcagt

SEQ ID NO: 19630 - DNA, 665 bp, Sorghum bicolor
  Clone ID: LIB3481-060-Q6-K1-D5
atctttgccaaagcgagcagctggtattcgctatgtattcattggcaagccaatgaatcaaaggcctaggtaccagatcttgggtatttttctgttgattcagttgtgtattctcggagctgaaagactccgaagaagtaatatatcgtcaatagctagttccattaatcaaatatcatctggaagctatccatcgtctacaggtcggggcatccctgttctaaatgaagatggaaatatcatcagcgacatccgcagtggtaaagctgcagatatagcttctcattcagaggcttccagtggcaagagcaaatgcaccctctgtctcagcacccggcaaaatcctactgccacaacctgtggacatgttttctgctggaattgcataatggagtggtgcaatgagaagcctgagtgccccctatgcagaactccaattacccattcgagtttgatttgtatatatcattcagatttctagcaaaccatttcgcacagtaggaattccataccatacttcgctggcgtcaaaatttctagaccatatttcggcaagaaacctgcatgctgaaatggtttcgtatactgaagtgggtcagaatttctagaccatttcaagaggttgaagatcagacaaagctgcatacagtagtttgtagggttga

SEQ ID NO: 19631 - DNA, 529 bp, Sorghum bicolor
  Clone ID: LIB3481-060-Q6-K1-E6
aaaaaaaaaaaaaaaaaaaaaaaaaaaaaaaaaaaaaaaaaaaaaaaaaaaaaaaaaaaaaaaaaggaagaaaaatataaaaggaaacaaaaattgggggcgcggttcttagcagaatccatgccttcttctctggtgcttgcctacgatttagttttcttggtcgtgggttcttcaacttcatttacttgggccgaccttgtccttccccaccttttgggaatcccctgcactttcccctattttgactggtgttgttaataactccccttttccccaccgggcgtctttcccaaagggcccgccccctgtgtccttcctgggactcgccctgtcggagtgcattaggggccgcgcctttgggggttactttcagcgcgcccgttgctgtggttacccccctagtgcccgttcctttggctctgtccctttcgttcgttgcttttgtttccttctttccctttcaagctataaatcgggggtttcctttggggtttctatttagggctttccttttcggggtccccta

SEQ ID NO: 19632 - DNA, 556 bp, Sorghum bicolor
  Clone ID: LIB3481-060-Q6-K1-F1
tgaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaggggggggcctgttttaggggaccaaattttccttcgcgggcatggcaccttttgcctttttttttggggcccaaaaggtcaattccgggggccgtttttaacaactgcggagtggggaaaacccttgggtccccccatttaaaggcttttgaagaaatcccctttttgccgggtggggtaaaagagaaaggggccctccccgttccctttcccaacaattctcccactttattgggtaaggggacccccctttttgggggtcttttaagcggggtgtggggggggttctcccctagggaaccctttttttttgctgggccctaccccccccccttttgctttttttccctttttttttcacgcagttgggcgtttttcccctggaacgttttaatggggggt

SEQ ID NO: 19633 - DNA, 541 bp, Sorghum bicolor
  unsure (1)..(541): unsure at all n locations
  Clone ID: LIB3481-060-Q6-K1-H2
nagnaaacgcanaaaaaataccgccgaacaaaggccatcgccaggagttgacaaaactgagaataaccaacattgaaggaatagataagccagagactgctgctgttgccgcctaaattcagggcaaagagagaagtaacagcgcgatttgtttatggcagcaaggcctgcctaggcaatcattttggccggtcttataagttcagtcagattttgatagtcgataccagtgaaatgatgcttcttttcttgttaattcaaaggttagaagctgtcagcattcggactcgggtacaatatctgacatgatgccaatgcactgagcagtttgggtggtgtggatcggctgttgtagtttacagtgacacttatttttcattcttggttagcttttctgtgcacatcctttatacatgtgttctgaacttctgatacgtcagttccatgttgattactagagtgtaataatgaaaccgcagtgcttcgtttctgcccccaaaaaaaaaaaaaaaaaaaaaaaaaaaaaaaggggcggccgccc

SEQ ID NO: 19634 - DNA, 491 bp, Sorghum bicolor
  Clone ID: LIB3481-057-Q6-K1-B11
gtcactgaacctgctgagggtgatatcggggcaggagggcgtcccgagcgaggagctcaacgctggccgcgtctgcgactggttcctcaaggacaagctcaagagggagcagaacatcggcaccgccgtcctgcagtgggacgaccctggcttctagagccactaccatcctaagcgcgggggggggcagattctgaaaaaaactagaggagcaagcacagcgtggacgaccatagtgcaacagagtttaatgtgtcaatgccattgcaggatgctcatggttgacaagagtttgatgccaccatgttcgcttgttcagtcttgatcatacctgtaatccacttgtgttcaggctaaactgccccattcggccatgtgtggttcaagcccttttggggtgagcaaccaagctacaaagttcagtatttttgattatttcggtttgtagaatgggttcgtcaaatcggtctatgcaataatgatttcatccc

SEQ ID NO: 19635 - DNA, 630 bp, Sorghum bicolor
  unsure (1)..(630): unsure at all n locations
  Clone ID: LIB3481-057-Q6-K1-B12
gttcctctttaaatactttggcaggatgtggggtgggggtttttggctccngaagtactaacatggagttgctacaaacgtgcttagttaaaagtttagtgaacttttagcatttttatggcgcagttgtttgcctgatggtcattttgatttgaattgtagtctaaagatgtgcgcggcaggggtacctcattatgctctggtgaacttatccaaatttccgtctgattttagtgtgtgattgtattgattaccttggcttggcttgacttgagatatgataggctgcaaatatcttggtactagttgacattttgttatgctttcgaccaccacgtagtacagaaatattttctgttgcttcacataattggttcacatgatttttctgtagctgcttacctcatccaggaactttgtcgatggaactagggatataaagtagattgctaaatcatctattataaataacattgaaacaagctggcagaggttgtcctgattagatgacttatgctctttttgtttgcactagattggtgagctacttatntcttttatcatttatcatctgtctgtttgtacactgccctaagagttgaaatgttgtttctctgctttcccataatt

SEQ ID NO: 19636 - DNA, 602 bp, Sorghum bicolor
  unsure (1)..(602): unsure at all n locations
  Clone ID: LIB3481-057-Q6-K1-D12
cgtccgctcctctgctgccgcgcgcccgcccggggggggntcgcngggacnaaaaaaataggggccgcaacagctactacggtaaccgtggtggcgttggattcttcggatcatcgtcgtcagagcgcctcctccacccggcggcggcccggcacgacttctcttcctccnccgccttgggcgggcggcgggccgacctgnacgaggaggacgtctggtcngctgtcaccaccaacgacaataaccagcaccaccaccgggacggcggcgccctggtgcatcatcgtcgcccagacccagcgtacggcctgtcgctcgcgttcgcgtcgccgcccgcgcggcactcggcgccggtcagtgtccccgagtgtccctccgccactttgccggattatgacggcggcgacctcgagtgggtgcctccgcacgagtacctgcagcggcggtggtgcggagcaggaggggcgtcggtgctggagggcgccgggcggacgctcaagggccgngacatcacacgcgtgcgcgacgccgtctggaacaagacccgattcttcggctagctgttgctgctggtattcttcttcagtgtaatatatatacat

SEQ ID NO: 19637 - DNA, 529 bp, Sorghum bicolor
  unsure (1)..(529): unsure at all n locations
  Clone ID: LIB3481-057-Q6-K1-E12
cgtccgtttctttcctcctccncnccnccgcgggcggggggggggcgaaaccaaccccgctgcagcgcacgtcgtccgtcctggaccggctccgctcgctggggctctacggcttcctcgctcccgaccaacccaccgccgccgcgccagttccagctacctatnccttccccacccactggggggagagccggcactctcactacnacaggagcctgtcctagccggcaccggtgcaaggcaagaaggagaagaagcaggaggcgaaatcaagaatggcaaagtcgggctcggagactaggaagacgcccgctccgaggccggtggaggccggcggcgagtgcgtcaacgcgagggcggaggcattcattttcttcttcaggcagcaacagcagcaggtggtgcagcactaccaggaggaggagtacgtnccgccttcagcgcccgcgcccctgtcgcgcaccgtctccatcctggaccgccttcgctcctttcgcctttaccgcttccgctccggcgacctgggccc

SEQ ID NO: 19638 - DNA, 665 bp, Sorghum bicolor
  unsure (1)..(665): unsure at all n locations
  Clone ID: LIB3481-057-Q6-K1-F8
caaaaggagtagatccgaaaaanagccttcatatgccgatttagccaagtattgtccattagaggagagcctccataggtgctggcagctgaaaatccagaagtagatcccaccataagtgaaagtagtcaacaaacccaccaactgtgagcgctccttgtatgtccaaaatccaagcccggttagtaagggcatcctggacagtatgctgcttaaccctccttttaggagtagccacaaaaagtcgaggggcaagatctgcaatgcattgcccattgatccgatctgtccagaaaagagtgtttgcaccatccaatttcagaagttactgccactgagtagaaggctcttacttgcttcggcacatggaatggtagagcagcccaaggacaatgaggttctgttttctgcagccaaacccatctcgtgcgcaaggaccagccaagggtttttaaatctgaaattcccaggcctccaagctctggtgggccacagactttgacccaagccacaagacaatgaccacctttttgcatattttcgacccctccaaagaaagccacgccaaattttatttaccactttgatagccatggaggaaagtcgaaagcaatagctaagtaaatgagcattctcagtgagaactgattgtacttgaacccttc

SEQ ID NO: 19639 - DNA, 188 bp, Sorghum bicolor
  unsure (1)..(188): unsure at all n locations
  Clone ID: LIB3481-057-Q6-K1-G12
cttgtgntntctcnnttctcnngcgccccccccctcngcctggccgtcnntgngcgggcttctgncctcctccccgtcccccgtctccttctcggtcgggggttgngcgngcttgtggttgttgtctntgtgcgtggtgntgttctgcgttgctcttgggtgggccttcttcccgggttcccttccct

SEQ ID NO: 19640 - DNA, 616 bp, Sorghum bicolor
  Clone ID: LIB3481-057-Q6-K1-G8
caaaaaaaaaaaaaaaaaaaaaaaaaagggggggggggggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgttttttaaagggaccaaattttacttccccttccttccagggggggggggtttttttttggggcccctaaatttaatttcttggcccgttttttaaaaacttgggattgggaaaacccttgggttccccaatttaattggttttgaaaaaattccctttttccccagttgggtaaaaacaaaaagggcccccccgtttcccttttccaaaagtttcccccccttaatgggcaatgggacccccccttttaggggcctttaaaccccgggggtttgggggtttccccccaggggaacctttatttttgcagggcctttagcccccttttttttctttttttcccttttttttttggccagtttggcggttttccccctaaaatttttaaatggggggttcctttaagggtcccatttaagggttttagggccctttcccccaaaaaaatttttttggggggtggt

SEQ ID NO: 19641 - DNA, 353 bp, Sorghum bicolor
  Clone ID: LIB3481-057-Q6-K1-H9
cggccgcgtgggttttttttttttgggggggggggtggggtttttttttttttttttttttttttttttttttttttgaatatttctaaaacgggagggggccctcttaaggatccaaacttaccacccccggccagccaactcaaagcttttttaaaaggtcaccaaaattaaaaggggggggggggggtttacaaacgcctgactggaaaaaccccgggggtacccaaattaaaaaccttagaggacaaccccctttccccagctgggcaaaaaaccaaaaggcccggaccaagggcccttcccaaaagttgcccaacctgaaaggcgaatgggaccccccctggaaccgg

SEQ ID NO: 19642 - DNA, 284 bp, Sorghum bicolor
  Clone ID: LIB3481-058-Q6-K1-D7
aacatcagggagctgacagctgggcccagcgggcctaaaaacgttgctaaaagtcaagagtcaagttacaacccttaaaatcaccaacagtcaaaacatagacaaatatactttcatgcattagcagaactggccaatggttttcgttgggcgcgtgcatcgaggccagaagaaggctttatatgcaacaaaagccatgacaatgtcgggggacctccatcactggaggaaaaaacaagacggggcaaatccaaagattattacaacacagggttttagatcgg

SEQ ID NO: 19643 - DNA, 480 bp, Sorghum bicolor
  unsure (1)..(480): unsure at all n locations
  Clone ID: LIB3481-059-Q6-K1-A11
ccagcgtccttttaattttgttcgtctacttgttttaggggatggggggggatataatcaggtcaaacagatgcatacctttagctgcattctggtatttggtgtgcccacaatactgcttgtcatgaacataatgtggtttgcgaagatcttgagaggccttaaaaagagcttgccaatagggggtgggaggagagaatggtaacacaagctcaaggacatcnacaaccatcccttcgtacagtcactttacagttacatgcacttcccgggtaaagccgtcagtgcagcttgtagcacaagctaaagcccttgtacatgatcctgaaatatgctaagcacagctcaattttttccctggatgctctgccttgtacataaggccgtctggttatggtggaggatgttttttcccctgtggattggatgattctacaccttaacaatttaggtagtcttatatagacctaggaaggttgg

SEQ ID NO: 19644 - DNA, 526 bp, Sorghum bicolor
  Clone ID: LIB3481-059-Q6-K1-B7
cttttatatatcaatggaaaatggtcacgcgttctgctggggaaaaaaaaaaaaaaaaaaaaaaaaaaaaaaaaaaaaaaaaagggggggcggttttaaaagatccaaaatttacataccccttccttgccaaataattaaatttttttattaggggccccctaaatttaatttacattgccctttttggggggggggggggatttttaaaaaccttgaatttcccaaatttattgggttggaggaatttccccttttggccggttgggtaattggcaaaagggccctaacggttctcctttccaaccattttttaagcttaatggggaattggaaaaggcctttaacggggcatttaggccgggaggtgttgtggtttatcgcaaattggaccgttccctttgcagggcccttaggcccggtccttttggtttttttccttttttttttggcaagtttggcgggttttcccggtaaggttttaattggggggttccttttaggtttcgattttatggtttttggg

SEQ ID NO: 19645 - DNA, 400 bp, Sorghum bicolor
  unsure (1)..(400): unsure at all n locations
  Clone ID: LIB3481-059-Q6-K1-B9
cggtagcgtgggcgngagcgtgggcgggggggggggggggagcgtgggcggacgcgtggngaaaaaaaaaaaaaaaaaaaaaaaaaaaaaaaaaaaaaaaaaaaaaaaaaaaaaaaaaaaaaaaaaaaaaaaaaagggggggccgttttaaaggatcaaagttaactaacccttccatgggagggggggggggttttatatggtaactaaaattaaattaattggccggggtttaaaaacgggggaattggaaaaaccttggggtaaccaaattaaatggctttgaagaaaatccccttttcgcaagttggggaaaaagcaaaaaggcccgaaccaatcgcctttccaaaaagtggccaaccctaaaggggaaatggaaccccccttgaaccgggcaata

SEQ ID NO: 19646 - DNA, 397 bp, Sorghum bicolor
  unsure (1)..(397): unsure at all n locations
  Clone ID: LIB3481-059-Q6-K1-C10
cggnggtcagctcaatggtagactgcgtagagtttgcagagcgggatgaggaggcggtgaaatttggggtggagggagattaagaagaagctggaaaacttcatgaagagcgtcgaggatcttggggagcaagcagaccggtgtagccgagatatccgtcgggcaagaactgtcgtgctgcggaggatcatccgacaaccaanactgaaaaaataaggggacatgtaaggtatggatgtcttaacatataagccatgtactcttgataatgttgtgatggaatgtacataagagatgcacctttaggaaattgtgaatgagtcaaatcgatttcgttatccatttgattcatggtatctgtactttactactttcatacttgattatctctttttcc

SEQ ID NO: 19647 - DNA, 585 bp, Sorghum bicolor
  unsure (1)..(585): unsure at all n locations
  Clone ID: LIB3481-059-Q6-K1-D11
cgtccgcccatcgtccgcccagcgtccgcgcagggggggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggccccttttaaaaaaccaaacttaacttgggggttgatggggggtaaaactttttttatantncaaccaaaataaaataaattggcctttttttaaaaacttctaaactgaaaaaaccttgggttaaccaaattaaatccctttaaaaaaaatccccttttccccagttggctaaaaaccaaaaagccccaaaccaatggcctttccaaaaatttccccaccttaaatggaaaatggaacccccctttaaccggccaataaagcccggggggtggggggtttaccccaagggtaacctttaaatttgaaaggccctaaaccccccttctttacgtttttttcctttcttttttggcaacatttcgccggttttcccctaaaacttttaaatgggggcctccttttagggttccaattaagggtttaa

SEQ ID NO: 19648 - DNA, 626 bp, Sorghum bicolor
  Clone ID: LIB3481-059-Q6-K1-D7
gttcgttgcactttttggtctcttggtgaatctttaaagcctggtggtgtagtgaacaatttcgttatggctgcttggtgctaccatttgtactctcagccatgtggtcaccctgatgtttcaaaatgtcacttcttcttttcaaatattggtgatcaacttctcaaagatgtagatagggcaaatgaagacatcttgagaagagcttttactcgttcatctaagaccaggcctcttcatcgttctgatttgttgtttttcccctgtttctacgaggaacattggtttgtatttgttgttgatataaaggatcagtgctttgtttttctggattcctactatgtgttacaacctgaattccaagttgaagttcgtgacagactgattccaaatttcaaattttggtgggagaaactcgtcatgcttgatatgggttttgaaatgtataaacttctttatccatttgttcctaggcagcctgctcagaacatatcggattcaggagtgtatgttatgatgtttcttgagtattggaaatcacctcgttcttctctttttaccttattcaaggagtctgacattccaaacttgaggatcaagattgcaaatgagcttcttttttctcc

SEQ ID NO: 19649 - DNA, 404 bp, Sorghum bicolor
  unsure (1)..(404): unsure at all n locations
  Clone ID: LIB3481-059-Q6-K1-D8
ttttttgggggctnnaggggggggggggggggggggggggaagacaaggatatggggggcgnagagagttaagtatagtggtaggtcggttggaggaagtttggggtagttgctacgttcatgctccctgtagagattgacattgctcacctcagttgagcttgactattgctgagggggggggggtgcattctgatcataatcatatacacaaattatggtctgtaacccatcttgtttctttacatttgatatatttgtgacatgattgcttcagccttgtataagtgaatcctaggtaaccaagaccaggttaccaagttcgtgattgctatatgtaaggagtgtgtagattcagtgtaatgtctgtaacaagcgaactggtgcttatagtaagtagaatg

SEQ ID NO: 19650 - DNA, 439 bp, Sorghum bicolor
  unsure (1)..(439): unsure at all n locations
  Clone ID: LIB3481-059-Q6-K1-F10
ctcgtcatgggtgtngcaccatacggggcgaggggggagccgggggcgggttcaaggcggaggacggggccggagctgagaacgacaggtgcaagtgcgggcccaactgcagctgtaacccgtggacctgcaagagagctgaataataaccccctgcactgaactgcaacccgggagggagggacggggggacgttaactgtaatatagaagagtcaggactgtgagtgagatagagtgaggcaggaagaagagtgacatggcaccatatgctagtggatatggtactgaggggaaccaataataattggactgggatantggtgtggtgtagancttaatgtgctagtaggggggctaatttagtaggagttggagaagagttgtgagtgggtgggtgcagtggagcacagtagtatgccaggggcggtggtttgtgg

SEQ ID NO: 19651 - DNA, 457 bp, Sorghum bicolor
  Clone ID: LIB3481-059-Q6-K1-G9
aaaaaaaaaaaaaaaaaaaaaaaaaggggggggggggggggaaaaaaaaaaaaaaaagaaagaacaaactaaattattaatttaaggaaaaaaaaagaacaaatatatattaaatgggatcatatgataataatatgctacccctttccttggcctaatccttccagcttatttgtatccaatggtggggggggggggggtttttaacaatggtctgggtttcctactactcttgtgcattgactcagcactgtttgcctttggaactggtctaaactgcactaacctttttttcttttatgtcatgacatatccttagataatagggcggggggtggtcctgccatcgtaagctcccggggctctcctccggtgaaagaaaagagggaaagagacggagccggctgaatggacaggggaagcaattcctccccgcctccccagagctcacctccgt

SEQ ID NO: 19652 - DNA, 650 bp, Sorghum bicolor
  unsure (1)..(650): unsure at all n locations
  Clone ID: LIB3481-059-Q6-K1-H8
gtacatccaagnacatatcgatggcacttcagacgacgagcgagagtttagcggcatggatatgaatcagagactccaactgttgatgaaatggtgcctccgggagacttgtgatgctgggaagaaatgcatgagaataaactaccacggcacgaagcaagtcatccgagcatttctgcctctgctgctgtcttctgacgatagaaggatagtcaatgtctcctcagtgcttggccagctcaggtttttcggcagcgaggctttgaagcgggagctgaacgacgtggagagcctgaccgaggagaggctggacgagttggcggccatgttcgtggaggacctggagggcggcgccgtggaggcgcgagggtggtggcctgctggtttctcgccggcgtacatggtgtccaaggcgacgctgaatgcctactcgcggatcctggcgcggaagcaccccgcgctgcgcgtcaactgcgtgcaccctggcttcgtcaagaccgacatgaccgtcaacttcggcatgctcacgccggaggaaggcgggagcagggtggtggccgtggcgctgctccccgccggtgggccgaccggcgcctacttcgaggagcgccagcagcaggcggcgttcgtgtgacacatactctgcttcg

SEQ ID NO: 19653 - DNA, 621 bp, Sorghum bicolor
  unsure (1)..(621): unsure at all n locations
  Clone ID: LIB3481-060-Q6-K1-A11
gtgtttcttgaagtggtgtgggggggggggggatgtaaattgcacattataaggtcattttctgctgcagattggattgagatggagaacagaaaaggaggtgatatctggcaagggtattattcagtaatcctgtcagttaaattccataaaatggtttacctgagagggggggggagacttnnatcgtatgagtattctgttgctagtaatggaccattaaaatggaagtctagaacttaaaagggtatttaaaggaactgtatcaaactatcgatgttaccgagcttaaagggttgcttggtacacttagcaaagtacaggtgggggttgcttgcatcgaacaacctcaaactccaaaatagatcagaactgaattctagtttttggaagccatcgttgtagttttatcatattattatataattacctgtaatagaacctagaaagttcctcgagagatcagaaatatatattcttgcaaacaggatctgctatttgttgatcaatatctatgatgttcagtaataaccagaatatgctcttatgcagggcaatttatctgtggcaataggcattgtgatgaaaaactggtctaggtagttatgagggcaatttttc

SEQ ID NO: 19654 - DNA, 574 bp, Sorghum bicolor
  unsure (1)..(574): unsure at all n locations
  Clone ID: LIB3481-060-Q6-K1-A8
atccctgggtgggccgangtcttgctcatcaaagaaaaccttcgaatttattatggaaaaacttggcaggatcattacagcttgaagaaatggatgattcaacgagtagaggtggttgtgtggttgcacatactccaggagcgggtaaaactctggggcggaggggatttcttgtcanttactttgaaagttcacccaagaagccgaccattggtccttactccaaaagccgcaatccatacatggaggagagagtttcagaaatggggcattttgcttccgttacatgtgcttcaccactctaacaggacaagcaaactgatgaggggtcttagttcgaaactgcaggtggttttaaagaattttcaccaaccaacatgngaaaacaatgcgcatnatggattgtctagacaaattatgcaagtggnatgaggaaccaagcattnttntcatgacatattcttctttcttatcgcttacgaaagaaaactcaaagttgcatcatcaggagttcataacgaaagttttgatgaacaaccctgggctattgattcttgatgaagggcacaaccca

SEQ ID NO: 19655 - DNA, 497 bp, Sorghum bicolor
  unsure (1)..(497): unsure at all n locations
  Clone ID: LIB3481-060-Q6-K1-B7
tgaaaaaaaaaaaaaaaaaaaaaaaaaggggggaggggggggggaaaaaaaaacaaaaaaaaaaaacaaaaaacatgcagaggaaatagctctataataatagtgaaaccttaaataagagttggctgggccgttagttttacaacttatttgactgggcaaaaccctggcggttgcccaccttattctgcagggggggggggggggcatttccctggctgtccgtaataacgatagaggggccggaccctatcgccttttccaaacagattgcgcattactgaatggggcaatggtacgtcgccctgttagcggagcatataagggcggggaggggtggatggttacttcgcagtgtgaccgttacatttgggaggggggtagggcctgttcctttaagtttattcccttggtttgtggggggtgttagacgggttttccttttaatgttttaaatnggtggctgcctttagggttcctatttactgttttattgt

SEQ ID NO: 19656 - DNA, 279 bp, Sorghum bicolor
  Clone ID: LIB3481-060-Q6-K1-D12
ttcggttcgacccagcgtcctttttttctgtgggctgccacaattgggggggggggggggggggaacatataaaactgatgtgtacgggcctggacaatgtggcttcctcgagttcggagtctactacttcagggtgagcaggtgcgaggatgagtactacatgctcggcactgtcaacttcacccacaccaccgtgggggggggggggatccatgtactttaaatactactaccaccatggatgcaagataaggaacagcaacgacaacgagtacagc

SEQ ID NO: 19657 - DNA, 567 bp, Sorghum bicolor
  unsure (1)..(567): unsure at all n locations
  Clone ID: LIB3481-060-Q6-K1-D7
gngaaagtaagtctattcctcctcttctcaaaccttcgcttggaggctccttagacgagcagttgctactggtgagagagctgggaggtattctgtccatatagacaagcattgctcttattatggggctattgaaactgaccaacatttgttttttaagtgcactttacctactgagatctggtccacagctaaccctcccctcataactaataacattcctgcagaagaagacggagtccaattgtccctacctctactaattacccctaacccaactgatgaaactttatataaatctctattcattctctggtatatttggaaggctcgcaatgataatatgttccaaaggagaacatggacttcttcccagattcatcaagccgcaaatgcccacatgaacactcatcttgctgctctcaatgagcaagatcagaatcagccaggtacaattctactttctgcaggtcctagtcgactccgacaacagcagcaggatgagccaagtgggacagaagcacacacatgatcaccagttcagccaccaaacaatgaactgacatg

SEQ ID NO: 19658 - DNA, 237 bp, Sorghum bicolor
  unsure (1)..(237): unsure at all n locations
  Clone ID: LIB3481-060-Q6-K1-F11
cgctagctagcgcgacgaactacggggggggggggatggccgcacagcgtctctgtccgccgtcgcggcgccgtgtccgtggccgggctcaggaagccgctcggcgcgtggtcgttccggcccctgcagccgagggcggcggngaggatgactgccgtgcgcgcgtggggtttgttagggggaatgtnttttcgtgctgaccgtggtgggggtggggggggtgctggtggtgttgga

SEQ ID NO: 19659 - DNA, 543 bp, Sorghum bicolor
  unsure (1)..(543): unsure at all n locations
  Clone ID: LIB3481-060-Q6-K1-F12
cgtccgttttttttctaacattaanattgtaggtggggtggggcttaaaaaactataagggtgttgcacactaatgtgtatcctattaataaactaaactgccatttttaactatggttatggaagcagctggctcttaccatgtatggacatattcatttctgtgatggaaccatctattggggggctaaactttcatttatttatttatttatttataatttatctatccagaggtcagcatcactagttctgaagtctgaagaatatctggtgttagactcatgtagaatattttagttaaagaatcacaatctttgatgagatattaaatctttcgtcagtccatcccttttaaatgaatccaaaatatttgtgtcattttaaatgcagttgaactcaaatgtccagttacggtgcatttgtcatgaatggaatatcacttgagatgacccttagtaaatttatctgatgcctcaaattaaccccacctgttgtttatgcttcagataccgtcgtgctggagttcaatcattacacgcc

SEQ ID NO: 19660 - DNA, 632 bp, Sorghum bicolor
  unsure (1)..(632): unsure at all n locations
  Clone ID: LIB3481-060-Q6-K1-G10
gggtttgcgcgcggtggcgctggcgtcgtgatggactccggcaacagcgggagcctccagtcgtctagcggcggcgacgacgagttcgactcgcggggtggagggggcgtcgactcctccccgctctccgcactgctccgaccgtcgccgtccccctccgccgccgcgttctcgctccacgggtcctacttcggcctccaagagttcacgtccgcgccgcctccgcagcagccgcaggccggtacctggtcatcggcctcgttccccggcgcctcctctttgtccccgcgcgtcgcgcaaccggactcgggcgcgggcgcgcgccagcagcaggctgctgacacgaccgtggcggcggcgcaagggcaaggggcggcgatgggcggcgcgccggcgccggcagcgcagcagccaccgagggggtcgaggaagcggacgcgcgcgtcgcggngggcgcccacgacggtgctcaccaccgacacctncaacttccgcgccatggtgcaggagttcacgggcattccgtgcccgcccttcggcgccgngggcgtcggggtcggggtcggtggccccgccgcgtcgcttnggacccgggttgaccacatttttcccccggggtggtntttcctggg

SEQ ID NO: 19661 - DNA, 532 bp, Sorghum bicolor
  Clone ID: LIB3481-060-Q6-K1-G12
catgttctcaaatttctctgtatcgcatggtcaggttgctgcagctgacaccgagtgaaaactgaggatcatcatgttctttaggaagtttttgcaggtataatctttactacggtaaacaacacacctgggggggtgtgtgtttggtaaggcatggttatcaagttctgaattggaataaagcaatcaattagagtatacagatttatttcttggtgggaacaaaattgcagaaatatatatatgtctcattgctgcctttagatatttgtagttaccacctaccatgcttgtattttttgtgtgtttgtttatcaaatgcacctctagtatatgcgatagcttcgtgtcatagcctatctgaacaatatattatctgaaacttatttgcttagtatgacttattctgtctatcaaggaaaccttctgctactaagtacaataatatatttgcaggctcgaataattgattgacatgctattgattgtcactaattaatttttatctccctcatgtataattgcagtgggc

SEQ ID NO: 19662 - DNA, 585 bp, Sorghum bicolor
  unsure (1)..(585): unsure at all n locations
  Clone ID: LIB3481-060-Q6-K1-H9
cccagcgtccggnctagttctaggacgcgagcgggcgccctttttttttttttttttttttttttttttttttttttttttttttttttttttttttttttttttttttttttttttttttttttttttttttttttaaagggggattttccctgccaaaattcattaaaaaaaaaaggggagggggggaattatttggggttcatttttacaaaaaattaaaaaggccaaaattttccacttgggcttcaaaaaaggggggaaaaatataaaggggccaaagccggggaaattaccaaaaccttcttttaggaaaaacaggggggggcagttttaaggttttccatccaaaacggaaaaaacccccccctccggaaggggggattattattggcgggcaatactttgcaggggaagaaaggggaaagggcctaaccggggttttttatgccggggggaatcccctttatgggggggaggagggggttttccacccccggggggttcctcctccgcgggttaaacttaaacaatccggggggtttttttttggggggaaaactttttgaaaggggggggtggggg

SEQ ID NO: 19663 - DNA, 232 bp, Sorghum bicolor
  unsure (1)..(232): unsure at all n locations
  Clone ID: LIB3478-015-P1-K1-D8-F12g
ctcatcatattcacccatcatcccgctgtcgcgggtcctggcgcagctgtgtgtgaccatggggcagaagtttctgtcaaagctttttttttnngtccantnntgttttttcgtggcggcatcaccgtctattgtcctgctctgctctgtcccagattgcacagtctcctgggccctgttttccgtttgccgtggcgtgtcntatgatcttataccttntntgctcttttgg

SEQ ID NO: 19664 - DNA, 270 bp, Sorghum bicolor
  unsure (1)..(270): unsure at all n locations
  Clone ID: LIB3478-015-P1-K1-D8-F13g
ttgttgcccggggggcgtcccgccccgcgccggctgcctcactaactttctcttgtccggcctgtgctcgcccctctccgtggcccctcgcgctcaaaccgcctttttgttacggctgcgccacagcctgggctgctggccgtgttacctgatccgttcgcccctgcgctgtcccnggagcctttcctctttcccttgccagggctctccgtttccccttgcctgtgctccgctttttttagccccgtcccttgtgctacctcccctgcc

SEQ ID NO: 19665 - DNA, 603 bp, Sorghum bicolor
  unsure (1)..(603): unsure at all n locations
  Clone ID: LIB3476-018-P1-K1-C11-F2k
gcctctccggcatggcgggtttcaaatttaagctccacttcagcagaatacagtatattacaggtaccacgggcacgattcacacccaactaaaaagcagcgtcgtacacacgggggcgggcgagaaagagtgaaaaaaagccagataaattacatagggtcgaagaaacaaaaataaattacggagtacgtacatagcaacacaaagggaccaatgtcaccatgaaagcaactagcaaagcggtgccatttcccatccaccacctacctaatcatgccgagcggtatggccggcgcccccatcaccgtgccgccggtaactcctcgcctctgccggtccatgttggcctcccaaccgattcccaagtcgaagccacggntcttgagctcgcggtactcttggcacaacgccaggtgctcgcagcagcagtgcaccaggaagtccgggcactccccttcatccacgtcgtactcggccctcancttggaccggtagaggcacgagtacaggcaccccatctccgtcgaggcgcagatgagcccatagatgaatccactcgcgagacatgagcaggtgcctttgtccacgatgtcagcgatctg

SEQ ID NO: 19666 - DNA, 312 bp, Sorghum bicolor
  Clone ID: LIB3478-015-P1-K1-D8-F96k
cgacggggcaggatcggattcttcggattagtgcggtgtcgcagagtgatttggtaatttagtgccggaaagatttctttgttttgagatctttcgcgggaccaaagggaagggggcagtgtaaagacgacagaacaggcgtgaaggcctcgagagtcgagacctcacagggtaccgcctagcgcctactggggtgaaagtgaagtcaaggagtcgggagggtgtgtgtgaataccgtttgtagcagctagtgcgtcagtctgtcttttttttctgtttattaattattaatagcctgctagatttcatttg

SEQ ID NO: 19667 - DNA, 666 bp, Sorghum bicolor
  unsure (1)..(666): unsure at all n locations
  Clone ID: LIB3478-006-P1-K1-C12-F78n
taacactcatcagttcgtgttgttcggtctaccgattttaaccgaacagcaagttatgaaccgaaaacggtttttggaagaagaggcggaagcggaggaggagaaaggtttagtggctcgtgggttaacatggaattatagtttgcaaggacttgagacgggtcattgtaaagttttcatggaatctgaggatgttggacgcacactcgatctctcggttattggctcgtaccaagaattgtaccggaaattggctgagatgtttcatatagaagagaggtcggatttgttgactcatgttgtgtaccgggatgcaaatggtgttatcaaacgtattggagacgaacctttcagtgatttcatgaaagcaactaaacggctaacaatcaagatggatattggtggcgacaacgtgagaaagacgtggataaccggaatcaggactggtgaaaatggtatagacgcttctacgaagactggtccgctcagcatcttcgcttgaacttgaagcatattgaggaataagcagtggcctttgttttgaacctaattttatttctgtctttaattctcttttttccctattttaaatcctttntttgctggtcttttgtgtgtaacaaaccattcccaagtgttaccaaaagtactctaattggtattttg

SEQ ID NO: 19668 - DNA, 536 bp, Sorghum bicolor
  Clone ID: LIB5047-008-R1-XP1-A1
gccggccgggccgggttcttcatcacccgggagccattttagcggcgtgtgggctagttataaagattcaaaatgacttcccatctctcatggatgattgtgcgcaacaacaacgctttcttgctgaagaagcgcaacatcagcaaacccttcagcactgagcccaacaatttgttgaacctcaactcatacagatacaatggactcgtgcacaagaagagtgtcggtattgtacctgctgctgacaagaagggcttcacagttgtgtacaagaaagccaaggccagccacaagcccgccaaggccaccattaagaggacactgaaggctggaccccgtcggtcactgaccaagctgaggaggttgatccacgctaaccactaccgccgggacttgctcaaggctgccctccgcagagctagcgctgttctgaaatcccagaagaagccagtcacctccaggaaggcacgtgctaagaagaccgagtaaattaataaaatttctttcaccaaaaaaaaaaaaaaaaaaggccccta

SEQ ID NO: 19669 - DNA, 705 bp, Sorghum bicolor
  Clone ID: LIB5047-008-R1-XP1-A11
gccggccgggcctggatcatcctcttcctgcgcactaccccttgcagcgcacgtccaggattccggtggtagcgaggacttggtggatttgtaatggatgcagaacggaagggtacccaattgatgcgccgtcgggtggttcctcccaccggtggccagccgacacgggtcctcttcccagatgcagcagaggtcgaggtcgtggatgagttatctggtaccatggattcaggagcatatttcgctgacctgattacaaaagggcatggtcttgctggtcagtctgaaaatccacctcctcctcaggaagtagtagcacaagatgaggttcaaacaatagggaaacgaaatcagagaagaacaaaaaatttcacagttgaagaggatgaacaacttgtaaaagcatggctaaacgtgagtttggatcgagtgaaaggtgttgaccaaccacataccacatattgggaacgtatacatgcatatttccatgtccacaaggatttctcatctgatcgcacccaagggtctctaatgaaccgttggtctggtatacaacacgatgttaacctctttgctggttgtctttccaagactgagtgcgaaaatcaaagtggagtgtctatcgatgacaaagtttggtgacacacctttccctttcgaattgtatgtgatttggatacaaaaaaaaaaaaaaaaaagccccta

SEQ ID NO: 19670 - DNA, 784 bp, Sorghum bicolor
  unsure (1)..(784): unsure at all n locations
  Clone ID: LIB5047-008-R1-XP1-B5
gccggccgggccgggatctttacctttaacatgttctccattctcgcctctttactccttcccaccactgtcaccgctcaggtcactgcgaccaacccaaacggtgtcactaacccccccgagccatactttgagccggtcggaactcagatcaaccaaacctccttctcccgtcttcttaccctcaacggggtcgatgacttctgtctctttggtcctcccgaggcaggcccagacagcctgatcggcaacgtcgagcctatcgtcgtttcttactgtaccaagccaagaaacaacgctcgactcattcccgatggtgtgatcactgccgctcacttcatcaagaccccaacctacgtccagatttacggtttctgggatggtaccaaggtcaacattccattcggtgatgccggaggagagctcgacccccacggagccgagaacgtcggtaacccgatcggaggaaacgtgacttcaaacgtcccaaccggacaagacgtcttttacgaagagtggatgtcgttcatctcttacgatcaattttgtctccgaatctgtaccgcccagaccaacaacgttaccactgctctccaatgtgagcacgagctcgatatcatgggttgtcaattcgtcatggccattcccgacttttactcttccaacaactctttcacttcatggtgacgnagatgttgccccaccacccagtctttaccctcaacccgatggatctacctccactttccgacagcgatacaccggtacctataccgctcctgac

SEQ ID NO: 19671 - DNA, 699 bp, Sorghum bicolor
  Clone ID: LIB5047-008-R1-XP1-C1
gccggccgggccggggtcgttgtagtatagtggtgagtattcccgcaaggagctcatcctcgtcaaccgcccgtggccgctcgatgtgcctctcccggccgcgctcctcggcgtcgccaccctcactcgcctctaccttggtctctggaaattcccggacacctccgctcttcgacagagtaagagtggtgcggacgcggtgttcccgcacctccgcgagctcgtcctctgctcggtggtggtggagagcagtgacatgaacttcctcctcgccgggagccccgtcctggagaactttggcatagtgggaatcagggagaaggcgatgatgcgcctccgcctcgtcggccagcatctcaagtgtgcgcagatcctcatgtccgctatgagcagcgtcgccatggtggacaccccgagcctcgagcggctcatcctgtgggaatccaaggcgtgcgacaactcttgcattaggctaaagattggcaaagccaccaagctgcgcatacttggatacttgagtcctggaattcacacgctggagatccggaacaccgtcatcaatgctgggataaaggcgacaccaagcaccatagttccaggcatcaagatcttggggttaaacttgcgcttcggagtctgcaatgattccaagatgttaccgacttttcctcagatgctttcccaacgttgagatactgc

SEQ ID NO: 19672 - DNA, 719 bp, Sorghum bicolor
  unsure (1)..(719): unsure at all n locations
  Clone ID: LIB5047-008-R1-XP1-C10
gccggccgggccggagttcccgttcattttcatttctgcgaaccgtgctggcattggtggttgtcacgggcgaaggcgggcggccacccggacaggggaggcggtcggtggccacccagaggcggaggcgacggcaacctggagtagccgctggacgaccatcgatccggaggcgccgtcggataggcatccggctccggggaggcgcaacctactgggagtagagccggagggtgacgagaacttgaggcagaggtggattcgccaaccggcgtcggtgctccagcatcattagcacagcggagagaacaatccaaagtctgcttccaagcgcggtcatcctgcaaagaagaaagcaaggattgaagaaggcgaagacgtaattgagttgcaggtggagtccttagaggctggtgcctcagttcattcaccatccatggcggactcattgctagcggacgagcaaccgtgattagtggtgtcatcagatgcagacgcagatggtccaggcacatttgttgacgatgttgcatggtttgcaagaatttgtttgatagtattgcagaatgatggacttatgggataagcacttgccataattttgcaaatttagagtctcctggcaatgaaaagtttcagtatgaatccagtaatccaatatcagtaatcctatattacccagtttttttgtgcaaaaanaaaaaaaaaaagggccctag

SEQ ID NO: 19673 - DNA, 637 bp, Sorghum bicolor
  Clone ID: LIB5047-008-R1-XP1-C6
gccggccgggccggggatctggccggccggctctctggacgaacctagctaccaacctgtgccatgaagcgttcggcggcgtccaccgtacccttcgtcctcctccgcctcctcgccgtcgcaacggcgtccgccgccgccgaggcagagcatgccgccaactacctcgtctacgtcaacccacacccgccaggcgtcgactgccaggcgtaccagctcggcatcctcgccgctgccctcggaagtgaggcgaaggcgaaggaggcgatcctgtacaactacaggaacgtcatgagcggcttctcggcgaggctcacgccgccggagctggaggccgtcaagaagcaacctcaggtgaaccgggtgctgccgagcacgaccttgtctctaatgagcagcaagttcgacggcgtcagctaatcccgcttcttcaagcagccaacaagcgcatccatcgccaaccataaaataaatcgcatctttcaatctattttgtggttgtgtgtgattggttgcttgcattaaacgaccttgtacatcacaaaaagccagcatatataaataaacgtatatacactgtcttgctgttatatatagtatcttgcacgtgtaaaaaaaaaaaaaaaaaaggccccta

SEQ ID NO: 19674 - DNA, 336 bp, Sorghum bicolor
  Clone ID: LIB5047-008-R1-XP1-D12
gccggccgggccgggtgatgaaggctaataacagattcttgaccctgcaagctactagaatcaaaagccatgcagttctttgcggccaatggatgatctatttttttactgtcttggacttcacttgtgaacctgtaataagtttaaattctgggcgtgtcgctgtaataagcatggactgatgctccttcttagaagggtgatgctggatttttgcattgtctaaataaagtggtcgatgttactgaaaactatgacatcatgaaatagcttaatcttttactaagaaaaaaaaaaaaaaaaaaaaaagaaaaaaaaaaaaaaaaaaggccccta

SEQ ID NO: 19675 - DNA, 652 bp, Sorghum bicolor
  Clone ID: LIB5047-008-R1-XP1-F10
gccgggccgggagcgcctgtcatttgtcgcgccccccacacagctcctcttggcggcgccctgacctgtcctttatcctcgccttcgatcggcggccgcctccctccacttccgtcccgccgccgccaccgccgccatgaagggacccggcctcttctccgacatcggcaagaaggccaaggatctactcactaaggactacacgtacgaccagaagctgaccatctccaccgccagcgcctctggagtgggccttacttccacagctgtaaagaaaggaggtctttattctctggatgtcagttcagtttacaagtacaagaataccactgttgatgttaaagtggacacagaatcaaatatctctactacattgactgtgttggacgccttgccatccacaaagcttgtcacttctgtgaagctgcccgactacaattctggaaaggtggcgctgcaatacttccatgagaatgcaacctttgctactgttgttggcacaaagccgactcctgtgattgatctttctgggacagtaggcgctcaaggagttgcatttggggcagaagctgcgtatgacactgctacaggaaaatttaccaagtacactgctgcaattgggggaaccaagccagactaccatgctgcattc

SEQ ID NO: 19676 - DNA, 579 bp, Sorghum bicolor
  unsure (1)..(579): unsure at all n locations
  Clone ID: LIB5047-008-R1-XP1-F2
gccggccgggccgggatcccttacatctttcactattcataggatgccctgcagctgagggtggagaaaatgagaaatgacagctaaacgtctaccaatgacttcaagccaagtctccaacgaatgaccgtcaccttgaatagtgatgattttagcgcaaggcttgcaaagatctttatagtggctaactctttgctattaatatatgatctacttatttttctcataatatctattgatttttatgtcaaagcagccggcctcttttatctttcctcttctctcttctccacctcactattgagccttcttgtaatccactattatatttcctctaggttctgtttgaagccaaagccttgtttagtcaaaagaatttacaaaatggacactgtagcacttttattagtatttgataaatattgttcaattatgaactaagatcttgtttagttcacccccaaaacccaaaacttttcaagatttctcgtcacatcgatgtaaaaattctttannnnnnnnannnnnnnnnnnnnnnnnnnnnnnnnnnngcnaaaaaaaaaaaaaaaaaggccccta

SEQ ID NO: 19677 - DNA, 726 bp, Sorghum bicolor
  Clone ID: LIB5047-008-R1-XP1-G1
gccggccgggccggccgccgccgacgctgcgtgggagggacccggtggccaccgccttctctcgagtcgggttttgacgccaattcgtgcgccgcccgctgcagcctccaccctccagttgcgttccacttccaccccgagttccgccggcggagatgaagccggtggtgggaatcgtggtgtcgaacaagatgcagaagtcggtagtggtggcggtagaccgcctcttccaccacaaggtgtacaaccgctacgtcaagcgcacctccaagttcatggcacacgacgaggccgacgactgcaacgtcggcgaccgggttagattggatccttctagacccttgagcagacataaacactgggttgttgctgaagttctgcgcagagccaaggtgtatgttccaccatctgtcacagcttccggtgaacatggtatcaagagtcagcaggctggcgttggtaccaaaacatccacctgaagttcgtcagaggcaaaggcgcatttgctcatttactcgctgtatgtttttttgccccccttgtggatgcaatttcaatccatggaagaaataacaccgcaccagtcagctttgctgatttaagtctattcaagtagctaaagaaatctttagagaggaatttactttgctctctcttagggcaatactcgagtttccatcacttttgatttatgtatccaaaatcagttgcattttttctgcttac

SEQ ID NO: 19678 - DNA, 678 bp, Sorghum bicolor
  unsure (1)..(678): unsure at all n locations
  Clone ID: LIB5047-008-R1-XP1-G5
gccggccgggccgggcttttttttctcaaggcaaattcagcaagatggtagcatcaaaaatcattaaagcgggtggcgctgagcctgatgagttcgaaaaaactgtcagccaagctttgcttgaattggagttgaactccgaattgaaaccacaattgagagacttgtacattacacgtgctcgcgaattggaatttgccaccaaaaaggctgtaatcatctatgttccagttccaaagcaaaaagctttccaaaagatccaaacccgtttggttcgtgaattggaaaagaaattttccggcaaacatgttgtgttcgttgctgaacgtaaaattctgccaaaaccacgacgaaatacacgcaatccattgaaacaaaagcgtccacgttcacgaacgttgaccgccgttttcgatgctatcttggaagatttagtgttcccagccgaaattgttggcaaacgtattcgcgtcaagttggacggttcccaattgatcaaagttcatttggacaaaaatcaacaaaccaccattgaacacaaggtcgatacattcacctcaatttacaagaaattgaccggncgtgaagttacattcgaatttccagaaccatacttgtaacaatggatatggatgtaaacatcaaataacaatacaccattgaatattttattcgatt

SEQ ID NO: 19679 - DNA, 266 bp, Sorghum bicolor
  Clone ID: LIB5047-008-R1-XP1-H12
tgtgcggcgctcgagccggctggcgggatgttcatcctggtgactttgtacaacatcctttagatatcattatttgttcttgagcttcttcgtttttagcgctcgaaagacataggcagagatgtcttgcagctgcggatcaagctgcaactgcggatcaagctgcaagtgcggcaagaagtaccccgacctggaggagaagagcaccgcgccgcaggccaccgtcgtcctgggtgtcgccccggacaacacaggtgctgccgaga

SEQ ID NO: 19680 - DNA, 358 bp, Sorghum bicolor
  Clone ID: LIB5047-008-R1-XP1-H9
gcgccgctcgagcgccggctcggatcactcagggacgggcggcggttgcgccgagctctcgtcacttccctagctgttgtgatgtggcgagccctccccacctcccggcgatgttgacgacgatggcgcagggcccctccaccaccggcgagcatcacgcaggggcggcagcgcggtcctctttgccactagcaagcctcacgcaggggccatggtgcccccgtcctctgccgtggcgccgccgtacgtctagcttcacggcgagggcagcagcactggtacggatccgttcgcatcgccaacgaggccactaattgctcatccacgatccatgggtcctactcccccatgttgccgc

SEQ ID NO: 19681 - DNA, 611 bp, Sorghum bicolor
  unsure (1)..(611): unsure at all n locations
  Clone ID: LIB5047-009-R1-XP1-B11
gtgcggcgctcgaggcggcgggccgggtgcatactcgatcgagctgatgaatgaatagcccaccttgtggctatggaatatatgggggccgacgacggccagtggccgccgccgccgcagccgcccctgctgctgctagctgcagcactggtggtggtggtggtgctcgcgctgtggcggcgcctggtgtggcaaccgcggtccgtggcgcggtcgttggcgaggcagggcatccgggggccgccctacagtttcctggccgggtcattgccggaggtgaagcggctgncgcgcgccagccggagaagggtttcgcacctggacgttggttgccatgacatcatgcccatcctgctgccacccttccacagatgggtcgtcgagtatggtaaagcctaacactctgtaatccggccgtatatatatttatttttgatagagtgagttagtctggccttttgagttttgacaacgactagtaagacttccgacgatctcttctatacattacttaggagatgtgtgcagcgattacctaaccatgtctaaactaaatatagctatgttactaaactccacaaccatatataacttccatgcccattactctt

SEQ ID NO: 19682 - DNA, 576 bp, Sorghum bicolor
  Clone ID: LIB5047-009-R1-XP1-C1
gccggccgggccgggatcatacctcctattccccatggctaccgaagatcactcctgcgctctcggcgatcgcaatcgcccagaagaagagatcaaagatgcctgcaaagactgtagtgatgatcaacgcagagttcctccagcgcttgccgacgcgtgacatcttctcctcggtctcacgaatcctccaaccagctaggggtcatgaattacatctgcgagcacaggacctatcccccacaaggatatgctatactatctgaccaacccatattctaagcagggatctccaacttaactactagaacagtgaggtcaaagatgcggatatccaggactccattgtaaaaactacagaggagaaatacgttctgctgcacacaagtcttggatgtcaacaatctcaggcacaaatcgctaactatgatgactttccactgtatcatcaatctgataagaaatatctgctttttcacgacacacacatgaaatcatctactctggagaccctacatgcacttctacgacaaagagcacgatccatcacagggactaaggatgaactgattgctcgct

SEQ ID NO: 19683 - DNA, 523 bp, Sorghum bicolor
  Clone ID: LIB5047-009-R1-XP1-C2
gccggccgggccgggacttccacacttcgagcgctcctcgatccggcttctccatcgcagcaaaaaatataacacaccgcgaacccgcatacctcgtcacacgcatgtcgtgcttcgtctccgccaaccgaacgacgcttgagcgggaagactccacctgaggaccaaacatccctgcataccacgaggcgccctgagagaaataacgatcacccactgtattgagaagatataccggaaagtgactctgtgtccggagaaagacaagaaggaagatgcttatcctgctgcgcctattcatcatgtgccattgtagtgtcgatgccgatgagataatctgcatctattcagatcactcccagaagcatcgaacgctgcctacttctaaaacagaagaggacaattactatatatgtcgccacaagacatagacgctcgaggaacaagaatcgcaccatccctgctgacgcattataatgacacctacgagtggatggccgagcacacactctataatgtcaac

SEQ ID NO: 19684 - DNA, 582 bp, Sorghum bicolor
  Clone ID: LIB5047-009-R1-XP1-D11
gccggccgggccgggatccaaaacaccgttcgacaacaatggtccgatactcgtcagcccacgtcgccgccagcaacccggagaagtttgccaaggctcgaggcgagtatgtccgaacccacttcaagaacatgcgagaggttgctgccgctgtcagcggcatgaacttgcaaaaggcttacacctacctcgccgacgttcaggagcacaagcaaatcattcctttccgacgattcgctggtggtgtcggacgagcttcccaggccaagcaattcaagaccaccaaaggtcgatggccagtcaagtctgttcaatacctcctccgtctcctcaagaacgccgagtccaacgccgatgccaaggacctctctgttgaggagttgatcatcaagaacatcgtcgtcaaccaggccccaaagaccagaagaaggacttaccgagcccacggtcgaattaacccataccagggtcacccatgccacatcgaaatcttcctctccaccccatcttccgaggttgcccgatccaaggacctcgacgtctccagctcttccaagaagggaaagaagatccaggctattg

SEQ ID NO: 19685 - DNA, 390 bp, Sorghum bicolor
  Clone ID: LIB5047-009-R1-XP1-E3
gccggccgggccgggagtctcggatgatgatggaatacaagatgctcgtggaatctatgtgctccacgatacactatgaaagacgattgagtttgttgtaacccacatatattacatcacaaaagcaacaattcgtcaccgtgcacgctggaatggtgccccttgaaacgccacaaccatctgtttgttgtgaagaggggatctaggaattgtattgcatagtaatcttcatacaacagagcaatgtacattacgtgtgttgcagatgtatggtagcaatagggcccttagaaggtatacgacgaaaaatcatgctcggggaaagtaaccataacaagcggtggtctcagtgttttgagatcccaaaaaaaaaaaaaaaaaatgccccta

SEQ ID NO: 19686 - DNA, 566 bp, Sorghum bicolor
  Clone ID: LIB5047-009-R1-XP1-F4
gccggccgggccggggagaaacggtggcagcacacatgccggtcggcgagaagacggccgaggcaacggccaaggacggcggcagccagccgaagccaccgtcccgcggtagcgcccgcttcgagcgcctcctttccgggctgggcgctggtccgctcgtggacgtcgagcccgacaaggtcaaggacgacatccggcgatgggccaagaaggtggcggcgctggtgcgccagctcagcttcggcgcctgggcggagaagagcgacggctcgtcggagcaccacggcgcaggcgatgatggatccgccgccaactgagcatctagagccttgactgcagataactttcgcaggcagtaaagccagtaatcacaactcgtatgatatggcggcagcgccgggataaagcaagagcaaaattcatttatctccattcgttcattcgtttcgaagagcttcttataggctgataatgcatgtgtactacaatagatcttacctcagttcggtcaaaagcaataaaatttagcaaaggtcatggaaaaaaaaaaaaaaaaaaagccccta

SEQ ID NO: 19687 - DNA, 415 bp, Sorghum bicolor
  Clone ID: LIB5047-009-R1-XP1-H6
gccggccgggccggggcggagccattcaaatctttgtgagttgcgacggcggccggcggcgacccctgcaactcccaccttggtatcgccgctgctgcgacggtatcaccgtggcagccatgagacctctccttagccggctcttcagctccactcacattggcatgggctcctcttccttctcttcctctccgtctcggaggctgggccatctcacactgccatctcgactcctcttcttccggggagatctcctcagtgggcgaccctgccgcgtgcgccgcatatgccgtccccgcaagaaccccacgctcggccccctccaaggtccacgccgtggagctggactgcctcttctaggaccctaggagagatccacgggtcctgcttacaaagcgcgcttccgccctctcct

SEQ ID NO: 19688 - DNA, 406 bp, Sorghum bicolor
  unsure (1)..(406): unsure at all n locations
  Clone ID: LIB5047-010-R1-XP1-A2
gtggcggcccgctcgaggcncggcccgggcccgggaagtaccatccacatattgatttgcaaggtaatgtctgcttgaacattctagcgcaaacattgcataccctgttctcaagatcaacactgatatttatgcttctgaatcttctttttatctgaaccaaaccacgaggatcctttgaaccatgacagatgcagttgctcttcgatgacacacccaaagatgtttgaggaaaatgtcaaaagatgcatggctgtatgttacgtacgacaacactatttctcaaacatgtgcttgacttgatgagatgtcttcaaaacatatttcaccgctcccttatgacatcagatccctgtatcagcaccaatccgcccatatatgctggatatgagtggatttagtgctc

SEQ ID NO: 19689 - DNA, 660 bp, Sorghum bicolor
  Clone ID: LIB5047-010-R1-XP1-B2
gccggccgggccgggctttttaccccactgggttatacggtcgacgtgtaaccccagtattgtcgcgttaaattaatcaaaatggggttcgtgaaagttgtgaagaataagcagtacttcaagaggtaccaggttaagttcaagaggcgtcgtgaaggaaagactgactacttcgcccgcaagcgtctgatcgcccaggacaagaataaatacagcacccctaaataccgtttggtcgtccgcttctccaaccgcgacattacttgccaggttgcttactccagaaccgaaggcgacaggattctgtgtgccgcatacgctcacgaactcccccagtatggcatcaaggttggtcttaccaactacgctgctgcatactgtactggtcttctcctcgcccgtagacttctgacccagcttggtctggataaactatacattggtaccacagaagttactggtgaggaattcaatgtagaagctgttgaagatggccctggtgccttcaggtgttaccttgacgttggtcttatgcgtaccagcactggtgctagagtattcggtgccatgaagggagctgttgatggtggcttaaacattcctcacagcaccaagaggttccctggtttcgattccgaatccaagaaatcaatgctgatg

SEQ ID NO: 19690 - DNA, 622 bp, Sorghum bicolor
  Clone ID: LIB5047-010-R1-XP1-B5
gccggccgggccggggctcgcgtgagccgtccgcccagtctattcccctccgctttgccatctcgtcctttcagctcgaaggtgatctgcttgtgtatggcgtgattttgaatcgaagttacgtcaaatcccatggtgataaacttgatttgggcagcaccgacctcaagcttgatagcggtccatcgtgctgacattacaccatggtggtcaggtggaacaacgagctgggagatgtcattttgcattgactcagttgcgtattcaagactttctcttccccaacaatttttttaagatgagagaatgttgatctacataggttctatgaggatgcgacaacaacacgaggctatatcaagactctgggtacatgaggagaatcgtcttccatgtggtttgcctcgtcaggcatggggggaattggctgagatgcccccgtatagctggtcttgttggcactggtgtcgtcaggcatggagagaattgggtgagattgagagaaacgagaagaagaatgctaatctaattacccttccgtatctagatgataatttgatggaaccaactattataattagcgccatttttcacaggcaaaaaaaaaaaaaaaaggccccta

SEQ ID NO: 19691 - DNA, 327 bp, Sorghum bicolor
  Clone ID: LIB5047-010-R1-XP1-D7
gccggccgggccgggtcttcctcccttccacttcttcttccggatgcgatggacgaattttctaagttccaaactttttgtcatccaaatttcggggaaactgagttatctttgtggagtgacgcctagttacctactctggaacgtgtccttgtaaatgcgtctatggtcaatcagagtttttttccttgtttatttcttggcgagtgtatgttcccaaggtagtgttttgctagtattgatgattctaccctgttatgtgacaattttgcaaataagcggagcagcttgtccttcgttcaaaaaaaaaaaaaaaaaaggccccta

SEQ ID NO: 19692 - DNA, 516 bp, Sorghum bicolor
  Clone ID: LIB5047-010-R1-XP1-E1
gccggccgggccgggcgacatccatctcattcgtctcatactctcgcaatcatgtcctggcaagcttatgttgatgaccacctcgtcggtactggaaaagtctccaaggccgctatcatcggtaaacagggaggaatctgggctgcttcgagcggatacaatctgtctcaaaaggagcaggatgcgatcacccaatccttgttctctaagcctgacgaggctagagctcacggagtcactctcgctggcttcaagttcatggtgatcaaagcagagtcagacgaagtcatcggtagaaagggtgaaagaggtgtcttccttgtccctaccaaccaagccatcctcgttgccgagtacgaggcacctgttcaagctggagacgccaatgtcatcgtcaccaagctcgctgattacctcaagagcgttagttactagatctgaaggtggtttgagagagtaaaatgaagtctatgaatcggtgtatctgatgaaaaaaaaaaaaaaaaaaggccccta

SEQ ID NO: 19693 - DNA, 286 bp, Sorghum bicolor
  Clone ID: LIB5047-010-R1-XP1-E10
tgtgcggcgctcgagccggccgggccgggacattttgcttcttcctcctggagacgttcacaccacacgagagcctgaccgcggtgcgtgtcatcctatgggattccggcgaccgacggctgccttgacatggcggcctagctcatccgcgatgtgatcagcggcctggcctctctgccactcccccgcgactggaccggcggcggccctgctctctccgcatccgacgtcgcagcagaggctcgatcagcgcagccgtaccccgacgcgcagcctagcaaggacc

SEQ ID NO: 19694 - DNA, 595 bp, Sorghum bicolor
  Clone ID: LIB5047-010-R1-XP1-E3
cggcgagcttatcgcttatcatccgcggcttgtgcatctcctccgcctccgcttgacccatccaatgccgcatcgtcatgtcatactcgaaggagcaccacttctaatcgaagggcgacgctggtgcgtccaagacttacccgcaccaggctggtaccgaccgaaagaacgccttcctctgcatcaagggccgaccctgctaggctgtgcaggcttctacctcgaagactgcgaagcacggtcacgccatatgccactttgttgccatagacatattcgacgggaaaaagcttgaagatattgtgccttcttcacgcaactgtgacattccgcatgcgaaccgtactgactatcatctgattgacatatcataggatggatttgcgagccttcttacttcacatggcaacactaaggatgatcttagactcccaactgatgagactcttgtggtccagattatcgaaggatttgaaagtgagaaggatcttgttgtgactgtccaggctgctatgggggaggagcctacctgctccctgaaggatattgaccccaagtaactcccctgtcttggtagacacaactactgtatctc

SEQ ID NO: 19695 - DNA, 616 bp, Sorghum bicolor
  Clone ID: LIB5047-010-R1-XP1-G2
gccggccgggccgggtctgaagatgcgacttcattcactgatcgataagtgaatcaatcgtgtccaatttgcttctgtagatatttcccttcaacttgcttgtgtagatatttcccttcagttgttgttattatctatccatcgtctcttgcataaggtcatctgggagaaacataggtgactagcaaattggtcacatacaaactgaggaatactgctgtgaatcagccttgtagctttgggttggatggaagtcagcagataggagatcctgtgtttggtcaggagcatgggtgctagaaagggaattggagaatgtagttgcagagtttttttagcattctaccaatgaaagcagaatcacttgtatatgagatgggggtgaatcttctatgtatccacaatcaacactgggcttacatggaatgtagttgcagggttattttagcattctaccagtgaaagcagaatcacttgtatatgagatgggggtgaatcttctgtgtatccacaatcaacactgggcttacaaggtggttgatttaaaaaaacaacacattttttgaaacttatttcatggtttatttgcgcatgaaagaaaacggagattttcttt

SEQ ID NO: 19696 - DNA, 693 bp, Sorghum bicolor
  unsure (1)..(693): unsure at all n locations
  Clone ID: LIB5047-010-R1-XP1-G3
gccggccgggccggggtacttcgttattccaaaggttagtaacatggtaccaaagcatggtttaggggtcgaattagggctaatctgatccctaatcacccccaagatccattttttttttccggtcgtcgcaagcccatcgcgtgtgccgccgtctgccgcccatcgcgtttcctctgttttcacgggggtcggcacatcaccaccgtgtcttcaccttcgcgccttcgcgtctcgtctccaccttcgcgccttcgcgactcgtcgtcgcggagctgtccgctctcgtggggggacgcattgcgcgtggggtcgtcgtccgcccgcgggtgtcgtcttcccgcgtgccctgcgcgtgccctgcccgtggagatttggagcgcccgcaggagtcgtcttcctgcatgccctgtcctcttccgcccgtggctcttcatccctgcacgctgcacgtggtcatcttctctaccagtggagatttggagttttcttcctctgtttctgcagagaccatctcaggctatttccagtcacggtggtagcgaanaattttgggtttcgctactgtagcatttcggttttatttgacattattatttaattatagactaactagactcaaaagattcgtctccgaaaataacaggaaactgtgaaattaggtatcctttttatctatatttatggtttatg

SEQ ID NO: 19697 - DNA, 522 bp, Sorghum bicolor
  Clone ID: LIB5047-010-R1-XP1-H6
gccggccgggccgggaaaacacttagtccaaggaatcgcagaaagaactttttttttctttttttttcgactcctcacctctcccccccccctctcttaacaaaacaccgcggaagaagacccaaccctccacaaacccaataaaaaaatgtctgacgctggttccgactctgcttcccgagcccctgaagaggtcgtcgtcgacgacgtcgaggtcgctgccccggccaagggcgccatgtcggtcgaggacgcccttcaggaggtcctcaagaacgctctcgttcacgacggactcgcccgtggtttgagggagtgtgccaaggctttggacaagaggcaggctcatctctgtgtcttggtcgagacctgcactgaggccgagtacctcaagctcatcgaggccctctgtgccgagcacaacatcaacctcatcaaggtctctgacgccaaggtcctcggacagtggtccggtttggccaagatcgaccgagagggtaaccccaggaagatcgtccggtt

SEQ ID NO: 19698 - DNA, 485 bp, Sorghum bicolor
  Clone ID: LIB5047-011-R1-XP1-A3
gccggccgggccgggatgttagacaacatagaaaagactttgggccgtggagaaaagttgagtgaactccaagacaagacttctgatctacatagtcaggcccaggagttcaaaaaacagggggtgaagattcgtaggaagacatggctgcagaacatgaaaattaagttggtgattcttggaatccttttgctccttgtaatcatagtctgggtttctgtttgtcaaggctttgactgcaccaagcatgaaacatagtaagagtggtacaacactactatagttctagcttgaagttgcgatggatgtgaatttgttctggtgaagtcaagtgtacctcgtatgctttggctctctagtttcattccgccggacaattattacggtacaaatataaatctgagttggtcttattgcacgcctgagatgtactcgcaacgtaagactggcttgatacgaaaaaaaaaaaaaaaaaaaggccccta

SEQ ID NO: 19699 - DNA, 652 bp, Sorghum bicolor
  unsure (1)..(652): unsure at all n locations
  Clone ID: LIB5047-011-R1-XP1-A7
gccggccgggccggaatgctctaagcncaccttcttatataccacacactagaacgggtgtaagaacaagctatacgcctcccttaccttagctacctgccatctttttcccttccttctcaaatttcagttagtgttcatttctgtggggaagaagaggcggcagcgacaatggatgagccttcacagagcgaggacaggaagctgtcggccatggagcatgtcaagaagcgccatgaggagaagggcttcctctatgcctgcgccttcatgttttgctgctgcttctgctgctacgaggcctgcgagcactgcctggagtgcttctgctgctgcggcaagaaggacgagtaaggtcggttcaaccaacaattccgccgccgcttcatcatcatatggatttgttgtggaatgtggatttgtttcggttgtgaagaactgcgatcaatctatcgtcaaaataaaaacatgctgtaaataaatgtgattggttgaagcgttaactctacgttaaccatagtgagctagctagctatctagctaccccagtatctggagtgagtccagtgaaacgctgtacttgcgactgtaaaatgtaaatctgtgattgccactggtactatatgtacgttacagtccttgtgtatatata

SEQ ID NO: 19700 - DNA, 576 bp, Sorghum bicolor
  Clone ID: LIB5047-011-R1-XP1-B5
ctgtgcggcgctcaggcggcgggcgggactccaaccatctccggccagtttttgctatcacctgtaactgtaactttcgttctcttcctgctatagctcttgctacgaatctacgatgtcaggcctgatcgatatttggacgctggagcgggagcggatggtccggaccgccggggccgcgcaggcgtcgttcttcaggtcggtggtctcgctcggcggaggcgaacggcagggacgacgcgacacggctcgaacggagtgtggtggggggagtaccagtagcgccgctaagcgctgcgacggagtcggtgccgtgctcgtggacgctgcggagaagcaggcggctgcgtctgctggtagtagcccgccggggttcgtccgagaagacgctttcttgtccatcctagtcgattgcttcggccagtagatcttcgttctgaacataggtagtattatgtatgttagctgtatgtccgactgcttttgtgtcattgtgtggttcttgtaatcttctgaaacatcgatcaaagagtacatcaaatgatgtttgaaaaaaaaaaaaaaaaaaggccccta

SEQ ID NO: 19701 - DNA, 431 bp, Sorghum bicolor
  Clone ID: LIB5047-011-R1-XP1-B6
gccggccgggccggaaatccgtaactttccgatcggaacagaaactcagcggccgccctctatttatggtggagcacaaaccctccaaaatctccccatgggtaaagtaggtgaccgggacgacgacgattttgtgatatctgccgattaaatcagtggaagggcaagaaccttctttcgtttcatcaccaggcggcactcgctttcttcggcgatgactataggctgctgagatggatacaaggtcggcgtctcttctccggcggcggcgactggccaccagcaccaaacaatcagatccgaataggaggcttatcattgcagattgcagatcctgttgattccattgatcttgttgctatcacattcctacttaaatcaaatcatctgacatcttctcactcgaaaaaaaaaaaaaaaaaaggccccta

SEQ ID NO: 19702 - DNA, 405 bp, Sorghum bicolor
  Clone ID: LIB5047-011-R1-XP1-C3
gccggccgggccggagccccacacctcgcatctacctatgggctaaaaaattaggaggctgagagagaactccagatgttcagcagcggtagggggctcgagcccgccctgccctgtcgctggcttcgtccctgctgggctcgtcttcatggagcagtagcctggtgacgcctccaaccccgacatcacgcgcgatgtgatcatcgatagctatatttgtccatggtggatttgatttggttagatgtttttttctttgatttgatttggatcaggacttggattgaattggttggatgtggtttcgagtatgatttgggagaggagtttctttcttgtctatgttgcgttcgaagcaattttttatccgatctttactaaaaaaaaaaaaaaaaaaggccccta

SEQ ID NO: 19703 - DNA, 606 bp, Sorghum bicolor
  Clone ID: LIB5047-011-R1-XP1-E1
gccggccgggtcttcgaggcggcataaaaattggggagaggagtcagcccaaggcagttgcgctcctcaaggcacgcagcaggccatttgaatgtgacagggctcccccttcactcttcaattctgctcggaagctagctgcccctcacccccagctccagtccccggcgtgcggcctttgaagaaccagtgggcagatcatgccttgcgccaccgaggtcgtccatggcgagggaggcacgatcaaagttggtacaacgggtaccatcggctcactcatgacgagagaactggacaccatcaaggtggcgccgcaggcggccgcgggcacccctcgcctgaggcaccaaggccgtccggtctcagtgctatgtggagccactactcctcggaagctcatgttgaggaaaagctcatcggacatctccagcagcagcagcagcaacaacagaaccgaccgcgtgagcgctgaagaggcctgcaagccaaggagggtctcccggagaagcaccttcgactcgccgatgctgcggtccgacagcgccctcatggacaggacccccgaatgccggcaaggcgaagaagaaggggagtgtgtacggtgtc

SEQ ID NO: 19704 - DNA, 465 bp, Sorghum bicolor
  Clone ID: LIB5047-011-R1-XP1-E12
gccggccgggccgggattgattgatatacgtatgtagcagccttcttattcttgtttctttctacctactgtatgtaaattagaatctcacatgtccgtccgtccgagaatgacaatggattgtttagtgtacttgtcaaaaaaaaaaaaaaaaaaaaaaaaaaaaaaaaaaaaaaaaaaaaaaaaaaaaaaaaaaaaccaaaaaaaaaaaaaaaaaaaaagcaacaaaagaaaaacccaaggccccaagagccggggccgccctaaaacaaacggctcccccggaggggcgggacccggaaaccaagcttaccaaaaccggccaccacaagggggggcccgggacccaattcccccaaaagggagacggataaaacgcggtcaaaggccgttaattaacaaagccgggacgggcaaaacccgggcgggacccaacaaaaagcacggcagaacaaacccccttcc

SEQ ID NO: 19705 - DNA, 303 bp, Sorghum bicolor
  Clone ID: LIB5047-011-R1-XP1-E3
ccgggccgggctggaacggccacgacgtcacctcgccgggcgtcttccagcagtacaagctgcagctcaactggatgtcgctcaaggacgccgtcaaggagaagctcacggtgctcgagaacgtccagtggttcgagctcctcgaggggaaggacggcagcaggtcgggcccggtcatcgagctcatgggtctcggcaggctcatgaacgagaaggccaggatgctatccatggggcagaggaagcggctgcagctcgccaggctgctcgctatcgaccgacccatctggttgcctggagagc

SEQ ID NO: 19706 - DNA, 425 bp, Sorghum bicolor
  unsure (1)..(425): unsure at all n locations
  Clone ID: LIB5047-011-R1-XP1-F10
gccgggccggaaaangagagttggtgttgccgtttacctttccgcctacagtcttttcggtcctgattcttgaaacacagacatggctgtaggaaaaaataagggcctgtcgaaaggaggcaagaagggagtcaagaagaaggttgtcgaccccttcacaaggaaggactggtacgatgtcaaggcaccatccatgttcaccacccgtcagatcggcaagaccttggtcaacaggacccagggtaccaagattgcctctgagggtctgaagcaccgtgtctttgaagtgtccctggctgatcttcagaacgacaacgatgctgagaggtccttccgcaagttccgtctcattgctgaggatgttcacggccgtaatgtcttaaccacctttcacggtatggacctgatcaccgacaagctcctca

SEQ ID NO: 19707 - DNA, 205 bp, Sorghum bicolor
  Clone ID: LIB5047-011-R1-XP1-G1
tgcggcgctcgagacggccgggccgggctggcttcatcttctgcacgactgggtggggcggtgttctaccgccgccgcccaaagacaagtgacgaggacttcgtaggtctattcgtaggtgatgaacacccaccagggatgattgcgataatctgtacatagagttgttgatatcagtgttttaaagatgtttatctatacaaca

SEQ ID NO: 19708 - DNA, 760 bp, Sorghum bicolor
  unsure (1)..(760): unsure at all n locations
  Clone ID: LIB5047-012-R1-XP1-A8
gccggccgggccggggagttccgactcccgcatcgctcgatcctctccctccgtccgccgcaccgtcgccgagcgccgccccgcgccggagacttcctgccttcttgccgccgacgagcgccgccccgctgttccttccgcggttccgccccagcctctgcatccgaatacgaagctgtcacggcgatggcggcggccggcggcgtttcaactgacgatgtcccgatcctgcaggcagagaacctcaccagcaacgtcaagtccgtctactacagtcgaacattcttgtcgatcattggtggagttgttgctggaatctggggattcacaggcttgacgggatttgtcttctactttctgataatgatgattgcatctattgggctcttagcgaagtcaaagttctcagtccagaaatacttcgatagttggaccaggatttcaattgaaggagtttttggtggtcttatgtcatttgtgctgttctggacatttgcttatgacattgttcacatcttctgatggacatagaaagatctactctccaaagaaaatgcggaatttcatatgacgttttgaacattcccaatggactcttgtacactcaattnttgtattggtaattgatataatctttagtgagactatncatgtagacctaagcaaagctcatgaactgatgtagcagttcctttccttggatggtctatagctggtggcgatttgtcatttccagtaaatgatataaactttgattgat

SEQ ID NO: 19709 - DNA, 501 bp, Sorghum bicolor
  Clone ID: LIB5047-012-R1-XP1-B11
gccggccgggccgggatttcttcaactacccttgccggggcaggctccctctcggagatcacgagcagcatcagcccgcgaacatggcgaagctcctctcggccggcaaggtgacgaaactactactcttctgccactcgacaggatctacgagcagcatacatgacttcgatcaattggagcaaccccacatagctgcatagggccactgtgcatgtgatcacctctcgctcgacatcccccttgaagtggttggctccgactcggtcatgaatacggcgcagagagatcacagacgtgacgtgactgtcaactggctcaacagattgaccctcctctggcccactagcgactctgtctgcgatgacatccataacatccacatcatgaagtctctatttgctcgtccaaccatgctgacaaagacaccttctgctacatcgtcacatctcttctctgtgagaatttgatgatatgaaatgacaggagcttgaatatcaa

SEQ ID NO: 19710 - DNA, 341 bp, Sorghum bicolor
  unsure (1)..(341): unsure at all n locations
  Clone ID: LIB5047-012-R1-XP1-B2
gccggccgggccgggactaaatgttgctgaaaatttgttcgtactcttgttattggtctgcanaggttgaatgaacgacttggttttggtggggacttgttagcagtagcacgagtcatactctccattaagccttaatcccggacaatcctagagggggacagttgtttaaggtattgtgggaataatgcctagtttacgatagaaaccgtagcatagttcagcgntcccaggatggacaggttggtgcgtgtggctggttggctcgtancagttngaattggtctcggaactggatattagtgattgcacagttgacctaccaaaaannnnnnnnnnna

SEQ ID NO: 19711 - DNA, 332 bp, Sorghum bicolor
  Clone ID: LIB5047-012-R1-XP1-C1
gcggcctggccgggagtacgtgtcctgattaccgaaggagatggcttcttgcgacacgtgcgtacgtgtctgtcgtccaggtcaggccctctttggtgcttcgcatggtcctgccgtgatgcgtgttcagcgtcactggacacgaagttccttttctcgctcctctcctcggcaaaactgggaactggtattagctttagcgatgatttcaacttctccggttagtaatgtagacgctgtttgaatctttcggtggtaacagtacctactgcttccgttttaaattataagatcattttattttataaaaaaaaaaaaaaaaaggcccccta

SEQ ID NO: 19712 - DNA, 790 bp, Sorghum bicolor
  unsure (1)..(790): unsure at all n locations
  Clone ID: LIB5047-012-R1-XP1-C11
gccggccgggccgggcaacccccgcttctctctggtcgactacgagatcaaggcggatcgttcagagacacctttgcctccacaagacggccgaacagccagcagccgcaatctgcgccgtatcttcaatggtgtcatcgaaattgacggccaggaacacaagatccagggatcgggtactggtgcgctgtcgtcgctggccgatgcactgaggagtctgggcatcgaccttgacgttgtagactacaacgagcacaccatcggtacaagcaaagacgcaaaggctgcaacttacattggttgcacagctgcacaaagcagtcagaaggtctggggtgtcggtgttcaccaggatgtggttcaagcttctctcatcgccatgctgagcgctgcttcctcattcctttcatcaagacctaccacacccatcccattccgccccaagcgatcgaatacgctcgagatccccagcccagaatcaagtcccagccgaaaagagggtagcacaatagtggataagcttgaagcagccgttaatggcgatcaagcggatgtgaagagcgcgggcgtgtaagctccataagtcttcttcatgtttcactgttcatgctttattttcacaaacgtcgcatatagcatttgngttcaaaaaggctgngagattggtgttcaaaaagtgctacataggttgaatgggataagtgtacagtcagccaccgttatgncatctanagatttatagggggtgacagaacatgatgaaaaaaaaaaaaaaaaagggcccctaggg

SEQ ID NO: 19713 - DNA, 247 bp, Sorghum bicolor
  unsure (1)..(247): unsure at all n locations
  Clone ID: LIB5047-012-R1-XP1-C2
gcggncgggncgggaaaaattcctttctccttcccacctcggcgggcgggctcctcttcttctcttcacccacacgcaggtcttcgaagatgtcgcggcggaggcgaaggcggcggtggtcccggagtctgtgctgcggaacgcaaggggaggagcgtgggcacggccagaaggagaggcgctcgcggacaggaagaaggcgctcgagagccgccagatcatcttctcccgcgcccagcagaccgcc

SEQ ID NO: 19714 - DNA, 577 bp, Sorghum bicolor
  Clone ID: LIB5047-012-R1-XP1-D11
gccggccgggccggatgattgacacaacaagcacaatcactagtgtggcaactttgctaaagtacgagggtagcagaagctgaatatgcttgttgtaggcatgctgttttcagccctcccggaattgaaaggttttctggaggagactgtgaggaagttattgtgacaaactccatcctgctgccagaatactaaatgcttccctcacaatgacgtcgctatcaatgacgaaccttgtaaccgaaacaatttggcatgttcactcgcgatgcatccatcagcagcatcttccaataacagaaacgcctatcatctatcatcatctcgacttacattcgggggggatagacaacgcacccagacgcctggtgctgtgacgcctactatagcatcgagacaattttgaaggcaggctataataaggtggtattgctgatcttgtacgtcgtgataataaggagctattccctgtgctacgctggtgcacctgccagatcaactatgcgtcatgctactaagaaatggtaagctccagacctgactcttatgaggacgactaccacaaaaatagcaaaat

SEQ ID NO: 19715 - DNA, 747 bp, Sorghum bicolor
  unsure (1)..(747): unsure at all n locations
  Clone ID: LIB5047-012-R1-XP1-D12
gccggccgggccggggtattctgtttgactctactatcaccatcatgaagctcactcttgttaccctctccgctgttgtggcgtccaccaccaccgcatctcctctggtcctcgaaccccgccaacaatgcagtacatcgtggagctacccctacactggtcgcgcacctcctggcaactacaaagccttcaacttggctagctgcaccgtacaactcagcttcaacaaagaccaatacgtcggcgtacaatgggcctttgaagccacctacgccgacggcagccgtgcagaactcaagcccttccgcgacttcaacagcttcggcgtcagcgacaccttctacccttacctaggaaataacttcctcacccggtacccagggaactcggcgtttacggctgtgcatgagtttagcagtgtgtgcaaaaacggacaggcgccgatctcatggcgattctacacaacatcagggacagcgaatggctgctacacaacgggtcagatccaggctgttggtggggtctcgcgtccagccaaggtcacaggcgtttctttgcggaggaacaacggtgctggngatttcgaggttgcctggtcgccagtgtccagagcagttgcgtattcagtgattgtgcagtacccaactggtacagatgaagttgngaatccatatacgaatgtgangngtgcacgtgtgcagggaagttcgacgagcgtcgcgacgactacgcgcaggcaggatgtac

SEQ ID NO: 19716 - DNA, 511 bp, Sorghum bicolor
  Clone ID: LIB5047-012-R1-XP1-E1
gccggccgggccgggagtggctgcactttcacttttgaagacttgcagagtgtggataaatcctcaatttttgcaggcggagatacaactgaacacacacgctgaggctttgaggctgaggcagatggagccaactgcaaggctactcatcaggaattccactcatcatgcgatggattgcaggagcagacgtggaggttgggttagtaatccatggtggcgcgttggagagaggaggtgaaatggtggccctgcagagaatcagtgatgcttgcagaagcgcctatggtcagaaaaagatgtggctctagcaaaaaacaaagagaagatcatcatttgtttggatcaaaagctgtagtgtatgctgctgttgctgcttgcgaaaggggctatatgcctcaaacttgtcttggactcttggtctacgtgtattgtgcttttggtgtgaaaccaccagggctgttagcccccattgctgctgctccaaaaaaaaaaaaaaaaaaggccccta

SEQ ID NO: 19717 - DNA, 634 bp, Sorghum bicolor
  Clone ID: LIB5047-012-R1-XP1-E10
gccggccgggccgggatccatacatcacccacacccatttatccctctccatcactccagaaatcactagattgctctgccaacttgctacttgctaactcaccacgatggactcctcatcctccttctgcttcctactgcgcgctagctggattgacggcattgtatgacattggctcatgcggaactacactcaccatcgaagtcctgaaggactccacctccaccaaactatccctcatcaccaaggtcgatcatctcccaggggtcaggccaaccctagggaggcacacatcacgcacactacctcagggagccataacccaagacttttacccttgacgacaaagaaccgatcaaggtgacctatcgtcttccactttcttgcaacagagtggcgcctaccgtgatgtcgataatgccatccctgctgactgcactgccgtgctcagtctacaaaaccaccgaacaagtctaagcaatgcacacatgtgaccttctgctgcatgtgagattatattgaccttaacaaatattctagagacaccaacggtacgctctgagcattcccgaaaattcattctctatggccattttgtgctaagctaccatgaaatacagtatactatgttct

SEQ ID NO: 19718 - DNA, 737 bp, Sorghum bicolor
  Clone ID: LIB5047-012-R1-XP1-F10
gccggccgggccgggatccgatcgctgactttgaccctgcttcggcgctgtcttcgacctctccttctccgctgactagcaacgtgagtctgccgcacggtgaacgggtcgacaacacttcgcgccgtccttcggcagaggagctgtacttgcagcagcagcagcagaaggcccgaaatggtggacgatcgcgtaccaattcgatttcatctgtcacaggctctcttcgccgagtgtttaccagcaattcgctcgcgtcgcttagccacaagcgcgcgcagagcgatgccgtcaggtcgcttggcggatcagtgcagtctgagaggcagttggcgatgggtgggctggcgacgcctctgacagagtctgcaccttccggcatgttggctgatgctattcctgaggggcccgagtcgcctcgtaagactggcttcaacaccttgcgcagatcgaggaccatgctcaactattcgaagagctggttccgcgcttcggcggctgccaatgtggttgagcgtgtcaacgctgaagctgttgctcctgcgcagggattgcagaggcagtcttcgttcatgagcatgaccacagcttcttcgggcaccgaatttgacatcgtcaaggaagtagctcctcagcctttgcgtaccggtagcgctcccgtcactcgtcagagcccccagcattccgagggcttcaggagggcatccgacactcatctcaccaccattgctgaacag

SEQ ID NO: 19719 - DNA, 635 bp, Sorghum bicolor
  unsure (1)..(635): unsure at all n locations
  Clone ID: LIB5047-012-R1-XP1-F6
gccggccgggccgggcaactttcaaactccaaccaactacaactaccactttcaaacctccaaccaaccaaccaaccaaccaccaacaatcaacatgtctgactctatgcgcaagggcctcggcgagcaagcctccgagaagatcacccccgactcccagaagtccaccaccgagaaggccagcgagagcctcaccggagctggtgaccgcattgccggtgccgtccagcctgagggccagaagtccaccggacagaagctcggtgacgcgacccgctccggcggcgacgatgcgtccaaccagggccagggcgtcatgaagcaagcccaggacatggcctccaacgctggccagagcatctccgacaccctctccggcgccactggccagaagaagtaaagcacctctcttcttgtttgcctggtagccacgatgcccttcttcctctctctctctctctctctctctcttgtatggcatgaagacctgagaatggaccaacatggtattgcgatggatggaacgaaacataccctttcggcgtgaaagccgcgtatctatataccctacncatgaatgaaataatgacttgatcaaaaaaaaaaaaaaaaggccctaggggcgcggccgctct

SEQ ID NO: 19720 - DNA, 553 bp, Sorghum bicolor
  unsure (1)..(553): unsure at all n locations
  Clone ID: LIB5047-012-R1-XP1-G5
gccggccgggccgggcctttttcttttcgacatttgccactatcacacaaaggataaaaaatggcttcacctgatttgaactggttgatcgttcgcaacaacaatgcatacttgatgaaaaaacgtaacatcaaaaaaccatttagtacggaaccaaacaatcttaaaagtgtcagctcattccgctacagcggtttggtacaaaagcaaaccgttggtattgttccagctactgacaagaaaggtttcacagttgtcttaaaaaccaagaagaacgagaacaaaccagcaaagaacacctataaagttaccttcgatcaaggtgcacgccgttcattgaagaagctacgaaacactttggtccataaccattaccgtaatgacctcaaacaggctgctgttcgtcgtgccagcgcattgttgagatcacaacgggcaccaaaagtcaagaaagctgttgccaagaaagaataaacatttttcaaaagaatggcttcttgaagaaataanataaaaataaaaaatcaaaaaaaaaaaaaaaaaaggcccccta

SEQ ID NO: 19721 - DNA, 444 bp, Sorghum bicolor
  Clone ID: LIB5047-012-R1-XP1-G7
gccggccgggccgggcttcttctttattttgtcgaacacaatgacgaagggaacatcaagttttggaaagcgccataacaagacgcacactttgtgtcgccgttgtggtcgttcatcatatcatattcaaaaatcaacttgtgcacaatgcggttatccagcagccaagatacgatcatataactggtcagaaaagtcaaagcgccgaaagactactggaacaggccggtgccgttatttgaaagtggtgcgccgtcgtttccgtaatggattccgtgaaggtggacaagcaaaaccacaacgcaaaggacaaaacaaagcctgaaccaaattcaatttgatttgaatatgaatcaacgctgttaaaatcgaataaaaaacaatcataattcgaaataaacatttactcttttgcattgaaaaaaaaaaaaaaaaaggccccta

SEQ ID NO: 19722 - DNA, 668 bp, Sorghum bicolor
  Clone ID: LIB5047-012-R1-XP1-H11
gccggccgggccggttcacacgcggcccgtggcgcggcagccgtgccagaagccgcacgtgtactacatgcgcgggagcaggatggaccggcgcaggaacgcgacggtgacggagtacgagcggcaccgggtgaagcaccccggatgcaggtggcggatcgccgaccccagcgcgctgctcgacagcatcgtcgtgctcaagaagcccgacccggaactctggaagaggtcgccgaggaggaactgctgcagggtggtgtcgtcgccgaagcaggggaaggaccggtcgatgaccatcgacgtcggtgtgtgcagggacggcgagttcgccaaggtttaattaattgattaattcatagtgggacgggattaggagagggaaagaggaattagcggcggcagaagaggtcccggccggaacgagaacagcagggagagctagctaattttggaccgactaattaataggctattagtaatactccgtagctcagtagtctcagcgtatcgagcaggtcgatcttgtctgaaacgtcacagcagctgtgcctcccccccgttttgagttgacttgcaatagctggaaggagcatggatggtgcttaacttcatgcgtgtttagccttagggagccgtcctgtgcgccggattccggggacgggttgtgt

SEQ ID NO: 19723 - DNA, 398 bp, Sorghum bicolor
  Clone ID: LIB5047-012-R1-XP1-H12
gccggcccggtcgggggtataaatatatgttgggtgcaagtcggtgccgaaggcaaagggcaatggcacccctctgcgtgtccctcctcgctgtggcgttgtgcgcgctcacgctgctcgcggcgccgccggcctccgcgtcgcgagaccttcgcccgcgccgggcgggcttcgtcgtgcgcggccgcgtctggtgcgacaactgccgcacgggcttcgagacccccgcatccacctacattgccggagctaaggtgtgagccgactgtcaatcgaaaaccgctgggggaaacacttgcagcttcgagggccatactgctcgccctggcacctaccacctcccttgccgctggcgcgctcgcgcctgccgctctgcgtgcccgctcctcgtgcgcctg

SEQ ID NO: 19724 - DNA, 469 bp, Sorghum bicolor
  Clone ID: LIB5047-012-R1-XP1-H3
ctcgaggtcggtgggtgcggcaacgctaatcgattatcatcatcggtgtgtgcatctcgtccgccgccgtttgaaccgtccatatgcacgcatacgtctatgagcagaatcgaaggagaaccagttctgatacgaagggcgacgctggtgcgtccaagacttacccgcagcaggaatgggaccgtacgcaagaacggcttcctcgacataaaggaccccccctgctagggtgaggaggtatctacctcaaagactgcgacgaacgggcacggcaaatgcgactctctgaatgccatactaatatgcaacggaaaacagcttgaaaatattggtccttcttcacacaactgagagattccgcctgggaaccgcactgattatcagctgagtgacatatcacacgatggacttgtgagccttcatactacagatgccaacactaaggatgatcttacactcccaactgatg

SEQ ID NO: 19725 - DNA, 323 bp, Sorghum bicolor
  Clone ID: LIB5048-001-R1-XP1-G9
tgcggcgctcgaggcggcggggctgatacgcgtggcgtggcaccggggccggcgtgtcagcgggtggtgcggggggttcgtgctgcacttcttcccctcgccgtgggtggccgtctcgctcgccgccgctgccgcgctcatcttcgtgccgtcgatgctgcagacagtctacaccatgttcggctacttcaatagcagctgacagcgtcaaaattacggtgctaaaagcagaaactcccgcgactcctgatgtttttattaccacaatattagatttaatttgagccacctgtcttaaaatgaacgtcacctttggaatgcac

SEQ ID NO: 19726 - DNA, 254 bp, Sorghum bicolor
  unsure (1)..(254): unsure at all n locations
  Clone ID: LIB5048-002-R1-XP1-C2
tgcggcgctcgaggcggccgggccgggagaccgtcatccttctcgtcgcctagccgcggccagcagaaggtaaaggtcaggagagagttttcaagaagctgacatggctcctaaagctgtgcgggccaagaagggtnatggcaangacgagagccttgaaggttgcaaaagctgtagagntctgggtctggtcaagaaaaggaccaaaaaataccgcacgtccgtgnaatttcaccgccccaacccctgaagaa

SEQ ID NO: 19727 - DNA, 231 bp, Sorghum bicolor
  Clone ID: LIB5048-002-R1-XP1-G12
gtgctttcgttcgagtcgctgcgtcgcgatcatgcaccttaacttgttgaactccattatactgactgacatcatcggcacgaaaacatctgaggcgagatacgagcagtcctctgaactgggacaattaacggaatgcaaatagagacgcaaaacaaaatgccgatcactgtattgcctctccttccccgcattgctgcaggaaacctacatcctctacatccacatcgc

SEQ ID NO: 19728 - DNA, 344 bp, Sorghum bicolor
  Clone ID: LIB5048-012-R1-XP1-D4
tctgatatccaggatgttcctctcgtaactcttattggctgctgcgatgaagggtctcacagaatcgtagtttacccccacattgagaacaacaggcttgcacagacgttggtaggatccagatacagaaacatatcgggtaaaatcgccgcaatcgcgccaaaactgcagcccggccttgcccgcgaagacgcatttctcgatgagcaaatccagccacaaattatccacaggcgacgtaaaggcaccccaacttcttcttggacagcaccccaccccaacaactaccgctacccccccgggaaggcatcctaccagagaatgcgacccgatgtgaccacccg

SEQ ID NO: 19729 - DNA, 744 bp, Sorghum bicolor
  Clone ID: LIB5049-002-R1-XP1-A6
gccggccgggccggggtagcgggtatagtttagtggtaaaagtgtgattcgttctattaataactgaatttgaaatgatatacttaaggcatccttaagtttttttatattcatattccgatgaaaactttagttcttataaagggtttaatccttttcctctcaatagcatattgaggaagaatatacattctcgcgattagtatccaaagactaattgaatttgcatctaaaatacaaattcgattatgagtacgtagtcgcgaagcaaaattttgcattggattaagtattccgataagtattccgattgaataaatatgagtaaaggatctatggatgaagatacaaaaaagtttatttccaatcgtaactaaatcttcttttgttttgtaggaaatggaagcccaatagctaaaaaacgatggttttggtttactagaaccatcagtatattatattgtttcagctcggtggaaacccaactcttttcctcaggatctcttgaatgaaattagggaacgaagtaagtagattagatagatatttaggagaatttctatctcctactctataaggatcatctagaaagcagagagctttggttccattcagacagaaaagctgacatagatgttaagtggtgagaatatccataaaggagccgaatgaaatcaaaatttcatggtcggtttttgattagagacgtcaaaaataatcaaccaacgtcgactataaccccct

SEQ ID NO: 19730 - DNA, 408 bp, Sorghum bicolor
  Clone ID: LIB5049-002-R1-XP1-B3
accgctcgaatcgctcggtgcggcatccttcttcacttactgtgacattccgcatgtgaaccgcactgagtatcctatgattgacttactccaggatggatttgtgagccttcttacttcggatggcaacactaaggatggtcttagactcccaactgatgacactcttgtggcccacattatagaacgatttgatcccgcgaaggatcttgatgcgactgcccagtcagctatgccggagacacccgatctgcgccccgaaagacattgcccccaagaaacttccctgtcttgcaagaccgaactactgtatctcaacaacttaaatgaatagaaaaaacgcatcaccaaacgattgctactgacacgctcacctgcctcgagttggcttttgctataacaaacaca

SEQ ID NO: 19731 - DNA, 761 bp, Sorghum bicolor
  unsure (1)..(761): unsure at all n locations
  Clone ID: LIB5049-002-R1-XP1-C6
gccggccaggccgggatcttcactcctttgaagatccagctctaccacgctctctagcaaccccacagtcattcctttgatcaactgatcagtcattcattcagtcattatgcttaccaccaccttcattatggcccttgctggcctctccaccatgatcgaggcatctcctctccaggcacgcggcggtagcaagcgcggtcttgccttccccaaacagcacaacggtgttgctggatctcagtggacacacaagttctctggttccaaggtctcttggatgtacgactgggaggcagtcatcgatggaacccccctcgacctcgaatacgttcctcttcttcactccaaccaacagtggtgcactgagggttgggccaacaacattgccaacgccaagaagaactacaaggtttcgcacgtgctgagcttcaacgagcccgaccaaattggtggtggaggctccaacatcgatgttgctactgctgtcgccacccacaagaagttcgttcagccgctcgccgcacagggccttaggatcggctctccttcagtcaccaacgccgacgagcccaacaagggcatcaactacctcaagaacttcatgaaccaatgtaccggatgccagatcgattntgtcgttgcccactactacgcctgggacaacgctcaggatttcaagaactacctcgaaaagtttcacaagacctttcacaagcccgtctgggtcaccgagttcggcgttacttctggcgacgcga

SEQ ID NO: 19732 - DNA, 330 bp, Sorghum bicolor
  Clone ID: LIB5049-002-R1-XP1-D1
gccggccgggccggcatcctgcccgagggcgaaacccccaaaccctctccctccctccctctctcccgttgcgcggcggatacctccatgggcgctgacgactgggaagcctctggcgccggatcgaagcgtccgcgttcctccgaacttcccgcgtattagaacagcttgagcgtggacagaagggtattggtgatgggacagcgcagctatggcatggatgatgcccatgcacatttatatgaaggcatggactggcacaatcattggccctcccactactgcacatgagggtcgcatctaccagcttacgatgtcttgtgaccagga

SEQ ID NO: 19733 - DNA, 465 bp, Sorghum bicolor
  Clone ID: LIB5049-002-R1-XP1-F11
gccggccgggccgggttcgaactcaaggaagttgctcatagctactgcatccaggcggcgccgaccttcgtcttcatcatggacgatctgacgctggagagctttgttggtgcctctcccgataagctccgtaacaccgtcaaggagttcatcgacaacacttctgcagcctctgcgtcgtcctctgcctaaggagacgtatatagcaaactagttaaactaaatatagcatctatatgatcaccagccgtcaataagggccaacgaatggcgtggtaggctgctagcagtaggcaccgccactgtcgtcgatcagtttggtcgtctaaataactgactgtgtactatactagctatgttcagttcagattcagatcggagtcgatatatgttggatgatacttgtgactggacttgcaatctataaatgtctggctcgaaaaaaaaaaaaaaaaaaggccccta

SEQ ID NO: 19734 - DNA, 279 bp, Sorghum bicolor
  Clone ID: LIB5049-002-R1-XP1-F4
gccggccgggccgggatatcttcctcagcctttttggctgtggccttgtttagttcccccaaaaattttaagtctcatactcttgtgggcaatgtgtccactctggtatgatgaaaattattttttgtgggggagggcccgtaacagtagcaccgctactggggctctcaagtgtcgcttgggcgttgcactactgcccaagcctggcacacccaacaaaaaaaaaaaaaaaaaaaaaaaaaaaaaaaaaaagaaaaaaaaaaaaaaaaaaggccccta

SEQ ID NO: 19735 - DNA, 443 bp, Sorghum bicolor
  Clone ID: LIB5049-002-R1-XP1-F5
tcgaggccggccgggccgggccggctccggcgccgtctcctccaccaagaaagctgacattgcaggcgctctgcctaagctacaggacgctgcgtcttcttcttcttcctcctccccctcggcagctgcagggcccaagtgcctgtggcagagccgccgcgccgacagcgcacacaagtcgctgccgggcctcgtcctcgccatctgaagagacttgagaccgcaagatccatctgctaccctccagtataaccgtataataaaaatcctaaagttccaaactattatcgcagaaataatctggaacggcactagtcgtagtatgtactgtactgtactgtactcagagccagtcagtgaaaacgtaatgacgtttccgtaaaaaaaaaaaaaaaaaaaaaaaaaaatatagaccagaaaaaaaaaaaaaaaaaaggccccta

SEQ ID NO: 19736 - DNA, 782 bp, Sorghum bicolor
  unsure (1)..(782): unsure at all n locations
  Clone ID: LIB5049-002-R1-XP1-F7
cgctcgaggccggccgggccggggtgtgtggtagtagtaaacaagcaccgatggctggtgaatcgtggaaggtgccaactccagtgaaagacctggccgccctcgtggaggagccaccgagccagttcgtgcagcgggaggaggaccgccctggaagcctaatgctcgcagctgacatgccggatcccctccctatcgtcgacctcgacaagatgtcaaccgccgacgaggccaccaagctccgctcagcgctacaaacctgggggcttttcttggctaccaaccatggcatagatgtgtctctaatggaggatctgatgaaggcgtcacgagagtttttcaaccagccgctccaggagaggcagaaatacagcaacctgagggaaggcacgcgcttccagctagaagggtatggcagtgatccggtgatagcacaagatcatatccttgactggagcgatcgcttgcagctaaaggtggagcctgaagatgaaagaaaccttgctcaatggcccaagcatcctgaatccttcagggatcttctgcacgagtatgcaacaaaaaccaagactgtaatggtaaagatattgcgagcgatggccaagaccttggagcttgatgaagaagatttcattgatcagattggtggtcgtcctcaagcttatgccagattcaactactatcctccttgtccaggnncgagctttgtctangtatcaaggctcactctgatggccctcttctcacggggtctctggtcgatcgtgagggtcgcggactgc

SEQ ID NO: 19737 - DNA, 791 bp, Sorghum bicolor
  unsure (1)..(791): unsure at all n locations
  Clone ID: LIB5049-002-R1-XP1-F8
cgctcgaggccggcctggccggggctgacctccccgaacaacacggcggagcgcgacgcgccgcccaacaacccgagcctccgcgggttccaggtgatcgacgcggccaaggcggcggtggagcagagctgcccgcagacggtgtcgtgcgcggacatcgtggcgttcgcggcgcgcgacagcatcaacctcacgggcaacctcgcgtaccaggtgccctcgggccgccgcgacggcaacgtctccctcctctccgacgccaacaccaacctccccgcgccgacgttcaacgcgtcccagctggtggccggcttcgcggccaagaacctcaccgacgaggagatggtcatcctctccggcgcacacaccgtcggacgctccttctgcaccgcattcctcccgcgcatctacaacggatccaccccgatcgttgacacggggctgagcgcagggtacgccacgctgctgcaagcgctgtgcccgtccaacgccaactcgtcgacgcccacgacgacggtgatcgacccgagcacgccggcggtgctggacaacaactactacaagctgctgccgctcaacatgggcctcctcttctccgacaaccagctgcgggtcaactccacgctcaacgcctccgtcaacagcttcgcggncaacgagacgctctggaaggagaagttcgtcgccgccatgatcaagatggggaacatcgaggtgctcacggngagcccaggagagatcaggctcaactgcagcgtcgtcaacaacggctcctcgtcgtcgtcgtcgtc

SEQ ID NO: 19738 - DNA, 796 bp, Sorghum bicolor
  unsure (1)..(796): unsure at all n locations
  Clone ID: LIB5049-002-R1-XP1-G9
gccggccgggccgggcactcagatcgtcactaccgaggcctccaagtctttcgctgtcaacggaactgctggagcaatccccgacgtcgattttgacattggcgagtcttacgctggtcttttacctatcagcaaagctgctaatgagacctctgaactgtacttctggttcttcccatccgagaaccctgatgcgagtgacgagatcaccatctggctgaacggtggtccaggttgctcatctcttgaaggatttcttcaagagaacggaccgatctcatggcagtacggttccggaccagccgctgtttacaacccctggaattgggcaaacctcaccaacatggtctgggttgagcagccagtgggcactggattcacccaaggcaatgctactgccacctctcaggaggggaccgctgaggaattccttggcttcttcaagaactttgttgatacattcggtctgcagaaccgcaaggtgtacatcactggcgagtcatacgccggacgctacgtcccttacatcgcggatgccatgttgagcaaaaacgactctacctactacgatgtgaagggtatcatgttttacgaccccagtgtagctgaggatgttcttcttgaggatattcccgctgttgcctttgtcgacaaatgggctggtctcttcaactttaaccagaccttcatggacgatatccataaccgctctgnagnctgcgnctacacgagtacatgggagagtacctgaccttcccccccgccagtaagctcccatacccggatatggatgcca

SEQ ID NO: 19739 - DNA, 745 bp, Sorghum bicolor
  Clone ID: LIB5049-003-R1-XP1-C1
gccggccgggccgggagttacttccttatcctcaacacatacgtcctacttcacttactcgctgttgactttgtttgataccccagttcgttcaagatggctcccaagatcgcgattgtgtactactccatgtacggccacatcaagaagatggccgatgctgagttgaagggtatccaagaggctggcggtgatgccaagctcttccaagtcgccgagacccttcctcaggaagtcctcgagaagatgtacgcgcctgccaaggactcttctgtccccgtcctcgacgacccagccgtcctcgaagaattcgacggcatcctcttcggtatccccacccgctacggcaacttccccgcacaattcaagaccttctgggacaagacgggcaagcaatggcaacaaggcgccttctggggaaagtacgccggtgtcttcgtttcgacgggcaccctgggcggtggccaggagacaactgccattaccagcatgagcacgcttgtgcaccacggtttcatctacgttcccctgggctacaagactgcgtttagcatgttggccaacttggacgaggtccacggtggaagcccatggggtgctggtaccttctctgccggcgatggatcgaggcagcccagtgagcttgagctgagcattgcgcagggcccaggtaaggctttctacgaggctgttgcccaggcgcatcagtgactagatgatggaaagactgctgggcgtgttgctg

SEQ ID NO: 19740 - DNA, 683 bp, Sorghum bicolor
  Clone ID: LIB5049-003-R1-XP1-D10
gccggccgggccgggctctgactctctcgagtcgagtcccggcggcagccaggttcgtttgtcccggcggcgggcattcatggcggggcagtccgacccgcacctctccatcttctcgccctccgaggtggagttcgtggcggaggatgagatcgtcgaaatcgtccccaacatccgcatggacgccctcaacatgatctgtggggatttcgggcccttcttcccacagattcccaccaaggtgccgctctggctcgccgtcgcgctcaagaagcgtagcaagtgcactatccgcacccctgactggatgactgttgaccgcttgacacaggtattggaagcggaaagagagtcgcctcgagaattccagccattaccattccactacattgaaatttctaagctgctatttgatcatgctcgtgatgacatctcagatgcatacctggtgagatctctaattgaggacatcagagatgtcagattccataaggttgagactggattagagacaatatctggacgcacccatgccgtaaagctcaaaaatctctctgcaatggaagtgaacattgtccgccctttcatggtgagaactttgcaggcattctataagcacgatagtccacagatgattcagcaagcagataatacagggagcagagcaacgccagttacagacc

SEQ ID NO: 19741 - DNA, 578 bp, Sorghum bicolor
  Clone ID: LIB5049-003-R1-XP1-F1
gccggccgggccggggtcggaccaggcctgcgccacctctcgctgctgcgtgagcacagtagcacacagacagccggcggcgctgaccatggcgtcgcgaaaggttctcccaggcctcgcctccgggaggcggctccggtcccgcgctcagcaactcctctgggccgccgatctccctgtagctaccacctctcgctcgctcgcggccgccgctgtcacggcgctgccgtcgggcgggtctccagcggctcttctgttctctttgaggaccatctcgtcaacgcgcctctcgacacagtccgccgccggtgacgcgcccggcccatctgcggtggaccacaagttgataatgcaagaggatgagtttcacaaattagcagatgaaacgattcatgacttgcttgaaaaacttgaggaatacggcgactccattcagatggatggtttcgacatagactatgggaatcaggttttgacactgaggcttggggatttggggacgaatgttgtaaacaagcaaacaccaaacagacaaatctggctctcttcacctgtaagtggaacttctaggcttgact

SEQ ID NO: 19742 - DNA, 540 bp, Sorghum bicolor
  unsure (1)..(540): unsure at all n locations
  Clone ID: LIB5049-003-R1-XP1-F10
gccggccgggccgggaaaattagaaatcttctccttgtcacagaaagaggagagtagcaaaattctcttcttcatggcactactcaagatctctacgacaaggattgtgtacctgtgggctgcattgttcttggttcttgggatcatgtttgctacgtcaccctcctaccgagccgctagcctctcaggcttcaattgctgccaggaaaataaactgccactgccacgagcagagatagattgcaggcagtacccaatttgcagaccttatgggtgctttcttgcttgtcgaggatggggctacactggtgttggttcccactgcgaaagcaagaaaaacccgatgaaggacgaatgctgctgcaacaaagatccaagacatggggctacaccactagtgtaggctctgtaagatgtgacttttgtggtacaaagaacatgccaaaaaaataaaaggtgttcttagcctgannnnnnnnnnnnnnnnnnnnnannnnnannnnannnnnaangcnnnaaaaaaaaaaaaaaaggccccta

SEQ ID NO: 19743 - DNA, 472 bp, Sorghum bicolor
  Clone ID: LIB5049-003-R1-XP1-G3
gccggccgggccgggatcacattcgagcataacacatcttcatagaacatacgaggcgaaacattcattcttcagagcatggagaaacacacaacccgcaatgatgcaatagtatttctttcattgctactactcctcggatgcttttccattcgtgcagaatgccgagcagccatggatgaaatggatatccagtatgtcccttcacattgcatctatactcatgattgccacggacaaaatcagagtactccttcctgctattgctgtgtccataatatagctcagtgctatgtcgatccaggtgaatgccaaagaaaatgctccgcaaaatgaattcatatttacttgaaacaatgtacggagtgtaattcttatgtgggagttgcgtgtgagcaacggaattgaatgaataaagacgcagtgcaatgtgtgttgctgcttgcaaaaaaaaaaaaaaaaaaggccccta

SEQ ID NO: 19744 - DNA, 245 bp, Sorghum bicolor
  Clone ID: LIB5049-003-R1-XP1-H1
gccggccgggccgggacatccattcgagcaacacacttgagtttcatgtagcatttggcaagagcgtggtagacacattcacatcttaatatcaactgcaaaaggtgcagcatcctccaacaccacaccaagcaaaccccatcgaccaaccctcaagccaccacgagcatgacctctcaaaccccgcctttccaccgtctgctctccttctactccaaccgcaatggctcagactcccagactat

SEQ ID NO: 19745 - DNA, 751 bp, Sorghum bicolor
  unsure (1)..(751): unsure at all n locations
  Clone ID: LIB5049-003-R1-XP1-H2
gccggccgggccgggattgtacatccacaaaaatgagcagagaaaagaaacttgtactttttggcgatgacaaaggctggaaagcttcggattggacggatagtgatgaccgtgtaagaggaggagcatctcagtcgtacctcaccattactggctcatcagcacgtttccatggcaatcttgacatcaccgctctcggtggtgccggctttgctagtcaacgcactactggcgaggaccgcacctgggacttgtctgcatacgacggcgtctatctcgatatcgggaaacatgatggcaaaaagtacacgctgactctcaaagacgagattctgccactcatgccagatgggcgagaacaatcaaccatcagctacgagtacgactttgagtcgcaaagcaaactcgatctgttcgtaccgtggcatgcaatgaagccaacgtatcgcggcaaagagaaggacgatgcgaagccattagacacgaagaatgtcaagcgattcagcatcatgatgagaagtttctttggcactcaagaaggcgacttcgatctcaccatcaactcgatcaaggcggttgcgcaaccagacgacattgagaagggtatcatcggtagcgagaagggcacgggagagcaagagccatggtcttggaaagaatctaatctcgttgngctggcagttatcctgggttcgacatgggctatctcgtggggatattgttggtggaaagatatgacatgggtatcatg

SEQ ID NO: 19746 - DNA, 757 bp, Sorghum bicolor
  unsure (1)..(757): unsure at all n locations
  Clone ID: LIB5049-003-R1-XP1-H5
gccggccgggccgggaaacttccctgccgcatcttccctaaccttatagcctcacttggatctagagaacacgggctccatgcaacttatgctcccttgatgaattatcgtaaaaatgttgacgtctacattgatgcggacatatcatccggaagaatgagccgacagatcttgagattgacgaaattattacaccacgtcgagaaggaggagaagtatatggatacatatgagatctccttgctgcgtggtgtttccaaagagtatgcttacactctccatgtaactgaaaagagtgacatatatggctttggtgtggtgatccttgagcttgttactggaaagaagccgatggcagctgagattggcgagatggacctggtggcgtgggtatctgccagcattgaacagaacgggctagagtctgtgcttgatcagaacctcgctgagcagttcaaagatgaaatgtgcaaggtcatgaaaattgcactgctctgtgtctcaaaacttccaattaaacgcccaccaatgaggtccgtggtgacgatgctgctggaggtcaaggaagagaacaagccaaagatgaaggcggcgacaactctgctcatctgacctgnggaggcaaacccatctgaacaataataaataaaagtagtgtttgctcttcttgngataatgtactaaaancatctgcattatatctcatcttgagaaagtcatttccagtagcagctagctaggtctgaaacgcagcatg

SEQ ID NO: 19747 - DNA, 708 bp, Sorghum bicolor
  Clone ID: LIB5049-004-R1-XP1-B4
gccggccgggccgggagctccctccatcttacatccacctcacacgacatcatgggcatcttctctcacgacgcatctgacgatctcatcgtctcggccaccttccccgagaccaacccgttcggactcgtcgtcaacggcgagaagaccggtctcaacatccacctctccaacacgggcagcaaaaactacacgctcgtgtccgcatcgtccagcttccacgacccgctcaaggactgggcgctcatccgtaactcgaccgcgctgcgatacaatgtccccctcgtgtcaggcgccaacttctctgccccgtaccacgtcaactcggagtaccggcccggagagctcggtctgaccgtctgggtaaacctcgccgagcaaggctctgccgaggtctcgcaactcactgtgttgaaccagaccgtctcgattgtggaacagccgtcgtcatggctcgacccgtcgttgttgctcctgtggcttatcctcggttccgcccttgccggaggcatacgccgtgtaccagacattctttgcccccaagacgaagaagggcaagcgggtggtgaagaagaaggcggtggtcgtcaatgagaagacagaggactaccccaaggtcaagccgtacgagggaggatggatcccggcgcagcacctcaagtcgagggcgagcaagacgaagagggacggaggagctagctcgggcgg

SEQ ID NO: 19748 - DNA, 728 bp, Sorghum bicolor
  unsure (1)..(728): unsure at all n locations
  Clone ID: LIB5049-004-R1-XP1-B9
gccggccgggccgggttataaggcgtaggcggcgcagctcgacgtgccggaggacgccaacgacaacgaacgacgtcttgacgaggctacgactacgagtgctcgtccgctcggagcgttgagctgaaggagagttgcctatcatcattatattgagaagaaagagactgttctgtcaatgtctagacaacttactgacatggaatccatttttcagtgaatgatttctaccctaactttgacaagtctgtttcagaaggctttccattatgatatcctgtgcagaactttggcaactctgtttcagaaggcttttggattagataaatctagcatgttcagagaaaccagatgctaccaaggatcatgctatcatacacaagcagaaaggtgctccatctctatattttgcagtagacaaaattcatactgcaatccaagaggtgccttattttggcaacaatgctctgcttcatgatgggttctgaaagacagtttaaaagaactaaggagttcatgttgtcataaaaggaaaattttgtgtaatggaaatccttgtgcagcagataaggaggtgttgttgcctgtttggtattcatgcagccatgaacggaagcttgcgtaataccaagccatgcaaatccttgtgngggcatgtaaggcggtataattgtctgtttggtcttcaggaactccacaanaggtacatttgccatttatcatccatc

SEQ ID NO: 19749 - DNA, 608 bp, Sorghum bicolor
  unsure (1)..(608): unsure at all n locations
  Clone ID: LIB5049-004-R1-XP1-C12
gccgggccagggacggccatgncttcttcttgatctgtggtgggtctcccccccccccccccccccccttggtgtcccaatctcgatccaagatcagtgccaatctgcagtatttccgccccttctgtgctagcgaaaagagagaaaaaaaaatctcaacttttgaccgctggagcttggggaaatgagtttgcaggtggatgtttcttcaaggtcatactagtagtttgatattgtcttggctacactgtcctagagcaagtttctcagtcgcaagtgagatatttttgtgagttccaaaaaggaagcaacaagacaacagaataggccgcatctagatatataatcttggcatctcctagcttcctgagttgtctctgcagcttcttctgttgaattgaatcatcaatgggtagggggagaggcagagggcggaagcagctcaccaatggcaggacccacgaggacaaggggagcagcggcgaggaggttgccgtgcctgcaaggaagaggaggggacggccccagaagcgtgtcgccgctgagaagatcattgaagcagagatgaagaaactggaggcggccgccgatgatggcgacgaggacta

SEQ ID NO: 19750 - DNA, 719 bp, Sorghum bicolor
  unsure (1)..(719): unsure at all n locations
  Clone ID: LIB5049-004-R1-XP1-C5
gccggccgggccgggcccacaacactagctatcctagtgcttaattatataaaaaaagctatcctagtgcttatatacaatacacacttgtttgtgctcgtggttaatagctagctagtagtagtagtatacaccaagcagccatggccaaacagtctcttctcctggccatcctattcgtggcctgtatgctggaggccaactcaaaaatagctgcagcttcgacagcttacgacgttctacagcagaacaacttgccgcaggggctgttaccgcttggcgtgaagtcatatgtcctcaagggcagcgctttgtctgtgagtctcggcagggagtgcaacttcttggtcactgttggtggcaagcaattcaagttcaggtacgccagcaccgtcagcggggtgatcaaatctggctccatcactggcgtgaatggcgtgcgcctacaggtggagttcgcgtggctcggggtcaaccaagtcagtcgcgctggtaaccagatcactatccagctggagaagtcctcccagtctttccctgtcagcggtttttcacagagcccccggtgcacctgatcagtctctaatttctgaagcagcatttgtggagtagtacaagtgcttgccaatagttttgttcatccttcatgcatgtgtttcttaagctcatatatatgctgcttatatggagtgattataataatanagtagagtgttttc

SEQ ID NO: 19751 - DNA, 460 bp, Sorghum bicolor
  Clone ID: LIB5049-004-R1-XP1-D6
gccggccgggccgggcgtacgcgatcactctgaacgatatcccggaaggactgcgcccgtacttgtgtccgaccgattgccgtctgcgaaccgaccagcgggcgttcgagaatgcgcagtatgacaaggcgcaaatgctcaaatcggccaacgaggagaaacagaggaatacgcgcaagctccgcgctgagggcaagctcccaccacatgagccgaggtggttcagcgcgggaagggacgacgattgtggcgagaggacttggtacccgagacgagcggaagatggcgaggtcttgttctggagtgagcgggagaaggcgggtgggaagggcgagtgggacggcgtggaccatatctttgcggaggacgtcgaggcgtagaatgatctgcgggcttgtatatcttggtatgtcttatgatatggcttcgcggttaaaaaaaaaaaaaaaaaaggccccta

SEQ ID NO: 19752 - DNA, 741 bp, Sorghum bicolor
  Clone ID: LIB5049-004-R1-XP1-E10
gccggccgggccggggaagaagagctaggatgagcgccggcacggcggacacggtggtgtgcgtcaccggcggcagcggctacatcgggagctggctcgtcaggaagctcctcggcagaggctgcgtcgtccacgccaccctgcggagcctcgcgggcgagaagaagacggagctgctccgggcgctccccggcgcggcggagcggctgcggctgttcgaggcggacatgtacgacgccgacaccttcgagcccgccatcgccggctgccacttcgtcttcctcgtcgccacgcccatggcgcacgaccccaccagcaccaagtacaagaacatgacggaggcgacagtggacgcggtgcgcatcatcctccggcagtgcgagcggtccggcacggtgaagcgcgtcatctacacggcctcggtcacggccgcgtcgccgctcaaggaggacggcagcgggtacaaggacttcgtcaacgagtccaactggacaccgctcaatctctcctacgaattcagcaacactcacctggacgattacgtgcggtccaaatcgctatcggagaaggagctactgagctacaacgagtcctctaaggatcagcccgggacgctagtagaggtggtcgccctggcgtgcgcggtcgtcggcggcgacacgatccagacgtacctgtggagcagcctcgccgtggtcgtggcgccactgacggggcaggcgatcctccaccactccctca

SEQ ID NO: 19753 - DNA, 724 bp, Sorghum bicolor
  unsure (1)..(724): unsure at all n locations
  Clone ID: LIB5049-004-R1-XP1-E11
gccnggcccgggcccgggaaaaaaaaaaaaaaaaaaaaataaagtgtgatggcaagtctgctctgtggtctagcagtagttgtggtgatggtgtgagttttgttgatttggttaaggaatactcctccagagcaagacggttcattgtcgaggatgaagagcttcgtgagcgcatcaagtccgatctgcacattgaatccatcaatggagaggaggatgcacttcgtgaagtggcgtggggtttaaggagtgggccgccttttattatttctgaatttttgtatgatgtcactatcagtcctcagcgccatctcccattatgccaaggatttgaagtcttcatgaagaaatatcaaatcgatattcctacagaagctgttgatgaagactttctaacccgtgctggtacattgcaacgaattgatgaactgattttgtatcgttgcactgagatgcgtgaggtatgttccaagctggttcccggtattagtgggatgatcaaggataactttcgctatgttgaagttatggcaaagattctgaccccttggttggttggtgaagaatgggattcatccaagtggtccactgctggtgagccgtggttcactcctgatgagatgcagaagatagtggctaaagatgctgcagcagatgatgcacgggaaaaggntaagggtgatcataaggtggctgctatgatagagcccaccctgatgactac

SEQ ID NO: 19754 - DNA, 584 bp, Sorghum bicolor
  Clone ID: LIB5049-004-R1-XP1-E3
cgctcgaggccggccgggccgggtttggtgggaccactaaacctcctacattcttgcaaatacgtagtgaaccaatattatgtttgctggaaatggtgcgcgtgttgaggatgcctacagttcttcttgtcacttctggtgggcagcaacaaggcaagagctctacagtttctgatcttgaggtactgcaatgcttaggagtgcacttggccaagcacatggctttggagttctccaaagaaactgttctcaagagagggatcgaaaaatcaccaattgatcaggaaccctggcgcgagctgtatgggtgacggtgccctcagacagtcagaaattagcttaagtggcccgtacatgttttactcggatgaactgtgctgtgttattgagctggaatcacgaaggatctggtctgttgaaatcactatatataatgtggttccttccatctttcgcctgggcaaattaattcataagcaagagattaatgtcctagcacttgtagactctttgcagttaaatattaaaagaaatacatttacacctctaaccttttggaaaaaaaaaaaaaaaaaaggccccta

SEQ ID NO: 19755 - DNA, 721 bp, Sorghum bicolor
  unsure (1)..(721): unsure at all n locations
  Clone ID: LIB5049-004-R1-XP1-E6
gccggccgggccgggtggccatcaaggcggcgctgcatgaccccggcaacgtgctctgggactgggacctcaagttcggcaacgacccgtgccgctggagcatggtcacctgccaaaagggacaaattcaagagctgtctatgacgaacaagaacctctctggcacactgtcgccggcggttggaaaactcaggacgctgcgatatctgttgttaagccataatgctctttctggccgtattcctgacactgtaggcaggatgaagctgcttgaagtacttgacctgtcaaacaatcatttcagtggaagcatcccaagtacactggttcatctggccaacctgcagtacctgaaattgaacaataacagcctatctggacctatacctgaatcactagccactgatgctcccatgctcttcagcctggacgtttccttcaacaacctgagtggtcaccggccgactttccgaatatggaatgtctttttcgaaggtaatccattcctaagtgatatcggctcagagtcaattgctccccccgtaggcccaaaggatggcaaagaagaggattcccagggcatgagtanaaacatttttatcctcctactatgcataggaattggttgtttactggttgccattgtggctggagctgtcctgttttggcgaaagcgtcagcgtgagcgagtctttgcagttgcagatggtaatattttttc

SEQ ID NO: 19756 - DNA, 636 bp, Sorghum bicolor
  Clone ID: LIB5049-004-R1-XP1-G3
gccggccgggccggggcaagaaatagaaggagaaatagcattatcttcgtcatggcaaagagcagtacctcaaggtggatcgcgcactccattgccgctgttctcttggttcttctgatcatgtctgcatcctgccaagccgaaaaccttacaagctccgactctccacagctgctaccggcgaagattcggtctccacagatgccgtgcttcgaggatataactaactgcacgttttcaagttgctacgatctatgcaaagcaaaaggcgtgatgagttacgatgcgtcctgcttgaattggactgacaaccaaggtcatgttcatgtggagtgctgctgcccacggtcggcggcctacgtcgccaacaaagatgataattcctctgcacccgtttacgtgctaccatgaccatgattcacaaggatgtactacgtgcagctcttcctgtggagccaaaggtttcgtagctgaaagagctccttgcttcatcaggaatatgatgattctagtcgtgctcacaccgagtgctgctgcacccatgaaacagtgtaatgcatgcatctgtctatagctgatgcatactggatcaataaacgtgttttttgataaaaaaaaaaaaaaaaaaagccccta

SEQ ID NO: 19757 - DNA, 685 bp, Sorghum bicolor
  Clone ID: LIB5049-005-R1-XP1-A10
gccggccgggccggggtagaaacctccttcgccatctcaattgatatccgactttgcacaaaaagcaaggggctgctgtcgcgaccaaacttagtgctcaccatgaacttcatctcaaaccttgtcaactcagatggcataatcaaccccctcatcgacaacggctacctgccccatgccgccatccgcctaggcatccggcgccagctagccgaccgcctctcctccattgccacgacctcgctggaagcgggctacgagtcgaaaatgaagtacgtggagctgctgcgccaacggcccattgcgattgagacggcgaaagcaaatgaccagcattatgaagttggcactcaggttttaaagggtatgttggggccgaggatgaagtattcggcttgtttgtatgagaagggtggggagacgctgggggaggccgaggtgaggatgatggagttgtatgttaagagggcggcgttgaaggatgggatgacggtgttggatctaggctgcggctggggctccctgtccctctacctcgccgaaatcttccccaacagctccataaccggcttctccaactcgcgcacgcaaaaacagcacattgactccgtcgccacggcaaaaggcttcaagaacctgcgcatcgtgaccggcgacgtcgtggaccacgaattcgagccggaaa

SEQ ID NO: 19758 - DNA, 754 bp, Sorghum bicolor
  Clone ID: LIB5049-005-R1-XP1-A12
gcactccttcataagaaagctttatgttaccaaaaaactcgccgatatttgtcacttattctattagtataaaatattgtctagaaatgtagaaaatcttcccaagcattgcaatggctccatccggtagtttataggacttgcgccctcttaagaccaggttcaagaattgcgtgcatatttgaaagaattgggtgctgaaatcacagaagaaaaatcaccgaaaggtattgaagatgatctccataaaattattggagtgtgagatgcgtgtttcaaagaacgttccgaacaagaagttgaaaaagttttacatgacattgcttccattatggacgttattccattagaacgcgcagaaaatataattcttgcattttgtgagaaattaacaaaagctccaggtaccagattgggaatggttaccctaagagcattatgtgtgatataccaatcattagatgataaatcgccaatgcggtatcatgtgaattaccatttgcttcatgtggcgaaacaaaccgatcaagttcgagctgccttcaaggatgtagataatttaaaacaacgatttgcaacatgtcctccatcaattgaacaaatgcaataattatatccattattgcatgaggtgcttgtacctagtgcacaacagtgacgagctgcataagtcactgtacgcagttattacgtacatacactgctgaaaatgcatcacatgcccgtgaccacgctattagatgtattgcatctg

SEQ ID NO: 19759 - DNA, 585 bp, Sorghum bicolor
  Clone ID: LIB5049-005-R1-XP1-A6
gccggccgggccgggattccacttgccggccatccagaatcacgacacgtttccaacgtctacgacactatccctatccgagtcgatggcgcaagtagtaaaaaatagcctccgcgctgctaggcatcgtgcgtgggtcggtggtgggtacaaaagcacatcgtcgctacgtgccccaactccaattccaacgcctgcctttcacaactctgcaactttctcaaccacaccacacatcatgtcttcccaaaagcctttcatggacgctgtcaaggagcgtcgcacctactaccagctcaacaaggagtcacccatctccgacaagcagatcgccgagatcgctgagaaggctctcctccacgtcccttcatccttcaactcacagagcacccgtctggttgtgctcctcaacaaggaccatgaaaagttctgggacttcgtccttgaggtcttgaaacctcttactcctgaggaccagttccccaagaccgagcaaaaggtcaaaggattcggagctgctaagggaaccattctgtgctacgaggaccctgaacccgtctagggccctcccaaagctttccctct

SEQ ID NO: 19760 - DNA, 754 bp, Sorghum bicolor
  unsure (1)..(754): unsure at all n locations
  Clone ID: LIB5049-005-R1-XP1-B5
gccggccgggccgggaggaaaacacaagacctcctattccccatggcgaccgaagagggttccggcggcggcggcgccggagccggggagaagaagagctcgcaggtgcctgcaaagcctggagcgggcggcgccggaaagttcctcgcgggcttgccgtcgcgtggcaacttctcctcgggctccggctcctccaacctgggagggttcagggtttacgtctgcgagcacagcacggatcccccagaaggacaagttataaagacggattcaacaaatattttaatcaggcatctccagttgaacaagcagaagagtgaggtcaaagatgcggattccaggactccaggggaaaacaacagagggaaaaggtctgctgccagaagtttggatgtcaacaattcagcaaagagggctaacttgggtacttcctctggatcatcagcctgtgaagaaatttctggcttttcacagcacacactgcaatcatttacagtggagaggttacgtgcacttctacgacaaagcggtcgatcgaccaaagggaaaaaggatgaactgattgctcgcttacgggagtcacagggttgacacgagtctcgcacttgtttggtcaaccaaacccctgcaggcagggttacgaccaaatgagtctcaggctgtacttgtcagtggctgttctgtcagatttattccgatgtagtggcatatgtangttgagactttgccggaccctattatactcggaattttt

SEQ ID NO: 19761 - DNA, 548 bp, Sorghum bicolor
  Clone ID: LIB5049-005-R1-XP1-C11
gccggccgggccgggaaaacaccccatgcgggctgcagttcatcccgactacaccatccctatcactacaccaggcgatggccttatgctccccatcaacttctgccgcgctgctcgtagcggcaagcacacatggacaatccaccagcaacaatagcttgtccatgcctcgcagtaggcatggcctacgactgctggcccgcgctccgtcttgccgtgaacacatctactgacatcttccctaagaggataaggaaccttgtgaggaggcgctccaggtgcagatatagaattatagctcctacgcctccgtggtgacggtcaagagagcaacatcacctttgccaaatcttccatattatctcaccgatgacacgaggctagcgctcatgtgagcatccttcccctacctaagccatactattctgccaaagctcgtctaagaattcatcggactcaagccacaccatactactttgaggacaatcagagacatgactgcggacacttgcgaaggccattgccaacaaattcaatgcgcgcctgat

SEQ ID NO: 19762 - DNA, 747 bp, Sorghum bicolor
  unsure (1)..(747): unsure at all n locations
  Clone ID: LIB5049-005-R1-XP1-D2
gccggccgggccgggccacaccaagcataccatccttctctcacctctctctctctctctcatcggtcactttatcatttctctctagatctctcaggtgtaccatggtttttctagtgggggaagtccttgaagccaaccggactgctcggagggcatacctgcgtgttctttttgagtcgactgggcgggatgttgccaagaaggtaatctgccttctcctctggctagagatgaccatggggttccaggtccttggcagcgtggcgaccatgacgtcgggcgacatgtcgctcgcgcgggtcatcgtagaagcgtgcgccgtgtacaactatgttctccatggctcctacgagcagccggcacccctcgtggacatcccaaccatcgtggccctctgcggcgtgcgtggtggtaggcttgtcgactctaggttcttcatgttccacaaggacatcgttgcgcgtggtgttgccttcatccgggacacctttgcgccgctcatattcgatgactatctccatgggatgctacaccggttcaatgatgtttccaattcgttcttggtccccgcaccgctgcccgctccagaactgatggcgccgttcatcgtcttcacaagtttgccgcccgaagactaccaaacagcgtttgtcgccatccctgagcacgaccctctgagctcacaagatatccaggagtatnttgagaggcgtcttatgttcgggccttgcatcgagcgcatcg

SEQ ID NO: 19763 - DNA, 145 bp, Sorghum bicolor
  Clone ID: LIB5049-005-R1-XP1-H11
gccgggccggggctgtcatcctccgctcaggcgggctccactctcctgtctcctctcccctgctgtgccgctccgctctactccggcgagctgtccggaactcacatctcgatccctcaatctgtcgatttctctcaacgaccaa

SEQ ID NO: 19764 - DNA, 556 bp, Sorghum bicolor
  unsure (1)..(556): unsure at all n locations
  Clone ID: LIB5049-005-R1-XP1-H4
gccnnggccgggccgggnaaaaaaaaaaaaaaaaaaaaaaaaaaaaaaaaaaaaaaaaaaagttggtgaagcattcgtttgcatgcattgattattgattaaaattgctcctcctaaatggatgcgtgggacttaatcatagtgatcgtggttgtcgccccgctcgttcttgaaggtgttggttcacaaaatctatggatatggaacgcttctttgaatgatggtgggtccatcagtgacatcagtgttcttgatcaatcaccggcgtataatgaaatcttgaaagggcaggctccccccatgcaattctccctcaataagagtcagtacaaactgggtgactaccttgcaagtgaaatctacccacaatgaaaggaatgtgttaggacaaaacccttccctcgcacagaaaaagaaaggttgtttgcacggcatcaataaaaagcaaggaaggatgtccgatgagcgtttgtatgcatgcaagctcgttcttccatcgatcgtgggccaacacgctatttccctcgcgcaactcttgcaagaaactttcaagctt

SEQ ID NO: 19765 - DNA, 736 bp, Sorghum bicolor
  unsure (1)..(736): unsure at all n locations
  Clone ID: LIB5049-006-R1-XP1-B12
gccggccgggccggggttatcgttcgacaatccataacaaaaatggttaatctctcccagcaaaaaaggctcgccgcagctgtggctggtgtcggccagaggaagatctggctcgacccccaggaggctgccgagatcggacaggccaactctcgatcgggtgtcaggaagctgctcaaggatggtcacatcatcatcaagccgaccaccatccactcgcgagcccgaaccagggagctgcacgccgccaagcgactgggccgacacaccggtaccggtaagcgaaagggtaccgccgaggcccgaatgcccaccaaggtgcaatggctccgacgaatgcgagtcctccgacgactgctgaagaagtaccgagagggcggcaagatcgacaagcacttgtaccacacgctctacctcgaggccaagggtaaccgattcaagaacaagcgagtcttgatggagcacatccacaaggccaagtcggagaagctccgaaccaagaacctccaggagcaggccgaggcccgacgagtcaagaacaaggccatgcgggagaggaaggccgcccgactcgccgagaagaggcagggtatccacgaggtcgagctcgaggaggccaaggagtagattcagcgatgattctgcttctcgggcggngcttgggcgtatggagggggtgtacattttacgagatggatgcgtatccgactaaaaaaaaaaaaaaaaaaggccccta

SEQ ID NO: 19766 - DNA, 546 bp, Sorghum bicolor
  Clone ID: LIB5049-006-R1-XP1-C5
gccggccgggccggaccacctagcaatcaccacttgcattttctcataccttaagcaaggaccaatgtctcaagcccagccccttcgtttccaggcccagcggaaacatgtcaagttccaggatagccaagccaatgctatgaaggaaccaggaaccagtgggtatggctatgggatgaaagatgacaagaataaggatgtggatacaatagcttcggacttcatcaagcttaagcacagggcttgggcgctccagaagagcacaaccatgtaccaaccttctacttaaaggtgtcgctagttcaagaagtcggtactatatacttatgcttgtgtctatatagtctacaggtcctagtttaaataatagatgctgcttgcagccttggatatttgcggagtgaagttatcatggcattgttcatagaatacaaataacaaagtaatgtattatgcggagatgtgtaattatgtggcaatattatttgcaaaaatgatgtatggagtacctttatatatgaaaaaaaaaaaaaaaaaaggccccta

SEQ ID NO: 19767 - DNA, 700 bp, Sorghum bicolor
  unsure (1)..(700): unsure at all n locations
  Clone ID: LIB5049-006-R1-XP1-D5
gccggccgggccggggtcttttgatctatacctcatctcttcacctacccaccacacatatcacacacaatgtctgccgctgtcgctccaggatacaccatccacgtcgctggtcttgctaccgagaccaccgaggagaagttgcacgacttcttctcattctgcggaaagctcgtcagcgtcaagaagactggcagcacagccgatatcacttttgaaaagctcagcgctatgcggacttctctgatgttgaacggtggtactcttgatggcgcacaccttgaggtaacctctgcttctgacgtcgagccaaaagcttctgtcttaccaactggatctaccggagctactcctatcggtgccggcgttgctggatcctccgagatcagccaagaagacaagccaaaggctgctattgtcgccgaatacctcgctcacggatacgtcatgggtgaccacgttatccaacgagctattgactttgaccaaaaacaaggcatctccagccggttcctcgactttttccattctctcgacaagcaagtcggtgagaaggttgtcggagagcaaaaaactgtcactggaaagatcaacgagtctgccgctgccgtcgttgccaagactcgagaangtgaccagaaccgaggtgtcagcgccccgattctcagactactacaacaaggctatcggaactcctatc

SEQ ID NO: 19768 - DNA, 778 bp, Sorghum bicolor
  unsure (1)..(778): unsure at all n locations
  Clone ID: LIB5049-006-R1-XP1-E1
gccggccgggccgggtcttctactcaggcagcccctggtgtctaggcacacaaatgggatggttccataatatggtggatcgtatagctcctagagacgctgccaagaagcaatttctaagtgattctcttgtcgtgatgggtggaattggtggcaatgactactactcatatttcatcgccggtaaacctagcaaggatggaaatatcattccagatgtcatcgcatacatagaacatttcatcgaggagcttatttgcagtacaggtgcgaaagcgttcctgatccccaataacttccccattggttgcttcgcatcatacctaagtaggttccatagtgacaaccctgaggactatgatgagcatgggtgccttaggtggttcaacgagttctcgcagacgcacaatgaacaactttattctgccatcggacggatcaacatcacttaccctgatgtgaagctaatatatgctgactactacaatgccaccatggaattcatcaagaaccccggcagatttggtattggtaatcctctagtcgcatgttgtggcggtgatggaccataccacaccagcatggagtgcaatggcacggcaaaactttggggtgacccacaccactttgccaattgngatggcatgcacatgacagagaaggcatacnacatcatcgtggaaggggtgctanatggaccatttgctgatcctcccattccacgnagttgctaggattagctagacttggaatcccttgcacatgtatccaactattt

SEQ ID NO: 19769 - DNA, 813 bp, Sorghum bicolor
  unsure (1)..(813): unsure at all n locations
  Clone ID: LIB5049-006-R1-XP1-F8
gccggccgggccgggatctcactgtcaactctcccatcgatcactcgtcagcacatacagttgctgtcaaggtcccggagtcaattcacaacaccaaatcgccatcatgattgaggaagtcttgaagaagacctcggagatgttcccgctgcccacggcaacggcctcatctctgccttcggttgctcccgttcccactgtcatccccggcagcgagcccgtctacgaggttgctggcgatgctggacagaaggcgctttgggtcgtctttgtccttatgctgatcgcctctgctggatttactgtcatgtcatggaaggtcccattgaacaagcgtctctaccatgtcatcaccaccatcatcaccctcaccgcagccctctcctacttcgccatggccactggacacggtgtttccctgaacaagattgtcgagcgcgagcaacatgaccacgttcccgacacctacaccaccacctaccgccaggtctactgggcccgttacgtcgactggagcatcaccacccctctcctgctcctcgatctcggtctccttgctggcatgtctggaggacacatgatcatgatgatcgttgccgacttgatcatggttcttactggtctgtttgctgctttcggcactgaggacactccccagaagtgnggctggtacacaattgcctgcattgccttcatcttcatcttctggcaccttggccttaacggtggcgccaacgcccgcgccaaggggtgacagctccgcactttcttcgtctccatcgctgcctacactgccatcctctggactgccta

SEQ ID NO: 19770 - DNA, 110 bp, Sorghum bicolor
  Clone ID: LIB5049-006-R1-XP1-H12
cgccgctcgaggccgccgggttcgaaagctcgggttgttctggcactatttccccattccctgaccctgagatgttggcttcgtcacgcagcgctttatactcgttctca

SEQ ID NO: 19771 - DNA, 709 bp, Sorghum bicolor
  unsure (1)..(709): unsure at all n locations
  Clone ID: LIB5049-006-R1-XP1-H7
gccggccgggccgggaccagttacttggttctcacaactttacactggcannatcctccctcttctcacacatacacacaaattaatctccatacgataccacacttaatagccacatctacgacacaatggcccgcggaaactccccccagacccaagtcttctacaagggcagcacaggcgacctattcaccatctttgtcgagagcgtagaggcgctgcagaagtggaaggctgacagcagcattcctatggttgaggttgttgctgggtggaaggtcatggtacccgaacatggcaagcagggtgtgcccaacacggcttccaagcagcagctagagaatgagtttggtgctggcgcaaaggaggacgacatcttcaagaagatccttcaggagggtgaggttcagtctagcgagaactctgagcgcatcggcatcaccaacgagactcagggcggacgccaagcccactagacgcctcgatcatgtctacagcgtgacgaagagcgaacgatcttagtctttcttatgactttcgatatgatatcatgacttggaaagggggtggatggggtttagctagtgagcgagagctgctggcttgcaaggagggattgngatgacaccttttcctgcatcctgcatgtttgataggcatctacaatggaatgtctacaatggggaaaaaaaaaaaaaaaaggccccta

SEQ ID NO: 19772 - DNA, 831 bp, Sorghum bicolor
  unsure (1)..(831): unsure at all n locations
  Clone ID: LIB5049-007-R1-XP1-A11
gccggccgggccgggctgaattcctctttcctcactttttcttcactactggctctcatggcttccaaggcgccgccggatctactgaatgctactagttctatccatatgattgtgcgccagctgttctcccggatggtcttttcccttcagatggagtgttccctctccatggagataatttccttttggttgtggcttgaagggaatggtcatcctgatttccttgcaagcgtagaatcctttgataactataatctcaggggaattgccgttgctggaaaaatgtttattgaagctctacgtcgtaagtctagtcacttcaatcatagatctgaggaagaaggctatttccagaaagaagctacggaaggtatccttttctacctcaacaatttctgctacaaggctttagaagatattctagaaatagcagaggcaaaggaacgtatctaccgaaacaatcatcaacaagttcagcaacagaacatgaagggtaaagctcctatcatgagcacgaaggatcttttgtctaagatcagggcatccttcactggtaatccgagtcatgaagaaggctcaagttctagaagcatgccatcccccaaaaatcagatcctcagagatattgaaaatccaatcgatcagtgcctatcaacataccctttggcgaccctttttgatagcctgaacttaagggatgatccacaagctgatgcaatccagctacagatccaggtgcagcgacagcccagtattccccgtgatgagagaactctcttcgtgnactttctcaatggnctaccatttactgcagatgaactattcgaa

SEQ ID NO: 19773 - DNA, 428 bp, Sorghum bicolor
  Clone ID: LIB5049-007-R1-XP1-D11
gccggccgggccggggcatataaactcttctaggatcgtgaagaatttctcccgtcatggtgaagtacacaaggcgcgtggatgcgttagtgtttttctctttacttctccttggatactttgctgctcatgtgcatgggaagggtcatgatggcacagatgaagtgggcgctcctgctccagctgaagaagaaattctgcgaacaagagcacagtgtagacaagtattgtttccatgcaaagataacagcaagtgcttctgctgtattgggggcggagctcgtcggtgttatgcgacacaagctgggtgtagacatgcctgcccctaaacacaaattaatcaagttcgttatagtataaaaaaaaaaaaaaaaaaaaaaaaaaaaaaaaaaaaaaaagaacaaaaaaaaaaaaaaaaaaggccccta

SEQ ID NO: 19774 - DNA, 679 bp, Sorghum bicolor
  Clone ID: LIB5049-007-R1-XP1-E10
gccggccgggccgggcacagctatgactgcaacccttgcttataacctgtatttgtcgttaacctacctgggatacttaagatcagccatctgttttgcagaaaaaaaaaaaaaaaaaaaaaaaagccgccgcaccgccggccaaccaatccggcaatccccctcccggccactgctccggccaccgattccgcgtgcccgccccctacccccgccccgtctacctcccttatttaaacgcttcccgtttcccgcgtgctgcgcgacgcgaaccggaaccgctgcttgccttctcggtccattctaccccgcatccatggcggaggaggcggccgcgacgttggccggcggcgacaagctcatcctgcggggcctgcagttccacggcttccacggagtcctgaaggaggagcagacgctgggacagaagttcgtcgtcgacatcgacgcctggatggacctcgccgccgccggcgagtccgacagcatcgctgacaccgtcagctacaccgacatctacggcattgctaaggatgtcatcgaaggcacgctacacaacctcttggagtcggtggctcactcgatcgcaaaggccacgctgctcaagttccctcagatctccgcggtccgagtgaaggttggcaagccccatgtcgcagtgcaaggcgtcctggactat

SEQ ID NO: 19775 - DNA, 730 bp, Sorghum bicolor
  Clone ID: LIB5049-007-R1-XP1-F5
gccggccgggccgggaatagctagctagctagtaggccgcgccgaactgccgcacacgcgcgcacagacgaggaggaggaggaggaggaggaggccagatatgcagggcggcggcggcgtggagcagccgatgcagatggtgctgcgggtgaagcacccgtcgtcgctgggcagcagcgcgggcgacgacgacgaaggcgagggctcctccaggtcggcgctctcggtgttcaaggccaaggaggagcagatcgagaggcgcaagatggaggtccgggagaaggtgttcgcgcacctcggacgcgtcgaggaggagtccaagcgactcgccttcatcaggcaggagctggaagggatggcggatcctacacggaaggaggtggagtcgatacggaagcggattgacacggtgaaccgtcagctcaagcctctcagcaagagctgcgtcaagaaggagaaggagtacaaggaggtcctggaggcgtacaacgagaagagcaaggagaaagcgctgctagtgaacaggctaatcgagcttgtgagcgagagcgagaggatgcggatgaagaagctggaggagctcaacaagacagtcgactcactctactagacgccagccagcctatgctctgctcacccacctccaatcctccatccagagcttgcacgctcgctcgccctctgtaatctgatcatctccgtgtgccatggattcgtgacctgtatgttc

SEQ ID NO: 19776 - DNA, 477 bp, Sorghum bicolor
  Clone ID: LIB5049-007-R1-XP1-G4
ctcgaggccggccgggccgggacgaaagttgggggctcgaaggcgagcctccgaccaactaccaccaccagtccactaccaccaccgcgacggagatgacgccgcctcacctccccgtcaccgtcgccgtcgccgtccttctcctcttcctctgcctcccggcgacctcagtcgctgccgccgccgccgctgacccgaccccgaccccatggcccccgcaattccacgcgacgctggtcatggagtaccacggcaacatgtccgtggccgacctctggtacgactggccgggcggccgcaacctgcacatcatccgctaccagcttgccgccgacgcgccctactatgacaacgagtggaacaatggtacctccttcttctacaccccggcgcgccgcacctgccgctccgccgccgtcggggacggaatcctccgccccgactggctccgccctggctccgtatacctcggtcgcc

SEQ ID NO: 19777 - DNA, 658 bp, Sorghum bicolor
  Clone ID: LIB5049-008-R1-XP1-A4
gccggccgggccgggagcctgcctctgaccgccgcccgagcccgacgcgacgccagctgcccaggtcttcgccgtcgccggcgacgagcacccacccatcacgcgctccaccagtggagaagacgaggggatttcaagatgccgagggccaccagcgatgcgaagcttctgatccagtcccttggcaaggcgtatgccgccacaccaacaaatctcaagattattgacctctacgtggtttttgccgttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaatttaaggatcttcccccagaaagggcctttgctgacttcgtcctgtgcaatctggtgctccacctggtgatcatgaacttcctcggataagcaactgctgcaccatgtggttaagattttgtagccccagattgtggacgctgatcgttgcgtttaaatgtttggaactatcataatattgaatatccataggatctgttgaatattacatatgtaacctgagtattcctggatgaactattagtcaaatggacaatttgtttgc

SEQ ID NO: 19778 - DNA, 701 bp, Sorghum bicolor
  Clone ID: LIB5049-008-R1-XP1-B7
gccggccgggccgggagtaccccacattccaaggtcgctgcttcacgagaacacacgagatccagagatcgcgagctactgcgagatatgaacaccaaagtgtgagatggaataggacgagcttctgcgcgacgaaatgtgtccatgcgcaagctcatcgagacggcagagagggacgacgagaaggatgaggactagaaggaaggcacccacgactgctgagtctgaggacgtcaatgtgaaggactgcaacctctagcgtgcggcatacaacaatgtcattgcaaccttccgcttcttctgcatcatcatcttctccattgtgcacaacgacgaggcccgctccaagtgaggaccgcgtaacactccatcaaggactactgtgccaacatagagactgacttcaccatcatctactgtgccatcctcaatctgctcgagtaccaccatgcgcctgcgactactgctcctcgacttgaggactactatgctcctaagtagggcgaccactaacgatatcttgctgagcctgagagtgaacttgagagataggacgctgctgagaacaccatggtggcataacatgctgaacaggacattggtctgtgtgagcttgctccaactcaccctattagatgtgcactgcgacttaacttctcagagctctattatgagatactcaactcatctgatcactgctg

SEQ ID NO: 19779 - DNA, 609 bp, Sorghum bicolor
  Clone ID: LIB5049-008-R1-XP1-C10
gccggccgggccggatttaggacgtgtccatatactacccggaggaggacgagatgagtgccaacgaggaaatatgggggagttgctaggaggcgggaaaggcgtgatactcctacatgaacgactcgccgtgcggaacgagatgatcgtcgtggcggacctcgacagcgcctgcgacagcactctacgtggatctgggctccgtcgctcggaccgtcgccgagtaccttcagacagtgatccgacaggactcacctgacaaaacggcccacaaggacccggtgacgtgattgtctcaagctcgaaaacttgcagcacacatgatgtgcagcggttaccgcatcgaggtttacttgacagcatccgactcagatgcagaccatcatctctatatccgtcatcaaaatgctcagcactgactcatccgacagaatggacttcaggaaaggcgacacacccgagagaacctcggatctctaggagaatgcgctgtctagatggcgtcagtgacgcattggggctgatttaggtgaaggtgtagtgcaatgacaactcctcacagtatctcagcattaatattgccgtcgaggtctcctacatgctgttgaa

SEQ ID NO: 19780 - DNA, 679 bp, Sorghum bicolor
  Clone ID: LIB5049-008-R1-XP1-D2
gccggccgggccggaacggcgccgcccacccgagcgagcggcgcagagagggggcgcgtggacgccacgctcgcctcagccttaggggatccgtccgcgtggctgctcctctcgtttcgcctctcccacccgtccaaggaggccgtgagtgtcaggcatggagcactgctatttgaggcagccgatcccgagggccgaggcaatgcctgagaggaggtccaggttctggcagatggatgcgccgccgccgccccgggcggaggtcatctgccctcagcctcgccgtgccacccggactcccttcgctgtggaaaccgtgaacaaagccagccccaagacgaacggtgcatttccgctgtacagatcagactccacttgtgatatacttgatcttatcctcagtaagaatgactcagatggagattcgagcagccaggtcggctttttatgtggctcacctccagtacgcactaacaaccctgttatccatgatccacagtttggtaaaaaagtgccatccttttctcctttagggagctcctatggcaaagcgccaacagtaagagttgaagtaggctcgccatcttgtggtgttagcagcagccccaaagtaagaatcgaaggtttcgcctgtggcaactctgagacccactatgcagttacctttgtctgagcattt

SEQ ID NO: 19781 - DNA, 838 bp, Sorghum bicolor
  unsure (1)..(838): unsure at all n locations
  Clone ID: LIB5049-008-R1-XP1-D7
gccggccgggccgggacacttcaatctcaacttgacacttttgatacccctacataccacctttttatccaaaaatctcaacacaaccgcaaacatgggtcgccaattcttcgtcggaggtaacttcaagatgaacggctctattaagagcatcaccgacatcgttgagaacctgaacaaggccaagctcgaccccaacacagaggtcgtcatcgcacctccagccctctacctcctcctcacacgcgagcacctccgcaagggcctcgaagttgcagcgcaaaacatcttcgacaagcccaacggagccttcaccggcgagatttcagctgagcaactcaaggacagcggcatcacctggaccttggttggacactcgaagcgtcgccagatcctccaggagaacgacgacttcattgccaacaagacaaagacagccaccgacaacggtcttggtgtgattctgtgctgcggcgagagcctggagcagcgtgaggcgggcgagaccgtcagcgttgttaccaagcagctcaaggctgttgcggacaaggtcaaggactggagcaagattgtcgttgcttacgagcccatctgggccattggtaccggcaaggtcgcaaccaccgagcaagcacaggaggtccacgccgccctccgtgagtggctcaagaaggaggtctcgcccgaggcctccgagaagacccgtattctgtatggtggcagtgtctcggagaagactgcaacgagcttgcccagcaggcgacattgacggttccctcgnntgtggtgctagcttgaagcctgccttgntgacatcatcacgctaccaggcatgaat

SEQ ID NO: 19782 - DNA, 409 bp, Sorghum bicolor
  Clone ID: LIB5049-008-R1-XP1-E6
gccggccgggccgggggtgagatacttagtacgagtccctgatcaccatgctgcccagaagctatgttcaggtacgactgcctaacacatagacgactgcgtactggaggtagacgtgtcccatgtaccgatatctatcatgaaaactgttcctgtggaaaaacgagatgaggggctgccaaagtctcaatatattgactaagccagcataaaagcctaatttgtgcaccaaagaacttcatgatatggatggcactcctgagaggcgttgggatggaccgaaggggaggagaagcctcccgagttcaagccttgctcgagaatgatgaaacaaagtgctggcatcattccccctggtggaacgcttgactttagtattcgctgccgccgctattactgctttaacatt

SEQ ID NO: 19783 - DNA, 666 bp, Sorghum bicolor
  Clone ID: LIB5049-008-R1-XP1-E9
gtgcgttcgttcgaggtcgctcggtccgcgaagattgcatctccatcctgatcgatcgtttgatgattggcgagcttcgttccattaccatctgttgctttgacggaggatgtgagctgggcaggtaactgcggatgcgtgatccggctgcaagtgctgcagagattgcatagggtgcaatatgtacccggacatggatgaataccatgtgaccaccatcgacaacactctcgtcatgggtgtcgcaccatcgcccaatgggcacatcgagggcgggatcaaggcggctcacggcgccggagctgagaacgaagggagtgagagcggccccaactgcagctgcaacccctgcactctgcaagagagctgtataataaccccctgcactgacactgcagcccggaggaaggacggactcccctaactagcatagcactgactgcactgcggagtgtgtgtgtttgatacattcagtcaatccagtgccatggcaccatatgctagcgcatctggtactgatgtaaaccaataataattgtactgctaagatgtcgacagagtcgaccttcacatgctcctccgggtgctcatctactaaacaacaggtgactagttgagagcttgtgctcgcactgcagaacagcaacaagccatgatccctgctct

SEQ ID NO: 19784 - DNA, 829 bp, Sorghum bicolor
  unsure (1)..(829): unsure at all n locations
  Clone ID: LIB5049-008-R1-XP1-H10
gccggccgggccgggcccacccagaacctccttgtcgccggcgatcgatccttctaaatccgtcgcccacccaacctctcctccgatcccgtcgactcgcgctccgaacctcggaggcacggactcgaccccaatggctctgccaaacaccccgcctgtggacttccccagcttcaagcttgtcctcgttggcgacggtggcactgggaagacgacgtacgtgaagaggcacatcactggggagtttgagaagcgatacgaaccaacaatcggggtggaggtgcgccctctcgacttcaccacgagccacggcaagataaggttctactgctgggacacggccggccaggagaagtttggtggcctccgtgatggatactacatcaatggtcagtgtgccatcatcatgtttgatgtcacctcaaggatcacctacaagaatgttcccacctggcacagggacatcagcagggtgtgtgagaacatcccggttgtcctgtgcggcaacaaggtggatgtgaagaaccggcaggtgaaggccaaggcagtgacttaccacaggaagaagaacctccagtactacgagatctctgccaagagcaactataacttcgagaagccttttctctaccttgcaaggaagctcgcagggaacatggacgtcaagttcgtcgaagagttagccctcgtccctgccgacgtgaccatcgacgttgctgcacagcaacagattgacaaagagatcgaacttgctgcagcgattcccctgccgnatgaggacgatgataacatggattgagctcagctagatgctgtgtcaggctgcctt

SEQ ID NO: 19785 - DNA, 801 bp, Sorghum bicolor
  unsure (1)..(801): unsure at all n locations
  Clone ID: LIB5049-008-R1-XP1-H12
gccggccgggccgggtcaataaacagtactatttctcttacactttattttcaaaacataaaagagagcacatacgtgatacatctttgctcaaggttatcttcatctgttctattttgtgttccttgtcggctttgattttttttattctatatcgcattattattctgtctaacatcatcaataacactgtctgaacattactgttatagtttatacaacacaatttgttgctctcttcattggtggaagctgtttggaaaaaaagcagtccagtaatgcctacttatcacaatctacacgtggcctacgcgcattactacggaaacatggtgtttgcttttctatgcctctttgcaacactgaagtggagcaggctactgaagatgaccttattgaactttcagaaatccaaaggcgcaatcttggacaggcactccatttggatgctttatctgatgtcgacaacaccacgcagtcactgctttcatttactggcaatgagaacgttcatggcttatacgatgttcttttgaattacaagtccttgctaaattctttatcttctgtggatgtcccagtcttatattcaccccagccatttcaaaatggctgtctacatattccagaggtgaagtgcagggagatgaggagagcagacatgnggctgctctcatccggcgggttcgacacagaacagggatcagcgtttgcctccacgacaggcaacatctgctacagcatggaaataaaggacgcggttctcccgccatgggtcgtctctggactctgcccggcgat

SEQ ID NO: 19786 - DNA, 847 bp, Sorghum bicolor
  Clone ID: LIB5049-009-R1-XP1-B9
gccggccgggccgggaatttccattcactgcacactccaccaggtcaatattggtaatcactgcctcgaccgaacttacatcctatttgataaagatatcagagcaagctaccagacatgtctcaattggctcaaaccctccacgacgcggcggctcgtaatcgtgagctgctatcagttctagcaaacacagactatgctgccagaacgctgtaacagaacaagtcatacatctcagatctcgaggcccaagagaaagcaaccgagaaggaattgaagaaactgcatgccataacagaagacgagcgcaaagaccatgtcaaattacgcgacagcacttttaaacgatatgtccacaagctaggtggtagcaaaggccaggctaagttcgcttccaagtctgagaaagaagaacgcgaattcctggaagcctggcaaaaagagcgagaggccgaggaacgccgggcagagctacaaagagctctgaacaccgccaaagaggaccgccagcgactcgaaggcaagaagacacgtaacgacggtgctcagcgcgaactcgatcagctctacgccagcattttctctggtccgacgcctgaagttccgggcgaggaccaaatggaatctacggtccagagtgcaaagcaatatcttgagcaagttcagtcgcaatgcaacgctgattgtgctgctgtcgatgcccttagccgcgtggaggagcgtatgggagttgctgccggtgccatgcaagaatcactgtccatgtcgaggttcgacatgatgggtggcggaacccttgcagatatgatggagcgtgatgcgctatcgaaagctttctgtgcgatct

SEQ ID NO: 19787 - DNA, 799 bp, Sorghum bicolor
  unsure (1)..(799): unsure at all n locations
  Clone ID: LIB5049-009-R1-XP1-D10
gccggccgggccggggatggatattttgaagcatttaaacacgatattttggctattgaggatgccaagtctacattgaatgtcaaagaggaatggagggagtaataggtggtagagccagtacatgtatttgatgcatcaccaaggccatagtatgggaaaaaaacattacttttaagctttcgctgaaaacacatttctttcggcaaaagatacttacagccattccaaccttgttctatccaatatattttctgtatatgaatacaatttactaatcagattatatgtgcgattgttaggtgcatcatggtggagcaggtaccacagcagcagggctgatagctgggtgtcctactaccgtagtgccattttttggagaccagttcttctggggcgagagagctcatgcacgaggagtgggccctgcacctatacctattgcagaacttactgtagaggcactatcaaatgcaataagattcatgcttgatccagaggtaaaatcacgaacaatggaactggcgatagcaataggcaatgaggatggtgtggcagcagctgtagatgcatttcatcgtcacctgccgtcagaattgccactgtcgccgcccgcacatgtggaggaagaacgcatagacttcttgcaatggttttctcgagccctggagaagtgttgtttcccattcaatatgtaggtatggtgttccatgtaggtataggtacgatttattcttttatgnggtggaaaggtcgatcacaccaattttctacatttgaaataaatgctggtacaagc

SEQ ID NO: 19788 - DNA, 731 bp, Sorghum bicolor
  unsure (1)..(731): unsure at all n locations
  Clone ID: LIB5049-009-R1-XP1-D5
gccggccgggccgggtttttcttctataaaaagtgttgaatgtcttccaaacctcttccattgcatctgccctgtttcggagttgattgtacagaagttagacttgcaataaatagtcaacttcgtagaaccaactatcatgtttatatatcatagttgtactaattgaataaaagctaaagctgcacaggccattttagacattagcctgcttaagaggactatggtgctccagctctcaagattcctgaatgctgagggggatctctgcttgctgctttgcttttgtttttgcatacagtttatttggtttctttgtcctccgagttggtttatattaacaaaaggatactaatattttgtgttatttctttatgaatagactctagcagtacacactttggtcaatagttctatttattcttttatcatctacaaaaggataagccaatgggcacgtcttgcctaagagtgcatgttcttcagttgaggggtgtttcttctctctcaaaactcgatgggaccgggatcggcagcaggcttgctgtagtgngactgtgggagtagctcggaggcacggtagattttggaaagtctcactggctcaccagccactagtggaagtagctctgatgagcggtgggatgcaacggcggcgagcagagagagcagagccagagggtaactgcctatcaggccgcataaatgtttttacagttctttggtttgtt

SEQ ID NO: 19789 - DNA, 697 bp, Sorghum bicolor
  unsure (1)..(697): unsure at all n locations
  Clone ID: LIB5049-009-R1-XP1-E2
gccggccgggccgggccagagttgatcaatagaaggaatcaattgggggatagcactgttgatattgacgtcgatccatgacagtgatagtgacatcgacatgggtgtggtgtggcagagaacaaggacattatgagccaagatgaatcgcttatggatattgatagtgtagactcggagaacctgcctgcagcatagaatttgttaaagagctttacaagttttacagagaaaatgaggttgccctgggtgtggtctatactgtacctaatgaggaatacctgcagaaccattcaaggttggaggagaatgaggatagctgcttgaggacaactaccttgagttcattgccaagatgatccttcagcaaaggtatccaaagtagaaggcctgttattatgcctaatttgctaggcatggcatttcctcgacaaccagctgttatagactcatttgtgggtcgccactataggcgccgggctagacagactaaggttaatcgtggactgttgtatacttggatcattggatggcaatacctccaccatctcacctcaagctgcttgacatttctgtttcatggtttccctgcttcagctctgatctcatttgtgttagcgagctgatgtcgctcatgttttactcataaattggtattanatctatatagttcaccactgcgtcgaggtaatctacc

SEQ ID NO: 19790 - DNA, 485 bp, Sorghum bicolor
  Clone ID: LIB5049-009-R1-XP1-G5
gtggcggccgcatcgaggcccggcccgggcccgggatctgcccaccgtcgacttcgacttttcccgcgtatgcgtttcaccaccatgacccgctacttcccagactaggaggtcaccgcccgtatccggccggcgaagatgtcccgcaggggctggggcggcaaggagctcgggaagggcggcgcgaagcgccaccggaaggtgctgcgcgacacacatccaagggatcttgaatacgtgcatccgaagactgatgaggagggactgagagaagtgcatctccgggctgatctacgaggagaccgcgcgctgtgctcaacgatcttcctcgagaacgatgtccctgacgccgtgcctacacacataacgaccgccgcaggacctgcttcgccgtgtacggcttctacatccgcgagtgccaccgccgtacccactgcggtctgggctatgctaagtgcagtgatgctcctggctacgtgattcga

SEQ ID NO: 19791 - DNA, 663 bp, Sorghum bicolor
  Clone ID: LIB5049-009-R1-XP1-G7
gccggccgggccggggccttctgcagtgcgcaacacatagtccgcggctgattcggatccagcgcgagagacatagctgaacggatggacgctgtcgccagtatagcactgaatcagcctccaccagccgatctctgacggcgcctccgcaacccgcgaccggcggggccgcggagacgatgcgatccacgcctctcgctctgtgataatacaagcgtcctcttctgctctatatcgccgacgtcccgccggcacctcaatcatgtccgagctcaaataccacctggtcaactcgttctctgcggcatcgcctacatctggaagccagtgcgcggtggtcctgctcccgcccgccgacctgcgcatagccgacgacgattggctgcagaccatcgcgtcgaatttcagctaccccgcgacgtcgtttgtcgctcccaagcaagccgaagggggcgatgagctcgagtacgacatccggtggttcgctgcgggtgtgcgttgttgctggtaggaacgacatgcaccgagctcacgcgcaggagctaccattctgcggccacgggacgatgggagccgcaaacgtgcttttcagcttgcattcaggagtcagccttattcgcttcaacgcaaaacctgggcagatcttcgctagacggcaggacg

SEQ ID NO: 19792 - DNA, 838 bp, Sorghum bicolor
  unsure (1)..(838): unsure at all n locations
  Clone ID: LIB5049-009-R1-XP1-H7
gccggccgggccgggaacttcactctctcccccatgcgaaccttcatacacgtctccctcgcaacgcgccaatctcaatcttcacaagacaaccaaccaacacatcccgatcattcaccatgtcctcaacaatttactcctcaaactcctccgcaccagcagaggaacaacagcagccacaacaacaacccgaaacacccaacaacgatgcgcccaaagcccctctagccctcccagaagcccccgcgaacgcaacgcagctcgacatgagcaccggcggcacgaccgtctcgctcgaccacctcggccccatggtcgtcaacgtcgacggcaccatgagccgcatcgcaaactgggacaagatggctgagatcgaaaagaagaacacgctgcggattatcggcaagaggaacaaggacaggttggcggcgttgaaggctgccgctccgcagaacgagggagaggcgaagtaggagacagaggctgcgtgaacagtaatgtggtttgatcaaaacatggaggcatggaacagccaggtctcggcgccatgcgatgcgtcggaaaggcgggatgagggagacactggatgcggcagaccgccagacaagaggcacgcttccttgcgcgcctgcagaagggaaaagcagctttgcgcgtgagacacgttgcgttcgtgacaaaacacgaatcgcaggaatattgccattcgaaatccgggaggtcctttggtctgagcttgcgcgagcaacaaccctcgtcgatgacagacatgacagcgctgatcatatgccactatcaacaaaaccggaagctgntgaatcgcacagtatacgaaaaa

SEQ ID NO: 19793 - DNA, 259 bp, Sorghum bicolor
  Clone ID: LIB5050-010-R1-XP1-F5
ttcccattgcagattcagaattcctttcactttcgttctgagttcgcgactgtgagatactcctgcagccatactcgcgatcgacccggcagaatggagcgtcgcgtcgtcgtgaccgtgaacccggtcctcgtggtccttgtgctccttgtgctgtcctgcctcctcgtctaccccccctccccacctccaccccaccacccgtactcctcctttcccatgaccagaagcctgcgcctggggagccacctgacggatt

SEQ ID NO: 19794 - DNA, 796 bp, Sorghum bicolor
  Clone ID: LIB5050-010-R1-XP1-H6
tgtgcggcgctcgaggcggccgggttgcgactctagctacatcgtgtcacactttagctctcgatcagatcgagtgagccatcagcagggagcacagtttgtgtgtccagccgccatggctgcccatgtggacccgctggtggtggggagggtgatcggcgatgtggtggacctgttcgtgccgacggtggccatgtcggtgcgcttcggcaccaaggacgtaaccaacggctgcgagatcaagccatccctcaccgccgctgctccggtcgtccagattgccggcagggccaacgacctcttcaccctggttatgactgacccagatgctccgagccccagcgagccaacgatgagggagttgatccactggctggtggttaacataccaggtggagccgatccttctcaaggtgagacggtgatgccgtacctgggcccgtgcccgccggtgggcatccaccgctacgttctggtggtgtaccagcagaaggcccgcttcagggctccgccggtgctagcaccgggggcggaggtggaggcgtcgcgcgcacggttcaggaaccgcgcctttgccgaccgccatgacctaggcctcccagtcgccgccatgtacttcaacgcgcagaaggagccagccaaccgccaccgccactactgagcctgaggccactccgctgactgatccaacaagctttagcaaccaagctttagctagccgctgccgtcagcgtccgatcagaaagaagacaagttttctttgtcgttgttgccccctagtagtagtacctttaat

SEQ ID NO: 19795 - DNA, 321 bp, Sorghum bicolor
  unsure (1)..(321): unsure at all n locations
  Clone ID: LIB5050-011-R1-XP1-A12
gaaggaagttnagattttncattggtccagtcnttacagttactatagaatnnctgatagagnacatgaacaancttctntaaatacaaggatcgatggttttgtttggtggtgaagctttggngaatnantcaattccccaaatttctgacacccatgaaccctactccctgtatttgtccccctacaaaaaattctaaccactgctactttcgaccttgtgacaaatgcacatatttggtccctcccatgtagttacagaatactctgaggatcagcttgaattggtcttataattctgtgattagatgaacgcccatc

SEQ ID NO: 19796 - DNA, 394 bp, Sorghum bicolor
  unsure (1)..(394): unsure at all n locations
  Clone ID: LIB5050-011-R1-XP1-B12
ggaagtttttngnagagaccagaacagagnaaanaaagagagcagagtgtttccgagngagtgtggtggttgtngtcagnagagaggctagagatngagagagagagaggatggnggaaatngngttgttggagacggagcagttcgagaaggaggtgaagagaggcgccggcgccgtcggtcacatcgtaatcgcctcccgccggccacaggcgcacattttcgggtcgtgccccaggtgtggagtcctctgtgtgtagtccgccaccccctccgccaccgccttgaggctcagttccccgcccgcgctcctgctgcccttaaccccgctcgccctggtcgaccccgacggccctcttctccgccttactgctctatctcacgccccccttgc

SEQ ID NO: 19797 - DNA, 355 bp, Sorghum bicolor
  unsure (1)..(355): unsure at all n locations
  Clone ID: LIB5050-011-R1-XP1-C2
ggaacnggagaagggagggggngaagnnagatggannagggcaataagtttaggggcggaagtggggagaagaaggnnaagaaaaggagnnacggatctacggngtctgttcgtcgtggtggactacgccttcctgctcgtccttccacctgcttcctcgcctacctcgtcgggtcagtgtaatcttccctccgtcgtcggctccgcctagaccggacttcgttagtggatctctctcttattttttccatcttcttgtttcttttttttcttgtagacgatggaggtgatagcactgacatcttgatgggaggctgggtggttttcgatttaatcttgtacacccccccccccc

SEQ ID NO: 19798 - DNA, 198 bp, Sorghum bicolor
  unsure (1)..(198): unsure at all n locations
  Clone ID: LIB5050-011-R1-XP1-D12
gggccggaagatgcatctccatcctgatcgatcgnttgattggngagnttcattccattccatcagttnctttggnggaggatgtcgtggtgnggaggnnantgggggtggggntccggttgnaagtggggnagcggttggggagggtgcaagatgtacccggacatggctgagcaccaggagaccaccaccgtcaag

SEQ ID NO: 19799 - DNA, 436 bp, Sorghum bicolor
  unsure (1)..(436): unsure at all n locations
  Clone ID: LIB5050-011-R1-XP1-H12
tctctcgattccgaagntgttctcgnnccnagaaatnaaagagttcctccggggggcggngaancacttcccatcgncaaaaccctagncccgatccggtcgaggagngctgcttcnttgggatggngagnannactagnnaggngagcctcctactccaaaagcagttaaagggacctgtgaagaaccacgaggatgggatctcgcgcgccgcttgaacacgataacaacgcactacgagtgataggttaccatcatcctacactacagccacaatatacgacggaagtcaacttcacgcattcactgaattaaccagaataatacccaagaccgtcataatacactaaaacttcatgagaagaggcctcnccaacgaaaatcagctgtacatgatacaaataaaatttcccccccccccccccccgaccccccc

SEQ ID NO: 19800 - DNA, 786 bp, Sorghum bicolor
  Clone ID: LIB5050-012-R1-XP1-B11
gcggcgctcaggcggcggctcagaaaagagaccagtccggtggcttgcttcctccccgaccgactccttcctcctcttctgacctccggaagcaccatggagaacgccgccgcgaacccttccgctgcggccgccgctgcggcagggaacggcgtccaagcatcgggggccggaggggagcggccggaggacgcgtcgaagcagaacctggcgcaggtgacgagctcgatccagaagacgctgggcctgctccaccagctcaacctcacagtctcctccttcaactctgcctcccagctccccctcctccagcgcctgaacgcgctcgtggccgagctcgacacgatgcagaaactcgccgaggggtgcaacatccaggtgcccatggaggttgtcaatttgatcgacgatgggaagaatcccgacgagttcactagggacgttctcaacagctgcatcgccaagaaccagatcaccaagggcaagactgacgctttcaagagtctaaggaagcatcttcttgaggagcttgaacaagctttcccggaggacgtagaagcatacagggagatacgtgctacgtccgctgctgaggcaaaacggttggctcagtcccagggtactctgcctaatggagatgtcaaagtgaaagctgagcattgagggaagggtacgactacagagggcaagtttactatctctgtttagtttggggatggctttgttaacgagaaacttgcataactttttattgcactttcccttcatacgattgatcagtgaatc

SEQ ID NO: 19801 - DNA, 630 bp, Sorghum bicolor
  unsure (1)..(630): unsure at all n locations
  Clone ID: LIB5047-001-R1-XP1-A11
gccggccgggctgcgaagattgcatctccatcctgatcgatcgtttgattattggcgagcttcattccattccatcagttcctttggcggaggatgtcgtgctgcggaggcaactgcgggtgcggctccggctgcaagtgcggcagcggctgcggagggtgcaagatgtacccggacatggctgagcagcaggtgaccaccaccgccaagactctcgtcatgggtgtcgcaccatcgtccaaggggcacgccgagggcgggttcgaggcggcggccggcgccggagctgagaacgacgggtgcaagtgcggccccaactgcagctgcaacccctgcacctgcaagtgagctgtataataaccccctgcactgcactgcagcccggaggaaggacggactcccctagctagaatataagagtcgccactgcggggggggggtggatgaatccagcagtcagactagcgtcatgccaccatatgctagtgctgctgctactgatgaccaccaataatagttgtactgtgatgttggcgtcgtgtccttcttcccgtgctcctccgggtgctcatctactagcagncgntgttgtggtgtgtgtttggggcagcgcagcaacacagcaggacg

SEQ ID NO: 19802 - DNA, 201 bp, Sorghum bicolor
  unsure (1)..(201): unsure at all n locations
  Clone ID: LIB5047-001-R1-XP1-A2
gccggncggttcgggaagaatgatctccaccctgatcgatcgcttgatattggcgagctcattccattccatccgtcctcttggcggaggatggccgtgctgcggaggcactgcgggtgcgggtccggctgcagtgcggcagcgcntgcggagggtgcaagatgtaccccggactgcctgagcagcaggtgaccaccaccg

SEQ ID NO: 19803 - DNA, 632 bp, Sorghum bicolor
  unsure (1)..(632): unsure at all n locations
  Clone ID: LIB5047-001-R1-XP1-A6
gccggccgggcttgnggcagccacaagatcaacgtgtgcttcgcgggcacaatgaatataacgcccgtcttcaaccaggtgcttgcaaagcacgatgcacctctcgtggagccttatgtctttcgcgtggaagctctcgacggcttcttgaaggaagcctaccgcatccgcacacacatctccaaactccatgccgacctcaaatctatccgtcaaagctatctttcaaccgccaatccgcctcgacgcaagcagtatgctcgcagcgaccagtcctctaccgacaaagacacaaagtatctcaccgatgcggagcgcaccgagatcgatgctcaagcgaagcagtccctgcgagagctcaaccacgctatcaacaacccgcgcgatgcagaggaactgcggcagactacacaatcgcaggtcgcgctgcggaagtgagcgaagcagggactgggtgcattagggcgatgggcagctggcggggctatcacagcaaaaagcgtggcagaagagttggaagaggcaaaagcaaccacaattagagcgcacagagagagtatagtatggatgctgcagaatcagttggaggagtgcgggcgcttccagagcggcatgatggagataggctcatg

SEQ ID NO: 19804 - DNA, 336 bp, Sorghum bicolor
  Clone ID: LIB5047-001-R1-XP1-A7
gccggccgggcctggacaggcaattgcgccgttcttgtcttgtatacgaatatttgccaccgtgccaggaggtaaagtttagctgggtctgttttttttaggactagtggatcaatcggattccttgacagaggcctttgggctgggagcttctgtagtaagattattagttcagttgagctgtgtattgcaatattttttggccagttgatgtgctgttttattcctttgggtgttgagaaatcgggccttggaatataaaacgagaagaaggaattttctgaatgatcttgtggcaaacggttgctgcaaaaaaaaaaaaaaaaaaggccccta

SEQ ID NO: 19805 - DNA, 190 bp, Sorghum bicolor
  unsure (1)..(190): unsure at all n locations
  Clone ID: LIB5047-001-R1-XP1-B1
gggcggccgggtccggngtacccgcgctggctcgttaactttcacggactctctagatcctccctggtcctggtgggtttgtggtgaagaagaaagaaaagtggacaattgtgggagacgtggtggcggggcgccacccggagacgggcctcaagaagctccgcaaggccgccactgcccgccccatcct

SEQ ID NO: 19806 - DNA, 663 bp, Sorghum bicolor
  Clone ID: LIB5047-001-R1-XP1-B11
gccggccgggcttgggccatggccgcagctccggtgagaggcaagaacacggcgaggaggacagcatggcggctagccgccgtctccttcctcctgttcgttttcgttgctgtgatgttgatctctacgacgacagttcagtcgcggcacgagctcacctccagcgaaagaggctctgaatttcgggcgtggcggaaggatggagtgaggccggacaggacgaccgatatgacgacgccgccggcgcccaaggccaacagcaacgtccctggagggcccttcggccgttgacggatccagatcgagtcgcactcgcctaatcgctacatctttttagcatcttattcgcttgagtctatttgttaaatctatcataattatttaatcaatatgtccatgctgtgtgttatttttcttcttcagtcatcttgtgcttcttttaacgatgaagaactacgttgtgatagaaataaattttgcttggaatttttttagggaaaacttgcttggaaaattaagaacaatgcattatggattctgtttcatagcatttcgcatggtatttattccttgttacaaagctttatatatgttgctgcaaagtacaacttgcatgggaaatatatatggctttttccgaaaaaaaaaaaaaaaaaggcccct

SEQ ID NO: 19807 - DNA, 596 bp, Sorghum bicolor
  Clone ID: LIB5047-001-R1-XP1-B6
gccggccgggccttgcaaaaaaaaaaaaaaaaaaaaaaaaaaaaaaaaaaaaaaaaaaaaaaaaaaaagcttgttttgtgcccgtgttcttcatcgacaccagtggtgcctgcgagatggtggcagtggcgtccgacgcggtcgtcgccttcaccagcggggtcatgtccgccgcgctcgtcgtcgtcaccgtcggggtcgtgctcgtcgccttcaccagcgtggtcgcgcccgccgcgctcgttgtcttcaccgttggggccgcggtcgtcgtcttcaccagcggggtcatgtccgccgcgctcgtcgtcttcaccgtcggggtcgtgctcgtcgccttcaccagcgtggccgcgcccgccgcgctcgtcttcttcaccgttggggccgcgctcgtcgtcttcaccagcagggtcacgcccgccgcgctcgtcgtcttcaccgtcggggtggcgctcgtcggcttcaccagcggggtcacgcccgccgcgctcctcgtgttgaccatcggggtcgcgctcgtcggcttcaccagcggggtcacgcccgccgtgcttgtcgtcttcaccgttggggtcgcgctcgtcggtggatct

SEQ ID NO: 19808 - DNA, 492 bp, Sorghum bicolor
  Clone ID: LIB5047-001-R1-XP1-B7
gccggccgggctgcgaacgtctcacctgtgagctgtgacttctccctcccccccgttcctgtgttcctcagatctttggattctccgtccctccgtctgatgatctctgcgcctctgcgggtgtcggcgccgaaggctgccgtcgggggtgggtcgttcctgttcggcggcgcgtcctacgtcgattccaagcccagcaagatcaagatccggtgcgccgcggcggcggcgccggcggtggggagggggggcgctgctgctgctgccgccacgctgtacgaggtgctaggtctgcgcgccggcgccacgggcagggagatcaaggccgcgtaccgacgcctggcgcgggagcggcacccggacgtggcgcccgcgcccggcgccgccgcggagttcgtccgcctccacgacgcctacgccacgctctccgacccggacacccgcgcgcgctacgaccgcggcgccgtggccgtggcgcagcgcccgtggagc

SEQ ID NO: 19809 - DNA, 198 bp, Sorghum bicolor
  unsure (1)..(198): unsure at all n locations
  Clone ID: LIB5047-001-R1-XP1-C1
gcgggtcgggatcaccagagtcctcccccccacttgtatgtcgcccatcaagttgctctctgcaggttcagccgtacctggtgaaacaagataagaaagatgggagtgtctccgcggagcggggctcttcttatttctcctttctctcgtcgcgggnagagatgggaagccatcgtcgtcgatgccaaaacgggagtg

SEQ ID NO: 19810 - DNA, 446 bp, Sorghum bicolor
  Clone ID: LIB5047-001-R1-XP1-C11
actcccaagaagagtccataagatgtcacgagaacggtgggggctggtgtaccacgtgctcgcactgcgaggaagcgccgccgccagcgcgccatggactgaaaagctgggagcaaccaggcctcgggaccactccaacatgcatgacaaaggatggtatgacacacttacgatgagaacgccaacgagaaaaatggacaacccagggacccttacaaagaagacaagcttgacatcccaaaataaccgactggaacagcagaaatcggcccaaatatccatgcatgcacgatggaacttgcatccatacactgacctcatacatatatatatgcctgtccatgaaactcgatgtcccctatccatatttttggcggccgacaaagttcgacaagctgtccctcacccactgttcctccatgagaacctatcggatccgcaggaat

SEQ ID NO: 19811 - DNA, 683 bp, Sorghum bicolor
  unsure (1)..(683): unsure at all n locations
  Clone ID: LIB5047-001-R1-XP1-C12
gccggccgggcttggataggagccctgcagccacatttgtttgttcctggttcccggccctctccatggggtggctccactccctcttctcccctctcaggaggatgtgggtgagggcgcattccgagcgccgcaaccggaggggaatgcacatcctgtacaaggacgtgcagtcgtgccaggacgaggacgtgcacgtcctctggtccatcctcatcgactcgcaccgccacccggctgtcctcaagcttaagctctgaaccaagctcagcaatggcgccgtctacgtgtacctatttatatatgccgggtgcagtctgagagagagcagccctcctagctggcctcccatcccatcatttagtactatctatggtttgtctttgatgaggattactactcattggccattgctgcctttgcattccaaaaccaaagaaaaaaaaaggagctcagaggttgaagaagaagaagagagagagaggttttctatgcttgttgtgtgatgttttccctttgttcttttgcttgtttctttgaggttgagatgtcacctttgtttgtgttgggcttgaaaaaagagtgtgaggttgagctccctgtacatagacacatacacttgctcaagtgatgccttaccttaattctatcgtactgtacagntgtgtgtatttgcttgcatt

SEQ ID NO: 19812 - DNA, 343 bp, Sorghum bicolor
  unsure (1)..(343): unsure at all n locations
  Clone ID: LIB5047-001-R1-XP1-C4
gccggccgggtcgggaatgtcaaatgcagcacattgcgtttgtagatagcgaagtgccctattttatatacaaatttgagacatggagtctgcaaatcacacgccatatgattataacaagattggatgatacaaacacagtcccagcccagtggngatgacagatgtcgacgatccatttcgatgaacgagaaatatttggattaattcgccttatcaatgatccggaacattcattaacattggaggaattgcatgttgtccaaccaagtcttataaaagtggctaataaaaataatgaagtatttggtcattttacacccaccattccgcattggagcat

SEQ ID NO: 19813 - DNA, 355 bp, Sorghum bicolor
  Clone ID: LIB5047-001-R1-XP1-D4
gccggcctggctgggtatctattataaggaatattgactattgtattttttagtttacaaaataagaaaattgcaaaaaaggaaaaaaaaaagcagagggggctccgtggccggcatcgcgcaggagttcagcaccacggaggagacgattctcgcggtcaacaagatggccgactccaatgcccttgtcgccggccaggttcttgtcgtgccactccgagataggcctcctttatttattttcctagcagctcgtgtgttcttgatctattttcgacttgtttaggtagattccttgagcttaaaaaaaaagtagatccactttcatcaaaaaaaaaaaaaaaaaaggccccta

SEQ ID NO: 19814 - DNA, 491 bp, Sorghum bicolor
  Clone ID: LIB5047-001-R1-XP1-D8
tcgcttatcatccgcggtttgtgcatctccgccccgcgcttgaaccatcctaggccgctactctgtcatactcgaaggagaaccacttctaatccaagggcgacgctgccgcgaccaagacttacccgcaacaggctggcaccgtccacaagaacggcttcctccgcatctggggacgtccctgtcaggctgagcaggaccctacctctcagacgtgggaagcacggaccacgccacatgccactttgatgccatatacatattctccctgaacaagcttgaacatattgttccttcttcacaccactgtgacatctccgcatgagaaccgtagctgaacatcccctgattgacatatcggaggatggatttgagagccttcttacttcacatgcccacactaaggatgatcttagagtcccaagtgatgagactcttgtggtccatagtaaggaatgtcgtgaaagtgttaaggatcttgctgtgactgt

SEQ ID NO: 19815 - DNA, 755 bp, Sorghum bicolor
  unsure (1)..(755): unsure at all n locations
  Clone ID: LIB5047-001-R1-XP1-E10
gccggccgggttggggcacaacgccggtgcggcagccacctcagcgcctctagcgcacagaagctgagcgacggcctcgtaccccatggcctccgccatctggagcggcgtggcgccgcgccttgtcctggcgttgacgtcggcgcccatgtcgagcagcacctcgacggcctcggcgtggccgccctcgacggcgaggtgcagcggcctgtgcccttccacgtcctcgcactcgacgtccatgcagcccgacccggcgagcagcgcgatcgcgtcgcagtggcccttgatcgccgccaggtggagcgccgtgaggccgtactggtcgcgcccgcagacggccgcgcgcttgctgagcagggactcgaggctcccgaggtcgcctcgcctcgccgccgtcatcaccagctcccaccgttccaggacgtccaccacttcttgctgcatgcaccactcagcaaaaacaacaccgccgttacacacaccaaatggacgaggaataaccttgcattaattagctaatactatcgcccgtacgtcctgctctcggnccgttcctatcatgattcacgagcacacctacgcggctcacgtaaagccaagttgcgttgcgtgcggactgangctggtccatggcgtgattccttgtgtctcttctcgnggttctggtcgntagtgacaggntagtatatgccggtttaacgcaaggggtgtccggctaattaataagaagcagcatccgaattcgttgcgcg

SEQ ID NO: 19816 - DNA, 704 bp, Sorghum bicolor
  Clone ID: LIB5047-001-R1-XP1-E9
gccggcctggccgggctcctcgacttgcaggccgccgcagaccaggtcttcgacaccgtctccaagcgtgtatgtgccaccatgaccatgagattccttcacttgtcgctcgaaccctctacccaccttactcgctccgtgcgctgaggaaattctcgattctcctaacatttgaagactgtgcttgtgctcgtctcagaccgccgaggagcgcgagaagctttcggccatttcgatgcgaatcaaagcggccaaggctaagatcaaagcattatctcagtcagaggagccactcgctattgtttcaccagcccgccatccttcgagttctactaaacaagaggattacagaccactctttcacgacaaacatggttcgcctatagcaaccattgctgtcaatggaggattcaaccgtacatgattatccttccccttccaaagctacagataagtttcccaaaaccaaagatggcacatatttggagaatcttttacagacagcaaaccatccagctctgggaaaccatttggcatctgacaccaagagtgatgaattgccacctcccacaccgagtctactaccaaaacaccttgcaaggactcaatttgtcaacattgacagcttgccttcaccctgttctcaaatcctcatggcatgctcatgcatgaacgccaggaatctgaataccactgcttactgg

SEQ ID NO: 19817 - DNA, 609 bp, Sorghum bicolor
  unsure (1)..(609): unsure at all n locations
  Clone ID: LIB5047-001-R1-XP1-F12
gccggccgggtttgctttccggttcctgagtagacagaggcccgcatcatgaaggctaaggggctgttgaaggaatacgaagtcgtgggacgcaaaattcccactgacaatgaggagcagacacccctgtaccggatgcgtattttcgcacccgatgctattgtagccaaatctcgtttctggtacttcttgcgtcaactgaggaaattcaagaaaactactggtgaaattgtatctattaagttgatccccgagaagagtcccaccaagatcaagaactttggtgtctggcttaggtacaactccaggtctggaacccataacatgtacagggaatacagaagtctggctgtgtcggaggctatcactgcctgctaccgtgacatgggagcaaggcacagggctcgtgctcacgctattcaggttattaaggttgaggaagttaaagcagccaactgcagacgaccacttgtgaagcagttccacgattctaagatcaaattccctcttcccaagcgtatccaaggacgcagcttggctcccagattcgcctacagganaccaaacacctactttatgtaaatgttggagaaataaaatttttcttcg

SEQ ID NO: 19818 - DNA, 318 bp, Sorghum bicolor
  unsure (1)..(318): unsure at all n locations
  Clone ID: LIB5047-001-R1-XP1-F6
gccggccgggcctggatctccatccctgcaccccgcagtcgagttcgtcctccgtctccacaagttgagttcgtccatggcaaggtcagcaccggcggcggcagcagcggcctcttctccggcgccgaagccacagccacagccacagccgcatccacatccgcagctgcggggcagccagctgaagcagctgcgggagatcttccagcggttcgacatggacggcgacggcagcctgacgcagctagagctagcggcgctgctgcggtcgctggnnctgcgcccgacgggggaggaggngcgggcgccgccggccgc

SEQ ID NO: 19819 - DNA, 489 bp, Sorghum bicolor
  unsure (1)..(489): unsure at all n locations
  Clone ID: LIB5047-001-R1-XP1-G2
gccgggctgggacccgcgcatcccncttccctacaccataccaatctccttttcacctctgcaaaccccacatcctcctctcttggaatcacatcaactgcatacacgctcgttatatcaccgccaggctcatcccactcgcatccgcctcccttatatatcgatcagattctccctcttcgccactagacctggacctcgacatcacacgacttcgaaatcgaaaaaacgcatcctctaacgccgggtctcgaacgacaacgccgtcgacccagcgactcagcaatgacctcgatcgcgtcggtcctgcccctggcgatctccaagatgctcgactacccacaactcggggccaactccaccctcctcacacaaataacaccctcgcaaccgcacgcccccttctactactccgcctcgccccagctcgtctcatggacatctgacaagattatcggtgtcgccgtgccgacagtcgtgtactgggtc

SEQ ID NO: 19820 - DNA, 647 bp, Sorghum bicolor
  Clone ID: LIB5047-001-R1-XP1-H11
gccggccagtctgcctctcctcagatttaactgaacttgttaagactcctgtagctgttgtatcggcaggtgtgaagtctattttggacataccacgaacacttgaatacttggaaactcaaggggtaactgttgctgcttacagaaccaatgaatttcctgcgttcttcacagaaattagtggatgccaggtgccatgtcgtgttgactctccagaagagtgtgccaaaataatatatgcaaacaagaacctgcatcttggttctgggattcttattgcagtacctatccccaagcatcatgcagcttcagggaaaattatagagtctgcaatacagacagctctaaaggaggcagaggataaaaggataataggaaatgcgatcactcccttcatgcttgaaagagtaaaagaactaactggaggatcttccttggaagctaatattgcacttgttaagaacaatgctcttattggtgcgaacattgctgttgccctttctaatcttcagcagagaaaaataaatagaatgggaagatccgcgttgtagagccacgctcaaggatggaggtattacagccaaataagcaatggcaaagtgccaaacccatttccgaggatggaagctacctgcaggatggaaact

SEQ ID NO: 19821 - DNA, 519 bp, Sorghum bicolor
  Clone ID: LIB5047-002-R1-XP1-A8
gccggccgggccttgacaagaaaccctctcactcctgctcctcccgctcgacgccgtctctctctttctgagaacaccgatccgtcacgagagagaaaacctgtcgaacccgtggcctccgatgaactcgccggcgcatacgctgccctcgtcctcacagaagatgatatcgccattgccgacgaaaatatccacccaaatccaccacgaggtcaccatcaactgcaactcctactggctcctcctcttcccaaacctccttgacaaccactacgccaaggaccacatccactccgataaatttgcccacagatgactactcgagatgctcttcctgccccctgtgacagcactgcgagtgctgatgatgcgtttggcaatcctacaatgaaaaatgatcatgaggagtatcaagactacatgaacgtcattctgatatactgaatgcacacacactctcatagccagtcatacttactgtgcaacacgatcaatatgtacctctcgacgctgaagtta

SEQ ID NO: 19822 - DNA, 243 bp, Sorghum bicolor
  unsure (1)..(243): unsure at all n locations
  Clone ID: LIB5047-002-R1-XP1-B1
aggccggncggtttccggcaactaatacaaaaagcanagcgttcgccgaggcgccggaggcgaagaaggtccaagacagcttctgcgccacgctctgcccaagcaggaaggggatgggacctcatttgtctgcaaggcagtcctggtgagctctcccagcgctccaacctggtgctgtacgggcggatccagtgcagggcaagtgcaccgagcaaaaggcatcactgcgccggcgatgaaagt

SEQ ID NO: 19823 - DNA, 174 bp, Sorghum bicolor
  unsure (1)..(174): unsure at all n locations
  Clone ID: LIB5047-002-R1-XP1-B2
gncggccggtttcgggccaaaccacgcaaccgagatattccccagcatccccagtccagccggcccccgagacaccgcgtgggaaccaagcagacccccagtagaagaagcgaagtcgtcgccggagaaggagggggaagagcgcggagcaagatggcgtgggcagacgtacgt

SEQ ID NO: 19824 - DNA, 240 bp, Sorghum bicolor
  unsure (1)..(240): unsure at all n locations
  Clone ID: LIB5047-002-R1-XP1-C4
gccggccgggtccggaagctcaaccaaagcgactttgtacacgccctttgctcgcgtttggtcttgagcttcttcgtttttgcaccacaagacnagcaggatgtcttgcagctgcggatcagctgcaactgcggatcaagctgcaagtgcggcaagaagtacccgccactgtaggagaagaganccgcggggcaaggccccgtcgtcctgggtgtcgccccggagaaaacagctgctgcc

SEQ ID NO: 19825 - DNA, 577 bp, Sorghum bicolor
  Clone ID: LIB5047-002-R1-XP1-D3
gccggccgggtcgggcactatgatggtgttaggaggaagtcaagccaaagcctatccgtgctactatccctgaacatgctagagtgggactatcatgctagatcactaggtcggagcactgcgtccgaccatcgaccaagattcaccggagatatacgagcagatctcggaacgcaaacagccatggcgcagggaaaagctcgacattgcctaggacgtcactgatacgacatacatactgcacaccgtcgtagactgaggttctcaagctttgggtgccaccaccaacgtctggatctagcctctcgcccgtcagcttccatctactacctccccggcatcatctacggcgtctacgccatcaccaagcagaagaagacgtcgacttgtgtgtgtcgctgtgcgatccatgcatgactagcattgcctagatgcctaaattaagatatagagtgagaatgtgcattattctagccaaacttccatgtaattaacacagaatgtattgtgatgagacccatgcattaagcaagagtaagttattaatccgaaaaaaaaaaaaaaaaaaagaccctac

SEQ ID NO: 19826 - DNA, 436 bp, Sorghum bicolor
  Clone ID: LIB5047-002-R1-XP1-D4
gccggccgggctgcgacaggaggtcgctgcggtggttcagtacttcagttcgccatggaaggtgcagtcggccaaatggtcgtcccggtcctcggcatcgttgccgcggccgccgtgaccttctacaccgtcagcttcatggagatgcgagacaaatctttcgaggagctcgacgagaagtactcggagctcgacgagtcaggcggacggcagcgccggtctcgccggagggccgagcgcgacaggaagagagcgaaatgattgaccaccacacacaccgccgatcttatgaatttgttgatttggagatatgccggttaattcataggggtgagtgtgcatgtaccctctgctgttcttcggttctatcaggacttgtaaaacaaatttcccctaaattgcttcgatgcaaaaaaaaaaaaaaaaaaggccccta

SEQ ID NO: 19827 - DNA, 681 bp, Sorghum bicolor
  Clone ID: LIB5047-002-R1-XP1-E7
gccggccgggcctggaaccacaaccgctgctcccacctgttcttgacctcctgctcccggacttccgctactcccgctcgtgacgtccactgctcccgctcgccggcgccatccgcacaagccgccaagaagaagggcgtcgtggactcgggcacaggatgaccggcgccatccgctgctctccttcctcctcctcccaaggtaagaaggagagggagagggcaaaatggcgaagcacaagaagcactagcagaactatgtcaagacacagttcaaccagcccgcccgcaagcagaggcgccacataggatcgatatttagtactgtctggtccaacccgagctgttgtgtggtcagatcatgtctccattgaggttaagatgacagtgaagggaagaactgaatctgaggataaagatttgagctttttagttgtgccattacttatcggtgatacaggagcttagcacgttggaatttacacttggtcatatggttaggtctgtggcggccacaatatttgtgcgagtgattgatggttcatggctagacactttccatcaattgcttatgtctttatggcgagtcatttgttaatctgtacgtttctgagtatcaagtaattactgtaaattgtacgtttctgagctcctaactgagcatgctactactggtatcagg

SEQ ID NO: 19828 - DNA, 419 bp, Sorghum bicolor
  Clone ID: LIB5047-002-R1-XP1-G11
gccggccgggcctggacaacatccaatcatcatctcaaagtactccctctcaagatgggggccaataacacgccatctccgcgtgcggactctgctgctcgacgtcgatcacactggaaagggcaccctccgagggtcgcacatggactgcacgagtggcccgcagccgaggtgaacgacactcttcattgtaatgaccctggatctgattgagaaatgcatggggaacatgcacgactgcaatgaacaaaccaagaatacttacaacgacgacatgcttgacaacccacaaaaaatggctgtaactgaggatatctgcccatatatccatgcatgaactacagatcatgcatttatatatgaactatgtaaatatatatgcatgtccacgaaaaaaagaaataaaaatggccccatac

SEQ ID NO: 19829 - DNA, 528 bp, Sorghum bicolor
  unsure (1)..(528): unsure at all n locations
  Clone ID: LIB5047-003-R1-XP1-A6
gccgggcctgacccctatccccttctctctctcccgtgaccccgcacgcgccgccccaccggcgagcaggccggcctcgcgggctcgctcctccgagctcgcccggctgcctccaccgcaccagcaccagccgaatcgtgcagatcgggacgccggagattgggacaccgaatcaacaccagcagacagcgcatccgcagaaactgcacttaatctcaggtgttacttccatcaaagcctgggaacttcatcttgggaatggtgtgatgtggaagatttcagaatcatgtttgtgaaagcgcttcctggaaggctctggcttgggttctggtttcttttctgcaaagacattgtcaaagtgctgatcctctacagataagcttgatgatgtttcatacctatcaaactgagcctcagggtccatttgcctgattgtaagactggnaacagcttgcccatttgcttggcttgaacctgtttactgatcagcttctgatcctcgcgagtgatgatctcccttttttagtc

SEQ ID NO: 19830 - DNA, 177 bp, Sorghum bicolor
  unsure (1)..(177): unsure at all n locations
  Clone ID: LIB5047-003-R1-XP1-B2
gccggccggttcggngacctgccnctntgtgcacgaagtcgacgagcagacgccgcgctaaagttcgtccggggagcttcggagaagggccgggtaggtcaagatgcagatcttctggaagccctgacggggaagacctcaccctcgaggtcgagagcagcgacaccatcggacaat

SEQ ID NO: 19831 - DNA, 525 bp, Sorghum bicolor
  Clone ID: LIB5047-003-R1-XP1-B9
gccggccgggcctgggctctctccctcttacagcctccgccgtatatcccaggctccccgcgctcgcctccggagccgctgcctatgcacgattgcaagccatgaaaaacgcgctaccctcgcttcgcttccttgcttctctagctaccgtatatacccccgatatggcttgcgacttgaagaccacttgtaccagcgtccgcgccctacacaagatgcaagacgaccgtgggttcccgccgccgatcgcgtcttcggcaatgagcatgctgcccgctccgcggatgagcaagcgccgccttgcgacggcagtcgtctcagaccggttcctcatgttttccgctctcagctgcttatgctcttgctgtcaggacgttcgctgtgcatgtgcaagcagatccttttggaggttctaccttcgctggtcctgtgatgagatgggaactcaagactatatatgtccctcggtattaagaatttgagatatgatgatatgagcgaatcaagaaacagaaaaggacccta

SEQ ID NO: 19832 - DNA, 142 bp, Sorghum bicolor
  Clone ID: LIB5047-003-R1-XP1-C1
gccggttcgggccgtctacttatatgaccaattctcctgccggtttcggccgccccccttctcggactcacgtgcccggcgtcctcccggtcgatcggtgcgtaatgcgggcaaggctatactcccgctcagtgtcggccat

SEQ ID NO: 19833 - DNA, 585 bp, Sorghum bicolor
  Clone ID: LIB5047-003-R1-XP1-C11
gccggccgggctgggatccaattgttgactgctgcgttattgtaaccctaccctatctctccgccttcttctcttatcctaagtatgtggtcagatctctgaggatgaaggaaatagatgcctacctgcttgctgttctgcatgataaccacttctccgactgctgatgatgttaaaaacattctggaatcacgtgcagctgcacctcatgaacaaaaactgcatctcctgtgtcacaaaactcaaagactatgacataacagaagtgtacttgcagcactgcaaagggaaaagttatcctctgtgacttctggtggcggcgcaattgccatgactagatccggcatgctgctatgtgatcgccgcgtgacctcgctgaagatcccaagaaggatgagaaagtccacatacaaggaatagtctgaagaatacatgttatttcagcttgctcgattaaagcaccactgaccgattccagattctctcgagaatggacccataatattgaccgtagaccacgaaataacagtgtcaatagctactacatacttatgctatattgcgtgtgatatacgactgtgcatc

SEQ ID NO: 19834 - DNA, 189 bp, Sorghum bicolor
  unsure (1)..(189): unsure at all n locations
  Clone ID: LIB5047-003-R1-XP1-E2
gtgcggcgctcgaggcggccggtcgagtgggaactcccaaatagctagttccgctcttacctccccgcagcgcgaagtagctagtgttgttggaacaagcgtagatctcgcgaggtcgagaaatgaaagcacactctcttgacgatcnnctagtgggcctccccccccaggagggngggggcccccccc

SEQ ID NO: 19835 - DNA, 780 bp, Sorghum bicolor
  unsure (1)..(780): unsure at all n locations
  Clone ID: LIB5047-003-R1-XP1-G11
gccggccgggcctggactacccggcgacctcgctcgcccgtggccacccccaccgcggcgaaacgaaaccttatcccccagaaccacgcggataaaccctagctgcggtgcgcgcgctccccccggcgatgtcggcgacgatccgttccggggagctcctcgcgtgccccgtcgcgctgaggcgggcgccgcccgtggcggtgtcggtggtgtcggtgcggacgagggcgagggcggtggcggtggcggtgcgggcggaggcgacggccgagggggtagggaaaggggggaagaaggcggcggcggcggggaagaagaggccggcgagtgggatcaccaagccgaagcccatctctccggagctgcgggagttcgtcggcggcgcgccggagctgccccggaccgaggccatcaagctggtctgggcgcacatcaagggcaacaacctccaggatccaaatgacaagaagataataatctgtgacgacaaactgaagaagatatttggaggacgtgaccgtgttgngtttcttgaaatctctgggctgctcaacccccacttccagaaatgataggatttttttttgtagatcactcccttctgtactagctgtggctgatgtatgagcatatttagctaaacctggttaaagtggtttaatgaagggaaatgtgntccctgaagatgcatcttcttctaatgtttgccatcaatggggtactagctcttccttatcatcatggttatatcctatccaaaaaaaaaaaaaaaaagcccct

SEQ ID NO: 19836 - DNA, 748 bp, Sorghum bicolor
  Clone ID: LIB5047-003-R1-XP1-H11
gccggccgggtttcgccttctttcctccaccgtacgtgaattaggcctggccaggcctcgcggaggcagcgacgcaggtgcacatgccacatggccgatgtgcgaggaagacctggccggcggcatgggtgcatctggatgcgtgcttgtggggaggcgacggcacgggcaccctggccggccagcaccaagccggcgaaacaggcggtcttggctggcgatgtaggcgccctagaagcacgactctctttgatgctttgtctgattttctcatttcgattatatttctctgattttctcaattcgattatatttctctgattttctcatttcgattatatttctctgattttctcatttcgattatatttctctgattttctcctcgattgattcgtgtgtggagaagaaaaaaaacaaatttattaatttggttttatataagttgttgtctttggatttagatttgtatcgatatggtgttttttattcattctcagtggtgatggtctcgatttggtgtgcctctctatttgttcctttgtctggtccggcggcacatgtttcggaattgtattgaatttgagtctagacgaaatccatccactggcgagctcgatctatattttgtattgaatttgtttcaaatagttgatttgaagaggcatggccttatggagggagccatgaatttaataagtttgaattgagaaggaaatgtagcctggttttgaattcctaatttggc

SEQ ID NO: 19837 - DNA, 511 bp, Sorghum bicolor
  Clone ID: LIB5047-003-R1-XP1-H4
gccggccgggtcgggatcccatccagacaagggcttcctccgccgacgccgacggtgcttccgtcatctccgcccggcgaagccatgtcgcctcaccagacgtctccggatctacaataacctggtcaagaagatgcgccgagagaccgccccatcccctactggatccgcatgggcaccgaccacaccatcaggtacaacgcccagcgcaggcactggagccgcacctggctcggcttctgagcgtgcgaagagatgctatgccaacgatgcttgcagaggattaggggtctgtgagctacgaagctcttgcttaagatattgcttgtgtgatgaaacgaatcttatcagactgtgcttgcagtagcattctgagaatatcatgcttgtctgacggttaaagaaccgtctctatgctatgctgaatttatttaacctggaccgccttaattaattgatctcgatcctactacttgtcgcagatgaatgatatgacatgggtccctaatga

SEQ ID NO: 19838 - DNA, 150 bp, Sorghum bicolor
  unsure (1)..(150): unsure at all n locations
  Clone ID: LIB5047-004-R1-XP1-A5
gccggccggtttccggattctaaccaactccattagaatttcacgcctggcaaagactacgatccctctcctcctgcttagtagtatccttgttgttgcaaatcaagccgttgcagcnacaacgcaattgtccccctggccgctgaaagt

SEQ ID NO: 19839 - DNA, 604 bp, Sorghum bicolor
  unsure (1)..(604): unsure at all n locations
  Clone ID: LIB5047-004-R1-XP1-A6
gccggccgggctgcgtgttgagatcccgtccgcgcgccctgtttcgtatgcgttgtggtcgtgcgcgtgcctctgctagctaagctaagcttgtgtgacttgcaccgtaccctagctaggagcgacgtcgacgaagggcatggcggcggcgacggggatgcagctggcgctgctgctgtgcttggttgtgctggtggcgtccccgcgggtggcgctgggcaactgccgcgacgactgcatggccgcctgcaacggctggcacgtcatgtgccagctctcctgtggcagcgcatgctacggagaagtcgggatcacaaccttaagtacgccggatgaatcatcagccagagcagaagcgcctgcatctgctgcaccagcaccacaacaagcacaagaacaagaagagggaggcggcgtgtccgggctcaagccatcaccggcccgtggatgaacgccagccagccagccagccaggcacagcaactcacttanattaattacttgttccgtgcggtcggntggcccatactcatgnataatttaattatataatactctgagaaatgaaacaaaaattatatatncagaatacgtgatgatcgag

SEQ ID NO: 19840 - DNA, 191 bp, Sorghum bicolor
  Clone ID: LIB5047-004-R1-XP1-B1
gccggcccgtttcccggaggtgatcggagaacccgccttgagtgaggaggaggaagaccggccgggggcgacgcggggagaaaatggggaagatgccggtgggggatgaaggcggtggtgtatgcgctgtcgcctttccagcagaaagtggtggcggggctgtggaaggacatcacccaccacagatccca

SEQ ID NO: 19841 - DNA, 676 bp, Sorghum bicolor
  unsure (1)..(676): unsure at all n locations
  Clone ID: LIB5047-004-R1-XP1-B9
gccggccgggccgggctccctcacatttccaaaccctggcggctgcgggctgacggcggtgacctggggctgcgggtggccgcgccgggcgtgcagggtgggcattcgagcaccgagcgctcagcgtagggtgtccggcggcctgccactccgccgattggagcagagccagtgagccactgccgattggtgcctccgcggtcggctaggcgctgggccgcaccgagaggccaaggcgacgggcgattgccgattgcagcagagcgaatgagctacaactccacctgtcctgtccaccagcaccggtgaattggaatttggttttcggtgttaacgactcaggttgcttgttcactgggggtttgcgagcttaatcagccaccatggatgttgataagcaagaaacaatggaggagaccatccttgttggtgatgatctcatgcgcgggccgccatcccccgtcataccaaaagagatcgcatcacatgtccttgatggtgttgagctttgtgatggtatactcaggaaccttttcttatgcctanncaatcatgatattgagccattctgccaaagatgaattgtgctataccgacaatgtgctgagaaacggngacaggaaaatagagagncgatgcaaaatagtgaatataaattgggttttttcatgcccct

SEQ ID NO: 19842 - DNA, 215 bp, Sorghum bicolor
  unsure (1)..(215): unsure at all n locations
  Clone ID: LIB5047-004-R1-XP1-C4
gccggccgggtcgggcctctctgatctcccacatggacaaccctagcacaggacaccaggcgagcgaggcggcctgcccaggacgtcggccaccaccgtgtcggcacctcccacatcacgaacacgggtggtggatgaggattanggcatgtggcaggtgacgccccttaccctcttccttctccaacagacgcatcatgtccgacccttgctta

SEQ ID NO: 19843 - DNA, 428 bp, Sorghum bicolor
  Clone ID: LIB5047-004-R1-XP1-E4
gccggcccgggcctgtgaataatctgaggccgcagggagtggggatctatgtttttaataagcttttgctactcgctccagtatttaaggttagagactctccatatcaagctctctctcgctctgaggatctattgtctcctcttctccgacgactgtgagatgggacgccgcttaccctcttccttcgccgacagacgggatcatgtccgacctttgtttacctccctctctcgccgccgcctgatgagtggagcgactcctttgacaccctgacgtccgtacacttcgcgcggccgcatactgaatactgcccaccaccccatctatacgatagtggagctgcatgagatgctcccctttccatatgagagaggaattgacatcgccacggttctaggctagacctactgattttacacggagga

SEQ ID NO: 19844 - DNA, 429 bp, Sorghum bicolor
  Clone ID: LIB5047-004-R1-XP1-G3
gccggccgggctggaaagatgcatctccatcctgatcgatcgtttgattattggcgagcttcattccattccatcagttcctttggcggaggatgtcgtgctgcggaggcaactgcgggtgcggctccggctgcaagtgcggcagcggctgcggagggtgcaagatgtacccggacatggctgagcagcaggtgaccaccaccgccaagactctcgtcatgggtgtcgcaccatcgtccaaggggcacgccgagggcgggttcgaggcggcggccggcgccggagctgagaacgaagggtgcaagtgcggccacaactgcagatgcaacccctgcacctggaagtgagatgtataataagcacctgaactgaactggaagacggaggaaggaggaactaacatagatagaaaaaaaatagattaactgt

SEQ ID NO: 19845 - DNA, 196 bp, Sorghum bicolor
  Clone ID: LIB5047-004-R1-XP1-G4
gccggccgggctgggctaaatctagttttccctcccctgtctctcacacgcagcggccgcagcggcggtggccaagcactcgctcgcacgcatcgaccgagcgctcgcgcaactacccatcgtgtcgccgtggaaggccagtgcggcggcatcgacgacgactgggacgcgctcacgcgtccgcgtgtgcgcccgt

SEQ ID NO: 19846 - DNA, 167 bp, Sorghum bicolor
  Clone ID: LIB5047-004-R1-XP1-G7
gcggccgggctggcgcaagtcgcaggggactcgtgtgcttgcgattgcaccggcgtctactgcgaccttgcgaaaaagctttccgtgtgagcgtgtctgcctgtctgacatcgtcgatctccatgacgacgacgaccccgcgcgtgtggctgctcgccatggcgttg

SEQ ID NO: 19847 - DNA, 588 bp, Sorghum bicolor
  Clone ID: LIB5047-004-R1-XP1-H12
gccggccgggttgggacccctactccctcgccgccgctgcgacgcggcggactgcctcccgtcccatgggctgcgtaggatccaccccggccaacaaagatgccggaggaagtagcgatggcaatcatgggactaagaaagtgcggaagcccaaagcttggaagcatccccaaccgataaccatggcccagctcaggcagatgcgtgaggaattttgggacactgctcctcactatggtggtcagaaagtaatttgggatgcccttcgagttgcatcagaatccgaggtatcccatgcacaggttgttgtggaaagtgcaggcataattgtttctaatgctgatctaactctctgctatgatgaaaggggtgctaagtatgaactgcccaagtatgttttgagtgaaccaaccaaccttattcgagacagctgaatggcagccgtaggaagacctacagatgtaaaaactgtaaatgactgcagatgccaaattaatctcttgctttagtgtcctggtaactggagcgtgcttgattaactttcaacttgcttcagcaactttcggcaatagggttttctatttgtta

SEQ ID NO: 19848 - DNA, 578 bp, Sorghum bicolor
  Clone ID: LIB5047-005-R1-XP1-C3
gccgggtcgggattcattcatctcgttagcagccgccaacaaacgcaccgctagcctccgcagctctgcctctttcctcgcctctcccaatctccagttctccactccgctctagcttccactgttccacgcaaggcacatctccactggccctttactgcttggccgttgtgtgcaccggggcagggcaggagcatgggatctgatagccatagccgccgggcttgccactgagcaggagcctgctcttgctgtgctgcacgttccgagagaactatgacggttggcagctcaaatccggccaaaaactagcaagcaacagggacggtctccactcttccatatgttcttccgattctttactccatttatttaatcccttgcggtacttgctgctaacacatggtctgttgagtgtgctactagatccatctgtaataaatgcaatggtgtatgtataatgatgctcctgctgtctagatctatgtgctgctagatccatttgtgagttcgatgatggatgtaagatttggtgaactactgatggatggacctgcttgtgcaaagggttcattttt

SEQ ID NO: 19849 - DNA, 524 bp, Sorghum bicolor
  Clone ID: LIB5047-005-R1-XP1-C5
tgcggcgctcgagccggccgggctgggacgaactagggtttcattcgcccctcccctcccctcccctcccctatcagtctatccccagcctcgtcgtacggcactccggcggcggcgagtatggtgaagggacggcagggccagcgagtcaggacgtacgtgcggggcacgatcctgggctacaagccctccaagtcgaaccagtacgagcacacgtcgctgctgcagatcgagggcgtcagcaccaaggaggacgtggcgtggtacggcggcaagcggatcgcctacgtgtacaaggccaagaccaagagcgacggcaccgccgtccgatgcatctggggcaaggtcacgcgcccgcacggtaactccggagtcgttcgcgtcaagttccggtcccacctaccgcccagctccatgggtaagaaagtccgcgtgttcatgtaccccagcagtgtctgactctaaccgagcaaggttttaccctgaaggagattgatccggaaagtttctgacgacgattttga

SEQ ID NO: 19850 - DNA, 509 bp, Sorghum bicolor
  Clone ID: LIB5047-005-R1-XP1-D10
gccggccgggtcgggcttcctccgccacaccaaaggcacaagccttccccctccctccctacctttccgatccacagaacccagaaagccgtagacgagagcaacgaggaggaggaggaggaggcattcgagcttctctttgcttcacgtcttttaagcggtcgccccatttgttggcgtcggcgttctcggggtgggagactcagcaatggcgacgaggaaccaccgcgctgctgccgctgccgctgccgctccgcagccggcgaaccgaggtgccgcgaggatcgcggggaaacagaaagacgcggcggccgccggcagacctaacgccacacgcccagccctcggtgacattggcaacgtcgccctctccgatgtcctcgacggggggatcaagctgccggaggggatccatcgccccatcaccaggagcttcggcgcccagctcttaaaggccgctttggcgaacaagaacggcgtagctcctggtcagcctggaacggcgcgcg

SEQ ID NO: 19851 - DNA, 640 bp, Sorghum bicolor
  unsure (1)..(640): unsure at all n locations
  Clone ID: LIB5047-005-R1-XP1-D4
gccggccgggtcgggcagtgctgtgctcgggtacattccggtgccgctgatcctcaatttcaccgtgcagcagggcaacacaatggacaccaggctcggcgcagttcacatctcacccgcaacgctattcgtcatccctacggttttccagatggttatcctcgtcgtttacgaccggttcattgtcccgttcctaagacgaataaccggctatgtgggcggtgtcacgcacctccagcgcatcggcatcgggtttctttcgaccatagtggccactggcattgcagccctagtggaggccaagaggaagaaggtggcagaagacagtggccttgtggatgctacaactggaattccaatgtctgttttctggctgaccatacaatacttccttctaggtgttgtggatgtcacctcctttgtagggcttcttgagttcttctacagtgaggcgtccatgggggatgaagtccattgggagctccatcttctactgcatccttggggtgtctgcttggctgnggagcctgttgatccaattggcaaaccgcttttcaagacatagtgatggaacaggaggctggcttgatggcacaaacttgaacaagggcaaacttgatcgattctattggttgctagc

SEQ ID NO: 19852 - DNA, 631 bp, Sorghum bicolor
  Clone ID: LIB5047-005-R1-XP1-D5
gccggccgggtcggctcacttgtgcgccctactctgacacgaaagcactgaagatatagttcacgatgcccgctccagcaagtgcaacatctgttggtgcaggaagcaggtcgccttcaaaggccgtggcctccagaccctctggtggtggcaccgttaggcaaaggaaaaccacatctacaactgcccccagaagtcgtgctgctggtaccagcagtggaggaatgtggagattctacactgatgactcccctggcatcaaagtgggtcctgttcctgtccttgtgatgtcacttttgttcatcgcctcagtcttcatgctacacatctggggcaaatacacccgctcttaaaccaccttcattccaacttatgtctcctgattgaaattatctttaccttatcattccgtgaatgaagggaaggcatggacagaattttctatttggattctgaccattaatggtacttgaaagtgtacaggttggttggaggatctcatccaaaacccttatattggtttcagcaatatgaatttatttggactggatttcaatgtgtggtttttgtgatccatacttttatttattggagagatgtaaccagctacaataattgtgttttatatgag

SEQ ID NO: 19853 - DNA, 688 bp, Sorghum bicolor
  unsure (1)..(688): unsure at all n locations
  Clone ID: LIB5047-005-R1-XP1-E11
gccggccgggcctcgagaacatccaccaaaccagaccnttgggtcactcaccacaccactccaccttccaatcttccactttccaatccatcacaaacactcgaggcccagcatcaactctggcaaccgccagagctgtatgtcaatccactgtgctcactgccatggagtttcctgcgctgcctctcgcgacacccacatcgccaacagtcttcctccctccctgaagcaccacagcacaactcgcgcgctcttcacaaccgcctcgcatgccgacccaaacagcgctgtgaggctcctgaactccaacgtcgcacgcgaccgcaaatgtcactgcaaccacatcatatgccggtgccagacacttgttctgctccgcgctcgcgtggtccgcgcttctgcaaggcgacgaccggtatcttctacggaagtagtaccatacgtaccagcctcactgagccgctacactcgatgcgaggtagccagtctcgaggtctgcttacgagtcggtgcgcaagaaggcgggccaccagcgcaacatgcatcagggcagtggcactttcagctacgcagttgtttgatcatggcagcagtgcaaatttccaaaacatcactccatagcaattgccgtattcgaatgattcnaaccatngtgaattttcaaaaaaaaaaaaaaaaaagggcccta

SEQ ID NO: 19854 - DNA, 398 bp, Sorghum bicolor
  unsure (1)..(398): unsure at all n locations
  Clone ID: LIB5047-005-R1-XP1-E12
gccggccgggcctgaatatcnacttccatacccttcacttatctccttcatctcacgtgcccaacatcattcctgactcgccatgcgcaacagtagctccggaatctcgactgcagaatgaccctccggctcgcgccctggactgccctcctgagcgaggatgactatctcgtccactccaaataacccttcatcaccagcatattacatgacctacatgtccacgtatgacaccgatgcacaaccactggaacctcacagaaatcaccctcttggactcccagaaccttcgcttctaagtgaagacatctgcctatatatgccatgaatgaccctgagatacatgcctcgatatatagtactatggctatatatatgcctgaccacactgttggctt

SEQ ID NO: 19855 - DNA, 285 bp, Sorghum bicolor
  unsure (1)..(285): unsure at all n locations
  Clone ID: LIB5047-005-R1-XP1-F9
gccggccgggtcgcggactgtcattggttcaaggggagttgagggagcggcggcggaggaattgtttaatccccccgtcaccgtctcctcttcgccatcaccacaccaccctggttcaggcgcgagcgcgacgttgccggcccgtctccggcgttcggcggcggagtggaacgaccccattcccaccaggaattccatcgtnttcgtggcgtttggtggcgtcccggggcgggcaagcagcatcaggaaattttcacgaaggatacacggtgttcgggacgagag

SEQ ID NO: 19856 - DNA, 412 bp, Sorghum bicolor
  Clone ID: LIB5047-005-R1-XP1-H3
gccggcccgggttcgtatcccgtctggagttggccgtagttcccaggcatggagcggtcttttatctgcgtacttcctacacatcaatttatcattatggcccacaagaagcccaacaagaagatcggaaagaaggttctcgtcgctcctttggctgtgatcaaaccagactacatgaaagtgttaatcctctcttcgagaagaggtccaggaactttggcatcgccacatgtatccagactacccgcgatcttagacggttcgggcaatggaccaggtaccttcgtactcagcggcagaaggatgtgtcttcaaaagggtctgaagggtcctcccccaatcaagcagctttcccaaactctggagcagtatacagttgatcaactgttcaagctgttgggaaaatacagac

SEQ ID NO: 19857 - DNA, 613 bp, Sorghum bicolor
  Clone ID: LIB5047-005-R1-XP1-H4
gccggccgggtctcggtgtgtggcccggattagccacctccggctcccctccacagatcgccccatgcaccgccagccttccagagctgatctaagccaagcgcgattgtgaaacaatggcgacatccaagaaggatcccccaaatcctagcagaggcaggatgtcacccaacctcaggccatccagcagtgagtcctctgggtatggatacggtgctaggcgggcgcggtctgtcccaagctcccccgaccgcaaattcagctcatcatcgtcatctgtgactgcctctagctccaaggatgtgcagcgtccatcattgtccagcgctggtcggtccatctcatcgcggaccatgggctcatccatccatggcaccaaggcccaaccattcccaggtgcagcctcacctacactagcgagggcgaaatccgacaaggtcagcacacctcgcaacggcctccggtgcttgctgtgccaccgagcaactcttttaaggacatgaccaagacagcaactaaggcacctccaactccaaccacctcgctgaggagtaagccatctccaagggctactgctgatagttgcaaggcagcagcatcacctaaacctagc

SEQ ID NO: 19858 - DNA, 580 bp, Sorghum bicolor
  Clone ID: LIB5047-005-R1-XP1-H8
gccggccgggctgcgaaaattgcatctccatcctagatcgatcgtattgattatatggagagcttcattccattccatcagttcctttggcggaggatgtcgtgctgcggaggcaactgcggctgcgggtccggctgcaagtgcgtcagcgggtgcgcagggtgcaagatgcacccggacatggctgagcagcaggtgaccaccaccgccaagactctcgtcatgggtgtcgcaccatcgtccaaggggcacgccgagggcgggttcgaggcggcggccggcgccggagctgagaacgaagggtgcaagtgcggccccaactgcagctgcaacccctgcacctgcaagtgagctgtataataaccccctgcactgcactgcaggccggaggaaggacggactcccctagctagtatagcagtgtcgtcactgcagtgtgtgtatgactgagtcaggcagtcagtcgagtgccatggcaccatatgctactgcatctgcgactgatgggaaccaataataattgtactgggatgttgacgtcatgtcgtccttcccgaggtcctccggaggctcgtctact

SEQ ID NO: 19859 - DNA, 562 bp, Sorghum bicolor
  Clone ID: LIB5047-006-R1-XP1-A7
gccggccgggctgcggcttctacacttcccatctctctgctgttacttgcgcgccgccgccggctggaatgaacgaagaggacgagagaagagcactacgcgatggaccgctccgacgtctggaactcccacgccagagaactacggacccgtctcccgcgtgtgccgggactgagggaatcctcgtggtctgatgaggaagcacggcctcatgtgatgaaggcagagcttccgcagcaacgccaaggacattggcttcatccagtaccgttgaacaatctactctgtgcaatgtacaacttcctgaatcatagaaatgcatgcttcattagaaggcctaaactatgagcttaagcacttcgtccacaacgtgagactcatgtgctactaaactaggtataatctgtgatgagaaccatgagcgcgatgcaccatctgcaatcagaagagttgaatattctgttagcgtcgatatctcgcgatgctatcttgactgcatagatgcatacatgtgttattggaggcaaagatgaatgatgcctattacactcaaggatattga

SEQ ID NO: 19860 - DNA, 490 bp, Sorghum bicolor
  Clone ID: LIB5047-006-R1-XP1-D1
gccggccgggtcggggaataccgcagcacagcacaccacagccatgatcgccgccctgttcgtcgtcgccctcgtggcctccgcccaggcgtaccccggccaggaccccattgcagaggcactgtccagcaaccagctccgtgccaaccccaccttctgcctcatgtccaaagtcactgagatcgcgaaagctgtcaacgaagccaggaaggacattcccctcatcgaagagatcatcccactgctgaagtcgaacctcgccaagtgcagccagcccaacgactccgaagagtccgtctactccgacaagttcgagtgctacttgcaggcgatccgtgacacctgggagggcagcgcagtaacgcgcgaggctctggaggcgggagctcagaagacctcgccgccgtgcaggacgtgataacgtgcttccaggacgacaagggccactccaactagaccctcacccgccgcatcgagcagcaggagcagc

SEQ ID NO: 19861 - DNA, 417 bp, Sorghum bicolor
  Clone ID: LIB5047-006-R1-XP1-D5
gccggccgggtcgggcctgcatcgacagtggctgcggggccactcgtcctgcccttcctgccgccggatcctgtccctccatcagctgccgcccggcgagcggtgccgccgctgcggcgcgcggccccaggacggggacgctgctgggtggaagcccacctactacggcgccatgccgccgttcctggcataggctgggcggcagaggaattgctccaatccgaaagcgaagcaaacctttcggttaaattccatcctcgcctcttctggtttcgttttactgatcgcagtggtagatttcagtaatggctgctggctggttgggggtggtacttggtaatgagttgcgtaagcggaagcgtaacaatctgggaatggagaaggtgggggggatccattcctggcctccccaatggg

SEQ ID NO: 19862 - DNA, 643 bp, Sorghum bicolor
  unsure (1)..(643): unsure at all n locations
  Clone ID: LIB5047-006-R1-XP1-D7
gccggccgggccggggatcatcaggttcctatcaaggtgagacctgtatagagagagcgttaacaatgaaaggatccagcgagcatggcgagacctcgaaggcggcgcccctgggcaggggtggtgtcagtaaaggagtgtccgtgcttgatcttatacttcgcttcattgccatcatcggcacccttgctagtgccattgcaatgggcaccaccaacgagacgctgcctttcttcacacagttcatccgcttcaaggcgcagtacagtgatctccctactctcacgttctttgtcgtggcaaattctattgtctgcgcctacctcatcctttcgctcccactatctatagtgcacatcatcaggagcagggctaaatacagcaggctgctcttgatctttcttgacgcggcaatgctagcattggtgactgcgggagcatctgcagcagcggctattgtgtacttagcacacaaaggcaatgtcagggcaaactggcttgccatctgccagcagttcgactcattctgcgagcgtatctctggatccctcattggttcgttcggagccatggttatgctgatactgctgatattactctccgccattgccctagccaggcgctaggncaaatagtgggatca

SEQ ID NO: 19863 - DNA, 413 bp, Sorghum bicolor
  unsure (1)..(413): unsure at all n locations
  Clone ID: LIB5047-006-R1-XP1-E5
gccgggtcgcgagctcgtcacctccctgtccccggcaggcagccatggcgtcgcgcctccgctccttcacccgcccagccgccgcggccttcctccgctccgctgccgcccggagccccgccgcttccctccccggcaccctcgctcctgtccccagggcttcggcaatagggcggcggatggctctggcgcggtcgctgcaaccgctgcacagcgcggtctcggcggcccggctgacgtcgcggctggggccggaggtggcccgggccgtgtcgcaggagacaggnctcagtgtccctcgataatgaaagaaactgctccaaatggcagcgacatcagcagcaaaaaagtggagggcttggttgtcataataataatcatacttggtaaacgggtaacctatttatttaagg

SEQ ID NO: 19864 - DNA, 627 bp, Sorghum bicolor
  Clone ID: LIB5047-006-R1-XP1-F1
gccgggtcgggagttcttcttcttcttctccatcatggcgctgcttgttaataagaagggcaccgccggtgctgtgttgctagcggcggctgtcatggccatcctcctcctcctctatgctgcatcctacatggtgagcacgccaccacgtgcagcaagccgacggcaatactacggccatgctgaatactaccgaacctacctcgtcatcctccggaagccaccaaacgccgacgccatggacgaagatgcgcaccgccgttggcacgagtctttcctgccgaccaccgtgattggctactccggcgagccacgcctcctggactcctactacaggtacgtcaggtacgggatctacgccttctccgcgaggctgaccttcgccgagatcgaggatgtggccaagaagccaggcgtcctgggctcgcggcattgccctccaaaaggggttactacgcagtgcacaatgtgccaggctgacgactgggattgtggtgcccttgttgtttccaagccagctgctactgctagtcagaaatagaaatcgctagctaagaaatgatttgattgcgcaacgatttccttaaattttctcctgcataaattgatctggtttcggatcctacc

SEQ ID NO: 19865 - DNA, 437 bp, Sorghum bicolor
  Clone ID: LIB5047-006-R1-XP1-G9
gccggcccgggcctgggaaaaaaaaaaaaaaaaaaaaaaaaaaaaaaaaaaaaaaaaaaaagaaaccctaaactctcctcacgccaaacgctgaccataacccaaaaacgggaaaccctaattctcctcacgccgccgttgacctgccccgacgccggagaatagggggcggagcaagagggattcggggagggccaagggaaaaaaccacccggggcataaccggccgaacaaggcgaaggagaagggacttaagaatcccaagggcccccgccaaccctcccccaggggaatggaccctaagtttctggggaacttggggtactcagggaggggcaccaaaaaaaggggggaggttgatccctagaatcaaaaggagtgggggttgaatttggggcgacaattgcttctcttgtatcgctaggcttttagttggg

SEQ ID NO: 19866 - DNA, 623 bp, Sorghum bicolor
  unsure (1)..(623): unsure at all n locations
  Clone ID: LIB5047-006-R1-XP1-H5
gccggccgggtcgggagatccaaaaccagtgagcgacagagatcaaggatggagctggaggtgggggcgccttcgccggcgaggtacctggtgggggcagcgatcatgatggccggcgtggtgctcccgctggcgtacatgatcttccgcagcaagcgctcgccgtcctccgcctccgccgcggggccctcctccttctccaagcagacgaacaaggggctcatctgagcgagtgggtgggtgggtggatcgatcgcctcccctgatgcttgtcattctgtctgttttggcgtggcgagatcatgcaactgctcctcgagactgggcaccatcacatcaagttactagctgattagtagttagttcctcttgtaccttgtgtagatcagatcgattgcttgtttgactgaattgatacagttataaatgatggttttacttttgagtgcactacttacaaggagcattcaaacaaactccagtttagctaaacaagccacctgccctcttctgctggtttagctggcttattacgacaattgtgtataattcttctctatgctagtactccctcaattccaaaanaaaaaaaaaggaaaaaaaaaaaaaaaaaaggccccctg

SEQ ID NO: 19867 - DNA, 792 bp, Sorghum bicolor
  unsure (1)..(792): unsure at all n locations
  Clone ID: LIB5047-006-R1-XP1-H9
gccggccgggctgcgttagaggtctaagtaaccccagagaggaaaaaaaaaactgctagctgtctgccgcggcgagctgacatcgtgcgggctcgatctgcgcacgcgtcaacatgagccgcctccgcttcgccatcctcctcgcagtcgcagccggcgtcctcctcctccccgcctccgcgtcgtcgtcgtcgtcgtcgtcacggccaccggaggtgtacagcgtcggcgacgagacggggctggcggcgccgccgggcaacgacgacgacggcacccagcagacgctcagcaagtgggccatgacgcagagcttctacgtcggcgacgtcctggatttcaagcgctggagcgattcggtcctcctggtgcggcagggcgactacgaccggtgcagcgcggcgagcccggtgcgccggttcttcgcggacggcggcgacacccagttcacgctcgcccgccccggnctcttctacttcatcagcggcgcgccggcgcgctgcgaggcgggccagcggatggtcgtgctcgtgcgcgtcgcagatcccctcaacaaaatcatcagcgccgctccgacgccggngccggngccggngcccgccgccaccctgtgcaagcgcagccgccgtccgctgactattgcgcagatgcagatggtggcgggggcactaaggttcgcgacgggatttatgccatggtcttgatcgttgggctctttatatgctacggggccttagttactacaactgtgaaaactagaataacgtgctagcatgatgattatttggactt

SEQ ID NO: 19868 - DNA, 595 bp, Sorghum bicolor
  Clone ID: LIB5047-007-R1-XP1-A7
gccgggctgcgctgactagcgccgtctccttcgtctgtccggaaccatctctgtcccgactatggggatccgcctgcggccacctccttccctgtccacgacgctcatcacgctcgtggttggctccctattcgtgatctcgtcaaccatgcgcgaagacctccacccccgcagctcctccctagtccgcaacggcgcttcagatctatggcctcgatccggatctcctccctttgctcgacggcagcactgtagctgcggctctgaaggtggagcttcatctccttggttcatcccaacggggctgcttccatagaggcgaggcggtggcggtgaatcatggctgtcgcctcggcggcctcctccgtgccgtccagcgatctggtgtggtcccagcatggcccctgatggtgcaggtggtggctggcttgtccacacagaacaagatctggagggcatcatccatcaccatgtcgtgcccactcagaaacaattaacatttcgtgaagctgttgcttttgtggtctttgatcgacaagcatctacaagttggtgagggacctaccacctgggagcaattggcctaccctgagct

SEQ ID NO: 19869 - DNA, 722 bp, Sorghum bicolor
  Clone ID: LIB5047-007-R1-XP1-B12
gtgcggcgctcaggcggcgggctggacaagcaagtctcaagggcaaacatctagctaccatcctctaatctctctctagcatccagccgaaagcaagctgataatgtttcgacgcaccaagaccaccatggctcctcctactgatggtgaggtgaggattcagaaagttgacaagattgatctcgtctacaacatcctctccaagccaaaactgtataacccaactgcggcaaccgggaagtatcctactactggtcatcatgaagtcacaggctggaagaagattgagaaccccagcaggcctaggaatgtagtttctgtagaagacatcaacaagaggtctgaaaggtacattacagagatgaagaaacgatttcttggctaggtagcacctgagcctgtgatgacaaggtgaagatctgatagtattggtgtcgtccatatggaattggtttggttatatgtatatttgatattaccctgtgggatggaatatatatgtgagagatgctttagatataaatgcttttatgcatgatgtatgcatgccatgtatatgatatagagagcataatgttgagtaataagcttagtatcaatatgcatgatgcctaccgatggtcgtcagttttcacaaagctgtacagtttcatatatactgttcctttttatgacaatctgaataggaaacaacccgaaaaaaaaaaaaaaaaaggccccta

SEQ ID NO: 19870 - DNA, 582 bp, Sorghum bicolor
  unsure (1)..(582): unsure at all n locations
  Clone ID: LIB5047-007-R1-XP1-B3
gccggccgggtcgggggcggcgcgtcctgcaccggctaaccccagcccccagcaatctgctgctccagcgccggtagcgacgactgatgtcgagctgagcgaggtatcgtccgccgtcgccgccggcaagctggtggtgacgaaggtcgtttccccttcccaatcgccaggcttcaccaagataagcagcgtcgtcgtcgtctccccgccgttgccggcaacggcacgttcggtggaccgccggtggcacatctcgccggcggcgaatgtcatcctagtacccatccctccctctgggccaagcgacggtcacaacaatgagccgccgcgcgcctcgccaggcgtgatgtaatgtgatgttctcgagatcggagtacctgctgcgcttcgatcctgctgcatgtttgcatgangtgtgcttctcatgtcatgttccatggcgaaagaggcctcagcatcatcaatggtaatttgttagggctcattagtgatgatgagcttgtaagactctttacaaatgggccatggcaatagcaatttacgtggccattcttggtcatggcaactataaatttggtgaat

SEQ ID NO: 19871 - DNA, 408 bp, Sorghum bicolor
  Clone ID: LIB5047-007-R1-XP1-B6
gccggccgggtcgggacaccctagtctctagctcgcgcggctcgccggacggatggaccctcagcagccggaacccgtcagctacctgtgcggagattgtggagctgagaacacgctgaagccgggagatgttatccagtgccgggagtgcggctaccgcatcctctacaagaagcggacccgccgaattgttcagtatgaggcacgctgaagacaagggagcaacatgctatatgctgtgtaaggtgttggttgtgcctctagcagtgtaacaagtgtcttgggagaatgactcctgggaaatagaattacaattactatgtgtgtaaccaaccgtgcattgaacttggtctgaaagtgctgaaacgttcgagatttttgaaaaaaaaaaaaaaaaaaggcccctaa

SEQ ID NO: 19872 - DNA, 498 bp, Sorghum bicolor
  Clone ID: LIB5047-007-R1-XP1-C10
gccggccgggtctgcgaatcgacgctgatcccacctcgacgaagaccaccgaatccgcctcgaaccctacccgagcgcttcaagcaaggaaccggcgatgggacggcccgcttccagaagcgccgccacaagacgcacacgctgagcatccgctgagttcggcgtagctaccacctccagaagagcacctggtcctcctgcgtataccccgccgcccgcatgcgcaagcataactggagagtgaagggcatgcatgcgcaagacaactggtaccggaaggatgacgtacatgcgtcacgtgcctcgacgcttcaagagcaacttcagagaatggactgaggctgcccccaataagagtgcccttgctgacaactacacctggatgctgccatcaagaacctcagaagatatgaagccgtcactatttgatcgatgaaatgtacttctgaactatgtagccgtgaatcactatgaaaataccgcaatatcgtgattgga

SEQ ID NO: 19873 - DNA, 215 bp, Sorghum bicolor
  Clone ID: LIB5047-007-R1-XP1-D11
gccggccgggctggaatatcccaacgactctccttcttctccatcacaatccagcacatccaacagaccccctcctctcacacctgcggctgaatgtacccaaacctcgacctgttctcgatccgatgcgcgtccaccgccgctacaatgatggatgaccaacaaaaccttcataataatacagaccgacgcggcgcagggttcgctgatctcct

SEQ ID NO: 19874 - DNA, 714 bp, Sorghum bicolor
  unsure (1)..(714): unsure at all n locations
  Clone ID: LIB5047-007-R1-XP1-D4
gccggccgggccgggttttcttcgttccggcaccccaccgggagagtgagctgctgcctgcgcagctcgagcgccgcttgccgcgcggaccacggcctcgatccggcaagctaatagcatgtctggacagcaggaccgcgctagtaaaagctctagctcaagcatcagcagcagtactcaagagagcgaggaggaagcgcctgtccgaagcgtcaccattggtagccttcttgcccaagcaaatagcagcagtggacatagtcttgggaagcgcctgtcccatttagggtcaatcccgtatactccccgagttaatggaaaaatacccaatgttgataatgcaacactggaccacgagcgattgctggaaaggttgggcacttacggtttggctgaatttcatatagagggggatgggaattgtcagttccgagctttggctgaccaaatatttcgcaatcctgattatcataagcatgtgagaaaagctgtcatgaaacagctgaaggaattcagaaaacaatatgagagttacgtaccaatggaatataaggtgtacttgaagaaaatgaaaagatctgggaaatggnngagatcatctgaccttacaagcggctgcagatcggtttggtgccaaaaattgtttgctgacatcatttaaagacacctgcttaaatgagatagtcccctgggnatctaactccccacaaagag

SEQ ID NO: 19875 - DNA, 351 bp, Sorghum bicolor
  Clone ID: LIB5047-007-R1-XP1-E10
gccggccgggcttgcatcatctgggaccgccccaacacagagagatacccccgacgacggaagaaatgacctaccgagatcgggcgctggtctcctccacccccgccgtctgaatgagggtcaacagcgacaagacatagactgaatgattgcttcttaggaagcgacgaaagatgcaggtaacatatctgagccgccgcatcttgaggctgagggaggaggacttaccctgcaccatgcgtgcttagatggagatgatgaagtatatcaaccgtccttgattcttgtctctctactagcatacgatgcccttatctaagacgcatgtccttgcatactgggtttcatctg

SEQ ID NO: 19876 - DNA, 418 bp, Sorghum bicolor
  Clone ID: LIB5047-007-R1-XP1-G2
gccggccgggttgagatcaaaaccaatcctcacaactacattgcactcttcttgcgaactcacatcctccactactaccacaacaacaacacctacatccacactacccctccaacacacatcaacatgcgcggaaacgctacccagatcaaagtccacttcaagggcgacagtgacgacttcattgtcttcgctgagagcgctcaggctgttcaggactggaagaaggacaagagcgtcccccttgctcaggtcgccgacagcttcaaggtcttcgtcacccacaaccacggcaaccagggcaccctcgacgctgccgccaagggcactctcgaggccgagtttggcagctccaaggaggaggacgtcattggtcagatcctcgagaagggcaacatcatcgagagcgagaactctg

SEQ ID NO: 19877 - DNA, 430 bp, Sorghum bicolor
  Clone ID: LIB5047-007-R1-XP1-H3
ctgtgcggcgctcaggcggcggttttcaaatctggatcaccttaaaactgttgcaacaaggaggtggaggaagcgcggaaaaattagataagtgggacgatacaaggcagcctcttctcgcaagcaaggagtgatccatggtcaggtatcaggtgtggatgaagagtcaataagcttctgctagctcatccagtatgaaattatctttcagtggccatcgcttttgtcaccgctaactgcaaagatagaccacgcaattcagaaatgtaccaattcatagcttctcttgtctccagaacatagcgcagtcagttaacccttagttcgggattgttttgcagggttaataacaaaacaaggctaactttattttgcaggggtaatgacaaaagaattatgcaaaaaaaaaaaaaaaaaaggcccctaaggg

SEQ ID NO: 19878 - DNA, 709 bp, Sorghum bicolor
  unsure (1)..(709): unsure at all n locations
  Clone ID: LIB5047-007-R1-XP1-H8
gccggccgggctgggccttttcttcctgtattaaggttatggcgatttgtgctcgtggcgctgcggcataataataaattgaaatgaagttgaacgtagccttccccgcaaccggggcccagaagctcttcgaagtcgtggacgagcacaaacttcgtatcttctatgaaaagcgcatgggagctgaagttgaagctgaccttcttggagatgagtggaagggttatgttctccgcattactggaggaaacgacaagcaaggtttccccatgaagcagggtatcctctcaaatgttcgtgtaagacttctgctatccaagggccactcatgctaccgtcctcgccgtgatggtgagaggaaaaggaagtctgtccgtggatgcattgcagactccaaccttagtgtttcgtcccttgttgttgtgcgcaaaggagaacaggagattcctggcctgacagacaagtccatccctcgccgtcttggacccaagagggcaagcaaaatccgcaagctgttcaacttgaccaagcttgatgatgtccgccagtatgttatcaagaggccccttccccagaaagaaggcaaganacagcgtttcaagcccctaagatccagcgtctcattactcctcttgctcttcagcgcaagagacatatgctggcactcaagaaaagcgntgcctgaagcgcaggaacaggctgctgatta

SEQ ID NO: 19879 - DNA, 656 bp, Sorghum bicolor
  Clone ID: LIB5049-001-R1-XP1-A8
gccggccgggctgggggcttctattctagcgaggctccagaaacaccgtaagccacaagcacacggcagtagaattcccctcgcgtatctccagctttcagacgtcaaagacgatgctgccgctgaggtccgccgcggccgcgccgtgcttggttgcaggattgctgctccaccgattctcatcctgctcgtcctcttctgtctattcggtccgccaccacgccacgtatgctgtctcctcccagccctccacctgccccaccactacctggttccctttcccccattccagcagccctaggatccggggatttgccgcctgggcatcggcgccggggcaggcggggtctgcggattcccccgctacaaaggcgctagaggctaagatcaaggagcagctgcaggcggacacagtcacggttgtggatacctctggggatggccgccatgtctgcatagatgtggtttccaaggtatttgagggaaaatcagctgtaaataggcagagaatggtttacaaggctatatgggaggagcttcagagcactgtgcatgctgtggaccaaatgactacaaaaacgcctgatgaagctggtgccaagtaatcgatagctgcataataccggggagacagattatctgtgcttttaagatca

SEQ ID NO: 19880 - DNA, 606 bp, Sorghum bicolor
  Clone ID: LIB5049-001-R1-XP1-A9
gccggccgggctgcggaccttctcctgctgctgacggacgccgcacgcgaggagcgttgcagcctgcaggcgccaccccgccggccgctgctacgccgcacgctaccgccgctgaccagccgctagctgagcagcctcccaacccgccgcagcgccggccaccggcctccgtggatcccttcgcgagtccgtgtccgtggctcccgcaggcaccgcgccggccgacctccgcggcttcgtgcaggcgcgttcaagtcgcaggccgccggtcaccgtcccccgctctcggactcccaggctccggcctccaagcctctggcccccggccgtgacccatccgcccccttgctgaagcatcggactcgctactcacgaggatgaacggtgtcaagaggtttggcggtggccgggtgcccacggggactccatcccttgcatggtcttctgtcgtcatggtcgcctccctcctcactggtgcctccatcgtccacaatatctacaagcctgacatgaccattccacctgtggagattgccagcggaggcaaggaccaggagagctgagttgcgaatggctggacactacatgcaagagaggctgggcatg

SEQ ID NO: 19881 - DNA, 544 bp, Sorghum bicolor
  Clone ID: LIB5049-001-R1-XP1-D2
gccggcctggtcggaaaggacgaagcagaatataacactcctccataaccatgtcattctacaagaaactagcaattgttggcttgatcttgaccttgctccttgtgtcacaccgcatggaggcggcagcaaaaatgtgcagttcggtagtgcagagactcatgtgcggtggatcaaacccaaaaaccacagacaaggcatgcagtgactcgtgcaaggacattggctacacgggtggcggctcttgcgacatgcatcagaagcagcataatacatatagatgtatatgtcgcaagccgtgtgcagcggagcaaacacagacgcacgccggcaacttagcccgcgccagagacgcaaagcagcggacgcaggagatatgatgagccggacgatggcagagagtgttcaagtgatcgagtgatgtgtgatatttagaagaataaacatattttggatcgttgttatgcacattttgtaatccaaattaatcaatgaagctagaaacagttagttgcagttacaaaaaaaaaaaaaaaaagcccct

SEQ ID NO: 19882 - DNA, 262 bp, Sorghum bicolor
  Clone ID: LIB5049-001-R1-XP1-D6
tgcggcgctcgagccggccgggtcgggcctcctcctcggattctttccccttctccagctcccccatcctcccgtccagcactccagcagcgccgcctgcactgtgctgccgcgccttcggcagcagcgcaccgctcgcctccggcctccagcctcctcggttcccgtgggaggctatgaagttaaggacaaaacggcccgaatggaagtcccttatgcctctacaactgagcagattgagcaggaaatctgccatgcgttt

SEQ ID NO: 19883 - DNA, 633 bp, Sorghum bicolor
  unsure (1)..(633): unsure at all n locations
  Clone ID: LIB5049-001-R1-XP1-G3
ggccgctcgaggggccggccgggtccgggattaaanttgaaagaaaacgctgccagatggttacgaccatcgctgcagcctgagagatgcacggccatcctcgctactacggccgtcgacgctgcagcctcgctactacggtcgtcgcagcagcctcgccctcatatgcgcgcctcatccttgctgcggagacgcacggccatccttgctgctcacgctgccctcatccttgccctcgtacgcgcgcctctgctcgtgacagccacgccgcccgcggactgcacctcgccgacggccttcttcgacttcgtcaatgcttttccctctgattccgtccgcggcgtcctcgttccttgtttctctgtgttgagctcgccgctaggcgtcatcttggccaggggaagtttcatccttgaaagttactgccattttccccgacgctggagcagctgcccttctcaagtatcaatggaaagatgcgcaattcaagtgtgccagattgcaaatttcaagtgaccatggcaacatgctgttcctgttgctcaagggttccagcaagcttgtggngaactgaagatggagattggcaacttgaagaccgaagtgaaagaactgagagagatgaaggggaag

SEQ ID NO: 19884 - DNA, 279 bp, Sorghum bicolor
  unsure (1)..(279): unsure at all n locations
  Clone ID: LIB5049-001-R1-XP1-G6
actgtgcgacgctcgagncggccgggtcgggatttgcgatcaagttatataccatcccacaattttttttgtcctgcgagtactctgaatggctaccaaggtgatcgttgagcttctgatgcttgtttcaattggcgccatctttttagcgcatcaagcgtgcggtgagcctgattgtcacaccgagaaactgttggtcatgattcactgtagacgaaccataaaacataacggagcgtaccacttcccgaccgtcgactgcatcgaggnnctatncnc

SEQ ID NO: 19885 - DNA, 345 bp, Sorghum bicolor
  unsure (1)..(345): unsure at all n locations
  Clone ID: LIB5049-001-R1-XP1-G9
gccgggtctggacgggtcaccccgggctcaggcactcaccactgcagcactacccttgatcccccagatttctcggaggcgcatccgtccatgggggccaaggcagcgcaccggcgtggggtgctggacctggaggcgcagttcgccttcttccggtcgcagcaccggcaccccgtgaacgcggcggcgcacgcgctgctcacctggcccatcctcttcaccaacctccttatcctccacttcctgccgctgcccgtgccccccgcgctggncctcacgctcgcctacgccgccgcctacctcgccgtcgaccgccgagccggcgcgctcgcgggggtgctcttc

SEQ ID NO: 19886 - DNA, 279 bp, Sorghum bicolor
  unsure (1)..(279): unsure at all n locations
  Clone ID: LIB5049-001-R1-XP1-H3
aacaagactacccagncgnccatcgagcccgcttatgtttccacccagcccgccgcgaggnccacgaggagnnagnatcacactatcacaccaagcgatcagctcatcccgcagtgcctgggatgaccatcgacgagccgtccaagcagcaagaggagaccctacgactccgaggaggatgccctggtgggtgcgactctgagcgcgtcagcgaggactcgccgggatgctggtgtggatgcggctggggcatgggctgattgcagggaaattctgggg

SEQ ID NO: 19887 - DNA, 818 bp, Sorghum bicolor
  unsure (1)..(818): unsure at all n locations
  Clone ID: LIB5049-010-R1-XP1-B6
gccggccgggccgggaaaaaacacaaactatccttaccaaagtaattctcccttgttgtgcaaacaccccaaaactacgccgatctgaagttccttacagtcttcctcttcatcttcctctcctacctttccatgtcctttctgactaaattcttccgccccttcagcagtatgtcgaatgcgcccgcacagcccatgaacgtaccctcgggtgcgcaaaccgcgaccgttgccgcaggatgtttctggggcgtcgagcacatgtaccggagggagtataagggcaagggcctgtacgacgcgcgcgttggatacattggcggtgatagcgataaccctgggtacagggccgtgtgcagtggacgcactggtcacgccgaagccctgcaagtagtctacgaccccgaaaaagtcacctatcgctccctcctcgagttcttctacaagatgcacgatcccaccaccgagaaccgccagggacccgatgttggtacccagtatcgctctgccatcttctaccacgacgccgagcaggagaagattgcgcgcgatgttaccgacaaggtgaacaagcaatggtggaagggtggtgttgcgacggagatcctgccagcggggaaatggtgggatgcggaacaataccatcaactgtatctggacaacaacccgggaggttacgagtgccccagtcacttcttgaggagtttcccaccgctgcaggactagcgtgttggaataggatatatgatcgctatgtgtgcaatgtagaatgacatgtctcacgncataccaaaaaaaaaaaaaaaaaagcccctagg

SEQ ID NO: 19888 - DNA, 626 bp, Sorghum bicolor
  Clone ID: LIB5049-010-R1-XP1-B9
gccggccgggccggggggatgttggcgtcgtgtcgtccttcccgtgctcctccgggggctcatctactagcagtcggtgttgtgttgtgtgtttgtgggtgcagtgctgcacagcagcaggccatgccccctgctctgtgggcacgtcgatcgtgtgcgactttgtttgtgctctgtcaccatccatctattacctataatatcccccgtctttgtgtaaaaaaaaaaaaaaaaaaaaaaaaaaaaaaaaaaaaaaaaaaaaaaaaaaaaaaaaaaaaagattgcatctccatcctgatcgatcgtttgattattggccagcttcattccattccatcagttcctttggcgtaggatgccttgctgcggaggcaactgcgggggaggctccggttgcaagtgcactagcggttgcgtagggtgtaaaatgtacccggacatggctgagcagcaagtgaccaccaccgccaagactctcgtcatgggtgtcccaccatccaccaaggggcacgcgcgagggcgacttccaggcgagggccgcccccggagctgaaaacaaagggtgcaagtgcgcccccaactgcaactgcaacccctgcacctgcacaagagctgtataataaccc

SEQ ID NO: 19889 - DNA, 481 bp, Sorghum bicolor
  Clone ID: LIB5049-010-R1-XP1-C4
gccggccgggcccgggaccgataccattgtccaagcagcagcactgcacctttgccaccttctgatcctgtccatctcctccagcctttcctttcggggaaccagagcagggcaagaacagcagagtcctcacggggtacggttgggccggagccggaccatggccgcggagtggtggtggccgtcgctggcggcggcgtggctgggctccgaggccgcgtggttccttgtcctgaacgtggtcatcgccgcgatcgccgtgctgtcctcgcgggcgcgtccatctccgtcgccacgcagcggcggcgtcacgcgcagggcctcgtcggcgctgctgcagcgcctccgctccttctccatcttctcctacccttccgcatgcttcgacaccccgacctcgctgcagcccgccgccgcccacgccgccgcccaagaaacagaggagccggcgaccatgccggtgccgtcgccgcactccctt

SEQ ID NO: 19890 - DNA, 763 bp, Sorghum bicolor
  Clone ID: LIB5049-010-R1-XP1-C5
gccggccgggccgggttcgtcatcagtcatcacaaagcctgtcacagacacagagagatcgtccatgtcctaattcctcttggcgagtgagtggccggcaataatctagctagcatcgccatgtctcgcccaaggatccttgcctccgtggaggccggcgtgcggctgctgcgtgtggcggcggcggcggcggcggtcttgctgtgcctgtccgtgcatctagggcgcgcggcgccgctgggcgcggaggttgcagagttcccagggttcgaaggcaacctcccctccaagcactacgccgggtatataacagttggccatgagcaacaaaagaggcacctatattactatcttgccatttctgaaaggaatccaagcttagatcctgtggtcatctggataaatggtggtcagcatgttcagggtttagtgcatttctgcattcaattggaccttttaaaatggagggctcccaagttcacattaatgacggtccacgagtaaccctaaacccttactcatggacaaaaatggctagcctcattttggttgactcgccagcaggtgtgggctactcttatgctgataccgaagatgactacacaacaaatgatacaagcagagtagtggacttgtatgattttctgtcaaagtggtttgcggaatattctgaatttctatctaatcctttctacatagctggatgctcttacagtggagtgatagtacctgtacttgcacaggaaaaatctaagagaaatga

SEQ ID NO: 19891 - DNA, 818 bp, Sorghum bicolor
  unsure (1)..(818): unsure at all n locations
  Clone ID: LIB5049-010-R1-XP1-D10
gccggccgggccgggataactgtctcgctatgccatcatctcgcacccaaaacggtatgttgccgattgttgagactgatatccttgttgatggccctcatgacattgatcgctgtctttatgatcagtgaggtatgccttgctgactgctacaaggctctcaacgatgaccatgtcctcatggaggtgaccctcctgaatcccaacatggagaccccattctctgactctaataaggtgacccctgtaccctcttgctgagatacaccgtgccgcatcctcgcatgatacccaccctgctgatgatgcctgctgtaggcttcctctctacatgacatgatcaaggactaggccaccctcaccctcactgccatgttgaaactcaacttcacaaaaacgagcatgctgtccttctccttcaggcgatgcactctccacagataccacactctactgtctgccgtgtgtcttaagctgagacaacatcagataactatacgttgttacttcctcgccaggcgtgaagatcaactctgaatgtaacctcggctactacaaaggtgatgctgatgatgacactcagaatctccgcctccaggactacaattactgatgtagcttcatactttatgcgcccgaatatccactcctgcctacaattacttggctgactgctgaatactactgtgagattagtatctgacattacaaaagcatgcttcctatgaacatgacgttatctctatatctgctcgatctttgngaagnctgctggttatgaattatgatgctaggattttgaacccgagttgtcttga

SEQ ID NO: 19892 - DNA, 645 bp, Sorghum bicolor
  Clone ID: LIB5049-010-R1-XP1-D5
gcggcgctcgagccggccgggccggggatcattcgacttgcgcctcccagccacagctgctgtggcgacccaaccccagcccgactccacctccccccgccgcctccccccgcggcttcgtcgtcaagagcagggttccggcggccgcgtctccctctgctcccccctcccccacactcggtttacgagtcggcgcgctaccggaggtcctcgcccccaagactcgtacgcccgtcgtcccggcggcgatccggccggcaccagaaccctagggatccgacgaagcagtttcaacagttcagaagagcaacatgggggtcctttgtttatcgattccagcaacagtttcagcttcagttcttgtgcaaaagcaggtgggcagcacataagctgcttggctcttatctcagcctaggagcagttggcctacattgagctaagaggaaaggaggtggctaggaggtatatgcatggccatttattctataaagcaaccgttacttcatagatctggtggatactctatgtaatcacttacagtttaacattgccatgtattatgatcacaagagcttgtattgtgaagtgtgaaatatttgtgtactgctatgaaatataccatattgcgaaatatgagattcaggc

SEQ ID NO: 19893 - DNA, 797 bp, Sorghum bicolor
  unsure (1)..(797): unsure at all n locations
  Clone ID: LIB5049-010-R1-XP1-F9
gccggccgggccgggaactttcacctataaccaatgtcgtctataatcacaccaggtctccgaaacgggctcagagcctcgtcttcttctctcagaccaacctttgccatcgcacgaccactctccacatcggccatcgctcgtaaaccagattcttccattagtatctcggacccatctccatcacgatcgaccatcacaactagaacagctcaagaaggttcaaaccaactttccttggaaactccacgaaacggcgctgaatatgtcttgtcgactcttgataaaatggtcaattgggctagacaaggttcgatgtggccgatgactttcggtttggcttgttgcgccgtagagatgatgcacatggctgctgctagatatgaccaagatcgattgggtgttgtgttccgagccagtcctcgacaaagtgatatcatgatagtagccggtacattgaccaacaagatggcgccagctcttcgaaaggtctacgatcaaatgccagaaccacgatgggtcatttctatgggttcttgtgccaacggaggaggttactaccactactcgtactctgttgtcagaggttgtgaccgtatagttcccgttgacatttacgtcccaggatgtccacccactgccgaggctctgttgtacggtatgcttgcccttcagcgaaagatgcgacgaaccaggacggccgtcatgtggtacagaaaatagatggatctctgcgtgttgtacggatttggacggggattcggaggcgaaagaggngttcgccctttggtatcatg

SEQ ID NO: 19894 - DNA, 139 bp, Sorghum bicolor
  Clone ID: LIB5049-010-R1-XP1-G9
cgctcttccccgagccttccaacctgtgtgcagactgaatagttgaatgcgaaattgattttgttaatattctcgtaaaattcttgttaaatcttttgcttttcttatcatttatgtcgccatcaggacgatctcttat

SEQ ID NO: 19895 - DNA, 614 bp, Sorghum bicolor
  Clone ID: LIB5049-010-R1-XP1-H1
gccggccgggtcgcgaatccactcaatccctccaaaggtacccacccaacacaccctcaaaccacacaaaacccagacacaatggccccaacaggtaccatcaaaggccccggcgaagcccgcacctacgacggcagcccgctgcgcatcggcatcgtgcacgcccgctggaacaaggagatcatcagcgcgctgctcgaaggcacgctggccagcctgcgcgccgccggcgtgcgcgacgagaacatcgtcatccagaccgtgccgggctcctacgagctgccctacgccgtgcagcgcatgtacctggcgtctcagacgcagcacgctgcgaccgcgggcggcacgctgacgagcgcggcgacggacctgctgggcggcagcacgacggaccttgctgggctggggcagaagaaggaggaggagcagagcaagggcagcaaggagcctttcgacgcgatcattgcgatcggggcgctgattaagggctccacgatgcatttcgagtacatctcggacgcggtgtcgcacgctctcatgaaggtgcagatggagacgggttgcgcggtggtgtttggcttgctgacgctgttgacggaagagcaaggactgga

SEQ ID NO: 19896 - DNA, 710 bp, Sorghum bicolor
  unsure (1)..(710): unsure at all n locations
  Clone ID: LIB5049-011-R1-XP1-A5
gccggccgggccggggtgctcacaacagcctcgagtcgagcttttcctctcccatcccaccgcgctcacgtgctcattccctcgcgagcccggctcgtcgtcgtccttgtcgggcgacggctacgcgggcggcacggcgcccttcctcccgtgcagcatgacgtcggctcgcccaaaccttcctgttgagggcggccgagggagaccgcagcaggctgcaggcaggtctctggcggcgtgcagtgcgtccaagtggtggcgtggcggcatcgctgtgcctgtgccggacgggaccggaccgctggaccatgaccgtcgtcgtctcgcaagtgcgacccggcgtccggtgctccgtccatggccttttcacgtggcgtgacagatacaggaaatgcggttcaccggtcgccgtcgcggctttttccctttttcaacggagacgaaagccatgcatggcagcttccacttccagagccgtggttcgtattcaaatgcaagtgtgcgatgcgtgcgccggaaaggcgaggaagcagcggcgttttacgtggcagccgccgtaggggactggctctggctggcttggctattgtggaatatactttttggtcttccatccacggngtcaccatcggtgcgcacctgcacgcagcccttgaaaaaacgatgcccgggcactggtctgtggtcggtctcacagagacggctttgac

SEQ ID NO: 19897 - DNA, 369 bp, Sorghum bicolor
  Clone ID: LIB5049-011-R1-XP1-B1
gccggccgggccgggcattggctgcatccagggcaccaaggacggtttcgtcaccggtgtgcccaacgctgccactggcaaggacaacggctttggcttccacgtcaagaagattgaggagaaccccaagggcttctttgctgatgtccactcttctgaggctgttcctggtgccgttcgtggccagatcaagtactagatgtgtttgaagtgtcgggatagttggacgagagattgggcggaaaggggtcgaagaggatgaggattcttatttcgtatcgtcttacaatgatctaatacgtaatcaataatcgaaaaaaaaaaaaaaaaaaaaaaaaaaacccaaaaaaaaaaaaaaaaaggccccta

SEQ ID NO: 19898 - DNA, 595 bp, Sorghum bicolor
  unsure (1)..(595): unsure at all n locations
  Clone ID: LIB5049-011-R1-XP1-B7
tgtgcggcgctcgagccggccgggccgaacattttggttangggggggaacgtaagcatcgccccccccttttggcaagaaaccctagctgccgcggccgtaactccatccctccctacccctcgtcgctacgagaggaagcggctcggaagctcgcatggctccctaggatgtcggcggccaggcttttcgcccaagtcgatcgtgagcccctatgtacaggaattgcgtttggcggccgagacggcaatgcggctaagcgcaggcgtctcgcgcggcatccctattgggccgcctcccacccctcgtccctccctctctcacctcgtcgtcgcttgagttggtgtggcagcgcccgatggacaacccttagctcccctcctcttccccatttccgacaagttccaacgaccaacgaggcgaatctggcctcctagggcccagatctatcgtctgtaccactggatccatgtggcgtggcatcagcggccaacccaactttacaaacatgagtggatataataaacttttgaagagacatgtttggatggccggtgaatacaaaagcttttaaagagacatatttggatcacta

SEQ ID NO: 19899 - DNA, 704 bp, Sorghum bicolor
  unsure (1)..(704): unsure at all n locations
  Clone ID: LIB5049-011-R1-XP1-C2
gccggccgggccgggaatattgttcgatcgatctcctcccagatctctctctctctcgtcagatcctcaaggctatatatggcgactgagtcgtcggcggccatggccatggaggagccgggcgtcgtcgtcaacggcagcagcgtggtgagctgggtggcgtccggggtggtgctgtggtcgaccgccttcttgctggtgcgggcgctgttccccaagcgctcctacgacttctgcaaccgcgccgtctccaccatgcacgccgtcgccgccgtctgcctcgcctgcctctccgtcgccgactggtcctgccccgtctgcccgctcgccgccgcgtcctccccgcgccagatgaaggcgctggcggtcacgcttgcgtacatggtctacgacgcggcgtgctgccacctcaacggcgacgtgcggctggacaacaccgtgcaccacctcgtcagcatcgtcggcatcggcgccggcttcgcctaccagaggtgcgggacggagatggtggcgtgcctgttcatcacggagatctcgagcccgctgctgcacctccgggagatgctcaaggagttcggcgtcagggacaccgacctcaacctcctcatcgacgtgctcttcgccgtcaccttctccgtcgcccggatgggcgtcgggccctacctttactacgtcaccctgaccgncgactaccccatcctcat

SEQ ID NO: 19900 - DNA, 390 bp, Sorghum bicolor
  Clone ID: LIB5049-011-R1-XP1-C4
cctctctctctcgctgctccgcctctcttgccgcccacgcccgcactctactgcgccgctggcgagccatccctctctcccttcctcccttcctcaccccgctacaacctccatgtctctatgccaccgaagtaggggcggcgacggtggcttgcagcgagcggtatgtctacctatcttcgtactctcttcctcgctttgcgacctccatggatgacggcgcgcctccgacgaggtaggtggggacgatttggatctgaggtctctcttccccctccctcctcctgtggatctagatctgagccctcctcttcgtctgtggatctagatctgagccctcctccctcctccacgttcttcaactctgctcctcctcctcctcctacttct

SEQ ID NO: 19901 - DNA, 656 bp, Sorghum bicolor
  Clone ID: LIB5049-011-R1-XP1-E12
gccggccgggtctgggactgtcgtccccttcgtcgtgcccaagagtccaaaacccagccccaatggccgccaccccgccggccccggcgccgccgcgcatcctcctcgccggcgacgcccacggccgactccaccagctcttcaagcgcgtcaaatcggtgaaccagtcgacggggccgttccacgcgctgctctgcgtggggcagttcttctctcccgagggggatgccgagggcgcaccgggggacgtcgccgactacatcgaggggcgcgcttccgtgcccatcccgacctacttcaccggcgactacggcccctcggcgccgcggctgctgtcgaaggccgccgctggtgctcgcgggttcgcgcccggcggcatcgagatatgccccaacctcttctggcttaggggaagcaaccgcttcaccctccacggtttgtcggtggtttatttgtcagggagaaagggactaggagggcctggctgctacagccaggatgacgtggatgccctgcgggctcttgcagaagagccagggattgtcgatctgttcttgactaacgaatggccaactggagtggtcagtggggctgacccttccaatgtgtctaatcatgttttggatcctaatgggtatgaccctattgctgctgaa

SEQ ID NO: 19902 - DNA, 614 bp, Sorghum bicolor
  unsure (1)..(614): unsure at all n locations
  Clone ID: LIB5049-011-R1-XP1-H6
gccggccgggtctgcggacctcaccataagaagataggagagataacaacacaatgggctcataaagataaccctagagatatctatccccatggcttagcctcccttggagctgtagtagagcccaagccacaaagtgtagaaacactctacatctgttcattttgcaacaagacattcaaaagtcctcaagctcgtggcgggcaccagaacgcacataagaaggaaattgttgtgcttaggaggaatttggaagaggagatgtcaaataaacgtgcaaagcaagctcataatgtctttgttgcatctcaagagatcaagcaacttccacttggtagtgattcttttgacgttttcacaaacctcgatgtggactccgaatcatgatttctgatatgatgaataaaccttccttggaatggatgtttatcctaaatcgatcatcattatattgttgaatagactagggaaatggtgcatgctttcccttgttgtttttgtttctcatgttctaatattttaatgtcttagttaaaggtctcttgngaaaaaaaaaaaaaaaaaaaaaaaaaaaaaaaaaaaaaaaggaaaaaaaaaaaaaaaaaaggccccta

SEQ ID NO: 19903 - DNA, 803 bp, Sorghum bicolor
  Clone ID: LIB5049-012-R1-XP1-B5
gccggccgggccgggtatccttcaacttattcatcaaaaatggctccttccacatcggttgccagcgccgagcacgtcgctgtcccggagactctcctcaagaagcgaagaaccaccgaggctagccgagaggccaagctcgctgccgctgctgaggcccgaaagaaccgaaccgccaaacgaaaggtcatcttcaagcgagccgacgagtacgtcaaggagtacgttcaacaggagaaggagcaggtccgacttcaacgagaggcccgaaagactggagacttctacgtcccagctcaaccaaaggtctactttgtcgtccgattgaagggtatctccaagatcgcccccaagccaaagaagatcttgcagctcctccgacttctccagatcaacaacggtgtcttcatccgagtcaccaaggccactcaacagatgctccaactcgtcaacccatacgttacctacggagaggtcaacctcaaggccgtccgagagctcgtctacaagcgaggttacgccaaggtcgacggttcccgaatccccatcaccgacaacgccatcattgagaagcaactcggcaaattcggcatcatctgtatcgaggaccttgtccacgagattgtcacctgcggaccaaacttcaagcaggtcacctctgccctctggcctttcaagctctccaacccaactggcggacggagatctagaaagttcatcggttacgtcgagggtggtgacgccggaaacgggagaagcacatgagcaacctcgtccaccagatggttttaaacgatggatgc

SEQ ID NO: 19904 - DNA, 735 bp, Sorghum bicolor
  Clone ID: LIB5049-012-R1-XP1-C3
gccggccgggccggggcaccaacacgcacaatctctccctctttgcccctcagatgcctctctcagcagcttccatcctccatgccttcctcctcaccattctcctcggcggcggcgccacggcctccttcccgcctggcgacggcgacggcgacgtgaacccgtcgacgatgtttaccaacgacacggggacgtcccgcatcgccgacgacacggagagatacatctgctacctctgcacgggccgcaacccgttgctgatcaggtattgccccatctactgggacgagtgccacctcgtctgctacgccgacgatgcgcccgccgccactgccgccgccattcccgccgcgcccttgccggcggcgtcggccaatcccagcggggtgcacgacgacgacgagtgctacgtcatgaagctgtaccggaacggcagctacaccatcgtcacccgcctcggctgcgcccggatcgccacgtgcctcctctcctgcggcggcggcgacatggccgacagcgacaggaaagccctgcagggcaccgcgacgaagactgcagcgccgacggcgacgacggctgcggtccaggggagtttaacgcccctgctcgcggattccagcggtgcggcacgcaggtcactgcgacgccgtctctgcgtggcagcggcggcgtccgggcttggtggtgcgcggcgaacgcgctagctctgttgggacggtccgatctccgatggat

SEQ ID NO: 19905 - DNA, 576 bp, Sorghum bicolor
  Clone ID: LIB5049-012-R1-XP1-C6
gccggccgggccgggccatgttgagctgtatcgcaatgatcagcaccggttcaagattgttgtcgacagtgataatgaagttgacttgatggtgcaaacacggcacatgcgagacctcatcatcctcacgatcagaggcctcgcccagaagttcaacagcacctccctcaacacacttctcaagatcgaggcatgaggatagggatgcccacctgatagacctgactgtaaaatcaactattagggaagctgttccttgttccaattggttagcgtgcgtgtatttagtaggattcgtagcatgacggccttttgtgtatgggtgtgggacgggccaagcgtgctgcaatacagttttttcccccctgactgatctctcaaatcagagcagcatcagctggttgctctgactcgtgcgtcatgaaatgtacatagggttgttagagtgagaaagagtggtgtttcttggtgctgtatttatttatgcactggttgggttgggtttttctactgccattctcatactaagcatgttgatgaatgatgagataaaaaaaaaaaaaaaaaaggccccta

SEQ ID NO: 19906 - DNA, 803 bp, Sorghum bicolor
  Clone ID: LIB5049-012-R1-XP1-D11
gccggccgggccggggtgatctctctctcgccgacgactgggccgccgccgcggccgtcctacgccccggcgcccagatcttcgttgggcccttcgccggcgatgagcaccgccaatacgctgcggttgtacctcacctgcatccggaacactctggaggcggcaatgtgcctccagaatttcccttgccaagaagtcgagaggcacaacaaaccagaggtggagctcaagacaagccctgagcttctactgaatccggtactgatatgccgcaatgaagcagaaaaatgcttaatagagacttcaatcaactctatacgtataagcatgaaggttaagcaggcagatgaattggagaacattcttgccaagaagttccttaggtttttgtcaatgagggcagaggcattccaagtgttgagaagaaagccagttcagggctatgatatcagtttcctaataacaaactaccattgtgaggacatgcataagcacaagctcatagatttcatcgtgcaatttatggaggatatcgacaaggagatcagcgagctgaagctgtcagtaaacactcgtggccggctagtggcgactgaattcttgaagcagttcatatgactgggccgtagcagtagtcagtgttgattatcacggcctgtaacttactgttcttccgcagcttaaagtttttttttactcagatttttttagcaggagctcctgtaaatgccttgcgaatttgggaccccctgattaccagctgaacattgcaatatcacgacgcatatagcgatctgcaattg

SEQ ID NO: 19907 - DNA, 743 bp, Sorghum bicolor
  Clone ID: LIB5049-012-R1-XP1-E6
gccggccgggccgggccctctccgcaatccaatccaactcaatcgcgcgtgcgcacacgcaacgcaagccccaggtccctcgcctcctcctcctcgccaaaccctaaccctaactcacaagggtcccggtcccggccgcggcggcaggagatatggcggactcggcgggcgatgccttcccggacgaggcggagacctcattcaccctccacgagtacatcgagggcatggaggccgtggagctggaggcggatttggtgctgggcggggacgatggcaaggactgcacctacgccggcggatacctcaagcgccaggccgtcttctcctgcctcacctgtgtgcctgatggagtcgccggggtctgcaccgcctgcagcctcgcctgccacgacgggcatgagatggttgaactttggacaaagaggaagtttcgttgtgattgtggcaactcaaagtttggtggtcatctttgcaaactttgccctgagaaagattcaaagaattcagcaaatgcttataaccaaaacttcaaaggttcctattgcacatgtgggcggccttatcctgacccagaagctaaggagcaagttgaaatgatacagtgcagtatatgtgaggattggtttcatgaggatcatattggtctaacctctattgaagagatccaagagatgaggaaggggagccactctacgaggaaattatatgccacaaatgctcacctctttgccattttcttg

SEQ ID NO: 19908 - DNA, 392 bp, Sorghum bicolor
  Clone ID: LIB5049-012-R1-XP1-G12
tgcggcgctcgagccggccgggccgggaaacccagcgcgcccccacacgcatcgcatacatcaccaggaggagatcggaggtcgcgacccgcggcccgaccaagtgcaagtacgctaccacacacactcccgcgccggacccggaccgagcgagcgaccgcgagggtgcaacgaggcaacgacgtggtactcctatatccgctagtccgcagcagctaggatccccaaaggcgaatgtacacgtacgtgtacaatcatatataggcaatagcccagccagtcagcagctcgcatcgatggtagtcactgccatcctcagacggacatgccggaggccaccaaacgccccccgtggcctctccctctacgtgcgcgaacttcacctccctcca

SEQ ID NO: 19909 - DNA, 837 bp, Sorghum bicolor
  unsure (1)..(837): unsure at all n locations
  Clone ID: LIB5049-012-R1-XP1-G7
gccggccgggtcccggaggatcaggttcctcgcggccggcgttaagtagggcggccgccttacctcgtactactggtaggtcctccacggagccgctggaaggaggctttgcggcgatggaccgggtcggcggcggcgagaagcagctggaggattgcacagtggccaatgctctaggaacttggttcttctcagttgcgggtgctcttgttgctattcctgtgggcataaagaggaaatccttagctccactggtcttctttggaaccacaggaaccatgctggacattatcacgggcattagccagtgtgagcgagagcatgctgagcggcaaatgaagcttttggaagcccagaaactttcgaccgatgcttcagctgggggtgaaagctctgattcctttggcagtgctgataagtgaaatacttctcttgcatttcctattgattagggttcttgctcagatgcaaattttacaccttttaatttctgaatataccattcctactccccttataacgtgtaattgtgtatttgagcaacgatcagttgttttcgcctcatcagtacgtgtcaactgctagtagcctagtagggattaggcaacgatgggtgcgctactttgtgtttgtgttcaatgctgagattanacacagatactggaggtgtcacggccccaaggtataagagatgctgagactgcatgacttattgacttggtgtaatctgtaagctctatgtgatgaagcacagatgttgagtttcatcccatactcccatccctcggatacacgaggttgtatccactgttttttttataatgtcaattgatgaaa

SEQ ID NO: 19910 - DNA, 371 bp, Sorghum bicolor
  Clone ID: LIB5049-012-R1-XP1-H2
gccggccgggccggtctgactctaccccctacctccccccaacctcgtctcatcgctgccgcgctagcgcccaaatctaatcccctaaaccctagcgccgccgccgccatgctgcgccgcctcaccgccgacgccccgcgggccttctcctccttctcctcctcctcctcctccccgcacgccccgacgctggcggcgtcgggctacaccccgcgccgcgagtacggactgatgcccatggagatcgagcacacctcccgcggggagagcgactacgacatcttctcgcgcctgctctaggagcgcatcgactgcatcaacggcccccataccgacgcacaggcgaccctcgacgtcgcgaagctgctctt

SEQ ID NO: 19911 - DNA, 789 bp, Sorghum bicolor
  Clone ID: LIB5050-003-R1-XP1-E11
gcggccgctcaggcggcgggcaggaattgtcattgcaacacaatcctcagctcatctaatagtacagaccattgcagcgcagctgcagcaacaacagttcctaccagctcttaatcaactagctatagcgaaccctgtcgcctacttgcaacaacagctatttcctctaaacccattggctgcaacgaatgccgttgcatacctgcagcaacaacagctgcaacagttcctaccagcactcaatcaactagcactagcagtccctgccacatacttgcaacagcaacagctgcttcctctaaacccatttgctacaacgaactctgttgcataccttcaacaacaacagctgcaacagcttttgccagcattcagtcaactagcattggcaaaccctgccgcctacttccagcaactacttccattcaaccaacccgctgtggcaaacatcgctgcctacctgcaacaacaacaaccgcatctatttaaccagttcgctgttacaaacgctgcagcctactaccagcaacagcagcgcctgacagttaacccattggcagtggctaacccattggctgccgccttcctacaacaacaacaatggctgccattcaaccagatgtctttggtgaaccctgccttgtcattgcagcaacccatcttttggaggtgacatcttctaaattacaaatgagttgtacttgataacaaagttctcatgtgggcatgtgcaactccccataatatcaatatttttgatgaagaaaaaaaaaaaaaaaaggcccctag

SEQ ID NO: 19912 - DNA, 915 bp, Sorghum bicolor
  Clone ID: LIB5050-003-R1-XP1-H10
ggccgcttcgaaaggccggccgggccggcgaaaaaaaaaaaaaaaaaaaaaaattccactctccacccatcgcctcccatggcgaccagggcggcggcagccacgctcacggcggccacgtcctctctcctcaggcgctctgcctcgctgcggccgcaggttctccgggtcccccaccgcgtgccttcccgaagatttgtgcgccatattgcttcatcaacaaatgaggaagctgctgccagagcagccgccgccaccgctgatactggaggacctaccatttttgacaagatcattgcaaaggaaattccttcaagtatagtatatgaagatgaaaatgtcttggcatttagagatattaatccacaagcccctgtacacgttctagtcatcccaaaagtgagagatgggctaactggattagacaaggctgagccaaggcatactgaaattctgggccagcttctttacgcggcgaaagtagtagcagaaaaggaaggtgtagcaaatgggtaccgtgtcgtcatcaacaatggagctgaaggatgtcaatctgtctatcatctgcacttgcatgtactcggtggaaggcagatgaagtggccccctggttaaattatgaagggggacatgtttgatttcttttgtgtcgagcataccctctttccaaaaagagagtgatgtactagtatctgcccctgtgattgcccccttttgagcactcatctctggaattactgagcttttgcagcattttgctaaggaaaactttttgagaagattttttgagaatataaacagggtttaggattatcctacaaaacatcagctgtggatattccaattgtttgaacaatgttttacctatggcactcctcaagatggttggacccaaaaaaaaaaaaaaaggcccca

SEQ ID NO: 19913 - DNA, 606 bp, Sorghum bicolor
  Clone ID: LIB5050-005-R1-XP1-C10
ctcgaggtcggtgggtgcggcatcgcttatgatccgcgttttgtgcgtctcctccgcgtccgctggattctccatgtctggtatcgccatgttggactcagaggagctccacttctagtctaaggacgacgctggtgcgtccaagacttacccgcagcaaggtcgctaccgtccgcaagagctctttcctcatcgtctacgcccgtccctgcgaagtcgagaacgattctacctctaacactgacctccacgggcacgccagaatgccactttgttcgccatagagatattcatcacgaaagatctcggagatattgttccttcttcacacaactgtgacattccgcatgtgaaccgcactgactatctgctgattgtcctatcttaggatggagttgtgatacttcttactttagatgcgatcactcttgacgatcttagactcccctctgatgagactcttgagtgccagattaaagaatgtgttgaaagtggcaaggatcttgttgtgactgtcctctctgctatgccggaagagcagatctgcgccctgcccgatattgtccccaaagtacttccctgccttggaagacggaactactgtat

SEQ ID NO: 19914 - DNA, 396 bp, Sorghum bicolor
  Clone ID: LIB5048-007-R1-XP2-E7
ttcctccgaatttcgtctcctgtgctataggtgccggaaacgactacatcgtcgagcccaaggcactgaacgatgctgatgttgacttccttgcctcgcgagctggctacaactacatctacatcaacgacacctcgcccctcgccggtcacgtccgaacggccacatacctcaccggtatcggagccatcttcgccctgttcatccaggccggaaacaagctctccaagggctacgtctcgttctaagcgacgtgtctgtacctcggagccgaatgaagaaacgtcatacaactcataatgcgtagatacatctgtagccatcttacaatgtcgcttgccaggcttgtcgcgttcggacagtcaatggcacacgctgaaacgtgacgagtggacg

SEQ ID NO: 19915 - DNA, 233 bp, Sorghum bicolor
  unsure (1)..(233): unsure at all n locations
  Clone ID: LIB5048-007-R1-XP2-G1
cggcgctcgnagccgccgggctccgnagagccaacgacttacgagaaccaagaatcaacaccgtcgtggccacgggcaccacgtgccgtctcgtcctcctcctgcctctcctctcgctcctcctcctccacaccgtgtcggcgttcgactccggcgacgacgacgacgaggatggtgattttgctcctccgccactgccgagtgttcacccagcggtggagggcgtcccctcc

SEQ ID NO: 19916 - DNA, 540 bp, Sorghum bicolor
  unsure (1)..(540): unsure at all n locations
  Clone ID: LIB5051-002-A1-XP1-A10
gccnggccgggatcagcatgaggcgactaccggcaaaaatgtagaccttcgtcaagaccctcacgggcaagaccatcaccctcgaggtcgagtcctcctacaccatcgacaacgtcaagtcgaagatccaggacaaggagggaatcccgcctgaccaacaacgattgatcttcgccggaaagcagctcgaggacggacgaaccctttcggactacaacatccagaaggagtccaccctccaccttgtcctccgactccgaggtggtatcattgagccctcgctcaaggtccttgccaacaagtacaactgcgacaagcaaatctgccgaaaatgctacgcccgtctccctccccgtgctaccaactgccgaaagaggaagtgcggccactcgtcgcagatccgacccaagaagaagatcaagaactagaggggaggtcattcacgatgggtggattgtaggcattgggatcgggcgaggttctcgatagccttgcatgtattgctttcctcgcgaaaaaaaaaaaaaaaaaaggccccta

SEQ ID NO: 19917 - DNA, 686 bp, Sorghum bicolor
  unsure (1)..(686): unsure at all n locations
  Clone ID: LIB5051-002-A1-XP1-A7
accgcacgcacatcttaccaacaacgaacagggccncccagagcgngcaaggcttcggcaagaagaagaccgcgactgctgncgcccactgcaaggccggaaagggncncgncaaggggaacggaaagcctctttcccaggnccagcccgagatcctgcgattcaaggtttacgagcccatcctgatcctcggtgttgacaagttcgctgatgtcgacatccgcgtccgcgtctccggtggtggtcacacctcgcaagtctacgccatccgccaagccattgccaaatccatcatcgcctactaccagaagtacgtcgacgagcactcaaagaaccagctcaagcaggctctgatccagtacgaccgcacacttctcgttgccgacaacaggcggtgcgagcccaagaagttcggtggtccaggtgcgcgcgccaggtaccagaagtcttaccgttaagcggtacattggcttgctggtggaggagaagaaacacagagggtgtgtgggggagcatggagcggtgttcatcctgggctttttcatggggtcttctactgtctactatctatccctcaaggacgaagttacgtgacatggcgcgcaacggctgcctgatacgatcctgcggcttgtgacgataaaaatgaatacattggntgcaaaaaaaaaaaaaaaaaggcccct

SEQ ID NO: 19918 - DNA, 306 bp, Sorghum bicolor
  Clone ID: LIB5051-002-A1-XP1-B2
gccggccggtacaaaaaaggtcctcgatcacaatggcatcccgaccgaaatcgacctgtacacggcaggaacacccaacggccacaaaatatccatcacgctggaagaactcggcctctcctacaacgtccacaaactcgaattcagcaagaaccagcagaaggaaccatggttcctccagatcaacccgaacggccgtatcccagccatcgttgacaagtcatcgggcaagccgaagcgagtcttcgagggtgctagacactgccaacttggtattcctttgccggagaaggtattgacaaagcc

SEQ ID NO: 19919 - DNA, 281 bp, Sorghum bicolor
  Clone ID: LIB5051-002-A1-XP1-B7
gccggcctggtacccgaccggaggaagaaggccaaggccgctcgccaagggtggtgacgaggatgctggcgaggaggacgaggagtagattacacgtcaaaaggaatgattcacggatgatcggcgttcggcatgacgggatgaatctcttcgacagttatcctgtccttgaaagcactatatcccttgtgggtctgggctggtggatgatctacatatacatcatgtagacactacccaaaattttcaactgccaaaaaaaaaaaaaaaaaaggccccta

SEQ ID NO: 19920 - DNA, 295 bp, Sorghum bicolor
  unsure (1)..(295): unsure at all n locations
  Clone ID: LIB5051-002-A1-XP1-B8
catgcactccgcngtanacatgatgtggtggccctttttcctccatttttcatatattcttgttagtcattgactgatatatgctagaattctccataaggtgcagctcgaagccattttttcacactaataaattcagagcattgtacaagaaaacttctgtttcagctattctctttgtacagcgttgcacgaagcaaatctctagaaatgtagcctttgcagatacagtatctttctgaagtatgatttttcttttttttattattaaaaaaaaaaaaaaaaaaggccccta

SEQ ID NO: 19921 - DNA, 753 bp, Sorghum bicolor
  Clone ID: LIB5051-002-A1-XP1-C3
gccggcccgggtcccaaaaacgtgagcctctgctctcaccatttcaaccaaacaacgccctcttctaaacaaattccaccaaaatacccaacacaatggccaccaccctcttccgctccagcgctatgcgctctgctgcccgcgccgctccctccatgcgcgcatccattggcggcaccacctttgtccgtggaaaggctactctgcccgacctagcctatgactacggcgctctcgagcccgccatcagcggccagatcatggagctccaccactccaagcaccacaacacctacgtcacctcctacaacaccgccatcgagaagctgcaggaggcccagcacaagggtgacatccaggctcagatcgcacagcagcctctcatcaacttccacggtggcggaaacgtcaaccacactctcttctgggagaacctcgcacccaagtcccagggcggcggcgagcccccatccggcgctctcgcccagaagatcaacgactcctacggctcgctcgaggagctgaagagcaagttcaacgccgctctcgccggcatccagggctccggctgggcctggctggtgcaggacgtgcagaccggcaacatcggcatcaagacctacgccaaccaggaccccgtggtcggccagtaccgccccatcctcggcatcgacgcctgggagcacgcatactacctccagtaccagaaacgcaaggccgagtacttctctgccatctgggacgttgtccact

SEQ ID NO: 19922 - DNA, 765 bp, Sorghum bicolor
  unsure (1)..(765): unsure at all n locations
  Clone ID: LIB5051-002-A1-XP1-C9
gccggccggttcataatcccacagaaacaccgaactttcctagaaaatcccacctcgtagcatcaaccatgcgtcgctttcccacaaccggtggtaaaaccaccgctcaaatgaacgcccagaaagcctccctgggaggcaaaggcagccgagggttggctgggaaaggtctcggcaaaacgggcgcaaagcgccacaggaaagttctccgcgacaatatccagggcatcaccaagcccgccatccgtcgtctcgcacgccgtggaggcgtcaagcgcatctcttgcaccatctacgaggaggttcgcacccagttgagggagtacctgcgcaaattgttgctcgatacttgtgccatcgtggagatgtgtaagcgcaagactgtctgcacatccgatgtcgtctatgctttgcagaagcagggcagatccatctatggctttggagagccgcagcgcggaattgcttgagtttctgagacgaagaatcgctgtggcgagcgacgagcacagttttatgcctacctgaaccacacgccacgaaggtgcgagcaatgcagtctgtgctgccactactgattgtacgaaaggacgaaggaacgactgcatgagagacgtcaattttgaagttttgggacgcaaagggattggcagacaccgtctgcgaggatacccttctgcacacagcgaatttgttttttcagcaaagtttggaatattgtactctangattgcaaaacgagaattcagcgaattgattagatgt

SEQ ID NO: 19923 - DNA, 578 bp, Sorghum bicolor
  Clone ID: LIB5051-002-A1-XP1-D11
gccggtacaacaacggcaacactttttctcatcttcccacaacaatcccggctgaaggagtggatatcataatgcccgagcaaaagccatccaccttcaagcgattcgtcgaggtcggccgagtcgtcctcgtcaacgagggcccgtccgccggcaagctcgccgtcatcgccgagatcatcgaccacaaccgggctttgatcgacggcccgaccacctccgtcccccgacaacaattcccttaccgaaacctcatcctcacgccatacaccatcgccaagctgccccgaggtgccggatcaggagcgatcaagaaggccgtcgagaaggctggtgttactgagaagtgggaggcttccggatgggccaagaagctcgctgccaggcagtcgcgaaaggaggccaacgactttgagcgattcaagatccagctcgccaagcgatcgcgacgggacgtcgtccgaaaggcctacgtcaaggagaagaaggcctcggcttaaccgtcacgtcgacacgtcacgactgtatgctgtatgctacggagaggagctcggcgcgagcgccagctggcgaggacc

SEQ ID NO: 19924 - DNA, 424 bp, Sorghum bicolor
  Clone ID: LIB5051-002-A1-XP1-E1
gccggccgggctgcaaatacgcgagatttcaccagaggcccttcactaccatagtaccctactccacgaaaatacgtagtgagaagacgagggggattgggggctaagggtgacctgatggcggaggtaccgaccccgggagacaaactgcgcaaggagctgtgggagtgcacggagctgtgccacacgatgatccccgagaacacagcataatcgagactgtcgacggcgaccgtcatcccggcggtcccggcggcctccgctatgaaacacaggaggtcccgatgcttcccggccccaccgacaacctcgacgcgcccgacgaagaaaacaaaggggtatccgatcccgcgccgcacggagaggtgggaggattcctaaaaaaactttcagataacactaaaggtgcccaacgaggaagccg

SEQ ID NO: 19925 - DNA, 636 bp, Sorghum bicolor
  Clone ID: LIB5051-002-A1-XP1-E2
gccggccgtgtccggaccctcgcaacatcggcgcccatgtcactgccgaaccagaacgcgctccacttgaagaagccgccgccgccacagctgccgcgtcgccgcctctccgagcttagcttgtccagctgggcctgcagcgcgttgcactgcacctgcaaacgtagagtgcgtatgtttcagtgtcagtgtagccgatctgagcactggatcaaacatcgtgcggactcggaagctcaagacgacaacgaagaagaacctggaggatggagcctggcgacgtcctcgcggaggcggcgcacctcctggtgctgcgcgagcgcgaggacctcgcgcttggaggggcaggcagcggccggggagctcaagcgccgggttggggctgcgctggctgctgaaggagttgctcagctcggcgaggcggttgagcttgccgtgctacgagaagagagcgcaccggcatgcgctcgttctggatggcgtgcgccgcggcttccgccgtgagctcgcgcgcgtcgatcagccagcacagcgcccttcccgctcccggctcctctttcgcggtgtttcgatgcgcctgtcggaaatggagccatgccaaggaaatagggatcagtgtcccatttgttttgaagc

SEQ ID NO: 19926 - DNA, 620 bp, Sorghum bicolor
  Clone ID: LIB5051-002-A1-XP1-E5
gccggccgggtacaaatacggggacccctctacgacagacttacgaatccatttctttgcgctccccacctcctccaaaccgccaaaatgtccacaaccaagcgcagcaccgccgccaagaagggccagaagatcaccaagaagttcatcatcaactgctcgcagcccgtcaacgacaagatcttcgacatccaggctttcgagaagttcctccacgaccgcatcaaggtcgagggccgcactggtaaccttggcgacaccatccagatcagccagcagggcgatggcaagatcgaggtcattgcgcaccaggagttctccggccgctacttgaagtacctcaccaagaagttcctcaagaagcagcagctccgtgactggctccgcgtcgtttccacctccaagggcgtctacgagctccgcttcttcaacgttgttaacgacgaggcggatgaggatgacgagtagatctacgataccacttgatgataccaacatggcttgcatagaatggagtctaaggttcggaaaatgagatgggtggaggtctacatggcatatagcacgatctaatgaattgatgcatttgccaacaaaaaaaaaaaaaaaaaaggccccta

SEQ ID NO: 19927 - DNA, 870 bp, Sorghum bicolor
  Clone ID: LIB5051-002-A1-XP1-F11
gccggcccgatacacacagtggccgccgtcgccgggtctttccgctacatggctcccgagtgcgcgtacacgaggaaggtgaacgagaaggtcgacgtgtacagcttcggggtcgttctcttggagctcaccaccggcagggaggccaacgacggcggcgagcacggctccctggccgactgggcgtggcggcacctgcagtccggtaaaagcatagacgatgccgcagacaagcacatcgcggacgccggctatggtgacgaggtcgaggccgtcttcaagctcggcattatatgcaccggtcgtcagccgtcctcacggccgacgatgaagggtgtccttcagatactgcagcggtgtgagcaggcgcaccagaaaactttcgacgagaaggtcgccgactacgacaacgcaccgctcctgcaggcgcgaggaggcagccgccggaaacaactctccgatgccaaagtgactgacgacgatgggaagggcggtttcgacgactgcaacatctgatgaaaatcagaacgagcagagcatgttcgctgataagtcatggctcaaagtactgttcgctgatttgttgttagagaaaaacactgttaaatggctagcagattcgacaaataagtttcccgaacaggctgactataggaatccagaccacctgaggcctgaacctaggaatctaggatataggcatagccgttacaccagctaccttgagcttgtgcaccgtccacggtcttagcctgacagcagagataaggatagtcatcacagctccttacaaccaccctgatggacagtgccaatcccaaacggggtgtatggacctgtaaccggtacgggcaaactatataattttga

SEQ ID NO: 19928 - DNA, 494 bp, Sorghum bicolor
  unsure (1)..(494): unsure at all n locations
  Clone ID: LIB5051-002-A1-XP1-F12
agaaaaaggagacccacnnacagaccaaaagggcgccccgcaaaagcncagggaggcagagaaggagaaaaacaaggcnccaaggaacgcacacccccgggagcagccaaagggagcancaacaagccccccancacngncaccaccagcagnnccagaaaccangccaacncnaaananngggccacggcaacccagaggagcaggaaaacccgagccnggcccgccnccggcnccngcacaagcaaacagcggcaacccgccaccanggangcnccgcacgggcagcaacaggcgagccccccccaaggcagccccgcggcagaacccgacagccacacaccngccaccgacacgncacggcgacccaggcaccaacagaagcacgaccccccccgaacccgcgaccgaacaccggcgnaggcgccaccaacaaagccaggccccgacaaacgccncacacggcgaccgaagcccgcagcaacacagcacca

SEQ ID NO: 19929 - DNA, 285 bp, Sorghum bicolor
  Clone ID: LIB5051-002-A1-XP1-F9
gccggccggagtacaaaggagaggatctggcaagaccatcaccctcctgccaagaagacgaagaccgcttaaatggttggttcgacaaaacgttaaccctcatctgtacctaaagaacatgaaaagtagtagaggaagtttctctaaggaatttccttcattttattcctttttgtattcttatgccacctataccgtacgtaggaatctgtaaagatcaaattcatccccaaaaaaaaaaaaaaaaaaaaaaaaaaaaaaaaaaaaaaaaaaaaaaggccccta

SEQ ID NO: 19930 - DNA, 394 bp, Sorghum bicolor
  unsure (1)..(394): unsure at all n locations
  Clone ID: LIB5051-002-A1-XP1-G5
gccggccgtggtcggaaagatctaccaggcaactttcggtttcccccatggagacagattcagacttttggtttctcggtgtcggacgnaagatgacggatgacttgtgatgtgcatgtttggatgtgaatgcaacctgagatgcaatcgtgattgtacgaacacctgaactgacacgatatgatgatggagtgagcacgacacacgacaattctgggtatcttgcctgacaataatattgatgttgaaatgtaagatatacatgatttttcaaatgagcattgcataagttgaatatttgccgattggtcattgtgtaactatagtatttgctatgcaacagagtagctttatgaaaaaaagaagaaagaaaagatcctaggtgctgcttctt

SEQ ID NO: 19931 - DNA, 457 bp, Sorghum bicolor
  Clone ID: LIB5051-002-A1-XP1-G8
gccggccgggtacaaaaaatcaacgacagcttcagatccccgcccgacgaagcacctttctacccacacgacaaacaaccgtcaacatgtctcacgagtctgtctggtactcgcgcccgcgcacctacggcaagggcagccgcgaatgccgtgtctgcacccacaaggctggtctcgtccgcaagtacggcctcaacatctgccgtcagtgcttccgtgagaaggcccaggacatcggcttcaccaagcaccgttaaatgtttcgaatgcatgcgatgacgatggacggagctttcaggtggatggtgcaatgaaaagaaacggttcagctgggcatgcgattgcagttaccggcgttaggcggacggacatgcgaacatgtcacttcatcagcggtagaatgaggccaacaaaccattccacctgttttcaaaaaaaaaaaaaaaaaaggccccta

SEQ ID NO: 19932 - DNA, 356 bp, Sorghum bicolor
  unsure (1)..(356): unsure at all n locations
  Clone ID: LIB5051-002-A1-XP1-H10
acggccacgacggccanggaggagaggaaagggcaacaaggggagggacaaggggagaaaggacgaacncaagnccaggnacaangccgacaaacgagagaagaggaaagacacgaacaggccgaccnccaaggacaccaacaagggcncgacggacaggcacagacagggcaacanggcggagnccgaaaaggnggacgaccaccggncnggaaagagcgggggggaacagaaaggaaagacaaacgaacgcggcggcaggagcccccgcancgaggaaggcgcgaaggagaacgaaagagggacagccaggcagcccccancccgacagccagaccacaccgcgangacaacaa

SEQ ID NO: 19933 - DNA, 338 bp, Sorghum bicolor
  unsure (1)..(338): unsure at all n locations
  Clone ID: LIB5051-002-A1-XP1-H12
accaccacaggtatctcacagacaaggcaccnacacnacgaagccaggccggaagaggccggccggcaagggcgcccaagggcgagcggggggnggaggccaagcccccggcggacaagccgcgggcggcgcngcgcgaccccacggagcngncccccaagaacngccccgagcagcacaagagcancgagaccgccgagggcgacggcaagnccgccggcaccgcccgcccccccaagnacaccgaggcggcgccgacgccgacgcccgccaaggacaagccggaggcggcggacgacgagaacaaggcggcgccgcacagcgcggcggacggcgag

SEQ ID NO: 19934 - DNA, 553 bp, Sorghum bicolor
  Clone ID: LIB5051-002-A1-XP1-H3
gccggccgggctgcgaaaaagaagatgctgcgaaagatcttaagcgaggagtatgtgcgcctccaacatccaagtgatgactcctgtgcaaggcaggctagatgacctgcaccatcccaggcacatctatcatgcaaccatgcctgaggcagatcgtgcaacgagatacaccccgagtgctaggacgtgccacatcctcggcacatatgactggtcaatggttgactgcaccatggttaccaatgattgatagcgcgatctggcaaggagattgagaaggagccctaattcctcgagaacggggatgctggaatggagaagatggcacccaccaagtccatgccgatatacagcttctctgagtatcctcctcttggacgctttgctgcccggcacatgatgcaaacgatggctgctggagctatcaaaactgcgtatacaaacgacccgactggagccaacgcgagcgaagatgtcgccaagaataaaagatgcgcctctgatggctcgtggtatacctaggtagaacttcaaaaatatatcaaacgttgct

SEQ ID NO: 19935 - DNA, 509 bp, Sorghum bicolor
  Clone ID: LIB5051-002-A1-XP1-H6
gccggccgggtgcgcaccggggacacacgctcttcaccttcccaagcagagcagcgaacatgtcgccggtcaccgcgctgctggcgggcacggccgtgccgccgtccccggcgccggcgaggcagcacgcccgccactactccgtcggctttccctcgctcccaaacggcgccgggcgcgcggcgctggcggtggagtgctcgtcgcggccgcagaagaaggggaccaagcaccacatgaagacgcggcccaagaagacgcagccgtgggacatcaagcgccgccccacgcagtacccgccgctgccgccgctcccgcccgactggacgctcgtcgcgtccggcgccaccgtcgacgtggaggaggctacctccgtgacccccgtcctcgaggtggccgcggccgtcgccgcacccaccaccgccgactgaggccaccgcggcatgtcgctgaagttgttccgtggaccgtggggcttgagctctccgcgtatgctgtttcctttttga

SEQ ID NO: 19936 - DNA, 224 bp, Sorghum bicolor
  Clone ID: LIB5051-003-A1-XP1-B3
gccggccgggtccgcaagaggtgttagttgtacgttggctacttggcatggctgtctgactcgactaattccagaaattaatgatgtccagttgttcgtggcatcacacactagacagtacagaatcagtgccggccctgaattttttgaggcctggggcggaaaaaaaatctggggccctttatacattattaagttcccaaaaaaaaaaaaaaaggccccta

SEQ ID NO: 19937 - DNA, 516 bp, Sorghum bicolor
  Clone ID: LIB5051-003-A1-XP1-B5
gccggcctggtgcggcgctgtcacaaaatacacaccaaattccacaacccgtcacccaccacttctacccacgctcgcaaacgcgccgaaatctcgcgaaggcacttatcctccacgtcacatatccacaatgtcttatttccggataacactcatgcgctccggcattggcatgcctgagaagacgcaaggtgtactcaaagcgctcggcctccgcaaacgcatgacgaccgtctaccaccccgtaacacagtccgtcgctggtcaaatcatgaggataaaggaattggttgatgtcaaagaagtcaagagcccgatgactaaggagcaaatgcgcgccgcgaggagaccggatcccggatactacatcgagcagagggcaggcgaggctatgaagggttatgaatagatgcaaagagacaggaatgagatgtgctgttcgcatgtaaattaagctgcaaacatgtatgcatatatggcgttatgggacaaaaaaaaaaaaaaaaaaggccccta

SEQ ID NO: 19938 - DNA, 341 bp, Sorghum bicolor
  Clone ID: LIB5051-003-A1-XP1-D5
gccggccgtttccggagttgagtgtactgctgtcagtattacttgtagtctgccctggccaattcaacatgccagaaccacttgcacgttgatttgttctttggactgaagaagggccattcgatggtgagcaatgtgtatatatcttcagatttgcttgccagagcaattgatacaggaactactctttctgcaatcatgcatggtagatcagttgttgaaacttcctctgtagtctgtactagtttctgttgaattatgtgctagcaggaagtcaggtcttgaacgaagtgaatgtatactctatctcctttgaaaaaaaaaaaaaaaaaaggccccta

SEQ ID NO: 19939 - DNA, 246 bp, Sorghum bicolor
  Clone ID: LIB5051-003-A1-XP1-F7
gccggccgggttgcgaagtgagcgacctccatcatgtcattgctccggccggcggcgtttgtgtaacatagtctgcatagagagagagctttgttttagtagcttattcgtctttgtctgtcttccgtttgtaacttcgtgagtgagcttggcatcgatgatcgtgcatgtacatatatgtattctgatttacccagaaataataatgacaaaaatttcgaaaaaaaaaaaaaaaaaaggccccta

SEQ ID NO: 19940 - DNA, 575 bp, Sorghum bicolor
  unsure (1)..(575): unsure at all n locations
  Clone ID: LIB5051-003-A1-XP1-G11
gccggccgggtacacacgactttgcccacccacccaagaataattcatcagctgccacgccacgcggaaaccattccgaggagcagcagaaaggcgccgtcgccatggccggctgctgcgtcttcctccggtggccgtcagcctcgccgccccgcatcggctaccgctccctcgacgccgaggaagacgacgccgacgagtcgccgggcacggagaaggacgtggtagagaaggaacggcggaaaatcgaggaggaacaacatctggtctactactaaaaaaacaaggagaacgtgaagatggagatccgaaagaaagagagcatagtacaaagagaactaaaaactaaaagacaaaagacggagaagagtaaatgttcagaaatataaagagaaaaaaatatacaataaaaaaaagagaaaaaaaataaaaaaagaaaaaataaaaaaaaaaaaaaaaagaagaaacaagaagaaaaaaanaaagaaaagaaatgaaaaaagaacaaaataaaaaaaagagaaaaacaaaaaccagataaaaagaaaaaaaaaaaaaaacacaagtaagccatg

SEQ ID NO: 19941 - DNA, 417 bp, Sorghum bicolor
  Clone ID: LIB5051-003-A1-XP1-G5
tcgaggccggccgggtccgtactcactcaactcatcaagtactcttacaaaatgaccaagcgaacaaagaaggtcggtgtcaccggaaagtacggtacccgttacggtgcttcgctccgaaagacggtgaagaagatggaaatcacccaacacgcccgatacgcgtgccccgcctgcggcaagaacgccgtcaagcgaaccgccgtcggtatctggaactgcaagccctgcaagaaggtctacgccggaggagcttacaccttcggaaccccctccgctgctaccgtccgatcgaccatcaggcgtctgcgagaggtcgctgaggtgtaaagcgatgaggatggccgacaggatttggtgtagttctgagatgtataccttacgacgacccaaaaaaaaaaaaaaaaaaggccccta

SEQ ID NO: 19942 - DNA, 775 bp, Sorghum bicolor
  unsure (1)..(775): unsure at all n locations
  Clone ID: LIB5051-003-A1-XP1-H3
gcggcggttcggaaattgctctcctcctgatcttcccttgattattggcgagcttcattccattccatcagttcctttggcggaggatgtcgtgctngcgngnagngnnccaaaaaaccctttggggnccccggggnggggggggngnggggggggggccccccggggggggggnnnnncttttttttcctcccccccccccggggggcgggnnnttttttttttttttcccccaagggtggccgggcacaacgcggcttgcccggaaggggggggcaaaaatggtccccccccggccccttggggccttggggacccccccccggggggcccccccccccccccgcccccaagaacccctccccccccggggggggggccccccccccccctccccccccgggggggccccccccccggggggggggtttttcagggggggggcgccccccccccccccccattttttttaaacaccccccgggggtaaaaaggggggggccccccccccctgtgggtgtgggtgttgaacccccccctttttctccttttcagaggggggccttttttgttatataaaaccccccccccccctcttttttttttttttttccccccccggggaggggaaaagaggggatttcccccccccccccccggcggaggaaaaaaaccacaccgccccccccccccccccccgcgggggggggggggtgtggcnnccccccccccacacccccccccccgcggggggggcggggcgggcgcccccccc

SEQ ID NO: 19943 - DNA, 322 bp, Sorghum bicolor
  unsure (1)..(322): unsure at all n locations
  Clone ID: LIB5051-004-A1-XP1-A9
gccggccggngtacaaaacacgccgtctggcgactgcccttaccttactctcctggcaaccccggtggcaagaacgccgtcttcaaccagggcaccaacgccaacttgatcttccagctttgcagctccaacggcaacagctcttagatggttgtacagcagattgatgtcggggacgaggcgagtcgagggacgaacggtgaccgatgcattactctccttttcttgtttgcatgaatgatacgaagaaacctaagatagacacagcctaatctataatgccgatccttacactgaaaaaaaaaaaaaaaaaaggccccta

SEQ ID NO: 19944 - DNA, 385 bp, Sorghum bicolor
  Clone ID: LIB5051-004-A1-XP1-B11
gccgggccggtcctccaccaaccgcaacagaccaaacccagccgcaaccgcagagcgcagagccgtccgtctctctccacgccgccgccgccgccgccgccgcagccgccgccgcctcgccccagaccctaccctccagtcccccttcccggcacgaccgattctcctcgatccagcgctgatccgtcggcctcccgggccggccatggatttgctggcgcccttggccgccgaggagcggcgcttgtacccggggttcctcccgatgtacgccgccatctactgcctcggccagctcctcttgttcccgcggcggccgccgcgccaccacccttgccgcccccgctgccccatctccctcctcccgcggccccccccccccccc

SEQ ID NO: 19945 - DNA, 798 bp, Sorghum bicolor
  unsure (1)..(798): unsure at all n locations
  Clone ID: LIB5051-004-A1-XP1-B7
gccggccgggtacaaaaatgtcctcgccatcttcattgtcgctttcttcccaagcgccttccacctgctcctaaaaccgataaccctccccttcgagctcttcaacacgcctctcgcgccttctctcaaactcccaacttgcgcctgctgtcccccagcctcctgctcatcctcagcaacaccacaaccacaaccgcccagcatgtctttcttccaaaaacaattcgcccttcccgcgaagtcgcgcggctgctacctcatcacggacgaagtcacacgccaagtaccagagatcaagaacttcaaagtcggcgtcatgcacctcttcatccagcacacttcctgcggtctcaccctcaacgagaatgccgatcccaccgtgcgcgccgacatggctgacgcgctggaccgccttgcgccagaggacaaggagggcgtgctctaccagcacgacgacgagggactggatgatatgccgggacacatcaagagcagtttggtgggtgctagtgtcagtgtgccgatcacgaatggaaggttgaacacgggcacatggcagggtatctactactgcgagtttagggcgagcaagcactcgaggaagcttgtggctactatccagggcgagaaggcttagagaatatattggagaatacctaagggtataatgactgatgtagtaacacttgcctcgaggtcgagcccgattttatatggcatgagcattagacaattacttcttcagacattatggtattatgtgatgaacatcanaaaaaaaanaaaaaaaaggcccct

SEQ ID NO: 19946 - DNA, 438 bp, Sorghum bicolor
  Clone ID: LIB5051-004-A1-XP1-B8
gccggccgggtccgaaagtggtgacttcaccaaccacaactgcactggtggaaagtccatctacggcaacaagttcgccgatgagaacttccagctcaagcacaacaagcccttcctcttgtcgatggccaacgccggacccaacaccaacggatcccagttcttcatcaccaccgtcgtcacctcgtggctcgacggcaagcacgtcgttttcggcgaggtcgttgagggccaggacctcgtgaagaagatcgagggccagggctccgactccggaaagaccaagtccaagatcaccatcacctcttcgggaaccctttaaagtggcccagggatttttccaatgatgacttgaggatgagcgttggacgtaaaatgtcaaagagtgagaagagatgcatacgtgttatgcaaaaaaaaaaaaaaaaaaggccccta

SEQ ID NO: 19947 - DNA, 747 bp, Sorghum bicolor
  unsure (1)..(747): unsure at all n locations
  Clone ID: LIB5051-004-A1-XP1-B9
gccggccgggttccggacaactacagctctctcaatacctccagatcctcaatccacaccaaaacacaactacacaactatgtcttcaaacaaggaccatacctcgactcctcagtcctacttggaccaagccacaggcgctgtccagagcgccatcggctctctgacgggtaacaccgccgacaaggctcaaggcgagaaccgcaaagacactgcggccgccgaacatgatctctctcactcagccgccaaagccggtcccttctccgtaattccctcaggcggcgtcgcaaaggacaactcggatcgcaccgaaggctcatggaaccaaaacatgggcgccgccaaagaagcgctcggcggtcttgtcggtgccgagggcctcaagcagcagggtattcagcagaacaaggagggcaaggagcaagaagctgctggacaggtcaacgacctcggcaagggcatcggagataggcttggtggtacggttggtggtgctgttgcaggtttgaccggcaatgcagcgcaaaaggaagaggcgcaacggcagcacgatgagggaaaggcgaggcagaggggtgtcgaagcagacttgcaaaagcaggctgaggccgagaggcgttaagctgtggtggtagtataaaggtccccctttgtgaggacggtcacgtttgatggcattttggattgatacccgatgaatgatatcccatgttcttttgaaaaaaaaaaaaaaaaggcccctan

SEQ ID NO: 19948 - DNA, 296 bp, Sorghum bicolor
  unsure (1)..(296): unsure at all n locations
  Clone ID: LIB5051-004-A1-XP1-C1
gaatcgagncaggtttaccgaaaaaaaaagaaaaggggaagagcacgcgccgccgccatggccgccgcctcctcccgccgcgcgtcgcaactgctggggtccgccgcctcccgcctcctccatgcgcggggattcgccgcggcggccgccgcggcgccctcgccggcgggcttcggcgaccagagcacccgcgcgacctgccagggccccacggggaagaacggcccctcccacaccgagcaggccctcgagcacggccctaccacggctggcggagcgacccccaccaacggcgg

SEQ ID NO: 19949 - DNA, 751 bp, Sorghum bicolor
  Clone ID: LIB5051-004-A1-XP1-C3
gccggccgggtacggaacattaacctatggaaacatggcataccaaaaactattggtattatttttcatcggaacaataacttttgagcttctgatacaaagtgctacagcaagcaatcctaacaaaggaaaaaatcttcacaacgctggaggcagtggacttcctgcaggtgatacaaatgatggtaatggtttctgtgaaaactgtggttgtccgaagaatgctccaggagctttcaatggcggaatgagccgcccaatgccaggctatccaggaggagccatgggtggttgtttccgcccaatgtcaggccatcaaccacctacaggatttgcaccaaacgcggctccaggaggagccatgggtggttgtttcggcccaatgtcaggccatcaaccacctacaggatttgcaccaaacgcggctccaggaggagccatgggtggttgtttccgcccaatgtcaggccatcaaccacctacaggatttgcaccaaacggggctccaggaggagccatgggtggttgttgccgccctgggtcccgaaattgtcaataattttgtcaaaagatcttggtttttaatgagggtgtattccactcttttccaagctaaaacaatgttatgtcatattgcgataggtaaacattgaaatccatgaacagataatttttttattggtgttaatcagcttattcaaataaatggaaaaacttcaattatgatagcattaaaaacttttgtacaacg

SEQ ID NO: 19950 - DNA, 845 bp, Sorghum bicolor
  unsure (1)..(845): unsure at all n locations
  Clone ID: LIB5051-004-A1-XP1-D10
gccggccgggtccgaaacggaaagtccagtgcccaaccgttgccaaagggaaggaggaatggaagccgccggcgcagcctcgccgcccacggagccgccgccgactcacccggcggtggcgccgctggccttcctgctggggaagtggcgcggggaaggcgagggcagcttccccaccatctcctccttccggtacggcgaggagctcctcttctcgcatcatccctccaagccggtgatctcgtacacgcagaagacgtggaaggcggcgtctggcgagccgatgcacgccgagagcgggtactggcggccccgccctgacggctccgtcgacgtggtcatcgcgcagagcactggcctcgcggaggtgcagaagggttcatatgacgctgaaaagaaaacagtgacactccaaagtgaactagttggaaatgcatcaaaggtgaagcggatcacgagaacttttcaagtggcagatggggagctctcgtacgtcgttcagatggcaacaatcacaactagcctacagccacatctcagggcccttcttaagaggatttgaagacgatcggatctcctatagcgccgtcgctgcggctaacctaccgagggacacctgtacaggataagcttctggtcattactagttaatgaatgaacttacgagttcaataagctcattttccaaaaataaagttccgttggagatttgccattataattttgcaaagttagagagttgccattggtatctcactgacatatgggacacacgtgagtccatgacatgtgngacaggatgacaaatctctanttttagtaaattataatggcactcttccaat

SEQ ID NO: 19951 - DNA, 651 bp, Sorghum bicolor
  Clone ID: LIB5051-004-A1-XP1-D8
gccggccgggttcgaacaaccaccgcagtctactctaaatttctcgcagccagagtgaggagcatcatatgactccacatccactctccctacatcagtcgcctcgcacacgccgacatgggccgacgccgctgcagatgttggccatcagcggctcctgaactgctcctcctactcctgctactcgtgtgcttctcccaaggtctggcaccgactcgcctcctgcctccgctgcaccaagctacagccgttcctccgaaggtacttcaccaacgggagaatgttgtcatgctgataactgccgacggactcgcgcttcaagaaggagatgccgtgcgtgaatggagaagagctctccatctcagacatgatgcgagcacagcaggacggagggaagacggattgccagagctagaacgaagaatggatgtagaggtgggtgctcgggaatgcgcacctcgactacatctacacgcagcacaatggcaagtcgtgatcgtgtcaccgtgaggactggagaaagacatgcatctcgccttgccggtttggattgcattgaatttgcccgggcacagcgagtacatgcatgattggaaggtgatagtatatagctgggctggaacggaatcagatggagatgaccctatgata

SEQ ID NO: 19952 - DNA, 632 bp, Sorghum bicolor
  Clone ID: LIB5051-004-A1-XP1-D9
gccggccgggtcgcgaacctcttcccatgtccgcccgttaagccgcctccaaagtcgactggacgaccatctacacccagctcggcctcggcaaggagaccctctcgtccctccaggcgttccgagcccgacacacgtccgccgtcaaccgaaacgccgcgctcaaggcttccaccccgcagatcgacctctcggcttacaagtccatcctcaaggaccagtccgccatccagcaggccgagaaggtcttggccgagttcaagccggtcgactacgacgttaagaagtgggacgatgccgtgacggcgttcgagggcaaggcggtcgccgctgccaaggagactgtcaccaagatcgccgccgaggagtctagcctgaacgacaccctgtccaacatcaaggacgcccgaccgttcgaggaccttactatcaacgacgtcgccaaggcccgaccagaggtccagaagacggtcgacacgatgctgcagaagggaaagtggtccgtcccgggctacagggagaaattcggagagcttgctcttatgtagatggaggtacgaggtcaggatcgcgtataacccaaatgcacagcataggattgcttgcaaaaaaaaaaaaaaaaaaggccccta

SEQ ID NO: 19953 - DNA, 497 bp, Sorghum bicolor
  Clone ID: LIB5051-004-A1-XP1-E1
gccggccgggtccaagacacgacgaattaccctctcggtttcctccctctcggcggcggcgcagttccccctccatctccggcgcggcacttgacttctgacctcaacaagcaagcaaatggcaggtggcagggttgcacatgccaccctcaagggcccgagcgtggtgaaggagatcttcattggaatgaccctgggtctgattgcgggaggtatgtggaagatgcaccactggaacgagcagaggaacactagatccttctacgacatgcttgacaagggccagatcagcgctgccgtccaggagtagtttcccacatgccaattctgaagagtttttttccgccagatttcaaaactctctgaagagcatgacaaagcgaacgctgaggagaattgccctgaaaatacacataccccatttgagaacaccacatattgctgaatttccctttccttgccatgaatatttaaacatgcctatgccataccaaaca

SEQ ID NO: 19954 - DNA, 805 bp, Sorghum bicolor
  Clone ID: LIB5051-004-A1-XP1-E4
gccggccggtgtcccgatccatcaagaggcacggcgcgttcaacatggggagcctacaaatacctgagcgagctctacaccaaaaagcagtcggacgtgctccagttcgtgtcccgagtgcgatgctgggagtactgacaactcgccatcatccaccgagcttcgcgaccctcgcgaccggacaaggctaggcgactgggctacaaggccaagcagggctacctcatctaccgagtgcgagtccgacgaggaaacaggaagaagcccgtcccgaagggtgccacctacggcaagcccgtccgacagggtgtcaaccacttgaagtaccagcgaggtctcaagagcacggcggaggagcgagtggccaggcgatgcggtaacctccgagtccttaactcgtactggatcaaccaggacggtgtgtacaagtactacgaggtcatccttgtcgacccccaacacaaggctatccgacgagatgcccgaatcaactggatcgccaacccggtccacaagcaccgagaggcccgaggtctcaccgccgagggaaagaagaacaggggtctcggcaagggatccaagttcaaccacaccccggcccgtgctacctggaggaagcacaacaccctctcgctccgacgataccgataaacgcctcgtctgtgctcgaccgctttctcgcatgttggaggaattggcgggcctggcgcgtttatggatgggtctgagagtctgggtgcggggatgagacgagtactggattgtacgaccgatggggagtgtgatgcatgatcaccgttttccg

SEQ ID NO: 19955 - DNA, 493 bp, Sorghum bicolor
  Clone ID: LIB5051-004-A1-XP1-E5
gccggccggtttgcgatcaaaccacaacttctatcacattttcaacaccaaatctaaattctctacgacttcaactccctctccataccaacaaccacaaacacattcaaaatggtctcttctcagcaaggctactccaacaccaccaccgacatgaagggtaacacccaagctgtcaacgaggctcagtccaacctccctctccccgagcagcattcccaacgatgctgtctctcgtgaggcgaaggaccactctggtcttgccgacacaactggcaaggactacggatacccccagaagaacgaccccagcggcaagcagtagagtactgtacgagaaggagtaataagatacccgaagcataatgggcgttttcacgattacgatggccactatcactgcgtttagtagccggactgcaagagcagtcttacgataatcaatgaatgaaatgaatcaacaagacaaaaaaaaaaaaaaaaaaggccccta

SEQ ID NO: 19956 - DNA, 567 bp, Sorghum bicolor
  Clone ID: LIB5051-004-A1-XP1-E6
gccggccgggttcataagaccttcactgtagctcccattgtccgcttccccacgtcaccatacctacacaatgatcgcgcaatccatcagggcctcgcgccaggcgcttgtccgagttgcccgccagcagcctgcctttgtcgctcgccgcactttcatcactccctcggccgtccgatcagccgacctagtgcaggacctgtacctccgcgagctcaagaactacaaggttcccgaagtcaaggccggcgacgctgagggccacgtccagaagttcactgtccccaaggcccccgcttcccccgaggagaccgacatcgcgaacgagctcaaggcatacgagacacaggcagtcgacgttgagggcgctcagggcgaggacgacgctgtgctgccccaggaggactggttcgaggaggaggacgagagcattaccacccctggagccactcactagagcgctgctgggtgagggaagccatgtattaaaatactagcgactgtgccaataccattgggcgatgaacccaactgaacctcgaaaaaaaaaaaaaaaaaaggccccta

SEQ ID NO: 19957 - DNA, 587 bp, Sorghum bicolor
  Clone ID: LIB5051-004-A1-XP1-F3
gccggccgtgtccagaaacctagctctcccgacctctcttcgatacacagcctcctccacacaccgcaaccatgtcttggcaaggatacgtagacaccaacctcgtcggcaccggcaagatcagccaggccgccatcatcggtctcaagggtggtgtttgggccaccagccccgactttaaccttacggccgaggagcaaaaagcgataatcgccggctttgacgacccttcgggcctccaagctggcggcgtccgcgccaacggcaaaaagtttttcacgctgggcgtcacacaacgcaccatttacggaaagcaaggcggtgatggccttgtggcggtcaagacgaaccaggcggtgctggtgtgcgtctacgtcgcaccgatcgtgcccggcgaggcgaacaaggtcgccgagggtctcgcggactacctcgtcagcgtcgcatattgagctagacgctacaggcggcaaagcacccgcgcgtttaggacaggcgttttcgattcgcctgccaagcgcactggagacgaagaaatgacatatcaaatacaagatcgagaaaaaaaaaaaaaaaaaaggccccta

SEQ ID NO: 19958 - DNA, 419 bp, Sorghum bicolor
  unsure (1)..(419): unsure at all n locations
  Clone ID: LIB5051-004-A1-XP1-G1
gncggncggttttcaatcatcaaaanaagncttcaatttttctactacactacactttccttcaaaccaaaccaaccaaccaccccaacactcaaaatgtctgctcccaacgccaacaaccccaacgagggcatcatcggncaggccgtcaactctgtcaagaacgccgncaactacgtctccgagaccgaccagggccagtccgctgaggcctccaaggagggcaacaagcagcaggccaagggcaacgtccccggccaggactccatcaccgaccgtgcctccggtgctctcaacgctgctggtgacaagatcaaccaggagaagcacgagggctccgccgaggccaacaagcgctccatctaagtactaagtacttgaagactggtccgacatttctcttccattcagaacgatac

SEQ ID NO: 19959 - DNA, 741 bp, Sorghum bicolor
  Clone ID: LIB5051-004-A1-XP1-G10
gccggccgggtcgcaaaggagagatagtcaccacatattcttggagttccagctaccaaggaagatcacccaatacgtcaagtaaccactcgggtaaaaaaaatcctcattcatctggatctatcaaagcccaatcccgcgcgcgcgacaacgtacgtccacccacgccggatcacaattattccatcgcaacttccaagaacaagaacccaacaccagcacatcctaattacctttcaagcccatacaaaccaaaacccacaaacaccaaaaatgtccgctccaacagccagcaccttcttccgcgtcaccctcatgcgctccgccatcggtctgccgcgcagaaccagcggcgtcctcaaagccctcggtctgcacaagcgcatgcgcaccgtctaccaccccgtctcgcccgacatcgcgggtcagattttcgccgtgaaagagctggtcgacgtgcaagaagtcgatcagcgcttgacgaattcggagatgaaggagttgaggaagccggatacgggcttctgggttgagaagagggtgagggatgctaagaaatgagatggaggaagggctttggtatcctgagacgggagagggaaagggattgtaaaaggcatatttcgaggtgttctgggagttttgtttctgctgggtgggtgtactgatattgcatggaggatggagcatgtgaagagaggctttggcgattctggcaggcatgtcgcatggagagagact

SEQ ID NO: 19960 - DNA, 753 bp, Sorghum bicolor
  Clone ID: LIB5051-004-A1-XP1-G4
gccggccggttccatcacttcttctacgttcagcccacttatcgcatggtggattcatcattccggtaatttcaagtggacggccgccactggtgtaccgattgtcctgctcggtaccgctctgttgattccattccgaaacccctccaccaaccctggtgtccttgctttcactcaaatccttgttggtctcggaacggccttcttcgccacctgcggtcaacttgccgtcatggttcccgtcactcaccaggaaatcgctgttgtcaacgccatctggggtctctttggtagtttcggttcttccatcggatacgccatcgctggtgccatgtggaacaacattcttcccggacaattgctccagcgtttgcccgagtctagcaaggcggactacaggactatatttggctccatcacagtacagagttcgtttgctgatggtacgccggagcgtgatgccattgttggtgcttacgccgatgtacagcggaagatggttatcacgggtgcttgctttgtgccactgtgcttggcttgtatctgggtgtggaagaacaccaacatcaagaagctcgagaaggaggagggcaagcagaccaagggtaccgtcttctaggcggttactttcttggttctatgagatgctcagcgcgactcttgcaaggagcgtcagtccaactctctaactcgtcgtttcagataccctcatcgctaagatgatttaaataatactatcgtttcacacttttg

SEQ ID NO: 19961 - DNA, 605 bp, Sorghum bicolor
  Clone ID: LIB5051-004-A1-XP1-G8
gccggccgtttcgggcttctcactctatcctctctctctgagtcttcgcccgaaacggacagcagcgatggtgacggccgcgaacaaggcacggcggcgacgctcccttccactctcctccccctccctctctcctggtattgcagcatgtctgtcgagccccgacgccgcgtcttcaccacgcagtgcgctcctgggcgacagcgcagccaatctggtgcgcgacgacgcgtgtgtgccccggcggcggccgccccccgccacagtgcgtagcatggctgccagcgtgcctgccccatggcgatggccgctcccgctggtctgcgtgagctccatgagaccctaactctctgtgcttgacacctgcgctgcaaccgtaacctactccctcttctagtctgcatcggagcacagacatggggagctgccggtgtcgtcgacttgctccgacccctcctgctcctactcaacaccctctaggtttgggatccttgcagtgtgaagaatatttttttccctcatgttgtgcaacttactttgacattgcaatcctattaagataacgtcgaatggttgtttaaaaaaaaaaaaaaaaaaggccccta

SEQ ID NO: 19962 - DNA, 625 bp, Sorghum bicolor
  Clone ID: LIB5051-004-A1-XP1-G9
gccggccgggtcgcgactgctctgcgttcacccccgcattgtacctcacccccgatctagattgaatcttggaagcggtgctgcacgatgggtcggagaccacggcggtggcatacgcgcggcgttgacttccgccagaatgtatggagcatgacggccgtgccctactgccgcccaaacgactgccgccgtaacaccgccatcgacatgttcggcgacttcctcatctgcatccccgtcgccatgacgttcgccgagctctagcatggacctgattacccagtccgagctgtcccatctcacctgtgctgcaacaactttggaaagaatgaatactgaaggaccttccgactagcatgaagcgcgtgcaccttgcttctgccttctttttgcgactactcgtgcttaccgataatgttgggtgaagcgtgaccagtcatacttctggaatgcttcgtgtagtgccttctgattctctttcttttctgtcaatcatgctatatgaggaatgcctgttgagctcaaataaactggagattcaaaagcctctgatgaatttacctgaggtgtttgaagctgtgattgtatgcatggcatgatgacctttgcacacttaatggtgcag

SEQ ID NO: 19963 - DNA, 450 bp, Sorghum bicolor
  unsure (1)..(450): unsure at all n locations
  Clone ID: LIB5051-004-A1-XP1-H1
gccggccgggtccggacaaaacgctcctttgccttccctttcccacttccccggcccctgcctcccgccgccgacagcccgacaccaccacaaaccctagcaggctccaccccccgccgccgccatgtcggaccctcggatgttcccgtccggttccgacgaccgcaccgacccctccgacaccgaacgccggctgtacaatccgtaccaggacctcaacatgccctacagttaccggacgctctacgacctgcccacctcgccggagttcctcttccaggaggaggccctggcgcagcggtgctcgtggggtgagaacctcactttctacacgggcgtcgggtacctctcgggcgccgtcggtggagccgccctgggcctctgtgacgtcgctagggtgtgtagagntaggggagaatgttaagtatttgtgttaacagtgtgtttaaa

SEQ ID NO: 19964 - DNA, 616 bp, Sorghum bicolor
  Clone ID: LIB5051-004-A1-XP1-H10
gccggtttcccaacacgtctgaccttgggcaccgttcagctgtgcgcgctttcatctcaaatcaccatgttctcgccctcaatatacaccgtcagcatattccagcttggactcacctccgccctcagcgcctacggcctctacctctcctaccaaaacataacccgcctacagcagtacgaagaaaagagccaaaaggctgcagaatggtcaaacacggctgcgcaaagactgcataagaccaggtcaacacagactagcggcactgtgacagtatgcttgaatcaccttcgaccgcccccagatagtactaacacgacaactctagctactacttagtttccttacatccaccgccctcgtcataatccccagccttgcaaccacgaaattactcatctgcgctggcgttgcaaatgctgcagctgcatatctctcccgtgtacatatggcaaacttctggaacgacaaaaaccagaccaaaatcccgtttgtcgaaaaattcaatgaagcgatacgaggaagcgagctcgtggtactgctactcggtacgttgagtttggcatgggcggttgcaggaggagtatggacgggtatggctaatggcggatcggga

SEQ ID NO: 19965 - DNA, 751 bp, Sorghum bicolor
  Clone ID: LIB5051-004-A1-XP1-H11
ctcctcgacgcgatttctcctcgctcctcgccgccgtcgagtcgtcgcagcaacgatgacccggcggaacggctgtacgatctacgtgggcaatctccccggcgacatccgcgagagggaagtagatgatctcttctacaagtatggacgtatcgtggaaattgacttgaagattccaccaaggcctcctggttttgcttttgttgagtttgaggatccacgtgatgctgaagatgcaatatatggccgtgatggatacaactttgatggacataggttgcgggtggaattagctcatggtggacgaggcccatcttcttttgaccgatctagcagctatagcagtgctggacaacgcggtgcctctaaacgttctgattaccgtgttatggttactggattaccttcttcagcatcatggcaagatctcaaggatcatatgcggcgagctggtgatgtctgtttcactgatgtgtatcgtgaggctggagcaactattggaatagctgattatactaattatgaagatatgaaacatgcgataaggcagctagatgattctgagttccgcaatgctttttcacggacatatccgggtgaggcggtatgatgctaggcgcagccgttctccctccagagaagaagtcggactcgctctcagcggacgaagccgaacccgtagcccgctccacctccgaaagcagaccccgcacctctcgccaccgcccgacccccccccctccccccgctt

SEQ ID NO: 19966 - DNA, 676 bp, Sorghum bicolor
  Clone ID: LIB5051-004-A1-XP1-H4
gccggccgtttcaaactaccctcctagctctctcgttcccgttcctcttctccggcgattcggggatagttttcgccggggggtgcctagaaatcagccgtcaggtgaaccgggaggagtggtcgcctgaggaggaggaggagatgatcacgcgagcgaagctggtggagcagcttcgggagcaccagatccggtcggtccagtcctaccccgccgcgctcgccgtcttctcgccaaacccccacatctcctccaggagagatctcaaggttgctctcatctatgcggtcttgttttgttttctcatggtgtcctgctacgttggcctttacttgaaatggttcagactttcagccatgtttgtaattttcggaatccttcttccagtaagcctcaaaatctctaggcatagaaggctgaagaggaaaagagagaggagattgttgttaccactgtccatgtgaatatatttttgatatcttgtaacattctagtgaaagttggccaactacagataggaaattgtcggcagattaactcaatttacagccccagcttacactttccaaaatgttgtatgcatcacctgttgtgctattgcgcacatgtgtgtacatatatgtgtgtgccgacactcgagtttttttgcccaaaaaaaaaaaaaaaaaggccccta

SEQ ID NO: 19967 - DNA, 624 bp, Sorghum bicolor
  unsure (1)..(624): unsure at all n locations
  Clone ID: LIB5051-005-A1-XP1-A2
gccgngccgggtcaaagacggcgccggccggagaaaaactcgccgccctggctatccccgccaaggtccgcgccgccctccaggctcgcggtcagctcctcatcgagagcgacaccctcacccccgagatgctcgccaagaccgatgtgctctactgcacccgcgtgcaaaaggagcgcttcgaggaccccgcgctctacgaggaggtcaaggacgctttcgtcgtcgacggcaagaccctcaagcaggccaaagagagcatgatcgttatgcaccctctgcctcgcaacgctgagctcagcaaggaggtcgacgacgaccctagagccgcttacttcagacagatgcgctacggcatgtttgtccgcatggctctcctcgccctcgtcatggcgccttagacgggctcatcagacgaagacgaaggcggaagagcacgatacacgacagcttttccgccgtgcaatgcatagcaggacggcgttttgttcttttcttataaccaccgttctcttttatccttttacgacacgcttcaaggcggtcatgttttcatcaagtagaaaatcatctgaaaaagttctgaatttgttacgtgaaaaaaaaaaaaaaaaaaggccccta

SEQ ID NO: 19968 - DNA, 664 bp, Sorghum bicolor
  unsure (1)..(664): unsure at all n locations
  Clone ID: LIB5051-005-A1-XP1-A4
gccggccgggttccaaaaacggattaatcgtcaataccgttgccatgcctaacgccactaagtccaacaagccccagggcaaggtcggccgcagcgccatcgaggatgtcgttgcccgcgaatacaccatccacatgcacaagagggtgcacggtgtccaattcaagaagcgcgctcctcgtgccatcaaggagatccgtgccttcgctgagcgtgccatgggtaccaaggacgttcgtcttgacccccagttgaacaagaaggtctgggagtgcggcatcaagggtgtccccttccgtctccgagtccgcatctcccgtaagcgtaacgacgaggaggacgcccaggagaagctctactcctacgtccaggccgtcaacgtcgccaaccccaagggtctccagaccgccgtcgttgaggacaactagattgtctcgcaactagattgatggacgagggcatgacggcgttactggcgcttgtcacggtggcaccccgtttgctatgaaggaaggacttgcggcgtctcgatgcgaccgtgcagaaactcgcggcgcagatgagacggacgtgcggagttcaaaggagcaacatctgctcaaatggtcatatacccccgatgcaatcgtcgaccacaaaaaaaaaaaaaaaaaagggcccctng

SEQ ID NO: 19969 - DNA, 705 bp, Sorghum bicolor
  Clone ID: LIB5051-005-A1-XP1-A7
gcggccgggatcaaataagttctagagttgtcctaaatacacttcacatattcaattccatcccataccgatctcacatatattcacaatggctcctctcaaggtcggtgactctctgcccgagggcgtcaagttcgagtgggcccccatcacagacgctgaccccaccgcctgcggccgtccccaggagtacgatgcctccaaggagtgggcgggcaagaaggtcgttctggtctccgtccccggcgcgttcacacccggttgccaggcccaccacctccccccctacattcagaagctgggtgagctgaagagcaagggcgtcgatgtcgttgccgtcatcgcatcgaacgactcttgggtcatgaacgcctggggcaaggtcaacggcgtcaagggtgacgatatcctcttcctcagcgacaccaagactttcttctccaagaactacggctgggctgctggtatgggcgacaggaacggccgctgggctatggtcttcgacaacggcaaggttacatatgctgaaaatgagagcaaccctggccaggtcaccgtctctggtgccgaggaggtccttgctaagttgtaaagacttcatgcgaggatgctgggagtctctagatgaaaggacatgagcgttcaaaacctcaaagcaatgctacaaacaaattcacacaaaaaaaaaaaaaaaaaaggccccta

SEQ ID NO: 19970 - DNA, 844 bp, Sorghum bicolor
  Clone ID: LIB5051-005-A1-XP1-B12
ctgtgcggcgctcaggcggcgtttttatttcgggctgtagaagaaaggaaataccagagatatcgccgacgctttcggccttcgccgagtctcacgccgaatccccccctttcttgcagtcaacttcaagagcccaaggccccaatttcccctcgaggttgggattttgtgggattcgccatgctcgagccgcagcgcgttcatcgcgacgccgacagcgatctccccgacaccgtgacctccccacttctcgcgcacccaccgtcgcctgatgagccttcgcctgcgaccgttggctcaccggagataaccgacgaggagatcgacgccgcgtccgccgcctgctgccgcatctgcctcgagtccgactctgagcctggtgatgagctaatatctccatgtatgtgcaagggaacacagcagttcgtgcatcgctcctgccttgaccattggaggtctgttaaggaaggatctgccttttcacactgcacaacatgcaaggcgcaattccatctacgggttgaatgtctggaggatgacatttgtcgtagaatgaagttccggttgtttgttgcaagagatgttatcgctatattccttgttatacaagctaccatcgcagccataggtggtatggcattttttttggataaagatggaagcttcagaaacaaattttctgatgattgggagcggtttctgtcaaagcatccagtgcccttttactactgtgttggtgtggttgctttctttgtactggttggatttattgggctaatattacacctctccctctacaacacaacgatccgtgcttggttggatcccgtgactggtgctttgg

SEQ ID NO: 19971 - DNA, 558 bp, Sorghum bicolor
  unsure (1)..(558): unsure at all n locations
  Clone ID: LIB5051-005-A1-XP1-B4
ngccggccgggctgcgacaccacaaaaacatcgttcgacatggtccgatactcttccgcccagatcgctgccggcaacccggagaagttcgccaaggctcgaggcgagtacgtccgaacgcacttcaagaacatgcgggaggtcgctgctgccgttagcggcatgaacctgcagaaggcctacgcctacctcgccgatgtccaggagcacaagcagatcatccctttccgacgattcgctggctccatcggccgagcctcgcaggctaagcagttcaagaccaccaagggtcgatggcccgtcaagtcggtcaacttcctcctccgtctcctcaacaacgccgagtcgaacgcggacgccaaggagctcgccgtcgaggagttgatcatcaagaacattgtcgtcaaccaggccccgaagaccaggaggaggacttaccgagcccacggtcgaatcaacccgtaccagggacacccatgccacatcgaaatcttcctctccaccccttccgccgaggtctcccgatcgaaggaccttgacgtcgctagctcgagcaag

SEQ ID NO: 19972 - DNA, 536 bp, Sorghum bicolor
  unsure (1)..(536): unsure at all n locations
  Clone ID: LIB5051-005-A1-XP1-D12
ngccggccgggtccaaaattcgccatccaccccagcatacttgctatctagcctgtttaagaaagccacgcccaccatgtcgcagtcgcccaaatggatctacaagatcttcccgcactcatcagtcgacccgcggtacaccttccccgtcccagtccccgcgtcgcacgagttcttcctcagcgagatcgactacaaggacggctttgtccatctctccacggcgaagcaggtcccaggcacgctgaaccggttcttcgcggacgtgccggccgtgacgctattgcggatcgagcatgagcggttggccgggttcaagcgggtcaggtgggaggaggcacacggcgactcgtatccacatctgttcgcacatctcgagggagaaaacgtcgagagcgtcaaggaggtgcatcgcaaggacggggagaagggatgggatgctgccttggcggacaaggacattgagcaatggcttgtgtaagttgtacaacgatgtatggtgcgcagagcaaaaaaaaaaaaaaaaaaggccccta

SEQ ID NO: 19973 - DNA, 546 bp, Sorghum bicolor
  unsure (1)..(546): unsure at all n locations
  Clone ID: LIB5051-005-A1-XP1-F2
gccggcccgggctgggnantaaaaaaaaaaaaaaaaaaaaaaaaaaaaaaaaaaaaaaaaaaaaaaaaaaaaagacccttctcactcgccatcactcaccctccaattctcttccaaacctcctctcctccctcccagcctcacctcacttcgggcatggtcttcactcttcttcagagtagagagaggacgaggagcagaggaggaagaagaagaagagcagggggcggcggcagcggcagcggcagcttcagcttccgccgatgtgctgctacgtgggcaaggccaccaagatcttcctgtgcctgggggcggcgctcctcgtcgcgggcctcgtcctcggcttcggcctggcccgccacacctggggagccgacagggcccagccagcagactgccgctggcccgactgccagcagcagcagggctccgcgtacggcggcgacccgctcctcccggccaccacgccgaccaacccgctcacgcagccggccgtcgccgcgtttcccggtgccactaccaccccgtcgtcctcctcctccgccg

SEQ ID NO: 19974 - DNA, 293 bp, Sorghum bicolor
  unsure (1)..(293): unsure at all n locations
  Clone ID: LIB5051-005-A1-XP1-F9
gccggcctggttccagtctctccggagacatccgataaaattggaanatacagcgcgttggtccctggccgctctgaagttgtcttataggtatgcccctggctgtgtattttcccttgcgcatatgcccttgtaacatttgtttcttggccctcgtggctctgaagttgtcttataggtatgcccctggctgtgtattttcccttgcgcatatgcccttgtaacatttgtttcttggccaaaaaaaaaaaaaaaaaaaaaaaaaagaaaaaaaaaaaaaaaaaaggccccta

SEQ ID NO: 19975 - DNA, 618 bp, Sorghum bicolor
  unsure (1)..(618): unsure at all n locations
  Clone ID: LIB5051-005-A1-XP1-G12
gccggccggngtccaaagaatgtgtgaaggtggtgactggtttgcaggtggatcttgccaacgcaacctgcccttatcgtcagaagaggtggaagattttttctctttggacaataacagcaccaatgtagaaacacgcttggtaaaccaacacttggtgaaggctcttgaacagtcaagtttcagagttctggacatcactcgcatgagtgaattcagagctgatgctcacccttcaacaactggcgggaaaaaacacgatgattgcatgcattggtgtttgccaggaccaacggacacatggaacgatttgctagctttgagccttgaagcagttgagagctagtctgagaaataaaactcaagagctcacctgaggaattatccctaacttcatttttttttccggaatatgagtatgaagtatgaatccactggcagaatagagtttttgctggaagctggttttagggcttttgctgcagcttgttaaatatagaggggagcattttccccacttgtattcttgaccctgtatattttaacatcactgtagagttccactgacgatatacaatgctatattcgaaggaaaaaaaaaaaaaaaaaaggccccta

SEQ ID NO: 19976 - DNA, 701 bp, Sorghum bicolor
  unsure (1)..(701): unsure at all n locations
  Clone ID: LIB5051-005-A1-XP1-G5
gccggccgggtccggaccatccgatcggactccagtcaatcaccatgccaccggaggaaaatcgggcctcgtggctgcaagcgacgacaaagttgtcgactatgttcaccactcgctgctgccgccgttggtgacaggccaccgtgatcacaagcggaagcggaggaagcacgatgcaaaagatgctcttcttcctcaagaactcaccgcgacatggtcgacgatcgacgctgaccgcggcggcacagagctcgccacacccacgggcggagcgcaccgcagccagagacgcgcgccggcggcagagaggacgggtgccggtggctcatcaagcaaggacgacaaggcatcaccgttcgtggctctacctgcatcgagcaaggcaatccgcgtcaagcactcatcgtcgtcgtcatcgttcgtcatcggcggtgacagcggcggcaaacaacattcggtcgccggcagcggcagctcaccgggagacagcaaccactcctattacgccaacaatcacgcagctgccactccgagttcttcttcgaggcggcttaccgtcttaggaccggntgccccgccgccgccgccgcaccttccggncaaggcgagacgaccaccatcgccgtccgccgncaattctgctgtcgtgccactgaaatcggacgaccacgacgagcgctttcgccgtggtgtggaggtgt

SEQ ID NO: 19977 - DNA, 670 bp, Sorghum bicolor
  Clone ID: LIB5051-005-A1-XP1-H12
gccggcccggtacataaacggcagtgcccgggcgccgttgacgcccccgcctcgtaagctcctagcggagtttacgacgtggtgggtcttggcggtgacggcgcggtgtcgacgagtcctcatgcgacctctttgacgcctcgacgaactcgaccaacccaccacgcaacggttccggcttcccccctctagttcccctcgtcacagttcagtcccccggctcgctttatcgtacatcgcaagtttgcaagttcgcagttcagcagttcaacatctccaatccgctttccgcttttcaatttccgaaaacatcatcatgccgctacttcggtcttcgctatcatctcgcctcggcactttgacccggctgtctctttcttctgttcatcgcttcatcgctccggcctggcatctcatcatcacatcatcgactcttttcgtattcatctcgtttgggtggtcgttcatcgtgggctggctggctggtagtagtcggtgggtttggcgcgtggaagtactccatatgggaagagtgcggtggttggtgctgctggtgccggagagttgtggacgggtggtggctggggagagtaagaggtacggtggtggagtaacatcaaagtatacagtaaatcccatctttgtaagataagatgcagaagtgaccatg

SEQ ID NO: 19978 - DNA, 611 bp, Sorghum bicolor
  Clone ID: LIB5051-005-A1-XP1-H5
gccggccgggttggatcctctcttcgataacccccgcagcgagaacctctgtcaaaatggcccctaccaccaagtccgccggcaagaagtctgctggaaagaccggccgcagcgccatcgccgatgtcgtcgcccgcgaatacaccatccacctccacaagcgcgttcacggtgtcagcttcaagaagagggcccccagggctgtcaaggagatccgcgctttcgctaagcaggctatgggcaccaacgatgtccgtctagacccccagcttaacaagaaggtctgggagtccggtatcaagggcgttcctttccgcctccgtgtccgcatctcccgtaagcgtaacgacgaggagggtgccaaggagaagctctactcctacgtccaggccgtcaacgtcaaggaccccaagggtctgcacacccagatcgttgaggatgcttagagtacttgcaaggataagcggaaagggtgatgtgcatatcaaaagcatggcgttccggcgggttgtgctgagtagctactacggatatctagagcgaaaggctggtgaaatgatacctcaatgacagatcatgccccgcaaaaaaaaaaaaaaaaaaggccccta

SEQ ID NO: 19979 - DNA, 624 bp, Sorghum bicolor
  Clone ID: LIB5051-006-A1-XP1-B7
atcgcttatcatcctcggtttgtgcatctcctccgccgccgcttgactcatccaatgccgcatctccttgtcagactcggaggagcacctcttctaatcgaaggccgacgctgagtgcggcccctacttacccgcagcgcgctggaaccatcggatacaacggcttcctcgacttcaatgtccgtctctgcaatgctgtggacgtctctacctcgaccactgaccaaacttcggcccacatacaagatgccacatttcttgccatacactgattcaacgttaaaaacgcttgagaatgttgatccttcgtcgcaacactgtgacattccctatgtgaacctcactgtttatccactgattgacatatcaaaggatgcatttgcgatccttcttacttcagatggcaacactagagaggatcttggactcccaactgatgagactcttgtggcccatcattaatgaatgtttgtgaagtgggaaggatcttgttgcgactggccagactgctatggatgacgagtagatctgcgccctgaccgatttgggcccgagtgacttccctgccttggaagacagaactactgtatctcacgagttactctggcaacaagaggtgtatca

SEQ ID NO: 19980 - DNA, 417 bp, Sorghum bicolor
  Clone ID: LIB5051-006-A1-XP1-C4
gccggccgggctgcgatacatcgaccgtcatcaacatccacgcggacttgtctggctatggcgacacggggtgacgatgggactatcggctcgcaggcgatagcaggcccgtcgaggacgccgccgacaccgtcagatccgcccccgtcagccgagataccaagcttcggcctgcagttcttcgagtaccgtcgcagattattcctcgcgggtcagactatcccggaaccgcccgtgactctcccagacacgtataccatcgcgctaccactgcccgacccggtcccaccgcttccgcgagccgatgtgcccagctcggcaataggccgcctggaagctctgctggatgaagatggagtgcaagagacgaatgcagcgtggagggccggcgtgccaggtgttcatgcccatttgaca

SEQ ID NO: 19981 - DNA, 805 bp, Sorghum bicolor
  Clone ID: LIB5051-006-A1-XP1-C7
gccggccgggctgcagattctcaacctttcccaccaaggtatatcatatcatgtcttctcaacccaagctgtacgtcctcttgaggaacaaagacttcccgcccggtggaccgattcgactcggttcgctccttaccgacgccgccaacccagagtctttggtggaaggctacacaccatcgataccgctgggcaccacaatatatcacgcttgggagaacaaccaccgcgacacaatcactaaaaaccactccacccagctagggctgtacaccaagttcctgcaaatcttgggcatcggcctcgacatttcggggaaacacgcacataccgattctacagatcatcaggcagagagactcgacaagcaatactacatcccaagcacagcagagtgctcagacattctgcaggaccgatcggtgcaagcatgtgtccagaaagcgaagttcagttgcaatgtgtacctggtcacgggaatccgcgttgccactcggggcgcgcagagcgagcataccgattccggcgagcgtgagttcaccacagatctgacgttcgacgcaacactgggtggcggtgttcctttgagtttcggtccgagtattgcacagtcaaacggtcactcggtccagacatcctccagccagtcctcgccgttcgtctacgcttatagagtcaaggaaattcactggtcgaaagttcggggcacaatgacgacgaaagacgtcaagggagagttgtatggcttgacgtacaagggtagcaatgaaacgactctgccgggaacggaagacgtgaccggctt

SEQ ID NO: 19982 - DNA, 551 bp, Sorghum bicolor
  Clone ID: LIB5051-006-A1-XP1-D9
gccggccgggttcggaagacaggtgtgagatggatcgcatccttctggagatggacagggtcctgaggcccaggggcacggtgatcatcagggaagacgtggacatgctggtgaaggtcaagagcgtagcggacgggatgaggtgggagagccagatcgtcgaccacgaagacggcccgctcgtcagggagaagatcctcctggttgtgaagacgtactggactgcccaggagcaggaccagtagcaggaggactgtggagtaaaatcctcaatgttgataagcattttacatgtttcgatttggatcgccatttctagctccttgagctggtgctctcttaactgtttgctgttctttttggacggtacttgttcagataggaaatttgtctcttattaaggtgtaacaggggtgaaaaatggaagggtaggtaaaaccccagacccctgcaaagcttttttttttcccccccttcaattgctaaattgtgccaagtggtaaatagaagtcattgttgccagacaaaaaaaaaaaaaaaaaaggccccta

SEQ ID NO: 19983 - DNA, 396 bp, Sorghum bicolor
  Clone ID: LIB5051-006-A1-XP1-F2
actgtgcggcgctcgaggcggccgggctgccactgctgtgttccttattactgagtcaactaactgtggcatgtatatgtctatgtctacctgtatatgtatatagaagcgaaaatgtatggaggggactttcttgcgctgtgtacagtagtgtgaacatgcagaaacaagtggagctggaaaattcaaggaagtgctgaggatgattcttcctacttggcagtgatgctatactatttaaagtttaggactttcttgccctgtgtactactactaaccaacatgctgaggactttcttgcgctgtttactatactccctcgggatcaaaaaagtgtatttcagattttatcccacttacactatttaaagcttgactaaccccaaaccccccccc

SEQ ID NO: 19984 - DNA, 745 bp, Sorghum bicolor
  unsure (1)..(745): unsure at all n locations
  Clone ID: LIB5051-006-A1-XP1-F5
gccggccgggctccaacccgcagcaaccgtcaagatgaagatatccactctgaggaagagctcgccatccccgagggcgtcaaggtcaccatcaagaacaggaatgttcttgttgagggtccccgaggcaagctcacaaagtctctcggccacttggcggtcagcttcacgcaccccaagaagaatgtcatcaagatcgagctccaccacggcgcccgcaagagcgtcgctactctccgaactgtccgcaccctgattaacaacttgatcatcggtgtcaccaagggatacaagtacaagatgcgctacgtatatgcccatttccccatcaacgtcaacctggagaagaacaaggagaccgactgctgggaggtggagatccgaaacttcatcggcgagaagctcgtacgaagggttgtcatgaggcccggtgttgaggttgaggcgtcgaagaaccagaaggatcagctcgagctgtccggaaactcgctcgaggacgtctcccaaggtgccgccgacattcagcaaatctgcaaggtccgcaacaaggatatccgaaagttcttggacggtctgtacgtgtcggagcgcggcaacatcgtcgaggacgcgtaaacggttcttgggagtacgggtttctttacgggcaatgagcatctatgaacttctctgcatcatatgcggntggcgcctgggggtctaagatcaaaaacgatgttcaaacaataacaccatgacttgatgg

SEQ ID NO: 19985 - DNA, 514 bp, Sorghum bicolor
  Clone ID: LIB5051-006-A1-XP1-F6
gccggcctggctgcgtagacatcagaatgggcgttaccgttgaatccatccaggccggagacggcaagaccttccccaaggccggcgacaccgtcgccatgcactatgtcggaaccctccaggacggatccaagttcgactcgtcgcgagaccgcggagcgccgttcacgacccgcatcggcgtcggacaggtcatcaagggttgggacgagggtgtcccgcagctctcgctcggccagaaggccaacttgatctgcacgcccgactacgcgtacggcgcccgaggcttcccgcccgtcattccccccaacgcgactctcaagttcgaggtcgagctgctcaagatcaactaagcgctccgcgcgaggtgaagcggtcgagagaccgttcttcttgaggaaccgtagacggcgggagcgaagaagcagaagacgaagaagtagataaaacatgcaggaccattcctgcgaaaaaaaaaaaaaaaaaaagaaaaaaaaaaaaaaaaaggccccta

SEQ ID NO: 19986 - DNA, 733 bp, Sorghum bicolor
  Clone ID: LIB5051-006-A1-XP1-F9
gccggccgggctgcatactaatcaagaaagagaatcccttcctcggatgccgctcccctcggctcgtctgcttatcctaggcgagaccctcacaggaatcaccatcaccctggactcgtacacctctgagaacacttgcaatgcgaagagactgatatgacaacaaccagaggatatccctcctatcaataaataactgtcttttcttcgaaacagctgctacaatgaccatgccttgcaaacgacaccatgaaaaaagaatgcactctcaacatgccgatctggctgcctcctctatcgacagcatcgtcacaggaaacgacgctcttatggaaccaacatgtgttgggaattcctcggtccctgctgctccaatcaactggctgacaaggaacgtgcattcactctgatgttgatgaacctatatagttccctttctcgaactaccaacctaaggcaggctcgaagcggtccagaacttgtctgaagaggcccggaattacaggagtcaactggcgatgtgataacttgaactgggaactgcagcgatactccgacaagcacgactgccatatcgactatcgcactgctgaaaaggatgacattgccaagggtaatacatcgatataaagcgttaccgataccacaagatctagagtttcctaccggtgcctcaatgaagatagcaacctgtggaacatcatcatgcacaattgctgcattgaccatgcct

SEQ ID NO: 19987 - DNA, 378 bp, Sorghum bicolor
  Clone ID: LIB5051-006-A1-XP1-G10
tgtgcggcgctcgaggcggccgggtcagattatttagtgcgtggagaaactcttccgttttacaatcccgtgactgcattgcctgagtgctgtggtaatccatgaatgaagtctaaaaaaagcaacataagctgtctgcatgttttagtatgtggtcttttgagttatgtgctatacttatgtaaaatgctgaaatttggcttatgcccctgcttatactgatttgttgtaaaagaagaaaaacattattcgttggttaaaaagtattgttcaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaggccccta

SEQ ID NO: 19988 - DNA, 729 bp, Sorghum bicolor
  unsure (1)..(729): unsure at all n locations
  Clone ID: LIB5051-006-A1-XP1-G2
gccggccgggttcctgttagaggatctatcctaactttctgccttttcctgaagaaggacaagagaaagagtagtgtccttatgagtgctcatggccacactggaagttcgattcaacaagtgcaatcttcgctcgataagaaagaggcgaaggtgaaggagctgttgaagaagaagaaagggtggaagagcaagacctggccaggcacaatggaagaggttcagctgctgttcgccctgatcgacatcaaggtcgtgtcaagggtgctccggatggggaagctgagcaaggagcagctgctgtggtgcgaggaaaagatgagcaaggtggacctgacagaaaaccggctgcgccgcgacgggtccccaatcctcttcccctgctgatgcagcctgcctgcctgcttgcctccgggggcatatgccgagacacctcccttgttagttcggcgtgccatggctgtggcggcatcatgggtggctgctggctgggcgtagctgctctgcgcggcgctcgtacccttccttcggctgttcggctaccttatgagattatatgtacatgcctttaggttgaatcggttgaaacgtccatactaaagtagggcttanacatgtgttgctgcgcgttcatgactgatgagtttatacaacgcaccatgcttcgtttcgccggcaaaaaaaaaaaaaaaaaaaaaacaaaaaaaaaaaaaaaaaggcccctagggc

SEQ ID NO: 19989 - DNA, 261 bp, Sorghum bicolor
  unsure (1)..(261): unsure at all n locations
  Clone ID: LIB5051-006-A1-XP1-G3
gccggccgggctgcgacctacgggcccttcggccacggcgacggcacgcccttcaacgtccccgtcctcaacaacggcagtatcgtcggcatgttcgctcgcgcggaccagtacctcgacgccattggcttctacgtcctccccttctgatttgatctgcagaagagaggcgccgcttgtgtttgttgtcggaataattaagagagatggtcatgcacacgtgcgtgcatatatggtngatgatcnnattgatccatgtgt

SEQ ID NO: 19990 - DNA, 709 bp, Sorghum bicolor
  Clone ID: LIB5051-006-A1-XP1-H1
gccggccgggttccgaactccaaatcctccctaaaaataagaacaagaggggagcgatcgagcgagcgtgcgagcgagggggttgtgcgtcagtcagatcaaccagccggcggtgaggctgcggggggagatgatggccggcgaagggaacggggacgaagggtggaggcggagcggcatcgaggttagcgccctgcagttcggctacgacgggcagccgccgctcttcgcgcgcttcaacctccgcgtcgcacccggctcccgctgcctcctcatcggcgccaacggatcaggcaagaccacactcttgaagattcttgcgggaaagcatatggttggaggaagagatgtggtccgtgttctcaatggttccgcttttcatgatacacaactagtgtgcagtggagatctttcgtacttgggtggttcttggagccgtactattggttcagctggtgatgttccgcttcaaggcgatttctctgctgagcacatgatttttggagttgatggggttgatcctgttaggcgagagaagctggttgatctgctagacattgatctgcaatggcgcatgcataaagtttcagatgggcagcgacgcagggtgcaaatctgcatgggtcttcttcatccatacaaggtgcttttgcttgatgaaatcactgttgatctggacgttgtgaccacaatggatctgcttgatttc

SEQ ID NO: 19991 - DNA, 617 bp, Sorghum bicolor
  unsure (1)..(617): unsure at all n locations
  Clone ID: LIB5051-007-A1-XP1-A10
gccggccggngtccatataagatgggtggctaagacagcgttcatggtcgtaggcgccgtgtcaatcatgaaggctgctggctacgagcctgtgatggggcagaacaccatcaagctggacatcgcgggtctgtttggtggtggtaagcaggtgaacagcggagaagagcaaagcgctcctctgcggtgccctcctggcaaggtgatggtgctcgagaacggcagggcgcactgcgtcgtgaaggaaagagtggagatacctttcgacgccgtcttggcgccgccaagttcaaggtacggtttaggctgaaatctgcgtgtgtgtgaatagtaggatgtagctctgtctgtgccctgtgggagctgcttagtagctggggaatggttctttgtaagacgtattgctgggagctttctttgtttgttccttccgcgtttgacgctgaacatgggcacgcatggagacgttgaagctatgtatcatgggaataaagcccttttgctcttccactgttgttgtggtgagctcttaaaaaaaaaaaaaaaaaaaaaaaaaaaaaaaaaaaaaaaaaaaaaaaaaaaaaaaaaaaaccccaaaaaaaaaaaaaaggccccta

SEQ ID NO: 19992 - DNA, 853 bp, Sorghum bicolor
  unsure (1)..(853): unsure at all n locations
  Clone ID: LIB5051-007-A1-XP1-A11
gccggccggngtcccaaaaacaaccaaccccacttcccttgtacttttctcagacttgtttgtcggagggccgttgttgaggtgaagaagctgcgcagagaaaatttgaaagagaaagaatttgagaatacagatcttctagaaacggatatcaagatgtcttccctctcccgtcgtgcatgctacaagtgtggcaacgttggccactacgccgaggtctgctccagcagcgagcgtctctgctacaactgcaagcagcctggtcacgagagcaacacctgccctcaccccaggaccaccgagaccaagcagtgctaccactgccagggtctcggccacgtccaggctgactgccctactctccgcatcagcggtggcgccgccaacggccgctgctactcttgcggacagcctggccaccttgccaggagctgccctactccgggtgccgctcccattgcccccgtcggccgtggcgctggtggccccttcagaggtggtttcgccggtggccgtggtggcttcgctggcggccgtgccaccagctgctacaagtgcggtggtcccaaccacttcgctcgcgactgccaggctcaggccatgaagtgctacgcttgcggcaagcttggtcacatctcacgtgactgctccgctcccaacggtggccctctcaacgctgccggcaagacctgctacaggtgcggtgaggctggccacatcagcagggactgcgctcagtccgttgacaccaccggcgctgcgcccgtcaacggtgaggccaacgcaacccccgctgccattcccaacccncgagctgtcgccgtcccagtcgctcctgtcgtcccgaccctgc

SEQ ID NO: 19993 - DNA, 474 bp, Sorghum bicolor
  Clone ID: LIB5051-007-A1-XP1-B10
gccggccgggtcaagaagggagcaagtgcagcccctttttccgatgccaccctgaccttgacaatgacacccttttaacccgctgtgctgccctgcaactgcggactgttgacttgatcccctaattggcattcccatcttccctctgcagtgtgtgtgagctgccatatatcatctagagtcgcggcatgttcctataggcgactgcatccgaccttgctggaaacactcattatgtggactgctgtgtatgccttgtgtagatcttcccgagatcctccgcaatttcatccactgtcagtctgtgccgtgattcgtcatactgaagacaggatgcactgatgcatgcgacctgccccctgctctgtgggcacgtcgatcgtgtgcgactttgtttgtgctctgtcaccatccatctattacctataatatcccccgtctttgtgcaaaaaaaaaaaaaaaaaaggcccctaa

SEQ ID NO: 19994 - DNA, 834 bp, Sorghum bicolor
  Clone ID: LIB5051-007-A1-XP1-C8
gccggccggtttccgtaacgcagcatttgcacctcactctccatcatatcctccacaccttatcccagttgcaccaccatggctccccgtgtcttcctcataactggatgctctactggctttggcgacgagttcgtcaaggtcgttttgcaaaagggtgactatgttgtcgcaactgcgcgcaactcttccaaactatccttcgatggtgccaacgactccaacagtctgcttgtggacctcgatgtaacaaagagagaatccatcgacaatgccttcgacgcggctattcagaaattcggaaaaatcgacgtcgtttgcaacaacgccggatacggtctcaacgggccttttgaaacgttgtcggaaaagcaaatcagacagcagatggagatcaactttttcggtctcatcgatgtcacaaggaaggccatggagactatgcgcgacaggaagaccggaggtgtcatccagcaagtaacatctattggtggtcagattggcgtgcctaatttctccatctactgtgccagcaaatgggcagtcgaaggattcacagaggcaatctccaaagaagtgaagcctgagtggggaataaagttcacttgcatcgaacccggtggtttccgaaccgactggtcaggtcgtagtatggactttggagagatctcaaacccggcatacgcggacgtcgacccaaagaagcaggctcaagggcgccatggctcccaagcaggagatcccgccaaggctgccaaggtcttctacgatctagcagtcatggacgatccgcctatgcggtgcgtagtcggtaccgacgcgtacagtctcatc

SEQ ID NO: 19995 - DNA, 842 bp, Sorghum bicolor
  Clone ID: LIB5051-008-A1-XP1-A11
gccggccgggatcataacaagcggaggcgctgtgtatctcttccccctttggcctcctcttcctctagcgaagacactccccccgaatttccttcgtgcggagcgcagcgaatgaatggcgaatggatgttgtcaacgaaatatactggtcacatttccaggtaaatgtaatgctccccagaatcttcttgtaaccaatgctggctcaaatacggcaaactccactctatagaacgaaagaataaacctcagacgctaccgacctgtagatgctgcccgccacgagatccacaattaccagaacgagaactgccatgctgatcaggaaaatgcccttcatcagggttgtgggcaatatgacaagacttccctactgatctgcgttgccagagccatggccggattgccctccatcgaggctgctgagggatccctcgatgtacagcttgacgacacaaacctgtgcaccatgcatgctaaggaagggaacatcatgaccagagcacattcatatggcaatgacgatcgcaggcgagaggtgctaatccccccctcaaatcattgtgactaaagtgaagccatgtgtcgcatcaatgaatttaatcctggtgacgtgtgtcaacgacatatgtagttatggttatgttttgtaggaacataagaatctctactgccgcactatgcgatgctgctacctttgctggcgatattactagagacgaatgcttagattgtctagccatgtaatgcgctgacaatctgcgacgtggatgcgatgtaggcactgactagtactgatgtctgcgctgctggatcttgcgccatcatgctgaggctgattt

SEQ ID NO: 19996 - DNA, 231 bp, Sorghum bicolor
  unsure (1)..(231): unsure at all n locations
  Clone ID: LIB5051-008-A1-XP1-A2
gccggccggngtcaaaaatatttagcgatatatgagacttgtcacaccaatgggcccattgcatnngggactgggaaacaaaatatttttatacacccaatactattgtaaaaaataattaatcttgtaatcttacaacacattggctgagttatattgttttcaacatgtaactgtattaataaaaggttaacttttcaatctgaaaaaaaaaaaaaaaaaaggccccta

SEQ ID NO: 19997 - DNA, 405 bp, Sorghum bicolor
  Clone ID: LIB5051-008-A1-XP1-A3
gccggccgggctgcgagaaacgatcaagcaacagaaccactccactctttcaattatcaacccaaactttcaacctctcccaatacacatcaaaatgaagggcggctgcggaaactctggatgcacttgcgccgactgcggctgcgcaccgggagcttgcaactgcaactaaatccatcctctcgacaatagttcttactacgcgccacgacggccttcgatctgacgcctgtccttaacgcttgacaatttcacactgaagtgcgacacagtaaccataacggtatcgagtatcacactgtcgttgacgaagaacaaaatatggtctggattacaggatgcagatttgagtaaacaataaaaaatacatggcttcggcaaaaaaaaaaaaaaaaaaggccccta

SEQ ID NO: 19998 - DNA, 682 bp, Sorghum bicolor
  Clone ID: LIB5051-008-A1-XP1-A6
gccggccgggaatcaaacacctacagcaagaacttgtagtttcagtctccggtcccgacggttaaatcgattgaactcctgttcctacaaatcaccaaaccacaatcacaatgaagcacctcgcggcatacctcctcctcggccttggtggcaacacctcgccctccgctgccgacgtcaaggccgtccttgagtccgttggtatcgaggctgactccgaccgtcttgacaagctgatctccgagcttgagggcaaggacatcaacgagctcatcgcttccggttccgagaagcttgcttccgttccctccggcggtgccggtggtgctgccgcttccggtggtgctgctgccgctggtggctccgctgaggctgaggccgctcctgaggccgccaaggaggaggagaaggaggagtctgacgaggacatgggtttcggtctcttcgactaagcgcatcaccatcgccaaacaaacaccttcacctacctttacgaagtatgatccggccaatctctcgactatcacgagaatcatgcgcaatgagaacgatttggggagtgtcgagcgtgcactgcaaggggcttggagaaggataccgcggcaatagtagaatagttgcctgctgagatacccggaatgaagccatgcacctccaaaaaaaaaaaaaaaaaaggccccta

SEQ ID NO: 19999 - DNA, 610 bp, Sorghum bicolor
  unsure (1)..(610): unsure at all n locations
  Clone ID: LIB5051-008-A1-XP1-B5
gccggccgggtctcgatccgccgcgctgatccactcagacttcactttcatcatctctgccgccgcccgccgctttcgcctcctcggcctctggtgactgagggagaggccgagttaatacaacggctcgacgacgggtgtccagtaggcgggccggagcccgcagatgattctgaagcactggatctacggggtgatggcctctctgacgctgcgccagaacgaggtcaagatcctcttcctcatcctcgacaacggcggtgataccacgctcctccacatgctcaatgatgagacattgcgccaacatcctcctacacagtattcttcttctngatcagctgaggatctggcaacatctaccctcaagggcatttgcattctaccgacgcacatcatgattgctcgccagtgatctggaaagattactacttgcttaggcgtgatgcacctgtcctacctatgcggatgcctatgacgaagagacgactagctgcaacaaatgatcgagctagatgccactcctatcacatgactccctggacgctgtctcattgctgatactgtggaacaagatcgacatcccttatgccgcttcagacgaggaact

SEQ ID NO: 20000 - DNA, 568 bp, Sorghum bicolor
  Clone ID: LIB5051-008-A1-XP1-D3
gccggccgggctgcgaagcttctctccaactagtccaccacaaccacctacatctctatacaccctttacaaactacacgtattacaaccaaaatgccaggagccaagtacacccagacctaccaaaaggtcagcgccatgggcgagaagctcaaggcggctggcaagcagggtcctagcaatgacgaacagctaaagttgtacgcgtacgccaaggtagcagagggcaaagacatcaacgacgccaagaagcctggcatgtttgatcttgctggcaaggccaagtacaacaagtggaaggaggtcgtcgacgccggaactacgcagaagcaggccgaggacgagtacgtcaaggccgccgaggagatactggccaagcacgacaaataagcgtcgggtgatcggagagacactcgtgagactttagtatcaccatggctgtgttatgctatatataatcttggaaagtacaaggacaacaaatgcttccatcaacgtgctcgtatggtcagtgtactagtacgctgctagcgaaattgcccaaaaaaaaaaaaaaaaaaggccccta

SEQ ID NO: 20001 - DNA, 522 bp, Sorghum bicolor
  Clone ID: LIB5051-008-A1-XP1-D6
gccggccgggtctggaccggctataccgcgaccagatacacctgcgcaccccttccacccaccgcaaaacacacacataccgctcgaaatggcgcccgtcactttctgggcagcgccccgccaatacatcaactgggctgcgcgccacaagcccgccattctctggagtttggtcattggcagcttcggccctctgattgtggccgttgtccctcctctccgcgagcgcctcggcgaccccaacagatccgcgatccctctcacataccctgtccccaagggcccccgccagataccccaaggctacgacgattaagcgaagaatgtgcgaaagaaagaacaagatttagagcgaaggtcatcgagaaggcagcagaggagtattggcgcacaagagaaatggtgcaagttcactaaggccacggaaggccattaccctgtatattgtacatactccgcattaaagccataagaaatgcagagatgatcgcctaacaaaaaaaaaaaaaaaaaaggccccta

SEQ ID NO: 20002 - DNA, 554 bp, Sorghum bicolor
  Clone ID: LIB5051-008-A1-XP1-E6
gccggccgggctgcggaccaacaccacccaaacccttctcaccacccccccaaaaaccgtcaaaatggagaacgaccgcggcgagcttgtcgacctgtacgtcccccgcaagtgcagcgcgaccaaccgcatcatcaaggccaaggaccacggctccgtccagatcagcatcgccaaggtcgacgagaacggccgctacaccggcgagaaccaggtctacgcgctctgcggcttcgtgcgcgcgatgggcgagagcgacgactgcatgaaccgcctcacccagagggacggctacctcaagggtgtctggaacgcgagcggaaactagatttgcgattgtgttgagcaacttttttctgagggaatgcgggaatgattgggatgagaggagtttttagagacgactgcacgctgatgcctttgatggtacgggacataacaaaacaatgggctgtgtgctcagcgcagccgggctcaacttcgattccgactttctcgtagctctgcaattcaaacctaccgagtccgaaaaaaaaaaaaaaaaaaggccccta

SEQ ID NO: 20003 - DNA, 489 bp, Sorghum bicolor
  Clone ID: LIB5051-008-A1-XP1-E9
gccgcccgggtccagactactcacaatggcatgccctattcaaaccccgtataggggccctttcccgtatagcgtcagttaaaggaatcagatcgagcgtatagggtcgtcatgcctcagtcgcaggaatcagggggaggtatcagatatttttttttctagaatcatacccgtacgtgcgacggggaaaagattttatgtgtgtatcatattctgttcttccaagttttgagacgattgtatctactcaaacattgttttttggtttagttctcttgacacctattattgatacaggattaggtagtacaggtgctctttgattgacaattacaatttatatctctaaaaaaaaaaaaaaaaaaaaaaaaaaaaaaaaaaaaaaaaaaaaaaaaaaaaaaaaaaaaccgtccaaccgggagaccttgaagagaataaaaataggtaaaaaataagaaattgcaaaaaaaaaaaaaaaaaaggccccta

SEQ ID NO: 20004 - DNA, 341 bp, Sorghum bicolor
  Clone ID: LIB5051-008-A1-XP1-F1
gccggccgggttcgggattggaatgtcttggaggggatgtgcgtggtgaagcagcttgaatctcaagaaaccaagaggtccgatactcccaagcagccctgtcgaatcgttaactgtggcgagttacccctggacagctgagtgaagtcaatagctcagttttggggataattagttgaagaggaagtgccgataattttttttattttcagtgaaatcctcttgctgagtgtgaacatgagtctctcggagtcttctcttacgttagagcatcgacgcccattcggtggcatcattcagtcaattgagttatatatgcgagatacgcgccatgatgaaac

SEQ ID NO: 20005 - DNA, 271 bp, Sorghum bicolor
  Clone ID: LIB5051-008-A1-XP1-F2
gccggccgggctgcgttgtcgatgagaacgacgaggtcctccttgctggtttcggtcgtaagggcaaggccaagggtgatattcccggtgtgcgtttcaaggtcgtcaaggtttccggtgtcggtctgtccgcactgtggaaggagaagaaggagaagcccaggtcatagaggactcgtctgcaaggagtcaaggaaggaaacgaacgtggaccacaagcccgccatgaacgaatgatggaatccgcggatcactatgggaggttaccgga

SEQ ID NO: 20006 - DNA, 354 bp, Sorghum bicolor
  Clone ID: LIB5051-008-A1-XP1-F3
gccggccgggcttgcaatgtgtgaatgctgttggctctgatgaatctgcagcatcgatcactttcttgagttattaggagcacctcttcatggcttgccagcttatttacttgtaataatatgatggtgaaagtaccggttcatatgcaaaaaattgaacctactatgtatgataatcctctagatgcatgcagttagttctgaatctgcagcatcaccaacacctgaggtgtggtgtgggtgtggtgggagtgggactgttgagttggaacttggaaccatctgccatctcattttcttgtaataataatcatatggattgtgaaccaaaaaaaaaaaaaaaaaaggccccta

SEQ ID NO: 20007 - DNA, 823 bp, Sorghum bicolor
  unsure (1)..(823): unsure at all n locations
  Clone ID: LIB5051-008-A1-XP1-G7
gccggccgggtttccaaagacgccaattataactcatctntgtttcgacattacacaccaaaagaaaccacatcaataatcaccatcatcatgtcaaatcaagcagcgtggatcccagaagcgaagggccagcttcaggtcaaggaagctcccatgccaaaggcgggcaagggcgaggttgtgatcaagaaccacgcagttgctgtcaaccccgtggattggaaaatccaggactatggaatcttcctgcaaaagtaccccaacatctgtggtactgacgtcgctggcgaggttcacgaagtcggtgagggtgttacacatgtcaagaaaggcgaccgcgtactaggacatgcattttccctcgttaccaacgaccctgcgcacggcggattccagctctacaccgcctgcaacgcactcgtcgtatccaagattccatccgacatgagcttcgcgtcaggctcagtcctgcctcttgccatttcaactgcagccgcctgtctctataagaaggagacgctcgggctaccgctgccatcctccaatccctcgtctacaggcaaatcagtattggtatggggcggctcgagcagcgtgggtgcgacggcgattcagttggcggctgcatctggcgtgaaggttgtcagtgtggcaagcaagcacaacctggagaaactcaagggccttggcgcaacagcggcctttgactacaggaccccaaggttgcccacgacatcatggtcgctctcgaaggcacagaattcgcgggtatttgcgacgccatcggtacgccagatgccgcggctgcctggacaccagtgta

SEQ ID NO: 20008 - DNA, 720 bp, Sorghum bicolor
  unsure (1)..(720): unsure at all n locations
  Clone ID: LIB5051-009-A1-XP1-A11
gccggccgggtttcgnggaaggtggaggccgtggcgttgaacgagagcaccgggtacggatccgccgccgtgctgcgcgggagcagcgccgttgacgtggtggcgttgcaggctaggaggatcgggcagtcgccgccgccggagaagccgaaagggtacggcaccgtggtgctgccgcactgccggttgcacgacgacgacccggcggcgggtgcggagaaggttgcatcggggaggaagaggaagaggaagaggaggaggtgcaagaagaggacgagctggtgcatgtaggcagcagcccgtgagccagttcactgtgctggtcgtcgtctccgcgagctctttactcgcgacaagttcaagtacgtagtagtgatttggttgcttgcttagctagtcatatacgcctgcaacatgccaatggagggagagaggtgtcatccatttgcacgatcgatgtgaccagagcagagggaggaagaagaaggagaagagaccggggatgattggaattgagaaagcaaagcttgtttaatcagtcagtcagtcagagaggacgtgtagtaaatggtcaagaaaatcctgaaaaaaccatatcttttggggggcatcagtctgaattctgattccccgagttgtttttgctgtaatcttgacttgacgacgcggagccgggtcacctgcaatctaacgcaaaaaaaaaaaaaaaaaaggccccta

SEQ ID NO: 20009 - DNA, 341 bp, Sorghum bicolor
  Clone ID: LIB5051-009-A1-XP1-A2
gccggccgggttccgcctggaattcgaacggcactctgcccgccaacatcaccttgggcgctgaaaactcgacctttggctactcgttgacgaccgagaacggcacctacacccctgcccagtcggccagccccatcaccaagcgcaacgttgccaacatcaaggcgcggtgggtcggccagatctaagcgagatcggagaagaagagatatacccatatacaagtatagtatagacacgcgtacacgtagctgtcgacatatcctcagactatgtagcgaatagacgaccttagcatgcattacgtccataatcaaaaaaaaaaaaaaaaaaggccccta

SEQ ID NO: 20010 - DNA, 618 bp, Sorghum bicolor
  Clone ID: LIB5051-009-A1-XP1-A8
gccggccggttcggatcacctctctcctccatcaatgagaagcttccttaccccttccaccgttcaacgcgcaacaacccgagccttttctacaaccgcacgcatcatgggtgtccagaagaccatcctctcagagggcaacggcccctccccacagaagggcgacaaggtcaccatggaatacactggctggctcaagactagcaccggcgacaagggcaagcagttcgacagcaccaccggccgcggtcccttccagacccccatcggtgttggtcgcgtcatcaaaggctgggatgagggtgtcgttcagatgaagctcggcgagaaggctaagctcgacatcagcagcgacttcgcctacggctcccaggagttccctggcttgatcccccctaactctgacctcatcttcgaggtcgagctcaagaagatcaactaagtccacgaagcaaccgatcacggatagacgtaatagtcgccgttataaacgttgagatagtaaagggaccagcataacattcaatacatgaagttatgaaacctaaaaaaaaaaaaaaaaaaaaaaaaaaaaaaaaaaaaaaaaaaaacccccaaaaaaaaaaaaaaaggccccta

SEQ ID NO: 20011 - DNA, 842 bp, Sorghum bicolor
  unsure (1)..(842): unsure at all n locations
  Clone ID: LIB5051-009-A1-XP1-B8
gccggccgggtttgggaaaagcttcaaactccaactagcaagccaagcgaagcagatcaaaaggactgccggcggagcagaggtacccttctttctcttattactactttgtgtcagtacttaattgtccgttttagcttgttcactgtactagttgtttctggtttcttgatatagggggcatctgccttccctttcttgaaaacggtgattgttcgttgctctgattacagcataagggcttgtttagttctattttttttttacaaaatagatattgtagcacttttgtttatatttgacaaatattacccaatcatgaattaattaggtttaaaagattcatctcgcaaattataaataaactgtgtaattggttatttttttatctatatttaatactttatacatgtgccgcaagatttgatgtgacgaggaatctgaaaatttttgtaaaattttttggaaactaaataaggtctaaacgcagcgtggtttctttggtaatagagccaagtttatggtttattaatcattgcaggtgtcaatcaagtgcatcatgcgtcattccaaaccgccggcgaaactcaccatgcatggttgcggtgttgcctctgttactgctgtgttatggagtcggcaacgtccattgcgcgacggttcatgaaaacagagaagattttcagtcattgctcgagttcaagaacggcaccatcgatcgcaatggagtcttgagcaattggaactcgactaaccacttctgtncgtggtacggtgtgaactgcactaccacgccaccatatcgcgtcgtgtatctcaacctcacaagccaaaacttaggc

SEQ ID NO: 20012 - DNA, 399 bp, Sorghum bicolor
  Clone ID: LIB5051-009-A1-XP1-C1
gccggccgggttcggacctctactacatcaccaaaacacatcccggcaaaatggagaacgacaaaggtgtcctcgttgacctgtacatcccccgacactgctcggccaccaaccgactgatcacggccaaggaccacgcctcgatccagatccaagtcgccgatgtcgacgccgacggcaaggccatcaagggcaagtccacgaccattgccatctgcggacgaatcagggctcagggcgactcggacgactcgatcaaccgaattgctaccaaggagggtctgctgaagaacacctggacctactcccgctagattgggcatacgtgtacgattgggatgtatgcagctggatcatgagaaaaaaaaaaaagaaaaaaaaaaaaaaaaaaggccccta

SEQ ID NO: 20013 - DNA, 744 bp, Sorghum bicolor
  Clone ID: LIB5051-009-A1-XP1-D11
gccggccgggtcggggacataccacccgacccgcaaccatggcgaccgaactcactgtccagtcggagcgcgctttccagaagcagcctcacatcttcctcaaccacaaggtcggcgggccccgcaagaacacccgcaacaggagatggtacaaggacgttggtctgggtttccgtacccccaagaccgccattgagggtacctacatcgacaagaagtgcccattcaccggcatggtctccatccgtggccgtatcctgaccggaactgtcatgtccaccaagatgcaccgcaccttgatcatccgtcgtgaataccttcacttcatccccaagtactcccgttacgagaagcgccacaagaacctcgccgcacacgtttctcccgctttccgtgctgagcccggtgaccaggtcgtcgttggccagtgcaggcccctctccaagaccgtccgtttcaacgttctccgtgtcctcccccgaaagggaaaggctgctaagcagttcaacaagttctaagtgcatagaaaagggatggtgtaacggttcatgatcaacaacggaaagaaacctggttgaggcggagcgtgatggttttcgatatggtcgtcaaaactcggcatcaagggttgaggaatcggagtcccatgggccatgtatgtttcttcagctacgatcaatgaaagtcctcgagtggtcaaacaagccaccgaggcgggccaaaaaaaaaaaaaaaaggccccta

SEQ ID NO: 20014 - DNA, 339 bp, Sorghum bicolor
  Clone ID: LIB5051-009-A1-XP1-D12
gccggccgggttcgggacgacttcctgctcaaggagcgcgcgctgtggtaccaccgggagatcaaggccagcgggtacgccggcgaggtcgagctgttcgagtccaagggcgtcggccatgcgttccacttcgacatgctggactcggagcaggccgttgaactccaggagcggaccgtggctttcatcaagaaatgaacaacgagacgatgaataagagttctctttacgctattatatcatttcgatacttccatttgtaatgcaccaaaagttgttcgattgccgaaataacataatatttcgttctcagaaaaaaaaaaaaaaaaaaggccccta

SEQ ID NO: 20015 - DNA, 461 bp, Sorghum bicolor
  Clone ID: LIB5051-009-A1-XP1-E4
gccggccgggctgggctgccaggccgagccatgctggaggacgcgaacaaccggtcgtgccggtggtcatggcctcgccggagaacgacggaggagggaagaagaggagacggcggcggcagccgaagcgcggctacgactcgtccgcggccgaggagaaggacgaggcggccgtcaagcggagcggcggattccggcatcatgggagccgccggaagagcaccccgcggcgagctgccgaggcaggagtggagtgcaagtgaggtcgcgcatgtgactatgccagtcacggcggattgcgttttcgatttctttttcatttttttctcctgcttcctgctgcattgatcgatcaagcttccaggagcatgagcatgctgtactatgaatttgtgcgaatggtaagctgctgatttggcatcagcgttccggtcgaaaaaaaaaaaaaaaaaaggccccta

SEQ ID NO: 20016 - DNA, 486 bp, Sorghum bicolor
  Clone ID: LIB5051-009-A1-XP1-F12
gccggccgggtccggaagcaagtatccggcaaaaatggtcgacatccccaagacccgacgaacctactgcaagggcaaggagtgccgaaagcacaccccccacaaggtcacccagtacaagaagggcaaggactcgctcgccgcccagggaaagcgacgatacgaccgaaagcaaagcggttacggtggtcagactaagccggtgttccacaagaaggccaagacgaccaagaaggtcgtcctccgactcgagtgcaccgcctgcaaggtcaagcaccagctcgtcctcaagcgatgcaagcacttcgagcttggcggtgacaagaagcagcgaggtgctgccatctcgttctaagcgtatctcctggacagagggaatcgtttggatcgcgacggcgcagctggagcaggggttttggtagtcgagtactcagagagatgtattcgtatcacgcctgggaaaaaaaaaaaaaaaaaaggccccta

SEQ ID NO: 20017 - DNA, 687 bp, Sorghum bicolor
  unsure (1)..(687): unsure at all n locations
  Clone ID: LIB5051-009-A1-XP1-F2
gccggccgggtcgggattggaatcgcgcgaacggctttataccactacatctccactcacaacctgcctctcgtcaccatggcctcagcgggaaaaatcacaaagacgctggcgtccatgggcggacgtcaagaagcgatcaagaagtacaccgtccaacccgtcggtatctgggcaaagatcaacaacttcttcgccgtcgactctagccgttccaccggtatccccatgaaccctaccttccgttacccttcacccggcgccaacgaccccaacctctacgacgaccccgtcacagtgcccgccggcgacatcgccgagaacccatactggaagcgcgacgtgcgccgctcataccccaaactctcggtcgtcaagcagccggatgttgttgcgctgctgtcagtcggctcggccgcgcagcccaaggaggacaagcttcagatcggcgaggctggcaagaaccagcttgttgcgctgaaggaggagggcgagaagggtttgagcgcattcttcgagaaggagaagagcgcggcgaagagtgtgctgggccccaacggcatgccgcctcttcctgcgcgttacggccagactgtgaccgcgcccaagtacgatttggcagaggaggatttgcnaacatacggagccaactaccctttgcagtcttntgtctagacgatgcgagaa

SEQ ID NO: 20018 - DNA, 528 bp, Sorghum bicolor
  Clone ID: LIB5051-009-A1-XP1-F7
gccggccgggtcggggattgacgacgacccgtacctcgacgacgcccttagccaaacgaccatcccgacacctcccacataatccacttccgccaaaatggactctgccaaggttcccgtcaagctcgtcaaggtcacccgcgttctcggccgcaccggctcccgtggtggcgtgacccaggtccgcgtcgagttcatggacgacaccacccgctccatcatccgcaacgtcaagggcccagtccgtgaggatgacattctctgcctcctcgagtccgagcgtgaggccaggaggctcagataagcgcgcgagggcgtgcgtgtgcgatttttggaactgaagttgggcgaggaggaactcggaaggagcaaaattcgttgcgatgttcttcttcagggacggctgcatgcacaacggcttgcggctgttgtttggcgttacggagacttcgatgccgaccttgcggtttggcaggacgatcaaatgaatacctgaactcccaaaaaaaaaaaaaaaaaaggccccta

SEQ ID NO: 20019 - DNA, 819 bp, Sorghum bicolor
  unsure (1)..(819): unsure at all n locations
  Clone ID: LIB5051-009-A1-XP1-F8
gccggcccggttccggataattgtggtaactaaggaatgaacttctcatccatcacttcaacgttgcacagctacccgtctcacttacctaaaatctaatcactaccatgcgattctccgccgttgccatcatctccgcgctcgctctcaccgcctcggctgagcaggccgccgagaagcgacagctcggctcgatcatcaaccaggccacctcggctgttgtaggcggtggagcgtccgtctttggcgatgccacctccgctatcgtcggtggaggaggctctgtcgcaggcgctgccacttcggccgtcggaaacggaggtggatcgatccttagccaggccacctctgctgtcgtcggcggtggagcctcggtcgcttccgctgcgtcatccggcatcgtcggcggaggaggatccatcgcttccgctgcgtcgtccggtgttgtcggcggagggggatctgccgcttctgccgcctcgtcgggcgttgtcggcggtggacagagcgctgctagcgccgcatccagtgctgcccagccctcgggcgctgctatgcgcggcaccgtgttctcgaccggcgcggccatgggagctgtcattggagctgccggaatcattgtcggcgcgggccgtgtccttgcttanaatggtcgcccgacctccacaacagtagtcgcaaagaacaggatgaggaagcacaacaaataaggactactgaagtgtcacaatgtcttgtacccatacacgcatatgtcatgtatcgctatgctctacagaaaaaaaaaaaaaaaaaggcccctanggccgcggccgctct

SEQ ID NO: 20020 - DNA, 705 bp, Sorghum bicolor
  Clone ID: LIB5051-009-A1-XP1-F9
gccggccgggtcgggattcctttctccccgctgacaggcaagcgaatccagtaggagtactatggcgacgacggcggccgcggggtacgggcacggctgctgctcggcgggtctgccgtcctttgcgctgtttccggggatcctctcgacccgccggtcgcctcctcctcctcctcgcgtgtcccttgtcgcctcctcctcgaagctcaaggcgccggcaccgcggttgagagtttcgtaccgtccaaggtgtttagcttcctcctccggccaggtcaattcggatgcggtgctgtcgtcaacggaagccactatcgatataaagcttcctagaagaagcttgcttgttcaatttacatgcaatgcatgtggtgaaaggaccaagcgcttgataaatagagtagcctatgaaagagggtcaatttttcttcagtgtgcagggtgccaggtgtaccacaagtttgttgataatcttggtctagttgttgaatatgatctacgagaagaaaatgagctacaaggagaaaatgccgtgaacaccaattctgaagattgatatgttgtgagaagcagtgttggtatgcaaaacaccctgtagtctgtaggttttgacagcattgattgtttacataaaatggcactttaaagttgttgcgtataatttgtactttacaatgcgaaaaaaaaaaaaaaaaaaggccccta

SEQ ID NO: 20021 - DNA, 766 bp, Sorghum bicolor
  unsure (1)..(766): unsure at all n locations
  Clone ID: LIB5051-009-A1-XP1-G10
gccggccgggtccgggcagctagccaggcaaaggcaatctagagcagggagagctgcgagagggcagcgagcgagctagagaaagatatatagagagagaaatgaggccgatggagagagttgaaggtgtggcggcgccggtaatggctggcggcggcgcgcgggcgccgagcctgtggaggacgccgacgccgtacctcttcctggggttcgcggtgatgatggggctcatcgtggtggcgctgctcgtgctcgtctgcacgcgccgcaagccggcggcggccgacgacgagaaggcggcgacggtgcgcggggtgctggtgccgctggaccgggagcccaaggtcgtggtcatcatggccggcgacgccctcccgtccttcatcgccgtcgccagcgccaagatgccgctcgccttcgccacgccgtccgccggtgccgaggaggccgtgtagcacgcccaagcccaacggcgcgcgcgcgcgcaggcggccgaggagccgagagaaccccgcgcgtcgcgacagctcgcgacgacgacgacgacgacgctcgcgggggccaattttgtcgagaggttctttttttgctttggagttcggtggcgtgtgaccacgtgaaccgtgaggccaccaaccccagccgccgccgccgccgccggnggcagcggcagaggcagaggcagcangctggttgntttgggctgtttcggngaaaaaaaaaaaaggcttgcttccagcttgaataaacgcgcaggggccggctt

SEQ ID NO: 20022 - DNA, 640 bp, Sorghum bicolor
  Clone ID: LIB5051-009-A1-XP1-G11
gccggccggttcgcgactctatctctagcaagcggacgcgtcctaagaaccaaagatccctgcgtcccagggctttgcagatgagctctccgagatgtcccactctattcagcaggggcaggtaacctttgcatacaatgggctgtcgacggtacaccacagcctcgcttcgtcgcagcaccaccaccaggcatggccaatgactagaattggtgatgcggagaacggagccgtctccctcacccttggcctccaccagaacaacagagtctgtattgacgagccactcccggagtccctccctcccaacctcgatcgccgatttgctgtggaggaggacatcgacccctacatgatgcgttctttcttaaaccagtaccggaatttcggcaaggaccatgggtgatcatttgttgcatgactttgctggctgacatggctgctggctgctgctgctgctgccattgttgcttatggccagctgagctgagctcagcttgctaatggtgcacaagcatgaatttgtaccactactagtatgttataatgctatataagagaatcacttggtggctttggcttgatcagtttgaatcaatttctcgcagaatggggacgtggactccaacgtcggccccta

SEQ ID NO: 20023 - DNA, 695 bp, Sorghum bicolor
  Clone ID: LIB5051-009-A1-XP1-G2
gccggccgggccgggacaatttctcacttcagccaccccactcattcatctccacacacattctgatgctgtgctacatctaaccaactacagtttggtcgaaggaacacagacacccaacactcacatcttcatatatctataaatgatatgctgccaagtagcaggttccatggcccttcatgactgctatgtgatctgcgccatcctcgtcaccgctgtaatgctgaatgatattgcgcgcgcttgcccatatgtgaactccatcgtgaactatacactctttatcgcaggctgatgtgtgctcacttttatgtacttcctaactacatccttcgtctacaactacagcatccccatcgaccagatcaagatggatgcactcacatgattcttctgattatgcgactgctgttgctcttcccgcatacgttgtggaacactgatgatccaacagcgcatacgctcactccaacattgaacatcatagttccctatacaccgatcacaactgacaactcgctcatgccactactgctttcctctgaaataaataggtctgcatgtcgatgatacccgtgcacctcaacatcatgtaacggatcacagcagcgttcggcatacttgcgcggatggcatccgcccgtggcggccccgccatgagccaggtctaggatgcctgcaaatcttactct

SEQ ID NO: 20024 - DNA, 446 bp, Sorghum bicolor
  unsure (1)..(446): unsure at all n locations
  Clone ID: LIB5051-009-A1-XP1-G7
gccggccgggtcgggaacgacaggagctgcgagatttcccgaccntaccttgncgactccgccaccacctccctcccttttagggtcgtcgtcgtcgacggattgcacgtctcctcctccgcgtgtccatcaaatttctcaccacacccattccggtcccggcagatcgatcgatcgcgcaaccatggacacggacacgacgtccaccgactcccagttccggcaccctgctcctgccatctccgcggccggagcgcgcgccgtcgtatgctcattggccgctcggggcgccgagagcctcgcccgcggcctcgtcacctgcgtcttcgcgacagtgggcacggtcctcggcgcgatcaccggcgcgctgatcgggctggccacggagacgggcgtgctgagcggcacgggcgtcggcgggatcacgggcgcgctggtgcccatgc

SEQ ID NO: 20025 - DNA, 752 bp, Sorghum bicolor
  Clone ID: LIB5051-009-A1-XP1-H4
ggccgcttcgagggccggcccgggtctgggactccaaaccactccaaatccaaaccaccactcaaaatgaagaccaccttcaccgtcgctgccctcaccggcctcctctccactgcctctgctcagtacttcggcctcacctctgcccgctccgcttctcccatccactaccagaccgtctctgcttctggcaactccatctggctcaacaagaagacctcctcctactgccccgagaacatcgaggacatcggcggttgccccgccggcaacaccactactttcgctggcggtgaggacaccctttccatgggtgccgttgtgccgggtggccagcaggtctacatcgaccccgacaccggtgccgtcaagtacacccaggctcactccgccgctatgcccgaaggcgccatccagactggctggaccgtcagccctggcaacggcttcggcatcctctccaactccaacggtgctttcatcgcctgccctgctaaggacgactcttaccaggtcttcattggcctcgagtgcgttgacttcgacgaggcttgcctgagctttgacgccctcgccagcaacggcaccgaggctggcgcctggcagtactcttagacgattgcaagaatcgtcgaatgggatggaggaaaggggatagatgcatgaaggggcaatgcttttcctactctgcctgcctgttataatgatacataaattatgaaagccttaaaatgctccaactattgaccccg

SEQ ID NO: 20026 - DNA, 263 bp, Sorghum bicolor
  Clone ID: LIB5051-009-A1-XP1-H5
gccggccgggctccggaggagggcatctagatgtctctctctttcacttcgacggcggtcgaaggctcttgcctgagactctacgacttgattgattgcatatggtaatggatagcattgcatcagaatggcaggctggcgtttgatggctatgggaggaactatgtcgcctaggatgaccctttaccctatggttacacttgtgtagtatacccaccaattcaaataatttcttacaaaaaaaaaaaaaaaaaaggccccta

SEQ ID NO: 20027 - DNA, 480 bp, Sorghum bicolor
  unsure (1)..(480): unsure at all n locations
  Clone ID: LIB5051-010-A1-XP1-B3
gccggccgggncctggacattatccctcaccgtctcctcttgaacgctccgctctctgctactcgtgtcgagagctcctcttgcatactctgacccgctccaagggaacgtgagcgataagcgctggcggacatgggtgcacatcccgtgactccgagaagcacttcgacgattcactcatgagaacggacacgtcttcctacccgctcggtaggttcccgagttcctccctcagaaccgcctcctctcgaatatgcagtggcgcgcgatcggcgtgtcgcaaagatgcgggtggatgcactacgcgatccatcggccagagacgatcatcatgatgttccgccgtgcgatgcaactaccggcagcaggaggaggcggctgccgccggattgctcgccaagtgagccgctgctggaaagggtggcgaccagagatgatctcaccctaggacccttttcatctctgagaggtgcgacgcta

SEQ ID NO: 20028 - DNA, 473 bp, Sorghum bicolor
  Clone ID: LIB5051-010-A1-XP1-B4
gccggccgggctggggtgattttagaagacaaaacatatccaccgaagaacaacttggttctgtttcggacatctctatggggaaaaaggcgcaaaatgttcttgctctaattttgatccctttctttgtctacataagccaagctgaaggagcaatggaacctgcaagtaacattactgaagtcgtggatgtggagtccatcaagacattgttccagttggcttacatgccagaagcagctcgagtatatcatacttgcggacaatgcagctgttgccaaggaaaaatctgtactgtaatggcatgctgctgggagtatagatgcaatggcaatgcacaagtgtcttgtgtagttgaggctaagacatgcggctgtgcaaactgcagctagtcatatcgtttctatgctcacaaatggatgacaataaaattttcgtttagagaacaaaaaaaaaaaaagaaaaggccccta

SEQ ID NO: 20029 - DNA, 349 bp, Sorghum bicolor
  Clone ID: LIB5051-010-A1-XP1-B5
gccggccgggctgggaggatacagggagttggttcacctgaacccatacgcccttcagttgatcatcatcactttgcttttgcttacttgtgcaccgagctaatgacgatggatatctaagtgtcctatccatcgttacctaccacgctgggatccaccgagttgcattgtgccgcacgagtactatcataatcagttgataggtcgtttttcttacactgcaattacttgacatatatagtagtatatgtgttgtgttgtagctaagataggcttgggatggacgacatgccaaccgctaagtacatctaaacatagtaaacaaaaaaaaaaaaaaaaaaggccccta

SEQ ID NO: 20030 - DNA, 278 bp, Sorghum bicolor
  Clone ID: LIB5051-010-A1-XP1-B7
gccggccgggttggggtaccctatgtactgagatctcttctcccgtgtaaacagtgttttaatatttgcgtgaaaaaaaaaaaaaaaaaaaaaaaaaaaaaaaaaaatatattttttgtgacttcagttgttttctgagccgaggtgaccgacgtttgcaccgtgtctatctatcttttttaatcttgttagtattattactgttgtgtaaaacactgatatagtgatatatatattgtcgcaactcctactaaaaaaaaaaaaaaaaaaggccccta

SEQ ID NO: 20031 - DNA, 505 bp, Sorghum bicolor
  Clone ID: LIB5051-010-A1-XP1-B8
gccggccgggctccggacctgtacgccatggcggtgatggatcgcatcaaaaacgatcggcagatcaccgtggatatgccgcacggcgacgcctggctgcgtgaagacagcgcgcggccgattgtgctgattgccggcggcaccggcttctcctatgcgcgttcgattctgctgaccgcgctggcgcagcagccggatcgcgatatcgctatctactggggcggccgcgagctgagacatctgtacgatctggatgagctcaatgcgctggcggtgaagcatccgaacctgaaagtgattccggtggtggagcagccggcggaggactggcaggggcgcagcggcacggtgctgaccgcggtgatgcaggactatgccagcctgagcggacacgacatctatattgctggccggtttgagatggcaaaaattgcccgcgagcgcttctgtgccgaacgtggtgcgttagaagcgcagataaaaaaaaaaaaaaaaaaggccccta

SEQ ID NO: 20032 - DNA, 652 bp, Sorghum bicolor
  unsure (1)..(652): unsure at all n locations
  Clone ID: LIB5051-010-A1-XP1-C4
gccggccgggctgccgggattttggggaagagatcaagtgtcaccacgcccccgccgccggagggcggcgtcgctcgcccccgcttgcccagcggcggcagcgcgcacgtgggcggcgcggggtacccgaacccgccagatgccgcgatccccgaagcggcgactcttcgggaccagtggcggttcgccgtgcggcagtacagccgctggtactcccacgcctggggcaccgccatcctcgccggcgctgccttcttcgcgctcggatggcttgtcaaggggtcgaacccgctcccgtcccgggccgagccgcaacacgacgccaacggcaaatccgtcgctgaggaggagaattgactgttggtacccttctgctcgtgcgaagttcacactggactgtcaatggtgaacaggactgaagacaaaacagagactttgtgtggcatggagctgtgaacctgctttctttctctagacgcaatcaatacctgctttttgtttctcccctgttgtatatttgcgaaataagggtcccttgcttgttgcaagggaggctcttgaaggtcttgtaatgtancaaatgaatgctgccgaattcatcgtgaaaagagtatgtattatcgttctaaaaaaaaaaaaaaaaaagccccta

SEQ ID NO: 20033 - DNA, 796 bp, Sorghum bicolor
  unsure (1)..(796): unsure at all n locations
  Clone ID: LIB5051-010-A1-XP1-D1
gccggccgggccgggatcttcccagaacatcatcttcacgactgcatctccctccaaacactctgtaacacttcaaaatcgaaaccacacctcgattgatatcccaacaactctcccaacatggatgtctactacttctactcctatggcactgccgcatggctggcaacccaagccgcgcctctcattgcgtccccaacaatgatagtagcactattgtcacccgaggtccgcgaagcctcaactctcgaggtctacttctcccgctcgttgggcttttcgctcatcgcactgggcatcatgacggttctgctcacgggctctgtgccactctctagtagactttccgagggagcaacgaccaacgccgaagaccccaaagccccctacgcgctccccaccctcaccataaccgcaatgttccattcagtcctcgccttctacggctacgccatgtgggccaagactggtgtcatgtctttcggtctgggaacgctcggctcaggcttcttggctatgattgcgctttggtgcatcttgttcgctagcagcaatggccgcattagcaggaagacaggtgctgacaagaggacatctggattcccgtttaagaaccaagaggctgataagaggaaggctaggtaaacgcatatacttagcttttgtcgaaaatggtcgattgtgaaagttgacaagccatgctttgngcggaggtaggggcatggaagggatgtctgcagcgcttcagccacagtgggcaaatgggcataccatgggagttatgcatggaagcggg

SEQ ID NO: 20034 - DNA, 288 bp, Sorghum bicolor
  unsure (1)..(288): unsure at all n locations
  Clone ID: LIB5051-010-A1-XP1-D3
ctgtgcggcgctcaggcggcgggctcgaccatgctgcttctactccnggaagtatgcatccacatatatccacccatttccatctccagaaccacccaaaaatattctactcctaatccaggagagaatagccaaaaatattctcctatttctgtttttccctgtgaaataaatgctcaagttatcttggttactaccacttgcaatattatttcaagagatgagtgctctaaaaaagagagaaaaaaaaaagtatacgaggaaaaaaaaaaaaaaaaaaggccccta

SEQ ID NO: 20035 - DNA, 475 bp, Sorghum bicolor
  Clone ID: LIB5051-010-A1-XP1-E1
gccggccgggctgggaggcttcccggaggcagtgacacaggcgcacatggccgatgtgcgcggaagacctggccggcgacataggtgtatctggatgcgtgcttgtggggaggcgacggcacgggcacccgggccggccaacgccaagctggcggcacaggcggacctgaccggcgatgcaggcgccctagaagcatgaccctctttgatgctttatctgattttcttgtttcgattatatttctttaattttctcctcgatcgattcgtgtatggattaacttgtttttggatcgatatggtgtttttgattcattctcagtggtgatggtctcgatttggtactctactcctcttgtgtctctctatttgttcctctgtccggtccacgatgaggggactctaatgtttcggattttaatttaaaaaatcacatgttttgtatttggaaaaaaaaaaaaaaaaaaggccccta

SEQ ID NO: 20036 - DNA, 634 bp, Sorghum bicolor
  Clone ID: LIB5051-010-A1-XP1-E4
gccggccgggcctgcgacaacaacatccacatcaaaccaccgcaaacatggaggtattactcggaatcactggcaaggacttcaccatcatcgccgcctccaaggctacgatgcgtggcccgaccgtcctcaaggccaccgacgacaagacaaggccgctgaacaagcacaccctgatggcatacagtggcgaggccggtgacacagtccaattcgcggagtacgtccaagccaacatccagctttacagcaagcgcaactcctccgaactctcaccctacgaggtctcctccttcgtgcgcagctcgctcgccaaatcactccgctccagaaacccatacaatgtcaacctcctcctcggcggcttcgaccccatcacagacaagccagagctctactggatcgactacctggcatcatcagcgcccgtgccgtacgctgcccacggctacgcacagtactactgcttgtcactcctcgacaagcaccaccaccccgacatcgacttcgagcagggcatgaagatcctcaggatgtgcacggatgagctcaagagacgtttgccgatcgacttcaagggcgtactggtgaaggtggttacaaaggacggcatcagggaagagccttatgtgga

SEQ ID NO: 20037 - DNA, 550 bp, Sorghum bicolor
  Clone ID: LIB5051-010-A1-XP1-F4
gccggccgggcctgcgagccctcccaccagccaaactaaccaacagtcaacgctgccaaaatgctgattcccaaggccgaccgcaaggcgatccacgagtacctcttccgcgagggtgtgctcgtcgccaagaaggacttcaacctgcccaagcacggtgacattgacaccaagaacctctacgtcatcaaggcttgccagtccctgacctcccgcggctacctcaagacccagttctcctggcagtggtactactacaccctcacccccgagggtcttgactacctccgcgagtggctgcaccttcccgctgagatcgttcctcagacccacgtcaagcagcagcgctctcacgctcccccgcgtggcatgctcggtggtgacggcgagcgccgtggtggtggacgtggtggtccccgcggtgaccgcgagggtggctaccgccgccgcgaggatggcgagaagaaggagggcgctccctcttccttcaaccccgagttctcccgtggtggcttcggccgtggccgcggcgccgccccttcgtcttaag

SEQ ID NO: 20038 - DNA, 787 bp, Sorghum bicolor
  unsure (1)..(787): unsure at all n locations
  Clone ID: LIB5051-010-A1-XP1-G1
gccggccgggctggatcaacttcaactttagcactcatcatagcctgtgatctcattcaccatgtcgtgggacaatgccaggaagcatgcaagagcactcgaaaccgctctggatctcaagctcgccacgtattcccgcattgcgcacatcatcacgcgagccccgggtcagagcagttccactagttcagacgacggtgctggcggatacaagcttgttgaagaagaagtcgaggagctgctgtccaaactcgagcaagccattgacgacctcatgactctaatcaactcgccgtctcaacccccgtccacatcgatgcaacatgccgctcaacggcaccgcgacaatctcgacgactacaggcgggacttcctccgtgccagaagcaatgtcgaccaggctatccaacggtcgaatctactgggctcggtcagaaaggacatcgacgacttcaaatcttcgcagaccgatgcgcttttagccgaccgaggcaggatagattccagtcaccggatgatggacgacacgctcagtcaagcttacgccacacgcgaagactttgcacaacaacgctcactgctgacatcgatcgagacgcggatgggcggtgtgctcaatcaaatgccgggaatcaactcgctcatcaccatgatccgctcacggcgaangcgcgactcgatcattgtgggatgcgtcgtcggcatctgtggtcttctcttggtagggtaccctctcggcttctgattgcgcgttgtaacccatacaggacatgcattaatagtcgct

SEQ ID NO: 20039 - DNA, 175 bp, Sorghum bicolor
  Clone ID: LIB5051-010-A1-XP1-H7
gccggccgggtccgggaatttccacgaacagcatctgtgttatatatcttcgattgcataggctttggaatgtgttaaactttcagctgtgtaccactattatctccggatgaaagagggctggaacctagctagttccattatttaagaaaaaaaaaaaaaaaaaaggccccta

SEQ ID NO: 20040 - DNA, 825 bp, Sorghum bicolor
  Clone ID: LIB5051-011-A1-XP1-A1
gccggcctggtcggaactcctctgtccctctctctggttatcggcggccacagacaccgaccccgtccaccgcacggcctcggcccagctgccccggtccccggatccgctcgttcactgacgaccctgctcaccggatccagttgttcacagccgcggcacgcccctccttttttcgtagcagccccggcagccaaccccgccctccgtgtcgccggcgccggctagatgtcttcgtcggcggcgtaccctgacgcggacgagaatctggaggccatcatcacccgcgtcgagcagaagtcccgaaagatcgagaccctcctcaagcagtcgaagccggtggaggccctgaagacggcgctggaggggtcgcccctcaagacccgcgacgagcgatgcaagtctgcgaactggatcgtggtgcaccgcgcgatgatggcgatcagggacgtcgacggcatgttcaactccctggatcccgagtactacgacatcctcatgaagtacctttatagaggtttatctacaggggataggccaacatgtgaccagtgcctcaaaattcatgaaaagctgactgagaaggcaggcctaggctgtatattgcggtcccttgctgatactgtaaacactgtatgagctttgtctgctgctgagggtggatataacaaacttctcttcctgctctttactgtgataaatcatatcagtaaaactagctataatagttaactagatggtttaccctgtcgttccttgccattaggcaatttcagttagagcatcattgtaccttactagactaaatgggtattatgttgggtt

SEQ ID NO: 20041 - DNA, 625 bp, Sorghum bicolor
  unsure (1)..(625): unsure at all n locations
  Clone ID: LIB5051-011-A1-XP1-B4
gccggccgggctgcgaaaacgtctttggcatctcactttcccaccaacctccacacatcagcaataatgtctgccgccgagctcgcttcctcctacgccgccctcatcctggccgatgagggtctcgagatcactgccgacaagctccaggctctgatcgctgccgccaaggttcccgagattgagcccatctggacctctctcttcgccaaggccctcgagggcaaggacgtcaaggacctcctccttaacgtcggctctggtggtgccgccgcccccgctgctggtggtgctgccgctggcggtgccgctgccgccgctgacgcccctgctgaggagaaggccgaggaggagaaggaggagtccgacgacgacatgggcttcggtctcttcgactaagcgtatcgcgattagtcgttgcctccaagtgtctcgacaaggcaaggaatgttctctggcaagctggatcccgtcatggcatagacgacaaggacgacgtgtcgtggcgaggggaagaaacttcatctgngatgtctagattccgcagctatagcttaaatgcatgtggcagcttgtcaagcggcttctttgattgtcacaaaaaaaaaaaaaaaaaggcccctan

SEQ ID NO: 20042 - DNA, 772 bp, Sorghum bicolor
  Clone ID: LIB5051-011-A1-XP1-C1
gccggccgggccgggaaaaagtaccattcctctgaccactaaagcctttctcgttggagcaccaaagaatcacccaaatctaccaacaacactttaactgccatgtcggagcaacaaaagacccccgcgaagaagacgcctaagaagctcggaggcaagaaggatgcccagcaaccaactcccgaccagaccgacgaagcagaggccgagggcgaggccggagccgatgttgaagctgaaggcggcgcccaagcagacggcgaagaggagcctgagccccaacaagagcgccagccatctcgccgccgccagagccgtggtcgcggacgcaaaggcggtgcacaggacagtgacgccgagtctgtcgcccgctcggatgtgagcgcatcaggcggccgtcgccagcgccagaagcagaagaagcagggcaagcagggcggtggaggactcgaagacatcaccgaaggtgtccccggcggtgacttggtcaacggcgccggcgacatggttcagaacacagcgggcaacgctgtcaaccaggttggcaacaccgccgggcaggcgctgggtggacttaccggcggcaagcagggcggtggggaggaagagggcggtggagagcagcttcgtctcaggttggagctgaacttggacattgagattcagctcaaggccaagaatcacggtgacctgacgctgggtctgctcaactagagtgttggatgaggttcacgtgacgttttgacgatggggagtaccagatgggatgttg

SEQ ID NO: 20043 - DNA, 568 bp, Sorghum bicolor
  Clone ID: LIB5051-011-A1-XP1-C11
gccggccgggctccggatcactcacgccaattcatctgcactactacctataccgatacaacatctcaacgcagcaatgttctccatcgtccgatcttcgacccgccgagcggctctcgcccccgtccgaggcgccatggccacgcgattcgcgagcacgtcgaccgaggcgcagaagaaggccgaggacggcgaggacgccgttggtgagggactgaagaaagccggaaaggctctgcagagcgacggctcgatcggaaagaacttcaacccggacggcgcggtcggctccaaggccgaggccgtcggcggaccgttctcctcggacggcgtgatcggcaagcagttcaccgacaagggcgctatcggcggtaccggccagaaggtcgctgagaacgtcgagcaggccggcaaggagaccaagaactagattgctcgatcaggggcggaggcgcggtatcacgaaagcgagatatacattagtgggagatcatcaccggatgtagcatatcagacgatcgaaaaaaaaaaaaaaaaaaacgaaaaaaaaaaaaaaaaaaggccccta

SEQ ID NO: 20044 - DNA, 678 bp, Sorghum bicolor
  Clone ID: LIB5051-011-A1-XP1-C4
gccggccgggctgcggtctgcattttcaggctttcagcccgggaaggagatccatctcatggccgcacggggtttcgagagattttcacgctggtttcagcgatcctctgcagctgcaggtggttccaaggacgaagacgaccgcagcgagaggaatggcttgctgaggagccaattggatcaggtcgtgccggtcacggattgtgctgatacatccaaggcgttagctgtccatatgggaccaaagaccgtagcactgaaggtgtccatgcactgccatggctgcgcaaggaaggtccagaagcaaatctccaagctgcaaggagtcgtatccttcagagtggagctggagagcaagaggctgaccgttgtcgggaatgttagccccacggaagttctggagtgcgtgtgcaaggtgacgaagcatgcagagattttgcaggctccctagtgatctttccagttccgatgatatacagacagctgtgaatgtgcgatacatactgcagtactatcggattgacgtggagttaaatttggtagcgcaaaaatactgtgattctcctttcaagagaaataaatcctactgtagatctcagtatatagtaacccgctattagctacctacccaactgactttttttttgctgcgaaaaaaaaaaaaaaaaaggcccccta

SEQ ID NO: 20045 - DNA, 813 bp, Sorghum bicolor
  unsure (1)..(813): unsure at all n locations
  Clone ID: LIB5051-011-A1-XP1-D2
gccggccgggtcgggaaaacacccggctcttcgaggatcttcgacactaacaaacagtcaattgaatcaaaatgtcggacggagaagaggttccccagcaggaggtcgaggccgtcgaggaggtcgaggtcccggctgacaacgccagcggcagcatgtccgtcctcgacgccctcaagggtgtcctcaagatctccctcatccacgacggtcttgcccgtggtctccgtgaggcctccaaggccctcgaccgccgccaggcccacatgtgcgtcctcaacgaggcttgcgaagaggaggcctacaagaagctcgtcgtcgctctctgcggcgagcacaagatccctctgatcaaggtccccgacggcaagcagctcggcgagtgggctggtctctgccagatcgaccgcgagggcaacgcccgcaaggtcgtcaactgctcttgcgtcgtcgtcaaggactggggtgaggagtcccaggagcgctccatcctgctcaactacttccagaccgagcagtaagcgtctcgaccctagcgacccaagcagcatacagccaagcagtttcgacattcttcgacaacaactttctgtcatgactacatacttcacgcggcgacatcttctggagacgaacatcgacaaaagttatcgtcattagcgagtttgtgtttggaagggataggagggtgttgaagagtgtangaagggattattttcttttcggcagtgtacagagcgctcgccggctacctggctggagctaccttgaaagncaatttgggacccataaaaaaaaaaaaaaaaggcccta

SEQ ID NO: 20046 - DNA, 470 bp, Sorghum bicolor
  Clone ID: LIB5051-011-A1-XP1-D3
gccggccgggtctggatatgttagatatattgtatgactcgtggtccccagcgatgactgtcagttctatctgtatcagcatattatctatgctgtccagctcaccagcaaagcaacgcccagccgataatgatcgctatgtcaggaactgtcgcaatgggagatcaccgaaggagaccaggtggtggttccatgacgacactgtgtgatgggtttcctgattgtcctgtgactccgcatttagttgccagactacatgggagatgattaggcttatttcaaaccgacgcatttgaccagaaattaacatgctctcgtggtttgtaaatgaatgtgcatcagcgtcaggtcctgtacttgttgatccttacaccgtccgatggtatatagaataatgtttacatcgtgtcaatttacggaacagatagaaatgcaagatttccgaaaaaaaaaaaaaaaaaaggccccta

SEQ ID NO: 20047 - DNA, 675 bp, Sorghum bicolor
  Clone ID: LIB5051-011-A1-XP1-D5
gccggccgggctccgaccaggtatcacgccaacaccgccaacatgcgtacctacgacgattccttcagcggtcaaaagatctacccgggcaagggcaagctctacatccgtggtgacagcaagatcttccgcttccagaacggaaagaccgagtcccttttcctccagcgcaagaaccctcgcaagattcactggaccactctctaccgaagggcgcacaagaagggtatctctgaggaagtcgccaagaagcgcacccgccgcacagtcaagcaccagcgtgccatcgtcggtgcttcccttgacgtaatcaaggagcgccgcagccaacgtcccgaggctcgttccgctgcccgcgccgccgccctcaaggagggcaaggagaagaaggccgccgccgagtcagcaaagaaggctgagaaggccaagaacgccgccgcatccgcacgaggcaacgccgccaaggtcagcaagcaaggtgccaagggtgccgcaccaaaggtgcaggcaaggactcgttaagctgggttcgatatggcgtgcatagtctgggttatggctggtttttcgggatgactcggtgttcttttactctcttccgataaacatacctacggaaaatggaatgaatggaatggcatcaaaaaagaaaaaaaaaaaaaaaaaaggccccta

SEQ ID NO: 20048 - DNA, 775 bp, Sorghum bicolor
  Clone ID: LIB5051-011-A1-XP1-E9
gccggccgggctccagctttcactctactcctgcaaaacacaacaaacgcccacaatgacatccacaatcgactcttccctcccacccctcaccccaccctacccacctagcaaaccctccctcgaccgcgaatccccccaaacccgcgctctaatcacccacctcaacctccaaccccacatcgaaggcggctacttcgtcgaaacagaccgcgacgccctccgtgtgcccaatcccttcacaaacacccatccctccgccacagcctccgacgccgactcctcctcccgcgccgccagcaccacaatccactacctcctcacgcgcgcctcgccgctcggcgctttccaccgcaaccgcggccgcacagtacacaccctgcacaaaggccgggcgcggtacgtgatcatccacgccgacgaagtcgctcccggcgacaggcccagcgggtacgggtccgaagacgccgcggacgagaagaagctgtggactggcaaggcgcgggtggagacgtatgtcgtcgggcaggatgtgctgggtggggagaggcttcagtggatcgttgagggtgggaagtacaaggctagtttcttgctgccggatgcgaaggatggggaggatagcgcggaggggtgtttgatcagcgaaactgttgttcctgggtttgagtttgcggaccatgatttcatgaaaagggagagggcggaggcgctgcttacgcaggagcagcttgaagagatgggatggatgttgagaagggattgaggttgcatt

SEQ ID NO: 20049 - DNA, 750 bp, Sorghum bicolor
  Clone ID: LIB5051-011-A1-XP1-F1
gccggccgggttcggcccccattgttgattacgatttagtttgaaaccttcaattcatcttgcaaattcagtggttgtttcctcgttcttgcaagttcttcgattgcttgcaggacgggagccctaggggctggttgtcgcgctccacaacatcgtgatggctattggacgtggtgtatcggttgctaaggcgcggtcttgagggctgtagtcgggcagtgaacgtcatctccatccaccaatcgagttatccccgtctctcatcaaaagatcgggcaaaaaccctagcgggttcgcatcagttggtaatcagagcaaggttcttcggtgagagacttctaatcctttgctatttttaattagtttcctgtagtccagaaaagccaaaaaaaatagtagattagtttttccataatcctattaaacctttgtgccttggctagtaccgttttagttagggcttgttgaatttgcgttgcttcggtttgtgtcgagttgctggtcttagtgtctagtcctttagagtttcgagttcttgtcaccatctatacacagccgagtattaccatatcttctctctgtcgaatctgttgcgaagtccttctgtgatccaaaaagaaagataactccatacttgttcgaccttactctagagagagagagagagaatagcgaattgctcttttgtattcttttgttcatataatcagtttttgaggtagccccaaaaaaaaaaaaaaaaaggcccct

SEQ ID NO: 20050 - DNA, 687 bp, Sorghum bicolor
  unsure (1)..(687): unsure at all n locations
  Clone ID: LIB5051-011-A1-XP1-F3
gccggccgggcttgcgaaatgaacaaatcctgactattactgtgctttactgtggcatcgcctcatgggtaccaaggtcctctcgacgacattcaacggcacaaacaagatccgtgcttatgcacattgcgcgaaaaattcggaagggatcactctactcctgatcaaccttgatggcaacaacacaaaccacatctgcgttacaagccaaggcgcacagacccagagtgcaaggaaggagagcagaatgtcttatcaaattcctgggcttggcgaagcggccgagctcacgagacaagagtaccatctcactcccaagggcgggaatctgcagagccaacaaatgttgctgaatggcaatgttctggcaactgacgccaatggggacatcccaaagctggagcctgtgcaggtggaggggacgcagcccataaccgtgggtccttactccattgtgttcgctcacatccccagcttctatgctccagcctgtagttagaattttcatctgaatttttttccagccttctccgtgtgaatcatagattagataagtccaggtgaacggcgaagcttgttcacctgtccgtgaagtaagctgcaaggctgaaaggggttgtganttatcattgnttgagagagaaagtgtcagatagtatgtgagcaaaaagaaggaaactgggaatg

SEQ ID NO: 20051 - DNA, 565 bp, Sorghum bicolor
  Clone ID: LIB5051-011-A1-XP1-F8
gccggccgggctgcgcctttccgttccttcttgctcagaatatcacaagacttccatcgatcccagcaagcttgttggaaagtacattcccaacgtcactgctcgtcccttcgagctgaccaaggagtacttcgaggatgtctaccgcctcacctcctctccccgcatcggcaacatccttgccaactgggagaagtacgagagcgacgagcccagcgcttccaggcccagagctggcagcgcggctgtgcgtccccaggaggagtagagtggagggcattaccctggcgtgttgacgaattttggttttaaaacaggagcatgacgactacggtctcgggcatttattttccatctggcgtttttgtgttgatgatcaggggcagcgagtcgggttctttttcgggcttcttttgatagcatcgcttattttttgttttcttgtgcatattatttatgcctgctacatatatagtttttcctcgtcgattaccttatacgatagagagagagagagattgtatatgcctttttccaccaaaaaaaaaaaaaaaaaaggccccta

SEQ ID NO: 20052 - DNA, 746 bp, Sorghum bicolor
  unsure (1)..(746): unsure at all n locations
  Clone ID: LIB5051-011-A1-XP1-G4
gtgcggcgctcgaggcggcaggccgtcagaccccaccctcgttcgtctactacccacaaacacgatccccagccggcaggcagccataatataaacaacgtcaacatgagcggctcaaccggataccattcagctggtgcgctgatgtactgcaacaccacgttctactcgggcatggacaacgtgacagtgcaatcgaatgagcgggtcaacgtctcttggcccgacggcaatgctcccttcgagatcaaaagactcaacggtaacagtgctcaggagctcgattgcatggtgtcgaggttcaatggcggctatatgccatggagcatcgattggtcctttaacaaccgatcattcatttggaacgtcgatgagcagtataacctacgatttggaaaccagacagccagccggaacgagacgttccaggctccaggcgattggtcactgttcattgcggtacaaaaggaggacatggacagcaacaactgggctcacaacgattatcgatactggaccagcccccgatatgtcgttgggaacaacccattgccgtccaacggcgtggagaggaaaatctcggtccaggccggtctcttggttggcatgctggcaatgacgtgcctgacgtctttgntctagcagtgcgagcgagaacacacgcgtaggaaactgcagaagcangttgattgtaataaaggccccgtggctgtgcacttttgtacacatgtaccaatgattctcac

SEQ ID NO: 20053 - DNA, 391 bp, Sorghum bicolor
  Clone ID: LIB5051-011-A1-XP1-H12
gccggccgggtccggcatccctgacgagggtcttgctatgatcaggtaccactctttctacccgtggacactggtggtgcgtacaagtggatgatgaacgagaaggatgagcgcatgctggaggccgtcaaggcgttcaacccttacgatctctacagcaagagcgacgaggttcctaaggttgaggatctcaaggagtactacttggacatcattgatgagttcattggcaaggacaagaagcttaagtggtagacgatagtagtatatcatggtaacgaatctctttgatctaggcgtttgggttatataatgacgcggagtgccaacaaggcccgcgatgcaattcatttttgacctcatctaaaaaaaaaaaaaaaaaaggccccta

SEQ ID NO: 20054 - DNA, 673 bp, Sorghum bicolor
  unsure (1)..(673): unsure at all n locations
  Clone ID: LIB5051-011-A1-XP1-H3
gccggccgggcctaatatcgcccgacaaccttccaatggccgccgtttacgagaacctgagctctgaccttgtctggcagatcagccgcgccaacaacgcttaccttaccaagcgtaagggtgctggtggtgtccagttctcccgcgaccctctcaacctcaccaacaagcacagccgcaagtgggccggctatgttaacgagcaggccatcggcatcaacgccgactcccccaacaccatcggcctgaccaccaagctcccctcgcgcgccaacaagcctgccaagtcccagcagacctcttccttctccgccaacacccccggccgcaagatctacaagagcgtcgtcaacaccaccgccaagcgtggctaccgcgctgacctccgcgccgccgctgtcgcccgtgcctccgccgtcaagctttcccagcagcagaagaaggagcgcgctgcctccaagccccgtggtgctgccgccaagaaggccgaggagagctcgtagagagtttctctctttgatgtcttgtcttcatgatggntgatcgcagggttgttgtggggtttggcgcaatagatgcactgggccggtcttgcatgaatgtagcatgctgaaaatattattanaagaaagaaaagctgctgcacgccgaaaaaaaaaaaaaaaaggcccta

SEQ ID NO: 20055 - DNA, 860 bp, Sorghum bicolor
  Clone ID: LIB5051-012-A1-XP1-A12
gccggccgggtccgggactaacccacagaccacgccgccaaatgaggtacattcactccgaggaaaccctgaaggtccctgagggcgtcaaggtccacatcaagacccgccaggtcaccgtcgagggcccccgtggtgtcctcaagaaggaccttggtcacttggctgtctctttccagcagcctgatgcctccaccatcaagatcgagatgcaccacggtgcccgcaagaacgtcgccgctctccgcaccgttcgctcgctcgtcaacaacatgatcattggtgtcaccaagggcttcaagtacaagatgcgttacgtctacgcccatttccccatcaacgtcaaccttgacaaggacaacgacaccggcctttgggttgttgagatccgtaacttcctcggcgagaagctcatccgccgcatcacctgcggtgagggtgttgaggtcgaggcctccaagaacgtcaaggacgagctcgtcctttccggcaactccatcgaggctgtctcccagtccgccgccgacatccagcagatctgccgcgttcgcaacaaggatatccgtaagttcttggacggtatctacgtctccgagaggggcaacatcgagcaggagtaagcgtattctggctggacggttgctgtggtacgaacgagacggggggttacttcaggcatttttgagcccgcagacaaggccgggacggatgcactggaatacaggcggctactgtttatgatgaaatgtagctccgctgaagaaacttcttgcgttcaaagcgccttttttggctcccgcttcactttaacgctgttgggttcttctattttcaaaagttccgcgccactgttggcgcat

SEQ ID NO: 20056 - DNA, 847 bp, Sorghum bicolor
  unsure (1)..(847): unsure at all n locations
  Clone ID: LIB5051-012-A1-XP1-A9
gccggccgggctttcgatcataaccaaaggcaagacaatggctctctccaagctcgatggctgcgagcttcccgctgcggcggacatgcacgttcacctgcgtgacggcgccatgaccgagttggttgtaccaaccattcgcaagggtggcgtcaacacggtgtttgtaatgcccaacctggtcccaccgatcacaactcctcaacatgcgctcgactaccaacagcgtctgcagagtctggcgccggacgtcactttcctcatgtcgctataccttcacccgaacatcactcctgagactgtgatcgaggcgaagaaggctggcatcactggcatcaagtcttaccctgctggtgtgaccacgaactcttccgctggtgtcgtctcttacgaggctttctaccctgtcttcgaggagatgcagcgtcagaacatggtgctcaacttgcacggcgaggcaccaccctcagctacttcggacgtcacagtgttgaacgctgaggagaccttcttgcctactctgctggagttgcacaggcgtttccctaagctacgcatcatcctcgagcactgcacaaccgctgctgccattgaggctgtcaagtcatgcggcccgaccgtcgctgctaccattacggcacaccacctctgtctcactgtcgacgactgggctggtgaccctcactgcttctgcaagcccgtcgcgaagctgccttcagaccgcagggctctcttgaagactgcgatcagtggcgaccccaagttcttcctcggaaccgactctgcgcctcaccctgcaatctcaaagcgcgntgaacaggtcgctgccggtgttttcactcagccc

SEQ ID NO: 20057 - DNA, 780 bp, Sorghum bicolor
  Clone ID: LIB5051-012-A1-XP1-B1
gccggccgggtcgggatcttacctcgtccaacaaccacaccaatgatatcgactataacacttctgccgctcttggcggcgctcatctcccccgtacaggcgcaaacgcgatactgctacgatcgtttcggccgagtccgacgatgtagcggcctgtcgtacggtgctcgaattggtatcggaatcggtatcgccgttgcggtcttgctcatctttgggctgtgcgggtactggcgacgccgaaacatcaggaaccagtgggccaagcacgcgccgcccgctctccccttcaccaacaacaacaacaacagtaccaacccgtacgccaacaacccacctccgcccaccggcggcgggggccagaccaactggaacagcaacccgtacggcagcaacccgccgcccccggcgcagacgtaccagccctccaacgcgggctactacggcgccggcaacggcaatcgtgagggacaggccgacaaggtgaacggcgggggcgcggctgctcagaacgagcacgagcacggatacgagtgggagcaggcgcgcgaggctgagcgtctcgagcgggaacgcgagaacggccccgcgccgcccggctacgacgtcgctgcgtctcaacacaacacgggcaactcgaacgggtatgccccgcctccgggcccgccgcccggcagcaaggagacgccgatcgtgcggaacttgtaggacagtgtgagggcaacagcgtagaccatctcgagtatagagacgggcacccgaatctagcgtcggactatc

SEQ ID NO: 20058 - DNA, 672 bp, Sorghum bicolor
  unsure (1)..(672): unsure at all n locations
  Clone ID: LIB5051-012-A1-XP1-B10
gccggccgggttccgactgcttccgtnattaccatccgactctttcccatcttcgcactcgatctcactcaaccaaatatcctcctccttcttcacccaaacaaacaagcccactcgaccaatactccaacatgtccagagctttcaagatcggtggtggtatcgccgcggttggtgcaggctactacttctaccaagctggtggtgatcccaaggccgcgcagaagaggtttgaagccgacgcagctaaggtccagcacgctggaaagaacgacgcttccagcaagggcactgagatccgcaaggacgccgaggtgtttgccgccgatgctggcaaggaggtcgacaggctcgccgcgcaagcccgtgatggcacccacaaggtcgaccaaaagctcgaagagtacagggcaagagcagagaagaacatcgattcgacgatcaagaagacgggcaccgagctgaacaaggcggtcgattcatttgacaagaacgtatcggagggcgccgacaaggccaaaagcggaatttccagctggtttggcggcagcaagtaaaggccataccagtagtgctggatggatgctacgagcaatcaagaatgaatgtaatgatatgactactaatcagtatcgaatcgactattaaaaaaaaaaaaaaaaaaggccccta

SEQ ID NO: 20059 - DNA, 683 bp, Sorghum bicolor
  Clone ID: LIB5051-012-A1-XP1-B3
gccggccgggccgtcatcactcttatcacctcattactcacccacgttacgccagtaatacctaccatgtccaacaccatcccgcccactgaccccgtcgccgccgtggtttccgactcgctgcccaagccggtggcccccgcagaggccatccagcagccacccgctgccgcgctggagccgttgaccaagaccgagggcggctttttgcaacaggcccgagagaccatcctgccttacgtcgagaaggtgcaaagcacggcgaagccatacaccgacgctgccacgcacaaggtggaggagcttgtccagaagattgagggcactgccccgacgtctgcgaccaccaccgacccgaccgcaacgcgggatctgaacgccccggctggtaccaccacgactggacagaccgccgcggagaaggcccagggcgtcttcgcgcaggtctccagcgctgtcacaagcaccttccagcaggtcaccaacaccattgagacgcgcacgacgaccgacacgcacccgggcttcatcacgcaggtgaccaacgcggtccacaagggccaggagaagattgaggcgttcctcgaccagccggtgcagggctcgcagcccgctgtgcagacacgacgaacactgtcccccacacgactacgaccggaaacccccgtggctgctaccccgct

SEQ ID NO: 20060 - DNA, 782 bp, Sorghum bicolor
  unsure (1)..(782): unsure at all n locations
  Clone ID: LIB5051-012-A1-XP1-B4
gccggccgggttggnatctttcttatatctcttgtcatatagtccccgtcaatcctctaccctctttgtaccatgcccgccgctatccccctcttacccctcgacgcgcctgaagcctggacaaagccaagtttggcaaatacagatggagggaagacttacaaaccgactcatcccgattgtttcaaagtggaattcagcgctatacctcctgatgaatcgggtggagaggagaccttcgcaagcgcgttgatagccgtcactgacatcgagccaaactcgatcatcaccccattaaccaacctctctcaagcgcctttaaaggcttattcttcagtccaatacggagttggagatcacgatcatctggaattgaactcggatctactgtttatgaatcattcttgcgatccgacggcgtacgtctctttaccgaaatacaaacccgatcaatgggtcttgatgtctacacccaaaggcctcaaacggagcgaggccgtcacgtttttctatcctagtacggaatgggacatggctcagggcttcaaatgttcctgtgggtctgagaactgtttgggtgagattaagggcgcaaagtacctttccatcgagcagttggaacagagaggtcacgtcaatcaacatatccggagtttaaagggacaacaggaaaaggaacagtcatangatcatagaggcgatagagtgaaaaacaaaagactagacatctgtgggcgtcgcatatctgtagcgcaagttaatatgcatccgtataagatgnc

SEQ ID NO: 20061 - DNA, 695 bp, Sorghum bicolor
  unsure (1)..(695): unsure at all n locations
  Clone ID: LIB5051-012-A1-XP1-C4
gccggccgggctggggtcctttgtccccttataataccattaccacctcgttgtacattcttgaaaacgtataatcaatcatgaagtggacgattgctctcggactggtctctgccgttgctgctctacgaatcgaaacgcctcctgcactcgtgacatgtcaacctgctgcggttcagtttggtgatggtacacccccctactttattgccgttttgccagcaggcgaagtcagtgctgtgcccttgttacaattccctgaacaacaaagtggaccatatacttggaacgtgaaccttccggccggtaccaaccttacccttcgagtgactgatggttctggtagcccggcatattcttcccctgcggtcattcaagccggtccagatacctcatgtgtgaatggaggatctagcgccagtgcatctgccggacctagcgcttccagtgcgagtggatcggcgggtccatcggctaccagtggttcccctaccaacccatctgcccctactcccgcgcagtccccagctcagtcttccggggctgcagtcttgngacaatcggttggaggaccgatggtcggtgtggtgggtctcgctgccgccctcggtctcctcgtttagaaacgaaatgtgagatagtttgattaacgatgcatgtatcctgaacnanaaaaaaaaaaaaaaaaggcccct

SEQ ID NO: 20062 - DNA, 569 bp, Sorghum bicolor
  Clone ID: LIB5051-012-A1-XP1-C5
gtgcggcgctcaggcggcgggcgggaatctacagcctacacaagatagaaaccctttaccacagcctaccggaccttctcaccaccgagcagcaggaagacaagaccggaatcgaaacactcgaacaagacgttggtaaacttgacgtcaaggaacagaacctacaagacagggtcaacaagtactgtcaagagtttctttacatcggcggtcctacaccccacaaacaagacctcacgtcaacctaaacaccatgcctgaccaccccgttgagcaaggcgccgctggcagcctcaccgacaagatcgcaaaagagtcgtccgactcgaccgcctcttcgcacgcgaaccacgccgatattcaggctcacaactcaaaggggcctgctattcctgatagcatgcccaaggctgagagcaaggaggaccttaagaagagggctgaggagttgaacaaataaatggtatgcgtcgttggaatggaagggaacatgctaggttgttagcggaggtagaaggagaaataatgaatatgtcatgatggaaaaaaaaaaaaaaaaaaggccccta

SEQ ID NO: 20063 - DNA, 724 bp, Sorghum bicolor
  unsure (1)..(724): unsure at all n locations
  Clone ID: LIB5051-012-A1-XP1-C6
gccggccgggcctggattctaatttcgagatcgtgggggaggagtcaagcagacgcttcgccgctccctccttcgcacggttcaggtcgcactcccttcttccgccgcatgagccctgcttcgccgccgccgaggacccttctggtgtcgtctccctcgccccctcaccctcacagctcgtcatcgcaactggttgcgatcgcggtcttgaagccctaggttagggttgcttggtcgacaccgacagttgatgtcgggttcggcatcggcgagctcgccgcaccaggagtggccgcaaccgcctctcctgcttgtgctcctccaacgcttctaccagatccaggatgtctggatgtgttccttgcgattggacgcaggcggcagccataagctcctcttcaattgcagcaaggatgcatgctgaccagcgcctggtggatatgatgcccttggttcagtcttccatatctactttttttcgttgtgtcaaatgagcctccacatgagttaggttacagcttatttatgttgtcagggagcaggtccttgttgtctagctttatattatcacttaagttatgcattcttgacgaggagttccggccaacgcattagaggtaagctctcatatgttcatcgcatcacatgttgatgaaaagntgggatctcgcatgcattggattttctatttacattangagttcaccattgcttgtttggacaa

SEQ ID NO: 20064 - DNA, 667 bp, Sorghum bicolor
  Clone ID: LIB5051-012-A1-XP1-C8
gccggccggtccgggacgaggtcatgtcgatccacccggtccagaagcagacttcggccggtcagcgaacccgattcaaggcgttcgtcgccgtcggtgactctgacggtcacgtcggactcggtgtcaagtgcgccaaggaggtcgctaccgccatccgaggtgccatcatcgttgccaagctctcgatcgtccccgtccgacgaggatactggggttcgcacatcgccgagccgcacaccgtcccgtgcaaggtttccggaaagtcgggatccgtcatgtgccgactgatccccgccccgcgaggaaccggtatcgtcgccgccccggcttccaagcgaatgctccagctcgccggtatccaggactgctacacccaatccaagggatcgaccgctacccagggtaacttcttgaaggctaccgtcgctgcgctcgccaagacgtacgagttccagtcgccggacctctggcagatcatccccccgggtctttccccgtacgacgagcactccacccacttgctcatcgctgctcgaaaggctgccggtggctactaaacagtcgattgtcgactggcttggtagtgggattcggaggatcatgggattattacactgagatgcatttgtcatcgctttcaaaaaaaaaaaaaaaaaggccccta

SEQ ID NO: 20065 - DNA, 488 bp, Sorghum bicolor
  Clone ID: LIB5051-012-A1-XP1-D10
gccggccgggtccggacaccactctcatcaaacaactcatacacaacactcaaaccaaacaacccccaccaccaaaccatcaacatgtctgctcccaacgccaacgctcccaacgagggcatcgtcggtcaggtcaccaactccatctccaacgccgccaactacgttgccgagtccgtccagggcgccgccgcctctgcctccaaggagggcaacaaggagcaggccaagggcaacgtccccggcaaggactccctcaccgaccgtgccaccggtgctcttgacgccaccagcgacaagctcaacgagaagaagcacgacgcctccgcctccgccaacaagcagggcatctaaatgtctcgctccggcacgtcagttacgaactctcatgattgttaaagcgtcttaatccgatgcgaagataattcagataattcaattagcctcaagaaaggcacgttcaaaaaaaaaaaaaaaaaaggccccta

SEQ ID NO: 20066 - DNA, 722 bp, Sorghum bicolor
  Clone ID: LIB5051-012-A1-XP1-E8
gccggccgggtcggggctgttctaaatctccagagcccccttccgacacatgggtatcgatattgagcgccaccacgtcaagaagggtcaacgtaccgcccctcaatccgaggacccttacctcatgcttcttgtcaagctctaccgattcttggctcgtcgcactgaatcgaggttcaacaaggtcatcctccgcaggttgtaccaatccaagatcaaccgaccccctctttcgatctcccgcatcgctcgtcaagtctccaagtccaacaaggcttacactgacaagcacaccgtcgtcactgtcggtaccgtcaccgacgatgctcgtctcatcgaggtccccaagctctcggttgccgccctccgattcacccgtaccgctcgtgctcgcatcgagaaggccggaggagagtgcatcactcttgatcaactcgctctccgcaagcctaccggttccaacaccctcctcctccgtggtgcccgtaacgctcgtgagaccgtcaagcacttcggttccggagtcaaccacgccaagccttacgttatctcaaagggcaagaaggaggagaacgctcgtggtcgtcgtcgctctcgtggattcaagatctaaacagtttagtttcggtcttgaattgttgcgaagtggaagtgggagaaggttgcaaaaacatttctgtgctttttcctggagaaataaaaaaaaaaaaaaaaggccccta

SEQ ID NO: 20067 - DNA, 692 bp, Sorghum bicolor
  Clone ID: LIB5051-012-A1-XP1-F9
ctgtgcggcgctcaggcggcgggtccgatccttcttctccaagaataccggtaccaccgcagccatggcctctcccgtctacaccacccgcaaagtcggtgctcctcacaccctcgagcaccgcgtctacatcgagaaggatggcgtgcccgtctcgcccttccacgacatccccctctacgccaacgagcagcagaccatcctgaacatgattgtcgagatcccccgctggaccaatgctaagcaggagatctccaaggaggaaaccctcaaccccatcaagcaggacaccaagaagggcaagctgcgcttcgtccgcaactgcttcccccacaagggctacctctggaactacggcgccttccctcagacctgggaggaccccaacgtcacccaccccgagaccaagatgaacggcgacaacgaccctctcgacgtgtgcgagattggtgagctcgttgccaagcccggtgaggtcaagcaggtcaaggtcctcggtgtcatggctctcctcgacgagggtgagactgactggaagatcatcgtcattgacgtgaacgaccctctcgctccccgtctcaacgatgttgaggacgtcgagaggcacctgcccggccttctccgtgacaccaacgagtggtttcgcatctacaaaattcccgatggcaagcccgagaaacagttctccttct

SEQ ID NO: 20068 - DNA, 409 bp, Sorghum bicolor
  Clone ID: LIB5051-012-A1-XP1-G5
gccggccgggctcgcgacagcaagcccaggaagaggtggccaaggccaaggaaggactggtcgagcgcctcaagcaggccctggacgcccaggtcagcgaggtacgcgtgtcccatcgcctgaccgattcgccggcaatcctggccatcggcgagcaggacttcggcctgcagatgcgccgcatcctggaagccagcggccagaaggcaccggactccaagccgatcttcgagatcaatccgcagcatccgctgatcgagaagctcgacggcgagcccgatgaagaccgcttcgccgacctgtcgcacatcctgttcgatcaggccgcgctggctgcgggcgacagcctcaaggatccggccgcctatgtccgccggttaagcaaaaaaaaaaaaaaaaaaggccccta

SEQ ID NO: 20069 - DNA, 763 bp, Sorghum bicolor
  unsure (1)..(763): unsure at all n locations
  Clone ID: LIB5051-012-A1-XP1-H1
gccggccgggccgggatcatccttcacagctctttataatccttcgagccccggtaatccactgctacagatctaaagcgcttacatatatctgcacaccactcgctacatcatcgtcaccatgcactctagcgccctcctcactctcgctgtcgcagcgaccggcgctctcgccggtcccatgaagcgtgagacaactgccagcgccagctttgcttgcaaccctgcccacagctacccaggtggtgcccagtgcgtctccaccaacggtgccttgaccctcgtcacatccaccgccaccgccagctttgcttgcaacccggcccacagctacccaggtggtgcccagtgcatctcgaccaacggtgccttgactctcgttacctccaccgccacgacctcagccaagtcctacaagaagaccagctcggccaccacgcccgccgccgtctccaccactcccactgctgctcccgtcaccaccgcaaagcccgcctccagctcggccaagtcttgcaaggcgaagtcaaccagccaggccgccgcgagctcatctgctgcagcttccagctccgctaagagtgccgcctccgccgccgccactccctctcctgccgccggngagaccaaggccaacggcctgacctggaccgtcaaggatctgacccgctactgcaaagacgacnnagtccggctgcgactacaagttcagcctgactggcagcgacaaccgcccccgccgtgacttgcagcatcagccgct

SEQ ID NO: 20070 - DNA, 731 bp, Sorghum bicolor
  unsure (1)..(731): unsure at all n locations
  Clone ID: LIB5051-012-A1-XP1-H12
gtgcggccgctcgnaggcggcgggtacggaccgagggcatctccatcctgatctaccgtttgattattggcgagcttcattccattccatcagttcctttggcggaggatgtcgcgctgcggaggcaactgcgggtgcggctccggctgcaagtgcggcagcggctgcggagggtgcaagatgtacccggacatggctgagcagcaggtgaccaccaccgccaagactctcgtcatgggtgtcgcaccatcgtccaaggggcacgccgagggcgggttcgaggcggcggccggcgccggagctgagaacgacgggtgcaagtgcggccccaactgcagctgcaacccctgcacctgcaagtgagctgtataataaccccctgcactgcactgcagcccggaggaaggacggattcccttagctgtagtatagcagtgtcgtcactgtgtgtgtgtgagacacacacacacactagagtgacgtgaccacatgtgatagtgtctcgggcagtggtgagaacctataataagtgcagtgatgtggtggcctcgtgtccctcctcgcgcgctcctccgggggctcctataataacacgcggtggtgtggtgtgtgtgtgtgtgcgcagcgcaacacaacaacgggacgtgccccgtgctgtgtggacacctatagcgtgcgacattgtgtgtgcgctctgccccccccctctaatacctaatatctcccccgtc

SEQ ID NO: 20071 - DNA, 439 bp, Sorghum bicolor
  Clone ID: LIB5051-012-A1-XP1-H5
gccggccgggctcgcgccatcactatcaacccacccaccacccgtcaaccaccaactcactcatacaaacatgtctgcccccggagaagccaccgcccaaggcgctgccaacaccgtcgcccccggcggcgcccagcaggccaccggccagcaagacgcccttgacaagggcatcgacggcatcctcggcaaggccggccacaagcagtccgccggtaccaccgagaagatctcggacggcgtcagaagtcttttcaagaaggccaccggcaaggacgtccccatccaggacaagcaatagagcggtcgcacgcatagatggcggtcccccgtttgcgatatacggtgtatcgagatataagcgcgaagcgaagtcatttgaatgtatcgctgtgagagactgaaaaaaaaacaaaaaaaaaaaaaaaaaaggccccta

SEQ ID NO: 20072 - DNA, 268 bp, Sorghum bicolor
  unsure (1)..(268): unsure at all n locations
  Clone ID: LIB5051-012-A1-XP1-H6
tgcggcgctcgagncngncgggtacgtagcgtgaggtctcgaggtgcttttcctcaaaacagcctcagcggctgcctcccctacgagctcggcctgctcgagaaggccacggtcatcgacgccggcaccaaccgcctcaccggcaccatcccggcgtcgttcgcgtgcctgcgcaaggtggagcagctcaacctggcggacaacctcctgtacggcgaggtgcccgacgcgctctgccggctcgccttcagccacctcaacaacctca

SEQ ID NO: 20073 - DNA, 739 bp, Sorghum bicolor
  unsure (1)..(739): unsure at all n locations
  Clone ID: LIB5052-001-A1-XP1-B6
gccggccgggttcgagataactaacccaacagtcaagtcatcatgcctactcgccttaccaagacccgcaagcaccgcggtcacgtctccgccggtcacggacgtgtcggcaagcaccgcaagcatcccggtggtcgtggtatggccggtggtcagcaccaccaccgcaccaacatcgacaagtaccatcccggttacttcggaaagattggtatgaggtacttccacaagcagcagaacctgttctggaagcccgtcatcaacctcgacaagctctggtcgctcatccccgttgagaagcgcgaggagtacctcaccaagaagggtggcaacgctcccgtccttaacctcctcgactacggctactccaagctcctcggaaagggccgtctccccgaggtccccatcgtcgtccgcgcccgctacgtcagcgctgaggctgagaagaagatcaaggaggccggtggtgtcgttcagctcgtcgcataaatagcgccacgatacgattgtgcatgataaggcgtctcggaatcatacaaaaggataacggcaatgattgggatggatctttcaagtccgcagtataccctacaggtctgcgtagacttgcgttcagcgtggtggctgaggaatgtttcatagacaatatgaccattcctgaatcaacctttggcctttggtggctttttcgctcaggaaaaaaaaanaaaaaaaaggcccctaaggccgcggccgctct

SEQ ID NO: 20074 - DNA, 674 bp, Sorghum bicolor
  Clone ID: LIB5052-001-A1-XP1-B8
gccggccgggttcggagaatcagattcctttttctatctagggtttctgcagaccagccgcccccgccgccgtttcggagctcagatcgccgctaacacaccacggtctcctgtctcgggtatcaacgtataattgggctgcgagactgactacacggatgatggcttcacgagggactagtgccgtgctttcaagagctgctcggatgaggcaaaaactgcagtctgtcttggaggccagtgccctagatattgaagatgtttcttaccaacatgccgggcatgcagctgtcaaggacaatgcaaacgagacgcacttcaacgtcaaggtttccaccaaaatttgaggggcagagccttgtgaagcgtcacaggatggtgtatgatcttctgagggatgagcttagctcagggctccatgctgtctccattgttgcaaaaaccccgaaagagttaggatcttgattgtataataatgtcgaataagcactgtcctatgtttcaaaataaatctgtcgtcatagcagtattcatgtaaccatgaactgattgccaaaacaatgccattggcatgctgctcttatgaagatctgatattcagaatagactggagtggagaatttattccaacttcttttgatgactaagaaaaaaaaaaaaaaaaaaggccccta

SEQ ID NO: 20075 - DNA, 745 bp, Sorghum bicolor
  unsure (1)..(745): unsure at all n locations
  Clone ID: LIB5052-001-A1-XP1-D6
gccggccgggctgcgaagcagacacaccacacattccttagtgtcatagctcaactgctgatggccgcaatgtcggagacgacggaggtgagactgcacggcgcatggggcagcgcgcacgccgccatggcccggaacgcgctggcactcaagggcgtgcagtacgagtacgtggaggaggacctggacaacaagagcgaggccctgctgcgcctgaacccggtccaccacgggaaggtccccgtcctcgtcctcgtcgtcgacggccggcggcggccgctcgccgagtcgctcgtcatcgtcgagtacgtcgacgaggcgtggcccgagagccccgcgctgctcccgcgtgagccccgcgcgcgcgccgcggccaggttctgggcgcggttcttccacgacgaggtgtcgccgctgtcgcgcccggtgctgttcgccgacggggaggccgagcgcgcggagctggtgagggagatgaaggcgcggatggccgtgatggaggccgggatagcggaggacttcccgagcggtgatgagggcccgttcgtgcacgggcgaagccccgggctgctcgacgtcatactgggctcgtgcgccgcgnngacccgtgtgctctccgccgtctccggngaggagatcgtggatccctggacgatgccgcgcgtgcacgctagcatggccgcgttcgaccagctcgccgccgggttcgggaacaccgtgccgcacgaacaccttctggcccggc

SEQ ID NO: 20076 - DNA, 869 bp, Sorghum bicolor
  unsure (1)..(869): unsure at all n locations
  Clone ID: LIB5052-001-A1-XP1-F10
gccggccgggcttgcgaccaccgtacagagccaccaaaggaaanatatcctctgggagacacatcagccaacatgtcgaaaatctctgtcgccggcgttcgcacgaacgttcaacagctccttgagtactccaacgagaccaagaagaggaacttcctcgagaccgtcgagctccagatcggtctcaagaactacgacccccagcgtgacaagcgtttctctggaaccatcaagctccccacccttccccgtcctcgcatgagcctttgcgttcttggtgaccagcacgacattgaccgtgccaagcaccatggcgtcgacgccatgagcaccgacgacttgaagaagctcaacaagaacaagaagctcatcaagaagctcgccaagaagtacgatgccttcatcgcctccgacgccctcatcaagcagattccccgtctcctcggacccggtctctccaaggctggaaagttccccactcccgtctcccacgctgaggacctcgccaacaagatgaacgaagtcaagtccaccatcaagttccagttgaagaaggttctctgcatgggtgtcgctattggcaacgttggcatgactgaggacgagttgatcggtaacatcatgttggccatcaactacctcgtctctcttcttaagaagggatggcagaacgtgggctccttggacatcaaggccaccatgagcccccccaagcgcctctactagagggtcggtcgttacttctgctgggttatgtcgtagctggctgtcgaaagacgactcgctacggattacgatcttacggaatctcgatggaatgaataccaaccgatgggtctagctagcttgaatgcatgcatgaacccgtg

SEQ ID NO: 20077 - DNA, 421 bp, Sorghum bicolor
  Clone ID: LIB5052-001-A1-XP1-F2
gccggccgggctgcgaagactccttcgaacttgttgaggaacgttcaaccccggtatcatcttcaagaagccgtcatcatgctcgcagcaatctccatccccacactactgcttctggctagcgttgccgcagcccaagaagagacgccctcggtcgcgacctcgccattcgtcagtcccacgcccgagtcggaggcaatctttaccattcagacctctgctgatccggacccatggtcttgctatatggactgcgtgcagcctccatgcccgccatgcaccggtagcatgatgagcatcccacccgttacagaaacagagtctgtcggctcaatcagccctgtccctatgcctagcgtgacagacgtatcgattccacccgttacagagtctgtcgttacaactcccgttcctatgccca

SEQ ID NO: 20078 - DNA, 502 bp, Sorghum bicolor
  Clone ID: LIB5052-001-A1-XP1-G4
gccggccgggctgcgaactccatttacatcacacaacatcatgtcccttcgcacgacaatacaaagattacccgccgcggctcgacccatcgtctccaagcgattcgccagcggaggtgcgcaatcgtggaacccgccgaccggttacttgtggaacgagaagccgctgcccaagggtcagaagcgaaagtcgcccactttcgagaagatcgcatggttcggatacgctagcttctttgcgttcggcgttgcgtggtactacaagccgaacacgagcttgcaagactgggctatggtccaggcgaagaagaggatggaggctcgaggtgacctgccaaagtacattccgtcggcggaccacatcgccaggtcgtagggcgggttatggatgtgcggacactgtcgaagaggctggacattggagactcgtctagctaggcagcagataggatgtatatgtatttcatttccttcgcaaaaaaaaaaaaaaaaaaggccccta

SEQ ID NO: 20079 - DNA, 481 bp, Sorghum bicolor
  Clone ID: LIB5052-001-A1-XP1-H3
gccggccgggctgcgatctctgcaacgacgatcacgccactctccacgccaatggggttgccgccggccgctggcatcgtcgtcgtcgggggccagcgcttgtgcggatggaggcaagctgacggaccgagcggcccccacgccgaccgccgcccagtcgtccacggtccaccggcaaccactgaggtcgtcgcgcccgccggccatccatagcctctcggtctcttcttcctgctactctctgcctcgccctttggagtcttgggttcttgcttctgcagctctgccaggcgtctgcatttttctcttcacatggattcggcttcaaaacaaagccggccccggtgttcgttttactccaatccggtgttaactgttaacacgtcttctctctttcgttttctggagccattctcttgagaaaacgaaggttgcagtgtaaaattctttcgggtaaaaaaaaaaaaaaaaaaggccccta

SEQ ID NO: 20080 - DNA, 149 bp, Sorghum bicolor
  Clone ID: LIB5052-002-A1-XP1-A3
tactgctttcgagttttaatcagtttccctcaccttctgtcccgctactgacttccgcggcgactctttggtaagcgcttttttgcctctggccgcggtcgcttcgacgagttagccgcgccttcttccacctgcaaggctgacctgca

SEQ ID NO: 20081 - DNA, 835 bp, Sorghum bicolor
  Clone ID: LIB5052-002-A1-XP1-B10
gccggccgggtcggggtcaggcttgaaactctactagttcatctcagaatctatctgatgtcgaaattgctgtttttggttcccgagctcatctagagaagcaggctcttgccacaaggaaatggtatagaaattttcttatgaaaggtttccatttggtagttttgttgactgctggtcctggaatcaaagatacacagtgtgggtttaagatgttcacacgagcagctgcaaggaagcttttcacaaacatcagattgaagaggtggtgttttgatgttgagcttgtatacctgtgcaagtgcctcaggatcccaatggtagaagtatctgttaattggaccgagatacctggttccaaagtgcgcatgacaagcatcattcacatggtattcgagctcctgctgatcaaagtaggttatggactggggatatggaaaatctactcgtagatcttgacatcctatgctgactagtttccgcaacttagtttacaatcactgtagcctatacagaacttagtccatcgccggcaaatccatttggaggaatacgtacaattttgcaagattttcaaatcaggagaatcaattcacatgtaccctagtgttttactgtacaattttccgaggattttcaaatcaagagaatcaattcacatgtaccctagtgtttgatcatagagatgtcgcaagatataggccaaatttgttgtcccagctgatgaactctctccttttactgatttattatacaagaaactcaaattgtgtctggcgttgtatcacagaagagggctaaacttgttactagaaaaaaaaaaaaaaaagcccct

SEQ ID NO: 20082 - DNA, 225 bp, Sorghum bicolor
  Clone ID: LIB5052-002-A1-XP1-B7
gccgggatgcttacccgcgttcacaaccaaccttttctcaacctcctcctcgccgtccgggcgcgcgcgcgcgcgcgcggcgctcgcggaccgcggtgaccacccagcggcgtccccgtcccctctggcgccgctcccttcgctcccgttcgagcagccccgcgggcggctctcggacgccgcgggagtgtttgccgccgtggacgcggtatcctcgtttgcggc

SEQ ID NO: 20083 - DNA, 423 bp, Sorghum bicolor
  Clone ID: LIB5052-002-A1-XP1-C10
ccggccgggttgggccactctctcgatctccttccctcatggtttaggtgctcttgcaaacactagccggcgatgccgtcatgcagctcgcgctcgccccaggctcgtgctcatctgactggctcgtaggctcgtgctccagtttcttcacaaccgtggcgaagctagaggacaggcgttgttcggccggcatgaacgcatccctgtgaccttatccttggccaaactctcgatgttctctctctactcactctttgctcgatctacaggaagccaggaaggcaacgtctaggtgctgagccatattattttctgtttgtgagaattccttccagggacttgtcattgtgagctgtgatttgtaaattattctacaatcctatttgatgttgttgcgaaaaaaaaaaaaaaaaaaggccccta

SEQ ID NO: 20084 - DNA, 663 bp, Sorghum bicolor
  Clone ID: LIB5052-002-A1-XP1-C5
ctcgagtcgctcggtgtcgcaccgaacttatctcttatcatcctgcggcttgttgtatctcctccgcctccgcttgaacctcctggccacgacatcttcatgatcagactccgatgagttccacttgcgaaatcgaaggtcgactctggtgcgtccaagacttacccgccccaggctggcaccggctgcaaaaacggcttcctcgccgtcatgggccgaccctgcatcgatgtgaaggattctacctcccacacatgggaagcacgggcaccccatttgcccctttgtggccataaacatattcgatcgctgaacgcttgaatatattgttccgtctgcacacaactgtgacgttccccatgtgaaccgcactgagtatctcctgattgacatatctgaggatggatttgagaggcttcttacttccgatgcttacactaaggatgatcttagactgccaactgatgatactcttgtggaccatattgatgaaagtcttgaaagagtgaaggatcttggtgtgactgtccagactgctatgggggaggagcagatctgcgccctgatcgatattggcccccagtatcttccctgacgtggaacacggaactactgtatctccactcttaatgaagaaggactcgtatcaccaaaggattgcta

SEQ ID NO: 20085 - DNA, 742 bp, Sorghum bicolor
  unsure (1)..(742): unsure at all n locations
  Clone ID: LIB5052-002-A1-XP1-D4
tgtgcggcgctcgaggcggccgggatcagtatnngggaccgtctttcaaccgtccatccaaacagtgtcaaccgtgtgagacctgacgatgttatcatggagaagcgtttgctgatgcaggccgttgtgctggcaacgacactgagaaccgtcaagattttggctctggaagatgcagattccatcgatgtcgtcagcaactatttgaagtgttttccatgcttggaaaagctatacatctcggcatcacaaggatacagaagtgctgcaagctatgataaacaaaatcctatcgagtgccttgagcatcatcttaaaatggtagcaatagatggatatgatggcataagaccacatgtcaagtttgcccaattctttgttcgaaatgcccggctgctagagttaatgaagttcagagtctttagaaactaccattgtgaacctgggacgaccaaggaatggattgaggatcaggaaaggcaactacaagtcaggagcatggcttctcgacatgttaagtttcattttgtacatgatgctagagattatcaagatgtttactgtggcgaggatatcagtgacctgtcagagcacatccatgattcctcaggagatgacccttttgatcaatggtttgaatcagagaaggaagccctggcatgctgaatgaaaacaagatgctatagtttggaactccagctgaaagcttggttcatttgataacaacttcatgttcaaacct

SEQ ID NO: 20086 - DNA, 749 bp, Sorghum bicolor
  Clone ID: LIB5052-002-A1-XP1-D6
gccggccgggctgcgagcttccgcggacggccaacagtcttccaggctgccccgtcgccgtcggcgataatccgccgccgagcaaagcagccgagccgagccgagccgatggcggcggcgctggccgcgctcccccgtggcgcttcccgcctcgcgcctcgtgtccgccagcctcccttccgcgctctctgcgccgcagctgcggccggcgaggcctcgaagcggaggctggtactgtacagcaagccggggtgctgcctctgcgatggactcaaggagaaactccacgccgcgtcgctgctcgctggcacgccctactccctcgcgtccctcgagctccaggagagggacatcacgacgaatccggagtgggagcggctctaccagtacgagatcccagtgttggccaaggtgctccccgacgggaccgaggaaatacttcccaggttatcgccacgtctaagtgttgagctcgtacaaaagaaaatttattctgcgtttgatcagtaaggagaccttttctggggggcaatggcaattttatttaattaatagctccagctgtaagatgtcagttgtaatactttcttgattgacacatggatttcaatttgcttgacttgtgttctgtaaggattttttatagatttgttcattgctttgatgaaatgtattatatggagtgacatccaaatacttatgttgcttcttaagaattatatgccaaaaaaaaaaaaaaaaagggccct

SEQ ID NO: 20087 - DNA, 551 bp, Sorghum bicolor
  Clone ID: LIB5052-002-A1-XP1-E12
ctgtgcggcgctcgagccggccgggtccggcctcggtgaagctggcgcctcagtggtggcaggacaatgccggtgatggggtgtttgatatgataatgacctttgaggagagggtcttcgacttggttgttgaagatatgagtaaccgcgaaccaaggctgatgaagtgtgtactgataataaatatggatgtcaaagataaccatgaagaagctggtgttggggcaaagcttgctgtagagttgtgccagaagcttgaagcaattgatggtgactgggaggacataattgatgacctgattactgcatttgagaagcagcacaagcggaggcttgcatacagcatttcattctactaacttgtatagtcccctgtgcggacagaggttgcagtggatggttggtaacttggcattgtagtaagcaactgcacaggagtgaagcatcaatgttgtggcagtgttgcttaaattcttccacgttgacatttgcaaaaacaggagatttgtggagcttatataacccaaaaaaaaaaaaaaaaaaggccccta

SEQ ID NO: 20088 - DNA, 404 bp, Sorghum bicolor
  Clone ID: LIB5052-002-A1-XP1-F11
gccggccgggttcagacgcgactttgtgagtatcccaaaaccacccctaccgtggctttctcaacaaccactttttggagaatgcagacgaactaacgaaatcgcaacaccagacttcatagaatcatttctatagtaaacgtccataactgtgttctgtacatgagccacagactccaacctggctgatgagtcgatgccccgcgcccaagagtgatgccgacgtgcgctggttctcttttgaactagcgtggcgatgatctcaaccttgctcagtgttctggcttcggccggctgtgttgggagggtgtggcggtatgtctgacaggttcacttcttttttgtgttgctttcatctgttcgtttcgctcttgaggcaaaaaaaaaaaaaaaaaaggccccta

SEQ ID NO: 20089 - DNA, 795 bp, Sorghum bicolor
  Clone ID: LIB5052-002-A1-XP1-G9
gccggccgggtcgggccttgtcgtccattcccatcaccccgcgcgacgacccgatcgtcgacaggctgcacgctctctactgcttcgacgtgctcgctgcgaagcttgagcaccgagacgccatagctccgcccttcaagtcggacaccaactatgcactcttcgtgacatggaacacgaccagccatactcggcacaacaagaaaccggctttgcggggatgtatcgggacgttctcgcctctaccgcttgcgaaaggtcttcgagactacgccttgatcagcgcactcgaagatcaccgcttttcacccatcaagtcctccgagctcccctccctatccgtcgccatatccctcctctcgcccttcacgccgatcccggacccgctcgcctgggtcccggggacacacggcatccacatcaccttcccgcatccctcgcatccgagccgatcactctccgcaacctacctgcccgaggtatgcaccgagcaaggctggacgcgggaagagtgcgtgctctctgcgatccagaaggcggggtatcgcgggacggtgcgagtgggggacgaggtctggcggagtctgaaagtgagggtgtattgctcggagaaggtcggggcgacgtgggacgagtacgttgcgtggaaggcattgtatgacaaggaagcggacgcggaagaggatgcgggtggagaggaagggcgggagctgtgatcagaccatacggacactggatcggcttcgattgcttgtactatgactggcattggcgaacagctgcgaggtccgctcg

SEQ ID NO: 20090 - DNA, 706 bp, Sorghum bicolor
  Clone ID: LIB5052-002-A1-XP1-H12
gccggccgggtcgggagctcccgttcttcattgctcggtaccgcaatcgccttgcgctgttgctccctctaacgtctgtcaattctcaatttcctcgttgctcgaagttttcgatcatgacgccatcaccttccgaagccgtagcaaaggttgcgcaagccgctgccggcaccaactcgtccgcaaaggtgtacaagagggagtccaacacagctagggtattgggtgcaggatgtgcgggtatcgcagagcttatggtcttccaccctgtcgacaccacagcgaagaggttgatgagcaacattggaaagattgaaaacgcagcgcatcttaacaaggtcgtcttcagggacgcggccaacgcctcggtcggtggtcgtttcctttctctcttccccggtctcggctacgctgccgcatacaaggtgctccagcgagtatacaagtttggcggacagccctttgtacgggactacctcgcgcacaaccacggtgacagcttcgaccgcgcattcggcaagggcaacggcaaggccatcatgcacgcaactgcaggttccattatcggtattggtgtgatcgttctcctgccattggacgtactcaagatcaagcgacaaacaaaccccgaggctttccgaggccgtggtcaggtcaagattgtctcagacgaaggatttggactgcaccggggttggggatggac

SEQ ID NO: 20091 - DNA, 805 bp, Sorghum bicolor
  Clone ID: LIB5052-002-A1-XP1-H5
gccggccgggctgcggcaccgctgctcgcgtcggccgccctccgcatgctttttgcttccccgtctccggcgactctgatccctctcctcttccagtgctcgatcgcgcaccaggttccataccaccgactcagtaatgttcgtaccaacccggacgcagcgacctagctagccgccctctcgctgcagctccgtgccgcggaggctcgcgacgcgttcgacggaatgccgcacgagccatgggaccatcgccccagtggtgatgggtcctcattcttgcggtaccgtgttcctgcctcgctcaggcccttcaattcatcggtgacgctcgtccgctttacggtcttttgcgacggcttgtggcctcgtcattgtcgccgtctgccggtcgaagcacttgtcatggccatgcgtgcggaggggagcccgcgcgggagcggatatacggcccaggaattgattgattgattcagattcaagttgtgggagtcaacaattggtagagtgtgaatgtgtgatggatatctagttcatgggcaggcagtgtgatagtgcggatgagaaaaggtgcgcgccagagccctgagaagaggagcaaacattaaacatgtgtcgagggataaaggtttgttctcactgtttcgcaggcaaagtttctccatgtcagtataaatgatcaacggatctagcaatctagagtctgtttacttggtttaagaatatggttcttcagatgagagtgtactattttcagaataacacgatcatgtttctgctttcgaaaaaaaaaaaaaaaaaggcccct

SEQ ID NO: 20092 - DNA, 236 bp, Sorghum bicolor
  Clone ID: LIB5052-003-A1-XP1-A12
gggggggggggaggaaaaaaggggggaaaaaaaacctgtgcggcgctcgagacggacggtttcaaaaacgggtgcctcatcgccaccctttctcctccctccccttccccttcacctcacaagccacctagccgcaccgcattggcaatttgcgcatggcgtcgtcctgcctcgcctcaccgtctagcgccgcgctctgccgcccgcagcggccgaggagccgcgacgtctcgtga

SEQ ID NO: 20093 - DNA, 729 bp, Sorghum bicolor
  Clone ID: LIB5052-003-A1-XP1-A4
tcaggcggcgggcgcgattacgtctcggttccgcgaattatcctactgaagatgacgagctgggaagaagctactgcagtggagaaactctcctctaacacgtactcgtgcaacctacaagatgattggtgtataggaagcgttcctaacggtggttacgttaccggatgcatactggaagtagtcaaaacacatttcaatacaactttggcaaaacaaaaccaaccacacacaataaccctccatgtcgagtttctgcgacggacgcaagccggacctgccacatacaaagtcgaagatgtgaagctcggccgacaaacgtctgtcgtgcatgtaaccatggagcaagacggacggaccgaagtcgtcgcgtacgtcacaaactctaacatggataccgaagcgggctttacgcacgacaccggatatcggccctcaccatccattccatcggtagacttttcgaagctagagaatggcgaagacccgaactggaggtatcaagccgaaatgccacacgccgagttcagaaaggctacgaagagagttcagttctacttccctcgagaagacaaaagcccagcgtatcttgccgatgaggtagtttgcttctccgatgggaaaacctttacaaattcatctgttgcgtttgttgcagacatgttcccgttgatggtcgagtcgttcaaagaaagggcgaggggcccttctggtacccgacgctacctg

SEQ ID NO: 20094 - DNA, 558 bp, Sorghum bicolor
  Clone ID: LIB5052-003-A1-XP1-B12
gccggccgggtcgggcggagcccctgcccaagcccgagctccccgtcccgccgcagcccctgcccaagcccgagctccctgtcccaccagagcccctccccaagcctgagctgccggtgccaccggagcccctgcccaagcctgagctccccgtgccaccgcagccacttgccaagccggagctgccacccccggtgctggctggcgagcttccaccgaagccatgatcgatgagctacgaggacttcacggacgcatatatattgattgatcgacactgcggattcagatatatacgatatagatacaatttgcctattttctattccatttcttgctcattcgtgtgtgtgtttggtttgttgacgaggtgtgtaataatgtatataggtagcgtatcagaattgctgcgtggagtgtatattgccatgccatctgatccgtgaccgtgatctatctatgtactcttgctgagatccatatgtactgtatatatatctaataaatggattcgtttgtatatgtgtacttgaaaaaaaaaaaaaaaaaaggccccta

SEQ ID NO: 20095 - DNA, 732 bp, Sorghum bicolor
  unsure (1)..(732): unsure at all n locations
  Clone ID: LIB5052-003-A1-XP1-B2
gccggccgggctgcggttctgtctccgaggtgaacgcggatcggcggcggcggcggcgcgaggcgagcaagatgagcgggaacggggtgatgaagaaggtgtccgacgcggcgacgaaggccggcaaggcgatcgactgggacggcctggccaagatgcttgtctccgatgaggcccgtaaggagttcgccaacctccgccgcaccttcgaggacgtcaatcaccagctccagaccaagttctcgcaggaaccccagccaattgattgggagtactacaaaaagggaattggatcaaaagttgtcgatatgtacaaggaggcctatgaaagcatagagatccccaagtatgttgacactgtcactcctcagtacaagccaaagtttgatgctctgttggttgaaatgaaggaagcggaaaaagcatcactaaaggaatcagagaagatagagaaggagattgctgaaatgaaggagatgaagaaaaagatcagcacgacgactgcagatgagtactttgcgaagcaccctgagctgaaacagaagtttgacgacgagatccgcaatgattattgnggatactaaggcgcagtgtcacctttctttggaacatccaataatacatttcgccccctanatgtccttanngagtaaccatccaaacttcacgaattgtgtagcgcatgtattgggcgtgcccaagttccaagtaacttgtctgtccttgcaccat

SEQ ID NO: 20096 - DNA, 599 bp, Sorghum bicolor
  Clone ID: LIB5052-003-A1-XP1-C10
gccggccgggccggggcgttgggtcagcggattagaacatgtcgaaccttagggtcgagtggttcgatccgcctctgcctctcatctgtgcggcggcgagccggcacccatgctggcggcggcggctcaaccatgtccagcgccatccgcacaagcacccaagaagaaggccgccgtggacacgggcacaggacgaccggcgccatccgctgctctcctttctcctcctcccaaggtgtggatctgatttgcaatgggaaatctaaaagtttgcatcaagtcatgggaggatgtggaaaaaagtttatgaaagatgaattggttttcaaacctaaggaagacatgagaagccatggtgtgcttgatgttggtttttgtaagatggaagttactgtcgcttggtcactcatttcctatcatcctgttcctttgaatgtttattagaaatgggaatgctactgtagctttgtggttgttagttctgaagtggcatgctattaagattgtgttgtgactgcacggtacttttttatgcaccggactgagattgatggcactatctcttggtcgcttaaaaaaaaaaaaaaaaaaggccccta

SEQ ID NO: 20097 - DNA, 540 bp, Sorghum bicolor
  Clone ID: LIB5052-003-A1-XP1-D10
ctgtgcggcgctcaggcggcgggtgggaaaaaacctccccggccactccaccagtccaccacccggccgccactatccattcagctgcagcccacagccgctagcgacgcgagtacgcagctgcacgagcacgagcgcatggagcgagttcgaagtagtgcaaggcagctgccaggcaccagcagctcggtggatctggacccgctcaggtctccaggcatggacgactcaaggatctactgtgcagcctccatcgtccgtctccatcagcatcgaagttcgttgcgttcatacatgtattgctattgctagctagttctggttctgtgccgtgatacatgcattgctagcttgttcgtatgtagatctctgttggttgtatctgtatattagtatatggctctgtgtatgcatatgtgcgggagctagacgcctggacacctgtgttggtgtgtgttgctggtaaactatgatttatgaatctgtgagattttagtaatttttgaaccttgcgaaaaaaaaaaaaaaaaaaggccccta

SEQ ID NO: 20098 - DNA, 885 bp, Sorghum bicolor
  unsure (1)..(885): unsure at all n locations
  Clone ID: LIB5052-003-A1-XP1-D11
ctgtgcggcgctcgaggcggccgggttcggacactacacacagacgcctcatactaccacttctacatcccgagcaacccttcaaactcgattagaaacaacacgagagagttctcaccctcaacatgaccactgtcactcccgaagttacctgggcgcaacgctcatccagcgacgaccccgagaagaactacgtatacctcaccatcgtcgccgccgatgtccccgagtcagacctcaagttggacctcaaggagcagtcacttagcttcaagggtacctcaacatccaagaaggtcacatacgccatcgaccttgagttcttcgccgagatcgaccctaaggagtccaagatcagccacagcggacgcgacgtcacaatggtactgcgcaagaaggaactcaaggaggagtactggcctcgcctgctcaaggacaacaagaagatgcacttcctgaagaccaacttcgacaagtgggttgacgaggacgagcaagacgaggcacccgaggacgagtccatgaaccagatgaacccaatgggcgctggcggtatgggcggcggtgacggtggcttcggcggcatcgacttcagcaagctcggcgcaggcggtggcggcggtatgccaggaatggaaggcatggacatggccagcatgatgcagagcatgggcggtgccggtggaatgcccggcatgggaggcatgggcggagaggacagcgacgacgatgatgacgacatgcccgagcttgagaacgacgaggacagcaaggacaaggcagcaccatcaggcgacaagcccaagattgagggagttgcgtagttgctccatcttctcgcgancagcttatgactggcagagattgattgggtggcgcgcatga

SEQ ID NO: 20099 - DNA, 513 bp, Sorghum bicolor
  Clone ID: LIB5052-003-A1-XP1-E6
gccggccgggccgggctttcggatctgggcgaggcgagctgcggcgcggggcgtcgcgggggccggaggaggaggatgaactggatcgggcgcaagatccacctctacaatgtcaccatcggcctctacatgctcgattggtgggagcgctacctcttcaatattttgatggtttgcctcttttggtacattcttcgctatctccttgggttcttccaaagtaatctgaagacgctttttcaggaggggaactatcttgggcaaggcagtacataaccattgtcaaacaagatctgcttatgatcatttgcccatgtaattccatctgtttaattagttgttaactgagaagctgagaaaactaatttgaacaagtgttaccgtgtagccattgtctgtatcttccctcgaagctaatagtctctagtgtttctttttatggaggagggaaaagaattatgttgtgcaagatttggctttttgttgtaaaaaaaaaaaaaaaaaaggccccta

SEQ ID NO: 20100 - DNA, 488 bp, Sorghum bicolor
  Clone ID: LIB5052-003-A1-XP1-G4
gccggccgggttgcgagaacattacaaatctcttcctaccaccatttccatttcattcgatccaatctatctccaaccaccaactcccacctccaagcacaacatcttgaaaatgcatgttgccatttaccgcatcactgtctatccaccatgtcacttccgccggcgctataaaggatcatgctccctcagagctttttgcttaacacgacagtcctcaaggggtgccagctctgacgaccgacaagaatgctgtggtcatttgctgctgcatcatgagtgtgatctctcctgcgtaccccaattgaaggagactggctcctctattgcgttgatagccatgcgctgacaccatgcgtagcggctgcttcttgcacctcattaagccgctactcacaggaatagaaatacagacctggcgataggagaaaaggagaggagaatgttaagtatgtaggatgatcacagtctcgacaggtctggatctt

SEQ ID NO: 20101 - DNA, 567 bp, Sorghum bicolor
  unsure (1)..(567): unsure at all n locations
  Clone ID: LIB5052-003-A1-XP1-H3
gccggccgggctgcgatctattagcattatgataccaataccactcctccccctttccttccatcacgccatcctaagccttgacgtagtatccccactgcatcaacatccaaagcaagctcgtgtttgcagcgacgactggcccaaccagcggcttcccccacctagcggtgccgaacacccaccactcgctcatgaaatgagcccaggcgacggcataactccacatggccagctgatacatggcggaattgttgatgttgtaggccgcgtagaacctaattaaacacgcaaggaaagtccaagttccgaaggtgcgtgaggaaagggccgttacgtgttttggcgttgtcgggggcgggtcaatgggcgtggggttgtagatgcgcgacgtaaaggccagtgtgctgtaagcttggatactgttcccgacggatatcactgagacctgggaaccatgtgttagtattgctggggtgctggactgcactccattcgtatggtatgcgtgtggaaaaannnnnnnnnnnnnnnnnnnnngaaaaaaaaaaaaaaaaaaggccccta

SEQ ID NO: 20102 - DNA, 662 bp, Sorghum bicolor
  Clone ID: LIB5052-003-A1-XP1-H8
cttcttccttccatcattcctatgttccaagaagtcgggctgcagactccactgggcgtgcgactcctggtgcaaccgcaggcaccgggtgtcaagaccgaaacacgcaccctcatctgcctgatcatcaagagaccaccaccgacaagaatctcggctcgtctgtcagcaccatcgtccaaagtgaacgccgcatcctcgtactaggcgacgacacgaactcggacctcagaacaaactgagcaagtgcacgcccaaatgcacactacaacccctgctgctgcaaataatctgcataataaccccctgaactgcactgaagaccacaggaaagacaaaatccccaagctaggatagctgtgtcgtcactgcagtgagtatctgtgacacacagccctccatccaaccgcaatgacaccatatgctacagtatctgttactgataggaacctagaataattgctacctgatgatcctcatgtgtcatccatcccgtactcctccggacaatcatctactaacagctcacgtggggtccagagattatgccgacttgtgtgaacaacagcaggacatgccccctgctctatgggcacgtccattctataacactttgatcccgctctgtcaccatccacctattacctataatatcccccgtc

SEQ ID NO: 20103 - DNA, 820 bp, Sorghum bicolor
  unsure (1)..(820): unsure at all n locations
  Clone ID: LIB5052-004-A1-XP1-B7
gccggccgggctgcggcgatgagagacgatgggaggcgaaaaaggccttgcaaccaaagcatagcctcactcgcctgcactataagactacacctcccacgaagaaagcaataccataatcactacttttgtaatacaaccaaaccgtcaccatggcaagcgagaagtcagatacccagaagcaggatgcccagattaagtcggccgacatgagcgaagagatgcagcaagaggccatcgaagtcgcacaatcggcaatggagcagtttaccattgagaaggacattgcccagtacatcaagaaggagtttgacagccgaaagggtgccacatggcactgcattgtaggccgcaactttggaagctttgtcactcacgagaccaagcacttcatctacttctaccttggccactgtgccattctgctcttcaagacccagtaagggggtgattttggattaggcaccatcggccatttacggtcacgtctcctctcatcgtcaaagacagtctcgttgtttcagagtaaagacggccgtttcgtttcaagctcgggctcggagtggtgcctgattgactttggtcaagtgtatggggagatgtattcttcttgtcagtattgactgttgtctttctatcaaggtgggagggtttgtgcaaatcagtggcgtctcttcacctggacacggtaaggtcgccacatctcaatgttaacgactgcgacgagtctccttctctccataaaggtggctttgaaggctaatctagcgatacacaatgaagcgntcgtgcttgtagaaaaaaaaaaaaaaaaggccct

SEQ ID NO: 20104 - DNA, 609 bp, Sorghum bicolor
  Clone ID: LIB5052-004-A1-XP1-B9
gccggccgggtcggggatacacatagactgtctttaccggccatgtccaccgccgatcccacagctcctcccttcgtcatagtcggcggcattgccaacttccgtgacctcggcggctgcaccacttctgctggccaaactgtcaccaagggccttgcctttcgatgcgcggacccttccaaagcgacgccagagggtctggacaagatgagccaggatctagaggtcggtctcgcaccgctacgcgaactctttgtagaacgtcttttgaagaatcctacgcttgctggtgacgaggtcggtgtgcgaaacatggtcagctcgaagcgggagaatatgctggccagcttggagatgattgacaatgagtttggtggctgcgagggatacatgaggaagtggtgtggtcttggagatcaagagattgagactctgaggaagaggttacgagcatgaggcgcaagcctttgacacgaaggagcatcggcaagcagagcgactgccactgcctatggagcaacgcgagtattattgtcactccaattgcatgccaaccttcaatcttgaggcaatgttgtattggaaaaaaaaaaaaaaaaaaggccccta

SEQ ID NO: 20105 - DNA, 650 bp, Sorghum bicolor
  Clone ID: LIB5052-004-A1-XP1-C12
gccggccgggtccggaagttctcttccgtcgatccacccaagctgtgactttgcatttattcagcaaaaggtcaagggactacgcttgatcgataagggcgtgcgttcttgacttgccgtcaatctctctagcgactccaaaccttgtcgcgtcggcatctagtctgtgcgtcgtcaaatttgggtgtcgagcaagactcgagatggaatacgggctggggtcgataagctagtcacagcacacatcatttcgacatccgaatcctcgagcgcgtgcgcggacaatcgaagatgtcatcggatgactctccttcgcagcgttaccctcgttcaccgcacacacgccaccattatgattcacataccgttcaatcgaatggaatctcttcaggtcataattctgcctcggatctgcaatcttcatctgttgtgccgcatacaactggacaacaggaaagtcttctactcacggacaaacggatcccagccagtctgagtgccaatctgcgaggtaatcgggcgcctgcgcctgcgtcactcgatcttagtcccagtcgccagcaagcccaagctcggcatgaggcaccacgcgtgagcttgtcaaatgcatctcgttgctcatccaaaaaaaaaaaaaaaaaaggccccta

SEQ ID NO: 20106 - DNA, 507 bp, Sorghum bicolor
  unsure (1)..(507): unsure at all n locations
  Clone ID: LIB5052-004-A1-XP1-C2
gccggccgggccggggattgtgcgaggttggtcagataagataattcgcagtccaacatgaattcgaggaacatttgtggagccttgatgtttatgttgttcctctttgcattccctgtgcaatctcgtccttatcaggagctcaatgttagatctgaaaggagcctggcatatatcctcaccaacacaacaccagatccgaataaattgtcaataaaattttgtgtgctgcgtgagtgcccaaataaacagtcatgctattgttgcttgacgcaaaaaccagatcaattgtgttactacaagttggatgaatgtcgggctgtgtgccctaattgtgatcccatctgcccgcctatcccatcgccatctgcataactgatctatacatcttattgtaggctctggtcttaaacttctcgtagcagtacatctaaataatgtattgaaaattgatatataattctaagnggagttgtttgttaaaaaaaaaaaaaaaaaaggccccct

SEQ ID NO: 20107 - DNA, 485 bp, Sorghum bicolor
  Clone ID: LIB5052-004-A1-XP1-E3
gccggccgggcttcgatctgccgtctgctcgctagcaatagtaatggcaccttcacggaggactctctttgcaaccgctgccatcgtccttgtactcatcatcgtggtcaccgagatgtcatctgttggggcaggtggtgctctttgcaggcacctgagcagcggatttaccggggtgtgcggttttgacactgattgtaggactcagtgcttgagcgagagccacgacaatcttggcggtgcatgtgacgggttccccgctaaatgctactgtgtgaagccatgcctgccttaagattggtgctgctctgtctgatccagcaataatacgacgatccttgccgcccctacatgtattactactacctgtgtaatgcggtagcttgcttgtaattttgttgccataaataaagttgttgaactcctggatctaataaatatatttggttttattttcacaaaaaaaaaaaaaaaaaaggccccta

SEQ ID NO: 20108 - DNA, 814 bp, Sorghum bicolor
  Clone ID: LIB5052-004-A1-XP1-F12
gccggccaggcttgcaatctatattccatttgctatactgccttctccctttcatgatctttgttttggaaattgcgacatcaaatcccagtcaatctaaaactttttgtttgcttgcatggttttgtaactagtcatatgtactacttaatagtcatcgctgttcagtgtctgctttacaaaccaaattgatggctagatgcttgcctatttgttctgcctgatttcatcgcagctcagttgttatgattactgggtttcctattttccagcttttgttttctgtttcatgtttgtagtgttgttttgtttcatggtctgatgagttttggtcatttacttttaataaagatctctgttggtgtgaagatctatagaacaggcatttgtagaagtgtaggcttgagatgtgctgtttacctcctttatctgaataacattattgtaatgagctgtcaatgttacaagactacagaacaaatgcattgcattctattttagctaaaaggtttattctttgaaaaagaaaatgatgtgctaattaactcagttctggggacttcaggagttccaggccggcctagcttattggaatgacttgttgttccattacattcaaagtccacatgttattttgttcagctccataatgctgtggcatcgtgttgggaaaacattgattgggagtagattagtacatgaataattgatctgcgtagttcagtttttgtgcatgtgaacatatggaaaatacgaagtcttagaggaactaattcctggcatgtggtgctcactgtgcagggcatcaggatct

SEQ ID NO: 20109 - DNA, 802 bp, Sorghum bicolor
  Clone ID: LIB5052-004-A1-XP1-G1
gccggccgggctcgggacacccacaccaccatccacacgcttcaaaacccaggcaacgaagccgcacttcagatctctcaccacacagcagcctaaaccgttgccatgcctaagaacaagggaaagggtggtaagaacaggagaaggggaaagaacgagaacgacaacgaaaagcgcgaactcaccttcaaggaggagggtcaagaatatgcacaggtcgtgaagatgctcggcaacggtcgtctcgaggccgcctgcttcgacggcagcaaacgtctcgcacacatccgtggcaagctgcgcaaaaaggtctggatcaaccagggcgacatcatcctgctgtctctccgtgaataccaggacgagaagggcgacgtcatcctcaagtactccgccgacgaggcccgctcactcaaggcatacggcgagctccccgagaccgccaagatcaacgagaccgacacctatggcggcgaagaggagggcggcatcggcttcgacttcggcgaggacgacagcgagagcgacggcgagatcgacgttgatgacatttgaggagggagaatctatactcttgtccttaccatggcgttggatgctgcgttttggcgacggcataagtcgggcgcaaaccgacttggaatgattctgccagtctcttctgggcggcccaaacagtgttggcgagcgaaggataacagacaccttcttttcgctcccgcactacgacaaagaaagaattctggccttgatgatgcagcgtgtgtgcgccggtcatcaggttcccgttcttctgttcatg

SEQ ID NO: 20110 - DNA, 538 bp, Sorghum bicolor
  Clone ID: LIB5052-004-A1-XP1-G4
gccggccgggttgcgcactctctcgtggcgcaattaggctaccgccgccgccgtagccgccgccgccctacgccacttcgtcgggccctaagctgcccaccaggtttgtattgagttttatgtgtccatgccctttactgggttcgccctgcaatgtgttggtttagtttaattgcctctgtgaaggcggaggaagttggagttccttctgctacaaatttgtaatcactgatggggaaggcaaagcgtgcctcaatcttcatcaggctggtttctgcagctggcactggattcttctatgtgaagcgctagaatcctcggcggatcactgagaagctggaatttagaaagtatgatccccgtgttaacaagcatgttctgtttacagaagcaaagatgaagtgagatcttgtatctccacaatgcagaactgtaataagttgtcaactttttacaatcagaaacctctgtgccgttattggacaagtgattaacaaaaaaaaaaaaaaaataaaaaaaaaaaaaaaaaaggccccta

SEQ ID NO: 20111 - DNA, 570 bp, Sorghum bicolor
  unsure (1)..(570): unsure at all n locations
  Clone ID: LIB5052-004-A1-XP1-G6
gccnggcccgggcttgcgggagaacggacccgcagtacaaacacgaccgtacgtgaggagagacgagcaaataggcccgcccgcagtcgccgcttatcctgccgcagcgcgtcggcgcgtccaacgacgaaaacactctactcacccctctgtcaggcaagacagccttaccgaccgcatcctcgaccactacctggacacctgctacctggatcgagttctccggccacgaggaccctcttgcccctcggatcttctgcaacagaacaacacctgatactgtagactcctcatctgatggtggagatagtacaacgtctgccacgagtatgcatgaacgataacgaatgaacatggattccgccctacaagacatgcaaatacgccccacatcgtgagaagcactatccatatgtaattaataaaagacaccccagaacaccccttggtagatgttatatcatacgtgtggaggcactgaggccaaatgaaccagcaaatataaacttgggcgaggactttcgtctgctgacgaactccttgacaaggtccctaaggacgcaggcgctc

SEQ ID NO: 20112 - DNA, 176 bp, Sorghum bicolor
  Clone ID: LIB5052-004-A1-XP1-H7
gccggccaggttcgggagtattgagcatttaaattaaaacctttggcccgtgaacatgttagcgagttactatttaattggttggcaccaggagatcttatccaggaggaatcgaccgaccgatcctacccccggtcaacgagatccggcgaatcggatacaaggaagggccccta

SEQ ID NO: 20113 - DNA, 433 bp, Sorghum bicolor
  Clone ID: LIB5052-005-A1-XP1-A1
gccggccgggccgtgcccaaggtaaaaacttcacccgcatggttatacgacattctgatagtcgatcccacttgaccatttctcgggtcagcgtaacgcgggcggtttggtgcaatcaatctgcaaggagatagaagatgaaaaaactcgccgcaatgctggccgtttgtacaatggcctttaccctggctgcctgttcaagcaactacgtaatgcataccaatgacggacgcactatcgttgctgaaggtaaaccaagagtcgatactgataccggtatgattagctataaagatgcgaatggcaatgagcagcagattaaccgttcagatgtgaaagaaatggttgagatgaagtaatccgcgcataaaaaaagcaccgcaatttgcggtgctactcaaaaaagtaaaaaaaaaaaaaaaaaaggccccta

SEQ ID NO: 20114 - DNA, 471 bp, Sorghum bicolor
  Clone ID: LIB5052-005-A1-XP1-A12
gccggccgggcctgcaccacctcaacacttcagaccactctactctcagccaaaatgcgtcccactattgctcgccgtgtcgccatgcccaacttcccgggtcttcaccgcaagaacaacgttcccgcgtggcagaggctccaccagaaccacgacggtctcaggcagtggcagaagggccctcgcgccaagatcatgctctacccctactacgccactttgatcgctaccagcggcgccaccatgtacatgatgttccgcatggtcttcggccacaagacctggtactagattgctcgccctaagcgattggttggagcggctgggccgggatgatgatcaggcagagcactgtactgtaaataagctagagggtcgaaaacgagctgtaacaccataccctggcagccacgagcgctctcaaatacgatgctgaattcctttgaaaaaaaaaaaaaaaaaaggccccta

SEQ ID NO: 20115 - DNA, 776 bp, Sorghum bicolor
  Clone ID: LIB5052-005-A1-XP1-C12
gccggccgggcctccaaaatagtcaaacgcctcgctcactaagcagccctcaaaaacaccagcaccaacctcaccatcactatcaatcaaccatgtctctaaaatacgaagccatcaacgcgcccagctccaccatcccttctgataccactaaacctttcacaatcccaacttcccccaagacggacatatggcgtcgcacgacccccggtgacatggagttcaatgctcccggcatcggcacccgcatcccagtctcgaccttcaaatctctcgcagccaccgtatcaggtccatggaagacccagttcgaccaaggcggcatcttgatcgctttccccaagaaccctggagccgatcttcacgattcgcagtggatcaaagccgggattgaatacttcaacggcgagcccaagctaggcgttgtcgggactgatcgatactcggactggagtctgtgtcccatgttcgaagctggtagcaaggcttctttcttggcagagaaggaaggcgataccatctggatctacgctgttgtgaaaggcaagaaggagcctttgagggagatcaagtgggctgatctcgagggtagggcaaaggatgcagagatgtgggtgggcgtgtacggagctaagcctacgcccgaggaaggtgatgcaaacgcagggatcgatgtcagttttcagggtctgaagatcgagactagtgggtgatgttctcatgcatgggctatcgatcttaggtagatgggcaatcgatgaaaacaatcggcatgc

SEQ ID NO: 20116 - DNA, 380 bp, Sorghum bicolor
  Clone ID: LIB5052-005-A1-XP1-C8
gccggccgggccttcgatccatatatcaccaccctttgatcattgctcgactaatcacatacgctacgacgctaaactatcacattcagcctaatcctggccttcctggtagatctcattgcggaggccattgattccttttaccttatgctcatgaggcctctagcctactgcgaggagttccccaatgtctgctgcgagcgcacctgctcctacacagcggagtgttccatcgtcaagctctctgaacccttcgacgtgctccattaccaagactctagtgccgatgcatgaactgcacccctacaactgtatgagctggaccagatcaacgaacagctctcctactactggatgaacctctagctgcctgccttcga

SEQ ID NO: 20117 - DNA, 545 bp, Sorghum bicolor
  Clone ID: LIB5052-005-A1-XP1-D1
gccggcctggttcataaagagacagttcaacaaatattcacatactgttattctccacttgccactcattagcaagacaatgaggaccgagtgctccgcagctctctgcattgtcctagtggttatgtcttcaaccctctcttcctgcaaccctggttcgtcatgtagtttcactttacctcgatgcactgcacagaaatgcagaggaagatgcttggcgtttgccaaatcggaaggtggagtgctaaagctgtcctactgtgtgacaaagaatagttgcgaatgcgagttagctcccaaaaagcatctgccccttacaaccgaagtcagaggatgataatggaacttttgtttgaatataatacataggattaaaactgacaccaatgatggatcgggtatcaaggcagacaataccgtactgctagctcttgcatgaaatttatccatgacctgtttccttttaggtctaataaaataattcgtgcccatcatttcaaaaaaaaaaaaaaaaaaaagaaaaaaaaaaaaaaaaaaggccccta

SEQ ID NO: 20118 - DNA, 516 bp, Sorghum bicolor
  Clone ID: LIB5052-005-A1-XP1-E11
gccgggcctggcacaccacaaccacggccacggcaccatctcgggaccatcaccgccgccgagcacgtccgccgcctgcccgtcctcctcccaccggtgccgccgccgccgcctccaattccctccctccctcccacccccaccgctactggcccggggcctcggaatggcgtcgcgcggagggagatccggtaggtaagtctagctgaagtgaggagtggcagccttgttcgaccgtgcggcttctgcttggccggtaaactcactactttgctcctgcagatggagaatggcgttcgattatgtatataaattgttcctgtatcgtctttcacctgcttgtattgaattgttgccttgacggctcctactgcctattgatacacttgttgtttgcactctaatgcgtgtacgtacactatgatgtgaccttcttgacaagttcagttgtgccttcataaggaaatctatatgttccgctgctgcttccaaaaaaaaaaaaaaaaaaggccccta

SEQ ID NO: 20119 - DNA, 673 bp, Sorghum bicolor
  unsure (1)..(673): unsure at all n locations
  Clone ID: LIB5052-005-A1-XP1-F1
gccnnggccgggccgtacaataaaggcggcagtccaaccaaaccattccagcagccaccaaccaagaaagagcccatggcgtccccgttctgcgccgctgccgccgcgtgccgcctcgccgtctccgccccgtcccctcccgccgcgcaggcgcccaggccccggcgcggcctggtggcggtgcgcgcggaggcggccggcggcgggataaacccggccatccggaaggaggaggacaaggtggtcgacaccgtcctcaccggcgagctcgccaagccgctcaccgcctactgccggtgttggagatcagggacattcccactgtgcgacggagcccatgtgaagcacaacaaagcaacaggtgataatgtgggccccctgctcgttaagaagtagatgggttttcgtttgagttttgccctagtgtcatgttgagcgttgagctgaacaccatctgtatttatgataaactatcacgacgcatcgatccttcaatcagaataaagtaagctgctcatgttaacaagactcagcttcatgattgtgggaagcgttagtgacaggtgatacatgtagtgagatgtatgaacatcgggaaaatatttaattctctgtgctgaacaatgaagtcatgagcttatgattcaaaaaaaaaaaaaaaaaaaggccccta

SEQ ID NO: 20120 - DNA, 502 bp, Sorghum bicolor
  Clone ID: LIB5052-005-A1-XP1-F6
gccggcccgggccgtgggatccacaagtccattcctaatctctacttcgacataaccacaagactccgatttcctgccaccatgcctcaagacctcaagaacgcccactactcctatgactaccttcacgggctgagggagaagtacgagaagtcggcccaggacttctgccgaggtatgacctttgaggacgcccttgcccatgtcaactccaccggccgcacagatttcaccagggaacagttggaggcctttgacaccaaccatgatggcagcatcaactttgctggtgagtgtcttagacatattatgagacgtgctgctgacaggagatagaatacatggaattgatgctcaacaacgacaaggagctcgcgttccgtaatgccaagttcatcgcatagattgggaggatcggccaggtctgtatataggccgcgatagaacacgaaataaatgatttatgactatttgcgaaaaaaaaaaaaaaaaaaggccccta

SEQ ID NO: 20121 - DNA, 681 bp, Sorghum bicolor
  Clone ID: LIB5052-005-A1-XP1-G12
gccggccgggcctgcccgccacccacaacaccactggcaccaccaccaacaaccagggcggtgtcgttgacaaggtcctcagctacgtccccggtctgagcccgacctcatcccgcaaccaagcctccggcaccacagatgccaccgctgagcctgctttcggcgccaacgtcggccctggctcatcttcacacactcacaccggcaccggcagccacggtctcggttcgtctactggtgtaggcgctggcagcgttactttcggtgctactcacaacaccaccagcggtcctcacaactcaaaccttgccaaccaggccgaccctcgagttgactctgataacagccgctttggctcttcgaacaccactggattgggctcttccaactctggcagctacgtccctgcacctaccctcaaccctcacgacgaggacagggctagggtcgttgctgatagagctgtcggccacactggcaccggcgttggctctggccttggtcacgagcacagccacggctctggtgtaggatcgggcgtcggtcttggatctggtgctggcgttggttctggcgttggccacgagcatggtcacggttctgctgttggaactggcgctgctcttggatctggcgcgggccttggctctgggctcggccacgattctcaccacggctctg

SEQ ID NO: 20122 - DNA, 539 bp, Sorghum bicolor
  Clone ID: LIB5052-005-A1-XP1-G8
gccggccgggcctcccacaagttcaacaaatatactaatactgttcttctccacttgtcactcgctagcatgacaaaaatgaggacagagtgcgccgcagcgctctgcattgtcctggtgattatgtcttcaaccctctcatcctgtatcccattacctgcatgcactgcggagctttgccaaacaaaatgcttggactttgccaataatcataacgtagtggtaaagagctcccactgtgcgaaggcggatttttgtaattgcgaggtagctcccaaacagcgtctgccccttaccagagaagtcaagggactagctgatgcagaggacgataattgatcttttatgtgaatataatatatgacaccaatggtggatagggtcgttaaatgatggcagacaataccaaactgctagctcttgcatgtaatttatccatgacctgtttccttctaggtctaataaaataattgctcaccttttttaaaaaaaaaaaaaaaaaaaaaaaaaaaaaaaaaaaaaaaaaaaaaaaaccaaac

SEQ ID NO: 20123 - DNA, 695 bp, Sorghum bicolor
  Clone ID: LIB5052-006-A1-XP1-B7
gccggccgggcctgcgaaataatatatcctccttctaaccgtaaagattatgacgcaataataataacacaatcccacagacacacagtgtcctcaatcttcatctcaaactggcgtctatcttgtggtctctgctcataaatgctgcttctatcgacctcgatcatcctcaagcagaatccatgctaaacctccgaaagactatgcgtccctcatcaacagactgatggcatggagcaaactgaatgcgctgagaaacgcaacattgctcccgggtgtgtctgtggagtacatctcatatagcatgaacactttggccaccatgcacctgctggaacaccgcggcgtgtacattgcccgagacacaaatgacccaggttaacgctgccagctgtctggtgcaactgcccacggcgaacggcttctcggggcgtttcatccggtgcaagtgtgatacgcgaggatgatagagaacttctacacgatgcgctatcatcacacacgcgaaaaggcaaagggcaacagcaccactaccaatgccctagcggtaatctctaccacaagaacacacccgaatgagattgcagattacatcacccacaacgccaacgagccttgttacgatggctacatcttcacagagatactggaaactgcaccttgctgctataccgaggcctatcagccatagaacc

SEQ ID NO: 20124 - DNA, 797 bp, Sorghum bicolor
  Clone ID: LIB5052-006-A1-XP1-D6
gccggccgggcttccgaacggcaatacccccggcccgacgacgagcacagctgcacagcgaactggcagcgtcctcactcgtcagttccatctcgttccccaatcttctctccccgattcgattcgagtgacccgtccgtccgctccaaatcgaagaggaagggagagagagaggagaggggcatggatcaggtgctcaacaaggtggggagctactggttcagcaagagggccagcaaggaaatcgattccatcggcgatgacatcagctcgatctcaagcagcattggaggttcagccaaatggatggtgaacaaaattaaagggaagatgcagaaagcactgccagacctcctcaaggaatatgacatgccagcagggctctccccacgggacgctactaactatgagttcaatgaagagacaaagaagctgacagtgtacatcccgtcagcctgtgatgttggttacaaggactcgtcagtgctgcggttcttcacctgtgtgaccggctaccttgagaaggggaagttttccgacatcgagggcatgaagacaaaagtgctggtctggaccaaggtgactgccatcaagaccgagggcccaaaggtccatttcactgccggtgtcaagaagactcggagccgtgatgcctatgaggtcgtcagagatggtatcaccatagataagttctagagcatacctggcgggaaaaatgcgatgtaattattcagatatgcttctctcctctcagttggtacacaaaatttatacaatcttctgtgctaattctgcac

SEQ ID NO: 20125 - DNA, 828 bp, Sorghum bicolor
  unsure (1)..(828): unsure at all n locations
  Clone ID: LIB5052-006-A1-XP1-D7
gccggccgggctgcgnaagaactatatcctcctcctatttgtcgacttcctgtcccaatcaattattacccaatcccaccgacacactgcatcctctatcttcgcgccgcagtgccctctatctcgtgctcacgctcatcagcgccgcggcaatgacctcgatcttccaaaagttgactcgtcccttcacatccgccaccctacgcttcgcccccgaacagactgctaagatggacgtccccgaaggcgcgcagaagtgcaccattgccgccggctgcttctggggcgtcgagcacatgtaccgcaaagactttggcaacaagggcctgctggacgcgcgcgtcggctacattggcggcgacacaaaggcccccggctaccgcgccgtgtgctctggcaccactggccacgccgaagcgctccaggtcgtcttcgaccccgcccaggtctcctaccgcagcctgatcgagtacttctaccgcatgcacgatcccaccaccgccaaccgccagggccccgacgtcggctcgcagtaccgcagcggcatcttctaccacaaccaggagcagaaggagattgcagaggacatcaccaagaaggcgaacgagcagtggtacaagggcaagatcgtcacagagatactggaggctggacagtggtgggatgccgaggcctatcaccaggagtacctgcaccacaaccccagcggatacgagtgaccaagtcacttcttgaggaagttccccgagttgacataagattcgtgcgaaagggtatctttggtagggatgggaatgggaaatgaaaaatgggataataattttacag

SEQ ID NO: 20126 - DNA, 733 bp, Sorghum bicolor
  Clone ID: LIB5052-006-A1-XP1-E3
gccggccgggccttcgcaccctttgcttcaccccaaaacggaccctcaagatgtccttctctgctcaaccggtcgttatcgacggcaaaggccacctcctcggtcgactcgcctcggtcgtttccaagcagatcctctccggccagaaggtcaccgtcgtccgatgtgaggagatcaacatctccggctcgttcttccgaaacaagctgaagtaccacgcgtacctgcacaagcgacacatcgtcaaccccacccgtgccggtcccttccacttccgagccccctcgaggatcctgtacaaggccatccgaggaatggtcccccacaagagcgcacgaggtgccgccgctctcaagcgattggagctgtacgagggtgtcccgcccgcgcaggacaaggtcaagcgagttgtcgttccttccgctctccgagtcctccgactcaagcccggacgaaagtactgcaccctcaagcgagtctcgcacgaggtcggatggggttacaaggacgttgtcgacaggctcgaggagaagaggaaggtcaagggaaaggcgtactttgagcgaaagcaagccgccctcaagctccgagccaaggcttcggaggctgccccgaagaacgagcttcttacccagtacggctactagatgtactattcttaggggaccgggctggatgatgagagggatgcatcacgatttctgccgaaaaaaaaaaaaaaaaaaggccccta

SEQ ID NO: 20127 - DNA, 268 bp, Sorghum bicolor
  Clone ID: LIB5052-006-A1-XP1-G11
agggacgctaagtcacatgcatatgtaacggtacaggcacacaggtacattattgccctcctttcctttctcagatacatacttgctcttcactacacaatgatttgaggtgtagtgccatactgtctgcgacaactgcactgggactccgacgacgagttattacctatcaatcgccggctcccatgcgctaatactgatcctcctcgtcgaccaatgccccctgtctgagcaattatacctacatagcacaacggacatccttgag

SEQ ID NO: 20128 - DNA, 599 bp, Sorghum bicolor
  Clone ID: LIB5052-006-A1-XP1-G3
gccggccgggctgcgcccccgtatgtcttcgccgccgacgatgtctaccaccgcggacgccgacgccgactaccacacctccgacggatccgtcatgcccgacgtcctcgccaagggccgcgaggcctgctacaaggcacgggatgccttctacgcgtgcgtcgagaagcacgcggacaagaagcccaccgagatcgccaccatgggactcctctaccccgccgactgcaagaagtcccgcgccaactacgtcagcaactgccgtcccacctgggtgaagcacttcgaccggcagtactgttccaagaagcgggtgcagaggctgctcgacggcgatgaggaccgccggggccccatctcgctaccccagccctacaccttcaagcaataggtagccttcctgtggttcagatcttggtattgagctcaattggatcagtactacgttggtatctagatgctatagtattggtttcaggcttggtatcatttagatggatgcatatgtgatgatgtgtagcagtacattgctctgaatgctaatggatgagtgaatctgtatgtgaatttctgaaaaaaaaaaaaaaaaaaggccccta

SEQ ID NO: 20129 - DNA, 503 bp, Sorghum bicolor
  Clone ID: LIB5052-006-A1-XP1-G4
gccggccgggcttcacatcccgaacatcggcctatgatcacacaggcgcatccgcgggtccaacaaacgcgtcagctacagcaaccccagcaatgcgatacgaacaagcggcgtaactccggggatcaattctccacccttcatcagccctctgtaacacgctacaatcaaaccaaatcactgcacggacaacgactacttttccaccaaccagccgcctatatgcgcagccgttccgcgactcgacagcctgccctctggggtgcagacgttgtaaattttccgatggcttgctttacttgtttcgacaagctttgtagcggggaaacaacgacgacgtagctcgctaagcggttgtttcgaggttttggtcagaccgtgagagtccgccaatatagtttgcatacccggcatctcgagcttattgcatgtatagatactgcgtgtcttcaggcttaattcaacattcgctcacctaaaaaaaaaaaaaaaaaaggccccta

SEQ ID NO: 20130 - DNA, 676 bp, Sorghum bicolor
  Clone ID: LIB5052-006-A1-XP1-H4
gccggccgggcttccgggactcaaagaagtcacctaatagcattgccatcccgcgccgccccatggtacaccgggagactgttgagcaacagaatgcacagagcaacgccaatgatcagcactaccaccagaccatggaagacaaccctcagcatcggccgttgccgcacgcacagcactatcccattcccactggacttgacttcatctaccctccagcaccagtagggcgtggcttgatccactcaactgctggaggggtgctcggagggatggcagaggttgtgcttccttgggtgttccgtggccagctgccagcgagcttgtactacatgagcccataccatgttgcgacgcagaacatgaatcccaggctgaggcggcatcagatggaactcgagaggtccctgcaccagatctggttcttcctctttgtgtttgtggtgctgtgcctgctcttgttctgagacaagactgttctatatacctctttgtagatattgaaagtgggagggggatactaatggatgatgcgtatagtaaacagggtaatggtctgtgtcgacaagcatgtgcttaagcatgctgatatagagttgtaatatgatgagacatggaggtgaaatgcatatttcattcttctcgtaacgttaaaaaaaaaaaaaaaaagccccta

SEQ ID NO: 20131 - DNA, 505 bp, Sorghum bicolor
  Clone ID: LIB5052-006-A1-XP1-H7
gccggccgggttcaaaaattcggtgtcggtagacagaagtttcaccagggctggagtgacgcctcccatctcagcatcacaaggcgctgtcaccattctgaagattttcctgagctcctgctccggatatcatgatcatatgtccactgcttcttgcccaattttactacaggacggcacttttatgaggcttggccgttgctgctgctggctgccgctgagacctgagatctgcggtggtgcttctaagaggagcactccaccgccagaacacggaaactacaagaaagacccgaatgttatggacgtgcaggctaacgagtatgccggaaccaatagcaacgaccgcatgaaagaaactgtgcccgagataacgtagacagtgaattgcacgtccataaatgaaaattacagccagcggacacattatggatcaagaaatgtaacttgaactaataaataatataattgttactcgcttgttgagacataacatgcaacaaga

SEQ ID NO: 20132 - DNA, 482 bp, Sorghum bicolor
  Clone ID: LIB5052-007-A1-XP1-A12
gccggccgggtttcgatcacaataatcacaagttaactagtcaaccacagttattagagcaacacatctagatagaataagatgaggagggctaatatggttctgctcctggctgttggcttcctcatgctggcttccgatgctgtcgcgctcaagaaagtttgtacgtctaagaagatcccgccacagggtaaagcatgtgaccccaaaacttgccatgaaaatgctaagaaagatttcaccgctggtggagctcggtgcccggatcattcgtcttgctacgtgcagggccattgcgttgctggaggttgccagcgcatcgtgtgcgcagtctacgtagaccctccatccctttaacaacaaaatgggtactgactggccatggtggtagccggtagggtgccatgatgtactgacatcgatacagaaataaatgaagtttcatattgattcgccaaaaaaaaaaaaaaaaaaggccccta

SEQ ID NO: 20133 - DNA, 473 bp, Sorghum bicolor
  Clone ID: LIB5052-007-A1-XP1-A2
gccggccgggctgcgacactcgagaaagaggaggagggcatcgtagttgagtctctttcaagtcatctgaataaactgaaaggcaacataaaaacgatggagaggcatctggatggaaagaagcaagctttcatttcaaatgtacatgataaattgaatgaaggaattaatcttgtcagtttggaaaaggaagtagaaactgctgaaaaatattgtcaggcaatgaaggatgaagtagctgcaatgagaatgaggtactcagattctggagtttagattgttccagctatcttcgtttaagaagttactttcttcctgagagcttgcttgatatctgtctgtatcatcaagcaggatgatcgatagaatataaccatcttactttccagagaagagtgatatggttgctactcaaaaaaaaaaaaaaaaaaaaaacaaaaaaaaaacaaaaaaaaaaaaaaaaaaggccccta

SEQ ID NO: 20134 - DNA, 609 bp, Sorghum bicolor
  Clone ID: LIB5052-007-A1-XP1-A7
gccggccgggctgcgaggaactcccccaacacttcgtcctcatcgatggcggccacggcgagtgtcactaccactgctccctcatctcctgcagctctcctcaaagcatcgccttcttcgcttatctccttccgccccgtctcctgccgctgcaagcacctctgcgtcaagaccaaggccacagaaaatgaccagtctgctaaaaagcctcaaaaggtgaacagcattctttgccaggactgcgaaggaaatggtgcaatcgcatgcaccaaatgtgagggaactggggtgaattctgttgactattttgaaggtcgatttaaagctggagctttatgctggctttgcagaggaaagcgtgaaatcctatgtgggagctgtaatggtgctggcttcttgggtggatttatgagcacttttgatgaaacggcgcaatagggtcatcggtgtaacttttaagttggattgggggagcacaatgtatgtatcgtgttccatggaaacataagcgtggccaaacatgccagccgcactatacgttcggtgcgatttttttttcatgtgcttttctgctagtttgaaaaaaaaaaaaaaaaagggccctaaggg

SEQ ID NO: 20135 - DNA, 824 bp, Sorghum bicolor
  unsure (1)..(824): unsure at all n locations
  Clone ID: LIB5052-007-A1-XP1-C4
gccnggcccgggctgccaagaaattaaaaagcaaccggccaacgtgtcacagcatagagatgacgctcccgcgccgccgccaccttgtcctgctcgccggcctcctggtcctcgtcgtcgtcgcggccaccgccaccgcgtcgacggattcctcttccaccacggcggtggcggtggacttcgtgcggcggtcgtgccggtcgacggagtacccacgggtgtgcgagaccacgctggtcccctgcgcggcgagcgtgggtcggagcccgcggcggctggcgcgggtggcgctggtggtgggcgccgaccgcgcgcgcaactgctccgcctacatccacggcagccgcagcggcagcggcggggcgatgaaggactgcgcggagctggcgcgcgacgcggaggaccggctgcggcagtccgcggcggagatggagcggatgggccgcgccggcaccccgcgcttcgcttggtccctcagcaacgtccagacctgggctagcgccgcgctcaccgacacctccacctgcctcgactccctcgcgcagcacaaggaccgcggccgcggtggcaagggcagcgacggcgacgacgatgccgtcagggtgaagaggagggtggtcgccgtcgcgcaggccaccagcaacgcgctcgcgctcgtcaacaggcttcagccggcgacgcaccggcagaggctcctcctgtgactctctctctctctcgtagctgcagcttgctatggaagtcggngctgctgattcctcatcgatcctcctcgctccatgtccgattcctcacttcccctgcatctccttcgccaatcccat

SEQ ID NO: 20136 - DNA, 737 bp, Sorghum bicolor
  unsure (1)..(737): unsure at all n locations
  Clone ID: LIB5052-007-A1-XP1-C5
gccggccgggccgggcggcaatgtcgcactcgcccgcacagaatgcaaaccagaaacaaagccccatagccagctgcaacaatcaagagcgagcgaggctcccttcttgtccccagcactcgctaacaaagccaagccaagccgagacagacgacagagatggcaacgatgtcgctgagctcgacgagggcgcagtggacggcgaagcagaacaagctgttcgagcaggcgctggcggtgtacgacagggacacgccggaccggtggcacaacatcgcgcgcgccgtcgggggcggcaagtcggcggacgaggtcaggcgctactacgagctgctggtgaaggacgtggagcacatcgaggccggcaaggtgcccttcccggcctacaggtgccccgccggctacgacgccgacaggctgaagcacctgaagatctaggcggcaagaatctcatgagaacgactgaacgagtcctacaccgcgcaccatgcatgtgagtgtagcaacgtgtgtggctacaaaaggaaggaagccaagcaagtgggtcggagcatctgttcatgcacgcatgtgaataacaactactagctagctatagcctataggatgtagatcaatcgatctcccgcgtattgtactgtgttcaccttgtgtaaaatctcagtatttgtagcatatatattttgggagaagtgaaataaaatattcacganaaaaaaaaaaaaaaaaggccccta

SEQ ID NO: 20137 - DNA, 246 bp, Sorghum bicolor
  Clone ID: LIB5052-007-A1-XP1-D11
gccggccgggttgggtgggaagaagagtggaaacggcaggggggaattggattcttgcgccgtcttctttccgtcgtatcgtacagtagctctgttcttcttcttcttcctccgttttcctctttgttgtttgttggcttcgcctctagttcctgtagatgactgcggtctgcgggcatgcccctgtgaatacgatgcaatgaaacaccaggttaattaacaaaaaaaaaaaaaaaaaggccccta

SEQ ID NO: 20138 - DNA, 371 bp, Sorghum bicolor
  Clone ID: LIB5052-007-A1-XP1-D8
gccggccgggctgcggatcctcactcgtttccaactcgccaaacaatcttttggacactcaacaatatgaagttcgccgctgtccttctcgccctcgccggcctcgttgctgctgctccagctcctcaattcgcttctgctgcaccttctgcttccggcccagccggtcaaggatggggtggaggacgatccggttacccatggaaggcttaagagccatgccaaacttgtttctccaatcatgataagatctgatatgagggttaagagttgagcgttggtaaatgcgtgggatagatttgtcatcttagagatacctttacggcgatgtacacttgtatcatcaaaaaaaaaaaaaaaaaaggccccta

SEQ ID NO: 20139 - DNA, 612 bp, Sorghum bicolor
  Clone ID: LIB5052-007-A1-XP1-E5
gccggccgggctgcgagagaccccatcacacacccgcatcacgccaccccgtccaggcatccccatccgtcaccgagcacccatggcgaagggaggtgcaggccagcgcgagggtagcgccctgaagacggcggtgatcgtcgctggagggctcgcgctcgcatgggtcaccgtggagaccgccttcaggcccttcatggaccgcctccgcgccgccgtctcccgctccaccgacgccgcccgcgaccccgaccaggaggaggaccccgcgcctgccgctgcggccgagccggaggaggagaaggcgcccgcaccagcggagccgtccgcgccgccggccccggccgaggtggaggagaaggtggccgagttggaggagaaggtggaggaggccgccgccgccgccgccgacaaggccgagtgaaggggatggcgacatagcgacctgtctgtctgctcttctgaatagtatgctgttggttctgtgaatctgttctgtggtttgaaacctgtctctgtcatggatagtgcaaagtttggactataatttcagtgagtttagcagtaaggttgcgttcgtctttcgaaaaaaaaaaaaaaaaaaggccccta

SEQ ID NO: 20140 - DNA, 730 bp, Sorghum bicolor
  Clone ID: LIB5052-007-A1-XP1-F2
gccggccgggcttccgaaacgcgcaacagcacgacacctgcccattgacctatttcaatccttgcagcctgcctggaaggacgcgctctcgagatgtcggtggccaagaatgtgaagactacggtcttttcgaaatacaccgttcagcccactggaacctatgccgccatcaataggctcttcgcgctcgatcccaagcggtccacgggtatccccatgaacccgcaattccgcaacccacccccaggcggtctcgaccccaacgcgtacgacgaccctgtcactgttcctgctgccgacatcgccgagaacccatactggaagcgcgacgtgcgacgacgataccccaggctctcgactgtcacgcagtctgacgcagttgcgctgctggaagttggaagcgcggcagcacccaagcaggagctgttggcgaggcaggcacaaaatcgctggtagctgcgcaagaagaaggcgctaagggactggccgttgcatttgagaagaacactggactcgcaaaggatgtactaggtcctggtggcatgcctccactaccaagtgggctgcacgtccacggtgttgctggacagaagcgatatgagctggagagcgagcagtcgtacggtacagcatacccatgccggacgttcgcttagattaccagaggaactgtgtaggtagtaaaagacagtccaatttctgcgaaaaaaaaaaaaaaaaaaggccccta

SEQ ID NO: 20141 - DNA, 861 bp, Sorghum bicolor
  Clone ID: LIB5052-007-A1-XP1-F9
gccggccgggctgggaccacactacacttgaccgcctttgcagaagaattgccactcgcgccgacacaccatcatagaggatcgacttcaagagctccgagccatacacatacatccacatacagaaagacataccataccagtcgcaacaccacctccacaacaatacgccatggccaccaccgctcccgccgcgagcgtcatccctgcgctcaccgaccgccccgtcaagaacaccatctgcctcttcgatgtcgacggcaccctcacgcccgcgcgccgaaccgtctcccccgagatgctgcagctcctctccgccctccgccacaaagtcgccatcggcttcgtcggcggctccgacctcgccaagcagcaagagcagctcggcaccgccagcatccccgtcaccaccctcttcgacttctgcttcgcggagaacggcctgaccgccatccgcatgggcgtgccgctcgcgtcgcacagcttcatcaagtggatcggcgaggacaactacaagcagctggtcaagttcatcttgcactacgtcgccgacctggacatccccgtgaagcgcggtactttcgtcgagttccgcaatggcatgatcaatgtcagcccgatcggcaggaatgctacgattcaggaacgcaacgagtacgagaagttcgatctcgagcacaaggttcgcgagaagtttgtgcaggctatcaaggacaacttccccgatttgggccttacctactccatcggcggccagatctccttcgacgtcttccccgctggctgggacaagacctactgcctgcagcacgtcgaagccgagaagcaggtcagcggcgtcgagtacagcaccatccactt

SEQ ID NO: 20142 - DNA, 862 bp, Sorghum bicolor
  unsure (1)..(862): unsure at all n locations
  Clone ID: LIB5052-007-A1-XP1-G6
gccggccgggtttcggacggccttgaaacacaactcccaacacgcccatctggagcgactgtcttctgcaagatgcagcgatagtcatggatttggatcgtacacaatgctggagttcatggactacgtccagtccgccttttacgccgcgtcgcgctggaacgtagacaacagctacgcgtccttgaccaatacaaccaacaacctcctcgactttcgcacccctcatggcgtccgtctgcacgtctcttcgctgtccagcccgaatttcgcgactagctatattcttggaagtaagggcgtggtagacggctcattcagctttctcttctccagcctgggcctgcaagtcgccagcaagagcagtgacctaccacttgggcatctggtgaaaggataccggcatctgcaagagctgcagaaacccgaacagccatggcaatgggaaatctggcatcgaggaaagcgagtcgacacccgtgatacattgctttatggccgcttctacctgccgacgagcactcttgaagcgctctatctgcgtcgcatcagtccgacacggctgtttcgactgacttgcgtctcggatggatcactgcctagtggcggttcagctcttgcccaactacaaaatgattgcggtaaatactctacggagtacctcttctctacggatgccgcgcttcttggtttccgaggattgtacaatttcggctacgatcctcgggatccagaaagacagccttccacccgntcaccttcgcatccatgggatcaccaaagtggtcgcttgagcatgggcggcgaggtatatttcagtcccatgaacaaaagcggntggcctcagcactgggctacgctt

SEQ ID NO: 20143 - DNA, 858 bp, Sorghum bicolor
  Clone ID: LIB5052-007-A1-XP1-G9
gccggccgggtcgggaatcacaagaacaacaccaccaccaccacagccaccatgagttggaagggattccagaagggcgccactagggcgccccaaatgttcaagcagcgcttcaacatgggtgagatcacaaaggacgccgtctacatcgacgccgagcgccgcttcgccgacctagaaatcgagaccaagaagctgcacgacgagagcgagaagtacttcaaggctatcatcggcatgctggaccaccagatcggcttcgcgaaggcctgcgccgaaatctacaagcccatttccggccgcgccagcgatcccgattcgtatgtcgtcgacggcaatcctgagggcattcgcgcgtgcgaggagtacgagaacattgtgaacgaattgaaggccagcttgtcgcctgagctggagatgattgagtctcgcatcgtgaaacccgccgacgagctcatggaaatcatcaaggcggtccgcaagacttgcaagaagcgcgacaacaagcagttggactttgaccgacactcggccacgctgaagaaactgcaagagaagaaggacaagagcctgaaggacgaaaaggcgctctacaaggcggagaacgacgtcgacatggcgacgcaagaatacgaatacttcaacaacctcgtcaaggccgacctgcccgtgctcttccagctcgagaaggacttcatccagccgctcttccagagcttctactacatgcagctcaatgtcttctacaccctgcacgaggttatgcagagcatcgacatcggctacttcaacctgaccctggacattgaagaggggcttcaagagaagcgcggcgagatccaggcccagaccgaagcc

SEQ ID NO: 20144 - DNA, 561 bp, Sorghum bicolor
  unsure (1)..(561): unsure at all n locations
  Clone ID: LIB5052-007-A1-XP1-H11
gccnggccgggttctcagaaaaaaaaaaaaaaaaatgtccagcgggtgtggctctcggggagcacgccggaaggagaagcagtagtagagggtctcaccccaccaggtcacaacacagcagcagcggcgggagcatatgcatcccaccacatgccgcggtcaggtgtgtgtgtgtgtgtgtgtggactgtggacggataagcacacggcgctttttcgttgagagacggacagcgtcgtgggcggacgacgtctctagcagtagcagctctccgcgacgacgccattggcggggcatggacaccggtcaaaccgcccacatgcccccgatccgtgcctaatcgcgcggattaattaactattattgctaataatactagtcagcaagtggtgctcgatcatcagctcagtggtcgagcgcatcaaaagcaagctgcttgggctgctggccttgttggtcaagtggttaggctgcatcacgcatgtacttgcacatatacaaaatgattattataaggagtggtagtacttagtctaaaaaaaaaaaaaaaaaaggccccta

SEQ ID NO: 20145 - DNA, 584 bp, Sorghum bicolor
  Clone ID: LIB5052-007-A1-XP1-H12
gccggccgggcttcgatctaacaaaccatccaataattcagtcgtcaccttcctcacctctcctctaccgatctccatattttccaaaacaactacactacacaacacaccgtcaatatgttccgtcaacagattgcccgccaggcccgcctcttcagcaccacacccgtcgcacgcaagagccccgtagatgctatcaaggacgctgccaaggctgtcgacaggacaatctctggtgccgctgtaaagggcattgagaagggcgaggaagtcgctggcgccgtcaaggagtccgtccccgagaccactggccaggctaagggccaggcaaatgagatggctggcgaggccaagggaaaggccaacgagctcgcaggtgaggccaagggcaaggcgcaggagctcaagggcgaggccaagagcaagatgtaaaaaagttgatatacattgggaacgatacgtaatgacatgagcgagacatgcttcgatggcatagctgcctcaggaaggtaaagctaaattgtcacggccgaatgaatgaaataatgtttcaataccaaaaaaaaaaaaaaaaaaggccccta

SEQ ID NO: 20146 - DNA, 820 bp, Sorghum bicolor
  unsure (1)..(820): unsure at all n locations
  Clone ID: LIB5052-007-A1-XP1-H3
gccggccgggctggatcgactgaaaccccagccgctctcctcacttattcccgtcgtccggtggctggttaaggcgttggctgccacgggcacaccgcaccaccttattcaacactctttcttctccctgaccggcgatgtagctttgtccttgagatctcccactcatcgtcttcgtctctgtctcgtctctcttgtcgaccttaccggagtccggcatcattagggctccatacttatgtgttgaggtaccagggtgctggatctccgcgacattgtcgtcgccgttgtctctggtgctccgtcaagaaagccgctggcgttgagggaccggaggccaacgacgatgagatgtcggacaagcaggaggacttcggtcactccatgaccatcaacacaagttgcgcctctacagcgatattttttttgttatatgtgttattgtttttctctgttctttttgaattgctcactaaattctaagttttttgagttgttcgagctttaggcctaggcacggcactatctcgatgggctgttgtgctctgtgtcacgacacgccactatctaagcaccttagtcttgtgcctgggccaagatgtaggcacaatgtcactacaccgcatggcacaaagggtcaccgtgcctgatagtgtcgtgccgtatagtgctagtgccgtgtagtgcaagtgccgcccatttgaaaaactataccactagaggccggtgatggcggccagcgacgcggcgtggttagctatcgcgtagtgcctggttggtactagactcgcaggtttttatgangaaccacatcccccnt

SEQ ID NO: 20147 - DNA, 523 bp, Sorghum bicolor
  Clone ID: LIB5052-007-A1-XP1-H6
gccggccgggctgcggaagcggaaaacgcgtcgccttcaggcagtcagagagcgttgatctcacctttgctggtggtctgctcgtcatcggcggcggcggcggtgatggagcccctggaggtggccataacgatcatattcgacgcgctgctgctggtgttcatggtcaagctcttcttcgccatgttccagatgaagctggtcgtcatcctcttctacctcgtcatcctcctcttcgccatggccttctccggccgggcgcccagtagcttctagctcgtagcaggtggcaaaaatctttctttccccacttctttcctttcttcgggtatagatcggtggagtcgtgcagcactacgtcatgtgaaaaagattatcatctcggttttgggttgaagactaatttttcttctagaaaaaaatgtactatgcatgatccgaggcgcaaattgcgtaagcgtgaagagaaaccgtgtgctcaaacacgtgatttagacaaaaaaaaaaaaaaaaaaggccccta

SEQ ID NO: 20148 - DNA, 567 bp, Sorghum bicolor
  Clone ID: LIB5052-008-A1-XP1-A12
gccggccgggttcgcgagcggtggatgtcgcatcactcaataactgttcacatcgtctcaatcgctacttgatctccttttccacacatactataagctaccgaggtcaatcgactacaaacaaacacaacacaaccgtcaatgatgcgcgcctctatcttcgactccgatgatgctttcgacactgcatctgcccacaagacatcctccgttccctcagtccatccatcgacccggaccaccagactacctacctcacccacatcaactctctcggtgttgaactggcatgcccgcaactgacactgtccatcgctactcactcctgaggctgtcaacactcagcccgctgctgtgactactcaatcaggaactgctgacataactgccagaggaccgtggaggccacaccctcactcgtgcagaaacccgaaccggctccatggctaactccacccgcactgacaccgacagcgacgaccaaacgactaccggcactcatcgagcctcacctgacccactctgaggccgacgcatactgtctccggcgcataacacaacgctgct

SEQ ID NO: 20149 - DNA, 680 bp, Sorghum bicolor
  unsure (1)..(680): unsure at all n locations
  Clone ID: LIB5052-008-A1-XP1-B12
gtgcatctccgccgcctcctcttgacccttccaagtcaggaatcggcatggcagactcggaggagcacccctatcgaatcagaagagccagacggctgcgagcggtccgaagactgtacccagcaactaggcgtgatccccgcgccgctgaaaacagtnttcctcgacatttatggacgcccctgcaacgttgtggaggttcctacctccaatactgccaataacgggcacgacaaatgccactctgtggccgtagacatattcaccgggaaatggtagaaccacagtggtccttcttccacaactgtgacattccgtcctcgccaaccgccactgaggatcaactgattagaatatcacaccgaagcatccgtgcacccttcttacttcacatggatgcactaaggatgatcttagactcccaactgaggagactcttgtggaccattattagaggaaggatctcatagtgttaaggatcatgtcgagactggccagactgctatgggggaggagaatatctgcgccctggaggatattggtcccaagtaacttcactgcactgcaatactgaacaactgtatctccaaacttaaatggagaaagaacggcattaccggaggattgctactgagacgaaccctgcctggaccatggtttttgctgtcgcagagcccagt

SEQ ID NO: 20150 - DNA, 717 bp, Sorghum bicolor
  Clone ID: LIB5052-008-A1-XP1-B2
gccggccgggttcgaaaagactgtacccccatcccgatccctcctaagactactgcaccacccccattccatcccctccgcaccttccctaggagcgatgtcctgctgcgcatgcaactgcatccgcggaccctggcggaagtgctgcagcggccgccgagggtgaaagatgcacccgtacatgggtgagaagaaggcgaccaccaccgccaacaccctcgccgtgggcgtcgcaacatcggccaacgggcacgccgaacggagtcatccaggcggagaccgtccccctagatgacaacgaacgcagccagcgcgggcccaactgcagctgcaacccctgcacctgcaagtagaccgtacaagaaccccctgcacagcactgcaacccacacgaacgaccgactcccccacataggataccggtggcaccacctgagtgcgtgtgttagagccacccaaacaatggagaggaatggcaccacatgctagagcgtacgctactgatgggaaacaacaataactgcaatgccatgaaggcgtcgtgtcgtccttcccgtgctcctccggggaatcatcacactatgagcgcttgctcggctgcgtgttcgtgggtgcagcgcgagacatgaccaggtcatgccccctgctcatgtggcccatatatagcgtgcgaacctgcatgtgctcagtcaccatccatctatcccctagtttttg

SEQ ID NO: 20151 - DNA, 510 bp, Sorghum bicolor
  Clone ID: LIB5052-008-A1-XP1-G3
agatatatgtctgctcagccagaagcctcttcattccatcaggaaccccatctttggatgccgtgtggccattggaatcggcgccgttagtgcgctcgtcaccgcgcaaacctctgcaaaaactgaataccaccatgacctcgctcacgagtaagccaccaccagaggccatactatccgcatgggacatcctctatcgtctgatggcacaccccatcccacctgccaggcggccgtccgactcggacgtgacaccgaagggtgaacgcgcaggcccaactgcatttgcaactccagtatctgcaagtcagctgcatactagactcgcgcgtagcactgctctgcatcccaggacgaaagaaggaatcccctatctagaatatcactgtcgctcactgcaacgcgtggagagcatgacccacaagatgaaccgattgacatggcacgcatatgcacaacttgtctgctactgacggaaagcaataagaatcgtacaggccatgttacctg

SEQ ID NO: 20152 - DNA, 398 bp, Sorghum bicolor
  Clone ID: LIB5052-008-A1-XP1-H8
gccggccgggctcgcgctaagtcttattctgaatatcatgaacccaagctctgatggagaggggaagcctggacaatctgtcagtgatcgctgcaaacttttgttgggactttggaagggcaagcattgcacgatgcacgggcggcattgccggcccttcggactaggcaatgcaaaccctgcgccacgctgacaaacagacaaggctaccttgggcgctaccaacaaagtagcatcgctcggtcattccgtcgtcgaactcgaacatccgcatggcaaacttctaaaaaacccaacgattaattcgaggcctgtcagcactcgttcgcttggcaaaaaaaaaaaaaaaaaaaaaaaaaaaaaaaaaccaaaaaaaaaaaaaaaaaaaaaggccccta

SEQ ID NO: 20153 - DNA, 388 bp, Sorghum bicolor
  Clone ID: LIB5052-008-A1-XP1-H9
gccggccgggtcgggagttccgagcagcggacaccggcgggcggcgggcgttggccgacgacgcgtccaaggatgggggaagtgcaaggctcaccgtcaccgccatggtcggacctcccttcggagctcctcggcctggtgttcctccgcctccccactcgtgcggaccgggccttctttcatgccgtttgccgaacgtggtgctccgcggcgcgacactgtcgcttgcccccgccatcgccggtgccgtggctcgtgcttcctgacggcagcgccaccagcttccctcgtggcgagaccttccagctcccgaccggcatgcgccaccacaactcttatggcgagtggcttctcctgtcacgcaatgacggcagctgcttgctgatga

SEQ ID NO: 20154 - DNA, 814 bp, Sorghum bicolor
  Clone ID: LIB5052-009-A1-XP1-A2
gccggccgggctgggtaactgacacttctccttcttggctggttccgagtaatataggacctcctggggcaggcccttggagagaggtctctgaaccaggaacacttttaagttggtcacaccgttatgaaagagaagttccatctaaatcgggtcaattgaaatcaggaaaatctcgtaaatggggtcttggaaaagcgaaagacttgcaggttgagtggtctaaaaatagatttcctttgtatgccgctgcttttatgctccctgtgatgcaaggatatgacaaaaggtcacatggtgttgacttgcttaatcgggactttgttgtcctcggtaaattgatatacatgcttggtatctgtatgaagtctatggccatgcatccagaagcatcagctctagctcctgctcttcttgacatgataagatctagagatgtttcacgacatgctgaagcatatgtcagaaggtctgcgttgtttgcagcatcttgcatattgatatctttgcatccgtcatatgtggcgtcatctcttattgaaggcaaccaggacatttctactggattagagtggatacgcacatgggctcttcaagttgctgaagctgatcctgatacagaatgcacatcgatggccatgacctgcctccggctccattctgagatggctcttcagacatcgcgcgcactgggatcagcagatcactcccagactggcagagccataccttctaagcttaacagcattatcctaccatttcggaacatgatgtgataaactgtaaaaagtgtggacggatgtgtcctgctgct

SEQ ID NO: 20155 - DNA, 591 bp, Sorghum bicolor
  Clone ID: LIB5052-009-A1-XP1-B7
gccggccgggctggggcaccgcgagcagatcagatcgatcaggatcatatcagggtgtagtagcgctttggcagattgcgcaagcccaaacaaaattgttgagtccttgagtgaatcacgcgtactcgatggctactcgcgtcgtcggcattgcgctcctggtgatcctgctcgtcggcgccgagctcgaggccgtgccggaagctcgccagatccagcccgccggcggtgctgtcgcgggtggtggtgaatccaccggcgtccgagtccgacggccatccaggtggaacaggggcggcgtggtgctcggaggagtcaagaggagcgtgcccggcggcccggacccgcagcatcacaattagctagcagcgtctcggactcccgagagatagaactgacgctgccaatccgtggcagtggcatgtccgcgcgtgcgtgccgtctgttcaccagagcagagcatatgcagctgccatatgccgtgcatcatcatctatgtattcttgattaaactggtgtttcagtgtaagagctccatatactagagtatctaaaaagttcgcacaaaaaaaaaaaaaaaaaaggccccta

SEQ ID NO: 20156 - DNA, 708 bp, Sorghum bicolor
  Clone ID: LIB5052-009-A1-XP1-D3
gccggccgggatgcgatctaaacagattgttccatcaactcttcatttgtgtccgtcagttacgcttgtacaattactctatcttttcgtctcttctatctgtacattaacaaaaccacattctcgaacccctcacttgtgcccgccagtctttgaaaatgttcaaagctactactctcaccaactccctccgcaccactaccaccacctttgcaccctccctcaaccgctccttccacgcatcttcagcaaacatggccatcaagacctacttcgagtgccagtggactggctcccagtacacctgcgacgcttccggcaagatcacctccaaggacgagtccgtggctccccgcaccggccgcatcaacttcaacctcttcgacgatgtcgtccccaagaccgctgagaacttccgcgctctctgcactggcgagaagggcttcggctacgccggctccaagttccaccgtgtgatccccgagttcatgctccagggtggtgacttcacccgtggcaacggcaccggtggaaagtccatctacggcgagaagttcgccgacgagaacttcaagctcacccacaacaagcctttcctcctctccatggcccacgccgggcccaacaccaatggctcccagttcttcatcaccaccgtcgtcacctcttggctcgacggccgccacgtcgtcttcggcgaggtgctga

SEQ ID NO: 20157 - DNA, 797 bp, Sorghum bicolor
  Clone ID: LIB5052-009-A1-XP1-D9
ccggccgggtcgggtatcggttactgtactttccactgtatctgatacttcttatacctagaaccaacaacagacgtctaagatgtcaagtgaacgaaccccattgatcgattctcggactcgaagacaggctgagaatgccttgccctcgaaaggtcaaagaatcaaagtagcagaaaccatcggtgcgcttcaagctggaaagttgccgtcccaagaccaattgtctaaattgcttcaagtcgtgcttgattccgatacactcaaatcgggcggtggaccaaacagtcgaactgcccgacttggaactgaaggacagaaagttttgggagatgtcaaggaagtcttgagagctttgaaagcttggggagaggagaagaatgataatgatctcttgcagaacttcttctacaacgcagctacggccgatgttgatgttgatatcaacactgcttctgctccttctcagaaggaactttctaaagatgctcagagagccatctactctttacgaactattgcttcattaatggtcaccaaccccgttttccgtcaactcggttcagatggtattctccttaccagagatatctttgcagatgccgcttcggtcgctgcggatctcgctaagcaagctgaaaagaccgctagaccctctgaggaggagagaaagaagggtgtagactttgaagaggctaaggccaaaggcaaacaagctgtcaatggcgtcaagtctggtaaagctcaggaaaggccaggagggttattcatgaggctgagaaggtaagagactttga

SEQ ID NO: 20158 - DNA, 667 bp, Sorghum bicolor
  Clone ID: LIB5052-009-A1-XP1-E12
tatcgtttattattcgtgggttgtgatcgcctccggcttcgcttgtgctttatgtcaggtatttcatgttggactctgaggagctcggcttcgaatcgaaggacgacgctggtgtgttgaagacttacgcgcagcatgtgtgttccgctctcgcaagaacggcttcctcgacgtcactgggcgcccctgcgatgttgaggtaggtgtctacctcggagagtgggaatcacggacacggcttatgccactttgttgccatagacatattcaccgggaccaagtttgaccatattggtccttcttcacacaactgcgatgttccgcatgtgaaccgtactgagcatcaactgattggcatatcacaggatggatttgcgagccttcttacttcctatggccacactaaggatgatcttagactcccaactgatgagactcttgcggcccatattaaggaaggatgtgaaagggagaaggatcttgttgtgactgtgcagactgctatggaggaggaggagatctgcgccctgtatgatattggccccgagtaacttccctgccttgctagacggtactactgtatctccgaacttagatggaaagataagtgcatctccaaacgatagctactgagacgttcacctggctcgaagctggcttttgctat

SEQ ID NO: 20159 - DNA, 861 bp, Sorghum bicolor
  unsure (1)..(861): unsure at all n locations
  Clone ID: LIB5052-009-A1-XP1-F8
gccggccgggttgggttgaactttcacgattatcgtcttcctgttcatgggtgtcatcttcgtatgcggtggtggtccagccaacggagagtactctgaataccagggcggcaaaagatggcaggatcctggcgctttcaccaacttcgtcggcttctgtggcgttttcgtcaccgctgccttctcattctccggtacggagctcgtcggtctcgctgctgctgagtccgagaaccctgccaggtcactgccctctgccatcaagcaggtcttctggcgtatcaccctcttctacattctgtccctcacattcgtcggtctgctcatcaaccacgacgaccccagacttttgggcagcggtcttatcgacgttgaagcctctccgttcgtcatcgtcgccgagcgcgctggtatcatcggatttgcccacttcaccaacgccgtcatcatgttctccgtcgtttccattggtctttccggtgtctacggtggatctcgtacactgtgtgcgctcgctgagcagggttacgcacctagcttcttcacctacgtcgaccgcgccggccgtcctctgtgggccaccatcttcgttcttgcgtggtctccactcgcattcatgacgctcgacaccggtggatctatcgccttcgactggctgcagtcgctttctggtctggctgcactcttcacctggggcagcatctgctttgcccacatccgtttcaggaatgcttgggagtaccacggccacactctcgatgagatccccttcagagncatctttggcgtcactggatcttggatcggtctcatcctagttatcatcgtgctcatcgcacagttctacactgctgtctacgc

SEQ ID NO: 20160 - DNA, 768 bp, Sorghum bicolor
  Clone ID: LIB5052-009-A1-XP1-G1
gccggccgggttcgggacgacaacccacccaacgactactaacctccgcagtcatcaccatgtccgactccaaggcctccaaccccatgcgggagctccgcatccagaagctcgtcctcaacatctccgtcggcgagtctggtgatcgtctcactcgtgccgccaaggtgctcgagcagctgtccggtcaaactcccgtctactccaaggcccgctacaccgtccgtactttcggtatccgaaggaacgaaaagatcgccgtccacgtcaccgtccgtggccccaaggccgaggagatcctcgagcgtggtctcaaggtcaaggagtacgagctccgcaagcgcaacttctcagagtctggcaacttcggtttcggtatcagcgagcacatcgacttgggtatcaagtacgaccccagcattggtatctacggtatggacttctacgtctgcatgacccgccccggtgagcgtgttgccaagcgcaggaggtgccagagcaagatcggcgcttcccacaaggtcaaccaacaggagaccatcaagtggtacaagaaccgattcgagggtatcgtccgataaacgtatcgtcgatttggggggaaaggaacgaagtgaagattttgcacgatcaccagcattttcggtctcggggggttcggtcctacggagtcctggaatgtatcttacaaaagagcaagcattgaacttgcggcctatcaatggagcgaccttgtctctaacgagcgggtctacgatcacaaaagca

SEQ ID NO: 20161 - DNA, 516 bp, Sorghum bicolor
  Clone ID: LIB5052-009-A1-XP1-G3
actccttcattaacaagcatcacctgcttcttccttcgcctgtgattcattcaacctagatgatgtcttgctgcagcggaactgcgggtgcggatccgactgccagtgcgacagcggttgcggggattgtaatatgtcccctgacatggagaccaccgccaccgtcgtcatgaagcccatggcgctcggtgcaccgaccaccaaggccagagccggcggcttcgaggcggccgtcgagggcgctggctgcgactgcaacacctgcaagtgcggcagtagctgcgattgcagctgctgcagctgcaactgagccatcccggcgatggagcacgacgaggaaggaggagacagagacaacaaccaccccccagcgtactaaactatgtagcggcgtctagataagatcctgtcaactgcgagcgtgcaccgccattattcatgcatggtcgccggactcttctccgtctccgaacctggagttgttcatctccaacgactcgacgtatgacgattgcc

SEQ ID NO: 20162 - DNA, 444 bp, Sorghum bicolor
  unsure (1)..(444): unsure at all n locations
  Clone ID: LIB5052-009-A1-XP1-H10
gccggccgggtcgggaaattcattactcaactatcaaaatgtccgtattaantcttcgaatttacaattnttggctcacagtctcatcctccatccgacgtggcttgccatgttagcatacttggctagagtttgatgctcaaatatagagaatcgctctgtcagtctgtcatgtgtgctcgttccgtgcgtgctggtccagtctttgcaatggtatcttgtgtttttgctttataagtggctgtggcgtgtggctaatcgtatgcacgtacaagtgaagacgtgaagtggattgagtttgcagatgcttcagcagttgacttacatcttgaaaaagaaacctatcttttagatgtggctggacgctttcttttccattgcttgcattgtacaggtccaatgccacttgttgtgatggattatgcaccccccccgacctcttat

SEQ ID NO: 20163 - DNA, 502 bp, Sorghum bicolor
  Clone ID: LIB5052-010-A1-XP1-B11
gccggcctgtccgtgagccggtttttggcggagagggtgaaggaggccgacgtgtttacctgcacgtacacaccaagggagcgggacaagtttgaggggaagattagggcggttgttcagtcactgatcgataacgggatcaatgtgaagctttatcttgattgagtttgtgttgtcggtatgaatagttctgttgaaacttgcaaatgagttatctgttgctagggatgcaaagctcgagttattctgtgtcattaagttgatataaaaaaaacttgctcaaatgaaatggaatggacatttcaaataatttgagtgaggggagaaatgaactagaatgatatttgactgtagttattagttagcacatcattggatacccacttgcgtccttgtgaccttgtctgttagcgtgaccataaatatatgtacttcgagctttatagtgccaaataagctatcgttctcattgttttaaaaaaaaaaaaaaaaaaggccccta

SEQ ID NO: 20164 - DNA, 698 bp, Sorghum bicolor
  Clone ID: LIB5052-010-A1-XP1-C1
gccggccgggttgggaaaggagtctgacatcttactattcaatacctacctttggtggatgaccggacaaaagatgaaaattttgcaaaactcttttgaagataaaaacaaggacatcatataaatggaaacagaggaagcctatggaatggtactgaatgctgtgctgaaatgggttgagagcaacatgaatcccaaaacttcaagagtattttttgtcactatgtcacccactcatacaaggagcaaagattggggtgatgatactgatgggaactgctacaaccagacaactcctatcaaggatttttcttactggggaccaggcaccagcaagggcctgatgcgagtcattggggaagtgttcggcgtgtccaagaccaagatccccgtgggggttgtgaacatcacccagctctctgaatacaggaaggacgcgcatactcagatttacaagaagcagtggaacccgctaaccccggagcagatcgcgaaccctaagagctatgcggactgcacgcattggtgcctcccagggctccaggacacatggaacgagctgctctactcaaagctctttttcccctgagctaaggttgattggagggttcgataacgccttgtctcatattcccttttgatggagtgcaagttgcaacgtgaagttgggactgggagcatagcatagcatagcattt

SEQ ID NO: 20165 - DNA, 699 bp, Sorghum bicolor
  Clone ID: LIB5052-010-A1-XP1-D1
gccggccgggtccggtgcggtggcaggaacgatcacggtgtacgcgaccaaccgattgatactgtgaagacgagaatgcagagcattgactcgaaggggcaatacaagaacagcatagactgtgctgtcaagatcttcagacaagagggcttcttcaagctatggtccggagcagtgcccagactggggaggttgatgttcagcggtggaattgtgtttgccatgtacgagaaaaccatggatcttttggagacactggacccggagaagaagtacatttagtgagagttgctggcacgaccttgggagacagaagtcccgacctcgagaggatatgttagagtatgaaatctgcaaccgcgatggtggaccaagacgcaagatcgcagtcgtgacctagcgaatcgaatgcgttggagatacgaagactcgtggcgaggctgtcctgcgattgtctccaggacatcacacgtggcattgagtcttcgcaaacagactggcctttttacacaggcgaatacatgtagagctgaaatacggcagcttgaggaccgggtgctgcacgctgaatgtggtggcagactgcaaacttacatatcttgctgcagtcgagccgtcgtaaggctgaaggacaggtgaataggtgggcccactcgccactctttagtcgagtccacattaaggcttggcgttcacctc

SEQ ID NO: 20166 - DNA, 763 bp, Sorghum bicolor
  Clone ID: LIB5052-010-A1-XP1-D11
gccggccgggtccgggttgcggcgaacactcgagcaccctcgacccccgttgagatggtctccatggcggccgcggcggcggccgtgggcgtgctgctgccgttcccgttctactacgcgctgtggacccacccacagcgttgggtggacttgtgcggccgcggcgccgacccgtgccggcggatggcgcaggtctcgcacgccatcaaggcgcttcagctcctcgcgctcgcctccgtcgcttcattctcctggcccccgccgctctactgccccgtcctcctcgccgtcggccagtacctcaacttcaaggtgtaccagctgcttggtgagtctggtacatactatggcgttcgatttggaaagatgatcccatgggtgacagagtttccctttggctatatcaaagacccacagtatgttgggagtatgcttagcctcgtcgcacttctgtgctgggttccacttcagtatgtgttgttgtggtgccttggttatgttttcatgatgtggatcgaacacaaggaagatccagccactcgtgccaaggtcatctcctaattgcttggttatggcagctgatagtttcctacaggtgccccagtgacattgcataaatattctttgaaaaatttggtacctgattgctgagaggtgatgcgcccccaagtttaagactggagtttctatgtccaaaaacctttacaaagtactgtggcaacctctattcttgaataaaaaaaaaaaaaaaaaaggcccccta

SEQ ID NO: 20167 - DNA, 509 bp, Sorghum bicolor
  Clone ID: LIB5052-010-A1-XP1-D12
gccggccgggtccagaaaccagagcaccgacggccatgttggcgggagctcgtggggtggggcacaaagggacatggcagcgctggaggtagcccggcctcaaaacgcacacgcccatcataccatggccgcgcacttcgtcgctagctatcgcgcacgccaccatatccgcgtgcgcaggcgccgcacacggcgccatagcatcggccccaggcgagcgccgtggcttccgctgcctcataaacttggtcgccggccacgaccagctgcactcccggcgcaagaggttcgatcagtctacagtgtctgcagaaggcacggatgctccatctggaaagaaaaaaaaaagtacttaaaagccaccattaaagcacgcaaatatttttcttcataactataggccttgtttagttcgcaaatttggtttttgattactgtagtactttcgtttttatttgacaaacattgtccaatcatggactttaaaaaaaaaaaaaaaaaggccccta

SEQ ID NO: 20168 - DNA, 467 bp, Sorghum bicolor
  unsure (1)..(467): unsure at all n locations
  Clone ID: LIB5052-010-A1-XP1-D8
gccggccgggttcggctgagcctggccggttgcctcctgtcgcttgtaaaataggaataggatcacgatgatgatgatgaaaagtttcttttccttcncnaaaaaaaaaaaaaaaaaaaaaaaaaaaaaaaaaaaaaaaaaaaaaaaaaaaaaaaaaaaagaaaaaaaaaaaaaaacaggcaccccaggccaagccggacgcagaaactcaacctctcccagaggatgggccccccgggccgcgccggttctagaattatggcaccccccggcgggccggggtcccatttcggcctttccggtaccgccccccccgggggggggcccgggccccttccccccctctgggggggcaaatccggcgcgttcccgggcctgtccttttacaagggccggcccggggaaaccccgggggttgcccgattaaagcccctggccggccttccccctttggcagggggggtgtt

SEQ ID NO: 20169 - DNA, 875 bp, Sorghum bicolor
  unsure (1)..(875): unsure at all n locations
  Clone ID: LIB5052-010-A1-XP1-E12
gccggccggtttcaggaacgagcctaaatatctcggaaacttggtctttgatgcctatattcggccacagtttcatttgagattggtggagctgtcacaactccagaacgtatgattagatccattcgcgaacgaattctatcgaccgagaacaatattggttgcatggctcattcaacactggcgtattcagctctcacaagtgccagaaaccgacgacgactacaacctccaaccctctcgatctatcgatcaatcaatcaaagactggctattctcacgcaacaataaaccactacccacgcaagcttactctccgaacgccaccaataatcaacatccggcacctcaacccatcacccgccctctcaccattcaccatgtcccccaaacgcatcctcgttggctacggtgtcgacatcgacgccgtctccggctggctcaacaccaccgatgggtcagaagcaaacccaaccaacatcagccgtgggatcttcggcgcgaccacaggtctctcacgcttgttagccctcttcgcccgccacaacatcaccgcgactttcttcgtgccaggtcatacacttgagtccttccccaatgaactcgctcaagtccgcgacgcaggccacgagctgggcctgcacggctacacgcacgagttccccagccagatgagtgtagagcagcagtgggacgtgctagagaagagcatacaagtcctaaccaaattcaccggttccaagccaaaaggctacacagcgcccgcgtggtcgacaactacagaaacgatccccatgctcgagaaagcaggcatcttgtacgatcacagttttatgcaccacgacttcctgcccctatgngccccgacacttctc

SEQ ID NO: 20170 - DNA, 675 bp, Sorghum bicolor
  Clone ID: LIB5052-010-A1-XP1-E9
gccggccgggttccggatcgtggcaaacgtgaccgttcgtctgcgacgaacgtgaccgactggagtgcactgcactgcactgagtgccaacgttaccttacccacagagggacacagccggccgccggcaacatcatggcgaggattctccaggtcgtggcgccgctcctcctgctcctgctccccgctggcctccgggagctcctctcgcccacgacgatccaccaccggacgccgccgatgggtgctgccgacgacggaacaacgtcgaccggcggcggcgaggtcctcctccacccgctggtgctgatgcccgggctgacctgcaacgagctggaggcgcggctcacggacgcccaccgcccctccgtgccgcggtgcggcgcgatgaaggggaagggctggttcgggctatgggcaaactgctccgacctgcccgcgcaccactacgtgcagtgcttcatcgagcagatgaccctcgtctacgaccccatcataaacgattaccggaacctgcccggcgtcgagacgcgcgtgcgcggcttcggatcctcccgaggcttccagaggaacccgaagcacacgtacgtaacattactataaaagatcttttgcgagacattctagaaaagaccatgaaggctggcagaaaaaaaaaaaaaaaaaaggccccta

SEQ ID NO: 20171 - DNA, 670 bp, Sorghum bicolor
  Clone ID: LIB5052-010-A1-XP1-F12
gccggccgggctccagaattagcttgagacgagacgggatttcccatgagtgcccatgtacgtatattgaatcccatgacgggaacgttttctcccatattcacgatacccatcaacgggaaggtaggtaggtacctaccagggcagagagataaggagagcgtctgggactgacctgatgcactggaagtccaatgactgcctgcttgtcttgcagaaacttggccacgttgtccagctcggaagtgacagctcgtcggactttttaaccctgcttctgcgcctgctgaatgagctgtattcagcgctctcctctctgtgactctggagggaagacccaggcggcgcagtcaacgagcccacccaattcgaaacaagtttcaaatcgcaatgatttgacaagcgcccccaaagcaagaggaaagctctgacgttcgtcggacgatgctcggatcctttaatgtgcccgggtgaaacaagccggctcaatgatggagatcttgacggagagacagggtctggcaggggctgttccgcacgaaaatgcgtgaggccggaagtcgcccattgcatgcattccacccgcttcactatataaagtctcgatcccggcccctggacgcgctgcgtcgtcctctcatcagaaaaaaaaaaaaaaaaaaggtcccta

SEQ ID NO: 20172 - DNA, 674 bp, Sorghum bicolor
  Clone ID: LIB5052-010-A1-XP1-G10
gccggccgggtcggggcttctctcttcctctccatcaacgcctacacaatcacaatcccaaaacacacatcaataccatcaatacaaatcacataaccgtcaaaatggtcaaagccgtcgccgtcctccgtggagactccaacatcaagggtaccgtcacctttgagcaggccgacgagtcctccaacaccaccatctcatggaacatcactggccacgacgccaacgctgagcgtggtatgcacgtccacgcctttggcgacaacacaaacggctgcacatccgccggtccccacttcaacccccacaacaagacacacggtgcccccgaggacgaggagcgccacgtcggtgacttgggcaacttcaagactgatggtcagggcaatgcgcagggaagtgtcacagacaagttgatcaagttgatcggctccgagagcgtcattggccgtaccattgtcgtccacgctggaactgatgacctcggcaagggcggacacgaggagtcgaagaagactggtaacgctggcgctcgtcccgcttgcggtgttattggcatctccaactagatgtgtcattaaaaaaaatctagcgagcgagtagtcttagtatagccaaatcaatctatctatgcctctcacaaaaacgaaaaaaaaaaaaaaaaaaggccccta

SEQ ID NO: 20173 - DNA, 304 bp, Sorghum bicolor
  Clone ID: LIB5052-010-A1-XP1-H1
gccggccgggttccgatggttgatcctgttatctgatagtatgttctaatgttagcttggactatgaatctatgatctctgtgagctctttccgggattgttccgttaatctctcccaaagaggtttgagggagcgaggggattttcttacttgcagggacaatcctcttcagtttctttctaattctaatctcacattctcaccaaactgaacaaggcctcgatgagatagcggagcatgacttgtgagagtatgacaaataatatacgtattgccgaaaaaaaaaaaaaaaaaaggccccta

SEQ ID NO: 20174 - DNA, 240 bp, Sorghum bicolor
  Clone ID: LIB5052-010-A1-XP1-H10
gccggccgggtacaaaaactggcgattccaacccctcacagttaaccgggaaaaaaaatctctactcctgctcagaagcaaagcccagggctgtcgtccattccattttcttttctttcatttcatccgtgcaagcaaagcaacaagcaaagcctggggttgtcgtcggttttcttccggccgggaagctaaggatcggagacggatcgatcgaatggtcggcgccggggccgggccgcc

SEQ ID NO: 20175 - DNA, 826 bp, Sorghum bicolor
  Clone ID: LIB5052-010-A1-XP1-H9
gccggccggttcgggccacatgcctatctccaagatcctctcccgctacgtctacgactcccgtggaaaccccaccgtcgaggtcgacattgtcaccgagaccggcctccaccgcgccatcgtcccctctggtgcctctaccggctcccacgaggcctgcgagctccgtgatggtgacaagagcaagtgggctggcaagggtgtgaccaaggctgttgccaacgtcaacgagatcattgctcccgctctcatcaaggagaacctcgacgtcaaggaccaggccgccgttgacgctttccttaacaagctcgatggcaccaccaacaagaccaagattggtgccaacgccatcctcggtgtctccatggctgtcgccaaggctgccgccgctgagaagcgtgtccctctctacgcccacatcagcgacctttccggcaccaagaagccctacgttctccccgttcccttcatgaacgtcgtcaacggtggctcccacgccggtggccgtcttgccttccaggagttcatgatcgtccccagcgccgctccctccttctccgaggccatgcgccagggtgctgaggtctaccagaagctgaagtccctcaccaagaagaggtacggccagtctgccggcaacgtcggtgacgagggtggtgtcgctcccgacattcagaccgccgaggaggctcttgacctcatcaccgacgccattgaggaggccggctacactggccagatcaagatcgccatggacgttgcctcttccgagttctacaaggccgacgagaagagtacgaccttgacttcagaaacccgactctga

SEQ ID NO: 20176 - DNA, 518 bp, Sorghum bicolor
  Clone ID: LIB5052-011-A1-XP1-C4
gccggccgggttgggaactaccttgtcggctagtctctcttgccccgccttatcctctgcgtgcgcaccaacgggaccgaagaccaattcagatgcctggagaccaccgacttatacatacggtagcccatcctggtgccttattgcacccatgatgtacacaagcgtcctccgcaagctccactacatgctgcatccatggcgagatcgcctcgtgaatgcttctcccagcgatgctcgtgaaccttctgggatatctataagaaaaaatctatggaagacatcgacaagatgctatcaccgtgtcagtgctatacaaccagcaaaatacattgatagattatgaatagatgcttcatattggccatactctcgacctgattttttacatatgtggacaggacacatgatgcatgactgaggatcccccatcgacttagcatctgtatcatctccacattgcaacggtctggttcgaatctgctgtgggttcacaatggatgtcacgaattactacc

SEQ ID NO: 20177 - DNA, 760 bp, Sorghum bicolor
  Clone ID: LIB5052-011-A1-XP1-D12
gccggccgggtccaaacgctatagaattctcaacatgttgctcgcactagcattgaaggccgaattgaacggagtcaccgacctccgcccaaacgacacggaagacgcgccctttttctacactttcaaagtccaatgcacgtcatgtcgcgaagtacaccccaaccccgtctcggtaaaccgcttcgagatgaacgagcaaagcggcagcaagggtgaagccaactttgtctggaggtgtaagaactgtaagagagaacactcagcgaacatcaaggccgcgcctacatcctacccacaaagcgacccgcccaagaagatcaacatcctcgagtttgactgcagaggcctggaatttgtcgaatttaaggctgagggggagttccttgcgacgggcatagaatctggcaccaagttctcgggcatcgagctgcccgatggcgaatggtacgactacgacgagaaagctggcgaggaagtcagcatcacaaatgtcgagtgggagatacgtcgcgcatagcatgtgcccagtagtgtaagatgaaggaacgtgccacgaggcttcaagaagggcacagtatgtgttacctgagcgagctcatgcatgaagcgcatgagaaggagagaggacatgggaagtcaccatgacgagacgttatccaagtgtgcatatgcacatgtgaggtgaagtggatgcgagtgctgatcacatatataaatggacacattcgtcaagaaaaaaaaaaaaaaaaggccccta

SEQ ID NO: 20178 - DNA, 668 bp, Sorghum bicolor
  Clone ID: LIB5052-011-A1-XP1-E4
gccggccgggctgggaaacagaacgacgtcgacaactggttcattcctgggagttctgaaaacacgtgaatagacactgcacataccaatcgttctgaaaaggccgataccatgtccgcttacaaccccgctcctatcccagagtccgactcctcccctcgagcccagcttgatcccgccagctccactgcgcagcagaacatttcccttggtgctcccgccagctcctcgggacaagtgcaagaccaagctgcatccgctcaaggtggcagctaccagactggtcaggataccttcgccgcgaggggacagcacgagcaatcgggtatcgaagctgcaccagccagcacagttgccgactacgactacccgaatgtgcctgagtcgagcgagccgcagcaggctgcgtcgggaccttacgctggtggacaggagaattcggagcaggtgcccttcaaggagcaggtgaacggctacgcaaagaagatcgcaggcacgttcttccgtaacccggaagagaaggagttcggcgagaagaagcttcgaggcgagatctgattcgcatttcattatcagtacttcgcacgctgtttcctcataccgcatcggaagacgcagtatgcctaatgcatataatcaaccaaaaaaaaaaaaaaaaaaggccccta

SEQ ID NO: 20179 - DNA, 580 bp, Sorghum bicolor
  Clone ID: LIB5052-011-A1-XP1-F4
gccggccgggcttgccaactccacacctgcaacttcaaacatcaactagaaccaccatctacctacacacactaccccaaaaacaataccacaaacagccaacatgaccgacgcattccgcaaagatacccacaccaagctcggtgagaagatgcaaccgcagtcttcaaagtccactggcaccaagatcaaggagtccatcactggcaccggcgacaagattgcccgcgaggcgcagcccgactcttcaaagaccaacacgcagtctactatggacaagattggccgctccaaggacaacaacgttcaccgctccactggcggtagcattgtcgacaagaccaagaacgctcttggaatgggtcaccacactaccggcactcacaccactcacaccactcacacccatggcagcggcttgtaagcatcctgcttgccctcgatggtagaaggaggaatgcgatacccaaagaagtctccatggaatgagatggacttgtactttatgagatacctcgcctgcgggctaatgaattaatacctttttacactgcaaaaaaaaaaaaaaaaaaggccccta

SEQ ID NO: 20180 - DNA, 684 bp, Sorghum bicolor
  unsure (1)..(684): unsure at all n locations
  Clone ID: LIB5052-011-A1-XP1-F7
gccggccgggtcggggntttctgagatccttagaagtttaaacacagcacgctacccacagtgctgcacttgctccgccgctcgttcgatctccagtgcccgtctcgtttttttttttctctccttcgactcagagggcttgcttcgctcctgacccgttcctggagtgagttcgacgatggacctcctctcgtggatcgtggtcggctccatcatcttcctcctcatcgtctgtgtcctcctcatgctccttgagagctacctgaagcatcgccccgcgcaggacctgctccccggcggaggagctgcgcgtcgtctgggccagccgccggcgccgggagctgcatgagtcctcggtttcttcggtccggaggctgatgtggtgtggactcaatgcatgtgtgcgagcgcatgctggctatatagttgctttaatttatctttggtctgttgttcagtgtgtagcgagaatagggtttagggtgtgacgatgtgtctgtaagataagtttgctcatcgatcgctatggtgtctgcctgactctgcctgtcgtctggatggttggggtcagtagcaattactaactactgcattagcatgactgtgtatggtaatattctgttgtagctagtagtaaacgtgcagcattttcatatggaaaaaaaaaaaaaaaaaaggccccta

SEQ ID NO: 20181 - DNA, 846 bp, Sorghum bicolor
  unsure (1)..(846): unsure at all n locations
  Clone ID: LIB5052-011-A1-XP1-H11
gccggccgggtccgntacctacctgtgtgttcttgcgcctgaagactcgcaactcgtctggacctgctcgcgaccatggcttcttatattgacttcagtcagcccagtttgtgggtatctgctgcaagcattgtatttaaccctactttctggaacatcgctgcgcagcaagaataccacaacaaggtcatcaccaagctgtttgggggtaactctcgacttgggtgctatgcgctcgccgtaaccattttctcactgggtatctttcgagactatctttacaatgaagctctcgccgatcagcccacccatccgactctcctctcccctgctatcaagtactccgcgatccctctgttcctaacggggaacaccctcgtcctgacctcgatgtgggctcttggtgtcactggcacctaccttggtgactacttcggcatcctcatggacgagcctgtgacgacattcccgttcaacgtctcgagttcgcccatgtatcacggctctgccatgtctttcctggccacggctatttggtacggaaaaccagctggtatacttcttactgcactagtccacactgcatactctattgcgtgcaggtgggaagatccattcactggtatgatctaccagaagagagatgaggagaggaagaagggcaagaagggtctgtagatgactcgtcattacattggccagcacgatacaagatagtaatgttgngcaaacgagcctgcgacatggctcttgtggtcaattgcacaatagcgcatccaatctccatgtccgcacacgtatgggttgtnggggggagaatgaggcggagtagcacgtcttttcaca

SEQ ID NO: 20182 - DNA, 706 bp, Sorghum bicolor
  Clone ID: LIB5052-012-A1-XP1-A10
gccgtttcgggaccctccaagcaaccaatcattgtcggagacgaagccggggctcggggaacatggaccacggaagcgaggtggcaaggccgacgacgacggtggagtccaccgacgtcgccatggccggcgcggtccagggaggcctgcaggcacacatgagcgccagcaccttccacggccatctcggcgctgccgcctctcctcgccgcgccagcttcgaaccaaccgcagcgttcgcgcgccatgtccgcgccggcggcgctggacgcggcgaggtgcctgtcgccgtgttgttccaccgtgaacccgcacccggcggcgaggtgtttgtcggtcagctaaccgacggcgtcttcgcgcagcagactgtcccggggcaccgggcgcgccgccggcggaatggtggccgagcacctgcgtcgtcgtctcctcccgttcgccggaatcggtgtctcctccttggctgtcaatgggctcgccgccgccggcccgagctcgccggcagttgcgtttcacctcttcgtgatgcttttgggcggtctgtttctgattattctgcacgtgctccgtgtgtagtcaccttgtccgatgatgagtgcagtgaagcagccaaaacatggatgtgatacgattatgagagctacgcttagatttgatgggggaataatcccggatatgtgatgtgtaggggttctggatctga

SEQ ID NO: 20183 - DNA, 470 bp, Sorghum bicolor
  Clone ID: LIB5052-012-A1-XP1-B4
gccggccgggcttgcgtatcgacacaatgcctccccaagtgaagtctaaggctcaaaaggccgctgccgctcaggccggttccaaggctggtaagaagaagaagaggtcgaagggcaaggtcaaggacaaggcgaacaacgccgtcgttctcgacaaggctctcttcgaccgaatcgtcaaggaggtccccacttaccgagtcatttcgcaatcgaccctcatcgaccgaatgaaggtcaacggatcccttgcccgacgagccattgcctacctcgaggaggagggcctcatcaagcaagtcgtccaccaccacgcccaactcatctacacccgagcccacgccggaaaggactaaacagccactagcgacgatggacgaagggagactgggagatgaggactataccgcgaggttgtaggatatggatgcatccgtcgacagcaaaaaaaaaaaaaaaaaaggccccta

SEQ ID NO: 20184 - DNA, 711 bp, Sorghum bicolor
  Clone ID: LIB5052-012-A1-XP1-B7
gccggcctggcttcgcgaaaaaaaaaaaaaaaaaaaaaaaaaattaaaaaaaaaaaaaaaaaaaaaaaaaaaaatttctcatccctaaaaatggacctgaaaaaagctcatccaaggttacactggagctaaaaatggaacttttgaactggggttcttgtttcaggaactggatcctatcccaaaaagcttatatcgaaaccctcaatggctggctagtcaaatggcttcctcaaaaaaaggaggaaactccggatggcattgcacccttctctcctggaaggcttggagctcctgctgggttcattacagctaatgattggggtcaagccatgaaaaggataccaaaagccagcgtcgtaaatacaatggaagcttttgctgtcaacgtacatatgttatgggagcggcaggacgaaaagcagcagcaaaagctgaaagctgactacctctctagggattttgcaaagcggctcaaatctcttcaggaggaacatggcttgcaagggcaatttgaagctgacaaggcagtgttgcccattgccgacaatggcagggcagtcgataaccgcatggttgcattggatacactgcacaagagattggatgaacaaagagctcggcacgacgaaactgtgaaacagattcgaaaggccagtgcagctgatctgaaacaggtctggctccgatatttgaagcactggaatcttt

SEQ ID NO: 20185 - DNA, 213 bp, Sorghum bicolor
  Clone ID: LIB5052-012-A1-XP1-C4
gccggccgggctgggatcaccaaatcctcttccgcctctcctccattaacaaatgccccaactactccagatccacaaaattgtagccgtccccaccctccagatgatggagaaccctgggcgacatcttgtacatgacgggcgggagggaaatggacggacatatcatgatgaagctctacactaacgacgatgcccgcacgggagagaact

SEQ ID NO: 20186 - DNA, 762 bp, Sorghum bicolor
  unsure (1)..(762): unsure at all n locations
  Clone ID: LIB5052-012-A1-XP1-E5
gccggccgggctgcgaggccgcgcaacacgcaattacccaccaactctttagaacctcggagtgacctcttttctcctaaattctgaacaagatggctgccgctgccaccaacgagctgaagctcgaccccaagtacgatcaatacgactaccctaccgttgctcccaccgcccaaagtggacacccaggccacacaactccagagcaagatgcccaagtcttccagctgaggacccagctggagcaggctggccacaccaagaacctcgacactctgactctgctacgattcctccgcgcgcgaaagttcaatgttgagcttgcgaagcaaatgttcgttgactgcgagaagtggagggccgagtacgctggctgcggtgttgatgagctggtccgcaccttcgactacaaggagcgacccgaagtcttcaaatattacccccagtactaccacaagacggataaggatggccgcccagtctacatcgagcagctcggcaacgtcgacctcaccgcactcaacaagatcacctctcaagaccgtatgatccagaaccttgtctgcgaatacgaaaagatggccgacccccgtctccctgcctgctcccgcaagtctggctacctcctcgagacttcgtgcacaatcatggacctgaagggtgttggtatcggcaaggctacctctgtgtacggttacttgggtgctgtgtcccagattggncagaattactacccagagcgtatgggcaagatgtacatca

SEQ ID NO: 20187 - DNA, 739 bp, Sorghum bicolor
  Clone ID: LIB5052-012-A1-XP1-E6
gccggccgggtccggcttcttcctcgtcatcggcccgctccagctcgtctccttccccatggtcaagttggtgggaatccacacgaggttgcctttgccgtccctgggggagattgctgcacagctgctggtgtacttccttgttgaggactacctcaattactggatccacaggcttctccacggggagtgggggtaccagaagatccaccgcgtccaccatgagttcaccgcgccaatcggattcgcagctccatatgcacactgggctgaggtgctcatactcggcatcccctccttcgtcgggccggccattgctccaggccacatgatcacattctggctctggattatactccgtcaggtggaggctatcgagacacatagtggctttgatttcccattcaccccgacaaagtatattccattctatggaggagcagaataccatgactatcatcattatgtaggaggccagagccaaagcaattttgcttctgttttcacttactgtgattacttatatgggactgatagaggttacagattccacaaagcatacctagcaaagctgaaggatctggggcaaaatgatggcgagaaaggagatggcagtggactcagctatgtgaaattggattagattgcaagatacagtgcatcttgagtgtttctatgaccatccacttcactgtggcattttgaaatgggagatataccgagctgggctgcatcttga

SEQ ID NO: 20188 - DNA, 759 bp, Sorghum bicolor
  Clone ID: LIB5052-012-A1-XP1-E7
gccggccgggctgcgatccttcccaaacgtttgtaaattgcctcaaaactaagaaaagaaaaatactgtttgtctggggctctgggctatccagggcgctgcattcatttgtactagcagaaatggaatatatatatatatatatatatatataaattactttttacacgcacgagtatctactccgacgtagctacacgcgtgaattcttctctctcgcacggagcaggagcgggatttgataccggatcaaccccctcccatccatggatccaccggcggcggcgcaaacctccttcccaccggcgtcggcgagcctcgccctcaacagccgcggcgggcctcgccccacccccatcggcggcagcacggtcaggtcagcgcgctcggtggccctcctcctctagcagatccagtcgcgagcggctcgcctcgtgccgtcgtgcggatgcgactcgtctgtggtgcggctccaccgcaagccaacgacggcagttgcctctttccctagcggatccaccgcacaaggctcgtcctcttcatcaactatggcgtcagggctccatcccaccactgatggcggctccggcatcagcgggcaggcagcctttggctggcggcatggccatcggcgactggggacagatcaggtggtgctgaccctcctccctgatcaatggtggccttccttcctctggctactacagcgaaccttcctatgccatgggctttttgatgcaggtggcttcctatgctatc

SEQ ID NO: 20189 - DNA, 775 bp, Sorghum bicolor
  Clone ID: LIB5052-012-A1-XP1-E8
gccggccgggctgcggccaccggcaagtgtgagtgatcgacagcaccgtccgagcgtcgccgtcctttactttactttaacccaacgagctgaggaggagcaggacggcgccccaccccccacagaattcctctctcgtccaccaccaccagcggctcagctcatcagatcgcacggaggagaggcttattgcttgcgggagcgggaagaatcttcgtctcgttggcgagcgagacaggtgcgcgtgcgtgcgtgcgtgcgccggcgaggatagtattgcagccgtcggtccagtcgttcgtcgatcgatggggatccacctggtggcgttcgtggcggcgaggggcttcctgcaggtgttccaggtgtcggcgccgctgctgtggccgctcaacctctggctgccgctcgcgcgccacctgcccgaggcctgcgccgccttctacgacgccctcgtctcgcacgcggcccgcctgcgcgccaccgtccgccgccaccgacgcgacaccggcagccggagcgccctcgacgagtacctccgcaacgccacgatgctaacgctctcgctcttccacctgtgagtagctatagctaggatctgctatctccgtttgttttttccctcgctagctcttcttctgctgcttttcggtgctttgattagattagtaggttgtaattgctagctagcatctcaaggtgagcattgagaagctctgtgtgggaaatttgtaatctcgtcttctggaactgaagaacaacccattttagtcgg

SEQ ID NO: 20190 - DNA, 515 bp, Sorghum bicolor
  Clone ID: LIB5052-012-A1-XP1-F1
gccggccgggccttcgagtccttcaagatcagcagtcatgtcgcccgctcacatccccatcgtcaagaagcgcacaaagcacttcaagcgacaccagtcggaccgataccatggtgtcaaggagagctggagaaagcccaagggtattgacaaccgagtccgacgaaggttcaagggccagacccccatgcccaagatcggttacggatcgaacagcaagaccaagcacctccttccgtccggccacaaagagctcctcgtccgaaacctgtccgacctcgagctcctgctcatgcacaacaacaaatacgctgcggtcatcgcccacggtgtcagctcgaagaagagggtggagattattggacgggccaaggttctcggtgtcaaggtcaccaacgccgccgccaagctgaggaccgaggaggcttaagcgtagtggttgggatcgcatcatcacgtttcctaggcgatgtatatcatggcacgacgaaaaaaaaaaaaaaaaaaggccccta

SEQ ID NO: 20191 - DNA, 655 bp, Sorghum bicolor
  Clone ID: LIB5052-012-A1-XP1-H12
gccggccggttctcgaactctctttggttcgacttgatcacatcactagagcctaataagctcgatccagccatggcgaagcaactcctcattcttgtggccaccatcattgctttgatgctccgagccacttatgcaagaatcatacagattaaccctgccgggtcagtatatcacctgttggagctgaacaacttgccgcagggcctcctaccacttggtgtgcaatcctatgtgcttggtgccggtggagctttggatgtgaaattgtccagtgagtgtaacgcatttgtcacattctccggtaggaaattcgagtttgtgtacgctaccgaagtaaacggggttatcaagtcaggatccattagcagtgtatctggggtgagtgtgcaggtggaatttgtttggcacgttttgcacgaagtcactcgtgcaggcaagcagctcaagatccagctagggaacaacactctgtcattcccagtcagtgccttcactgagatccccagctgcaaccgaggcatcgaatcctcgactgatgcgttcgcctagagccatgtcgattagagatgaatatacatgatactttttgtcgattagagatgaataatatacaggtttacttggtgaaaaaaaaaaaaaaaaaaggccccta

SEQ ID NO: 20192 - DNA, 835 bp, Sorghum bicolor
  Clone ID: LIB5051-001-Q1-XP2-A6
gccggccaggtccgaacttacttcgctggtcactctcgctccatccgtagatgcgctctgcgtcttcttccctctggaacacactcccacacagacacagagcttgagctcgaaggccatggagaaacgaagacgcaggcacttgctgcttgctgctgcagccgtggtgctggtggcagtggcagcaataccgctgccgtccgcggaggcgaagctgtccccagactactaccggtcgacgtgcccggacgtcgaggcgatcgtgcgggcagtggtggcgaagaaggtcaatgagaccttcgtcacggtcccggccacgctcaggctcttcttccacgactgcttcgtcgagggctgtgatgcgtcggtcatgatcgcgtcccgcgacaacgacgccgagaaggacgcgcccgacaacgtgtccctcgccggcgacggcttcgacaccgtggtgcgcgccaaggccgaggtcgagaagaagtgccccggcgtggtctcctgcgccgacatcctcgccatcgccgccagggacgtcgtcgccatgtcgtccggcccccactggaccgtccagcttgggcggcttgacgggctcgtctccaaggccggcaacgtcgcgggcaagttgccgggacccaacatgcgcgtcaaggacctcgccgccatgttcgccaagcacaacctcacgacgctggacatggtcgcgctctcgggcgcgcacaccgtcgggttcgcgcactgcacccgcttcacggaccgcctctaccgccacggcggcggcggcaatggggcgcgtcggtggacccgtcgtacaaccctgcgtacgcgcggcagctca

SEQ ID NO: 20193 - DNA, 610 bp, Sorghum bicolor
  Clone ID: LIB5051-001-Q1-XP2-B3
gccggccgggttccgaaaactgatcatccttctccatactgatcgatagatcgattatctgacgatcttatttcccttcaatacagtgctttgtggaatgatgttgtgctgttgaggctgcggcccacggggctcctgttgcaatcgcgtaacagacctgcttatggagatgaatgtacccggagatgtgtgataagtatgtgaccaccaccgtcaatactctctatatgtatgccacactagtcaaccaaggaaaacaccaagggccctattcgaggcggccgccgtagactaagcgtgacaaccacgggtgcaagagcgccccctactgcttatgcaaaccctgcacctgcaagtgagctgcataatcacacccctctgcactgtactgcagcccattacgaagcgactcattgccttacgctgtactatagcagtgactgcactgagccgtgtggttacacccatcaatcagcttgagtgccatcccaccatatgcctactggttctgatactgatgaggaaccaataataattgcactgccaatggtggcgtcgtgtgaatgttcacgggctcctgcgagggctcatatactagcagaattcgctg

SEQ ID NO: 20194 - DNA, 773 bp, Sorghum bicolor
  Clone ID: LIB5051-001-Q1-XP2-C6
gccggccgggttccgatttgactacattactttccacatcacgttgccggaagaatctccagaagccatcatcatgtttgccacccgccgtttcgtgtcactcgctcctcgtgccttcggcgcagcccgcggcttccagtcaacggcacgcgccagtgttcaagttggcgactccatcccaagcattgatctcgtcgagacctcgcccggcaacaaggtcaacatcgccaaggagcttcagggcaagggtgttatcgtcggtgtcccagctgccttcagcccggcatgctccagctcccacgtgcccggctacatcaaccacccggcgctgaagaacgccggtaaggtgtttgtggtctctgtcaacgacccttttgtcatgggtgcatggggaactacccttgaccccaccggcaagtctggcatccgcttccttgccgaccctcacagcgagctcacttctgctcttgacctctcctttgatggtgccgccatctttggcaacgcccgcagcaagcgctacgcgctcgttgtcgagaacggcaaggtgactaaggctttcgttgagcctgacaacaccggtctcgatgtcagcgctgccgagaaggtgcttggcagtgcttagatgtagcagagcagagtgtctttgctcggcaacagacccggcttgtacatactaaacagacgcgtgtaagacaaagtatcaaatttcgccgatcgtgcatcgcggtatgttgcactcgttcaataaaaaaaaaaaaaaaagggcccta

SEQ ID NO: 20195 - DNA, 581 bp, Sorghum bicolor
  Clone ID: LIB5051-001-Q1-XP2-E12
gccggccgggctccgactcacacaaccaccccaccacgcaactcctcgtacataccaccatccactgaactcgccaagatgcagatcaaagtccgcaccctcactggcaaagagatcgagcttgacatcgagcccgactacaaggtccagcgcatcaaggagcgtgtcgaggagaaggaaggcatcccgcctccacagcagcgtctcatctacggcggaaagcagatggccgacgacaagaccgccgaagagtatgcgctcgagggcggcgcgaccctccacttggtcctcgcgcttcgcggcggtagctggtaaagaagagcaaggctatgtggacaagcaaagcaagaaggacagaagaataccaagaatcaatgagcagtgaggactacaccatggcgttcggagcaagcatgacaagctgggctgtgaattatcgagcgaatgatatgaatgcataaggcgactggctggctgcttctcagcggcatagcacgagttcgatcgaccaggtccgtggaccggtacatgaatgaaacgagaaagtctaattctaaaaaaaaaaaaaaaaaaggccccta

SEQ ID NO: 20196 - DNA, 672 bp, Sorghum bicolor
  unsure (1)..(672): unsure at all n locations
  Clone ID: LIB5051-001-Q1-XP2-E2
gccggccgggtccggaaaccgactctcgagctgtatcttcagttcactgcttcatcgttcccgctccagtccgctgtccagtcatgttgcacaacttccggcccgtcgtcgttctcgtgctgagcttccttgtcctgctcgccagcgcttcgccggtcaaacggcagtccagctcctgcaaccccgtccgattcaacaccgtcctcccgaccttcatatgcgccgagtcaaccattgacttcgcgtgggagggtgggtcgggcaaatacaacatcttcaggtgggaccaggaccaacggatctactacctggagaacacgggcgtgcagcagattcaattcggatggggcgaattcgacacatatccgaccggtatctcgttcatcatcggcgtcgagtcggcagacgatctttccgcggagtgcggagacgctttcgaggcggagcagcggacggagatcatgccttttgtgcggtgcgagacgctcagcgggtgacggtcgcgaccagcatgcaccaacaggaccagagacatgagagacagacatacagaaacgagtcaaagcggcaatatggtacgacaccgcatgcatggtttatgcgnngaanannnnnnnnnnnnnnnnnnnnnnnnnnnnnnnnnnngaanaaaaaaaaaaaaaaaggccccta

SEQ ID NO: 20197 - DNA, 432 bp, Sorghum bicolor
  Clone ID: LIB5051-001-Q1-XP2-F1
gccggccgggttccgccgcggtgttggcatcgacaaatgagtccgaggcgcagaaattgttgcagcaggctctggcgccattggcggcaatgaagaggaagcccggtggcggcgttggcttcttcgagcaaggcttcctcatcaacgccggcatgatcctgacaatcaccatcagtgcaacggccgcagggacgatctggctggtcaagaacggaaggatcccatcttgggggttcagggtatgagtccgatactaggcagatcgctggcatcagcagcaagaggtcggtggctccaagatatatcctaagcgcgcggtctgtgagtgtgccggcagcaaggaggaagcgcaaaggtataaagcattgagaacataagggtaatgagaattgtgggctacatcaccaaaaaaaaaaaaaaaaaaggccccta

SEQ ID NO: 20198 - DNA, 893 bp, Sorghum bicolor
  unsure (1)..(893): unsure at all n locations
  Clone ID: LIB5051-001-Q1-XP2-F4
gccggccgggtccggcttcttctcgttatcaaatgggtcgaggtcctaagaagcatctcaagcgtctcgctgctccctcgtcatggatgctcgacaaactgggcggcacctacgctccccgaccgtcgcccggtccgcacaagctgcgagagtcgctccccctcactgtcttcctccgaaaccgactgaagtacgcccttaccggacgagaggtcacctcgatcgttaagcagcgactcatcaaggtcgacggaaaggtccgaaccgacgagacctacccggctggcttcatggacgtcatcacgattgagcgatccggcgagcacttccgactcctctacgacatcaagggacgattcaccatccaccgaatctccgccgaggaggcttcgttcaagctcctcaaggtccgacgacaccagctcggcgccaagggtgtcccccacatcgttacccacgacggacgaaccatccgatacccggacccggctatcaaggtcaacgacaccgtcaagttcgactttgtccagaacaagattgtcgaccacatcaagttcgagcccggaaacgttgtcatgatcaccggcggccgaaacatgggtcgatccggtgtcattgtgcacagagaaaggcacctcgggggcttcgatatcgttcacgttcgagacgtcctcgaccgaacgttcgcgacccgactgtccaacattttcgtcatcggtgagggcgccaaggcccaggtttcgctgcccaaggcaagggtgtcaagctctcgatcgccgaggagcgagaccagaggcgacgagctcgagctcaggaggcttanngaggtacgggcttgtaccatggatgcagactttacgaaaaaaaaaaaaaaaaggcccctagggcgcggc

SEQ ID NO: 20199 - DNA, 664 bp, Sorghum bicolor
  unsure (1)..(664): unsure at all n locations
  Clone ID: LIB5051-001-Q1-XP2-G10
gccggccgggctgcggtgctgaaagaaagcctggctggaaagagggaggaagctgacgatgaagaggctgttgatcatgcgaaggtgtgagccgatcgtgcggttcacgtgctgcagcgtgcactacagggagtgccgtcggaaccatgcggcgagcactggaggctacgccatcgatggatgccgggagttcatcgctgaaggggaggagagcaccagtggtgctctcaagtgcgcggcctgcggttgccaccgcagcttccaccgcagggttcaggtctatgaggttgcatgggattacggatccgacacgtcgtcaaccgagtagagagcagagaggagaggtgaggtgcaaggtgctccgagcttggatttgtgctcctgcaatggcaaatgctcaaacaattggtctctttcttctatgtctccggtgacaacctggctggtggatgtatagggcccttgtgattgtttgtagcgtgtacaccctgatttgatccctcgaaattcttatctacagtttctctgtctgctacacccttgtattgtaatttgagtaaagtatatgcgagttcaaattaanaaaaaaaaaaaaaaaannanannnnnnnnnnnnnnnnnnnnnnnnanaanaaccccaaaaaaaaaaaaaaaaaggccccta

SEQ ID NO: 20200 - DNA, 608 bp, Sorghum bicolor
  Clone ID: LIB5051-001-Q1-XP2-G9
gccggccgggttccggctctgggactcagcgctggtgatcagatcaccatgcagctgacgtaccagaccggtccgggcaagtgggacatgtacgagtgtgcggacctgaacctcgtctccgccgacgcgttcgcagctggtaactgggacacccagtgtctcaaccgggttgccggaacgcagaccaagcgagtcagcgcatcaaaccccaacctgtacaagctgcaacaggaggccgaggcgtccgctgcggccgagagcggttcgtctagcgacagcggccttagccgggtcgagagtggagttgtcggagctatggtctcgctggcggttgcgcttctcgccatcgccttggcgtacttcgctggtgtggtggccttcgggaggaaggccaaggctgtcaagcatcagcgagcggggtcgtacactgagcacgccgatgccaagaccgtcaactcggtctaagtgcatgacccgtgtacgccgacagagagcaatggtaccgagccataaggaaagaatctgagagccggagagaatcccgtagatcataatacatgtcaatgcagatacgatgtcgccaaaaaaaaaaaaaaaaaaggccccta

SEQ ID NO: 20201 - DNA, 356 bp, Sorghum bicolor
  Clone ID: LIB5051-001-Q1-XP2-H10
gccggccgggcctgccgattattattaggggattccaatcccaaccaaggggaagaaaggaaaggataggcaaagatggcggcttctgattctgatgacctgataaaggaggcgttgctgcaggtaagggtgcgcgatgaggatggcgcgctggtggacgcgctgaaccgacgagctgctgctgctaccgccgcgcggggggagcccagccccagccccagcttcttcgaggggttcgctctgcaggggatccgcgtcgagagcatcctcccgggccacatcctctgctccttcacggtccccgcacgcctcaccgccggcgacaatcacatagcccccggcgccgtggtggccct

SEQ ID NO: 20202 - DNA, 612 bp, Sorghum bicolor
  Clone ID: LIB5051-001-Q1-XP2-H11
ctgtgcggcgctcgaggcggccgggtccggaccaccgacgacaccgacgaaccgcccaacaccgcaaaaatggttgccgcaaagaagcatgtcccgatcgtcaagaagcgcactgcgcagttcaagcgtcaccagagtgaccgcttcgaccgcgttggcgagagctggaggaagcccaagggtatcgacaactgcgtgaggaggcgcttcaagggccaggctgttatgcccaagatcggctacggttccaacaagaagacccgccacatgatgccctccggccacaaggctttcctcgtcaacaacacccgtgacctcgacctcctcctcatgcacaacaagacctacgccgccgagattgcccacgccgtctctgccaagaacagaatctccatcgttgcccgcgccaaggagctcggtgtcaaggtcaccaacggcaaggccaagctctccactgaggcataagcgtgaagcgtgtgttatttgcggtaggcgaacggctgggaatgaaatttgggcgtttgcatcggctttagacgagtgtgcaatgccagcacctagctagccgaaatgaaagaggccgaacaaaaaaaaaaaaaaaaaaggccccta

SEQ ID NO: 20203 - DNA, 594 bp, Sorghum bicolor
  Clone ID: LIB5051-001-Q1-XP2-H5
gccggccaggctgcgagactcgcggtttcttccccaactacaatctcctcaatctactccagatcattcacacgcacagcaatcaacatgggtgttaccaagaagctgatctcccccggcaacggcaccgacaagcccaaggctggtgacaagatcaccatggagtacactggcaacctctacgaccagaacgctcccgacggcaagggcaagcagttcgacagcagcgtcggccgcggcgacttcaacaccaacatcggtgttggtcagctcatcaagggctgggacgagggcatcatcgagaccgatggtggcatgtctctcggcgagaaggccactcttctcatcaccggcgactacgcctacggtgaccgtggcttccctggcctcatccccccgaacgctaccctcatcttcgacgtccagctcaaggccatcaacggcaagaagatgtaaaatctgtatcacaaagtcggacatgtagcacgactacgggaaatacgaaaaaattaagggaataggcggcttgttttgacatagctccgcaatgaacaaaaatatcctgcacaaaaaaaaaaaaaaaaaaggccccta

SEQ ID NO: 20204 - DNA, 874 bp, Sorghum bicolor
  unsure (1)..(874): unsure at all n locations
  Clone ID: LIB5051-001-Q1-XP2-H8
gccggccgggctgcggaacaatccagatacccattacaccttgacgttcaacgaactttacgactcttacaccaacaacacacttttcctcaccaaacaccaacacacatctatcacaatgtctgccgcataccagggtcaggaccttaacgacatcgccaagcaggctgagcgcgacctcaactcccagggcgccaagcaggagcaccgcgttgacgacaccgcccgtggcgccgccggcgcttccgactccactatcgagtccggcgtcgaccaatccgtcgagtccaagttccccggcgccgaagtcaagattggcggccagggcgccagcgacaaccgccagatccccgtctccgagggcggcgacatcaaccccaccaccggcaagcagaccaaggccggcgacttccagggcgtcggtggacccgaggacaaggctgccatcgacgctgaggtccgtggcggcgacaacgacatccgctccaacatccgccagggcggcgagaccgtccgtcccgctggctcgatccctcagaacgctgctggcggtcagggaaagagcactcagtagagtcttcattttgacttgattgagtgatctcttcgcttccttttctttttttgttctttgatactcatggttgagatacctggttacgatggcacggcctttcttgagacatagaaggccgatacgacgactgggatacatgccttctgcttgcatgngtgcgagctttgggctttgcaaaagttcgttggcatggatggtgatgatgcgaatatttatcatcgcttgagtcgagatatgtaaaatcagtaacgatgtaatgtcacgctcaagaccaaaaaaaaaaaaaaaaaggcccct

SEQ ID NO: 20205 - DNA, 746 bp, Sorghum bicolor
  Clone ID: LIB5050-004-R1-XP1-C4
ccgggatcctgaacacccaggtcaccaaaccctcgctcctccgccgccggggccggggcgccaaatccggccccgcagcatggccgcacggcagccgccggcgctggtggacgagctcgtggaggagattctcctccacgtcccaccggacgaccccgtgcggctcatgcgcaccgccgtcgcgtgcaagccctggcgccgcctcgtctgcggaccgggcttccgccgcaggttccgcgagcaccacgggtcgccccccttgctgggcatcgtctcgaactgcatgaacgaagacggcgcaaagctcgctcgcttcgtccccaccggctcattccggccgcgccgcgccgagctcatcaactggctggcgatcgactcccgccacggccgcgtccttctacgcagctcgttttctagtgaccacttcaatgtcgcagtctgggatcccatcacggacgagctgctggaactgcccgcgacgccatggatgccgcagatcatgcacaattacaaaggagcggtgctctgcgctggcgaaggctgtgaccacctggactgccacggcaaacccttcctcgtggtctttgtgggcgcggcctctcaatgtagtaagatgtccttgtccctccatgatccaaaacttatgatgtcgtcctatgtctactcatcagaagctaatgcgtgggagtggatcagctcatcatgggtacttaggtaatcttttgcagtcggtatgcagcactctt

SEQ ID NO: 20206 - DNA, 520 bp, Sorghum bicolor
  Clone ID: LIB5050-004-R1-XP1-A10
ccgggataatatatattacgcctagaatccatcccctgcggccatttcttctgaaagctgaagagggtccgctcctcaaaatttttgcggctctcctcctgctcctctgtgggtatgtactgatacgaagctggggacggccgactatggcactggcgaggaagagggagtcgcctagccaccgcttccaaggaccctgatccagagaagcaaactgcgcaaccggttgccggagtgaacggtttaccgcgtggcaagtgccaaggcctaccccaccgctgcttctgtacctaggactgataactgcctcgcgggctgctcctgcatgcatatgcctgcatgtcctgaacgcatcaggagaatatgtatgcattaccatatgggagtagtacatgtatgacctaaataatggaacgccgctgatttgtaccgtgaagagttgagagcatcttctctcttatgcacgagggctgagagctcaacagaaaatcaataaaaagccccctacggacggcggccg

SEQ ID NO: 20207 - DNA, 240 bp, Sorghum bicolor
  Clone ID: LIB5050-003-R1-XP1-H11
cctcgatcaccaaatcctcttccgcctctcctcgattaacaaatccccgcagccactccagatgctcatgacacataggctcgaacttgccggtgatcgcgcgaacgccgcgacggcgtctatacgacatgcacggacgagcggcagtaccgtgccgccacggatgcgcgcacgcagcatctacatgcaagcgaggttcacccaggacgcgccgatgaacttgccgagacgcgtgtgcac

SEQ ID NO: 20208 - DNA, 325 bp, Sorghum bicolor
  Clone ID: LIB5050-003-R1-XP1-G4
ccgggacccccatccgcgacgccaccgccgctccgaaaagggggccctcgtagcgcggcggcgaggccggccggcgtttggaggagctccgaagatgtggtgccactcgtgcaaggaagggtacgacgaggaggatgccgggacctgcaaggagtgctacgacgaggccagcgagacggaggaggagctcaagcgcgagatcgaggagctccgctcccgcctccacttcctccgcctcccgtcccccaccctcgacgccgcatccgcccccaactgcgacctcctcctccacgccatcccctcctgcccctcctcctccggcgcg

SEQ ID NO: 20209 - DNA, 660 bp, Sorghum bicolor
  Clone ID: LIB5050-003-R1-XP1-D1
ccgggacctcttgccccctcgaatgctatctccaacgagaggccagctctacgaccgcatccccgcctccccttcttcgccggcgacacgagaacctcaccgcaaacttctggcgtggcggaccccatcaccaacgacccataatcccggagtccacggaggccttactacctcttccacatggatgaagacggatgcatcaccgccaatgatgttgaagctgtgattggctcccttgaccagaaccctaccgtcgcagaactgcaggacatgtagcaatgatgctcatgctgatggtaatgcgaccattgactccccagagttcgtgaatcctgacgtgcaaggcaaaatgaaggaccctacgtctgatgaggaactacaccgaggtcttccgcgtatttgaccaggaccaaaatgcgttcaactcgcgtcgttgagctccgccatgctgtgaccatgctcattaataatatgaccgacgaggaggtctacgagatgatccgggaggctgatcccgatgtgcgactggcacatcaactatgaagagcccgtccctgctaagatgatacatgcgaggagcatatccccatgaaataaatatatcgaccaactgaagcgagatatcatgctctatagctgtactttgacatgtccctttga

SEQ ID NO: 20210 - DNA, 517 bp, Sorghum bicolor
  unsure (1)..(517): unsure at all n locations
  Clone ID: LIB5050-003-R1-XP1-D4
gcacgggcccgggaaaaaaannnnnnaaaaaaaaaaaaaaaaaaaaaaaaaaaaaaaaaaaaaaaaaaaaaactagggcccatcaagaccgactgccgctctatgactccccccgtcccccaaaaatgaggatatccccgcttttgtagatattaataattctggaggtgggggggggcccccttcacgatggggcccgatagcaaattcttccactactcgggcggtgttattccactttccttgctggtggatgtaaaaagtctgccaatttaaaaacaatgggggagatcaccccattcccctttctgcagatgatcgctaaggccaacaggcggataacctattgaccacctcaacaattgtggattcgtaaagggagagtggaaagngtaaagattgataatattttcgaataatatttttttaaaagccaccttttttttttttttaaacacgcaatccttttttcccctagtccgttatagtcaaaaaccctttttagttataggattaa

SEQ ID NO: 20211 - DNA, 441 bp, Sorghum bicolor
  Clone ID: LIB5050-003-R1-XP1-B7
ccggggcaccaccagcccacacagcatctcaaatataaccttcatatattcactcgcagagagcggagagagatatatatatagcaggcaaggcatggcgaaggcggtggcgatgctgatggcccttgcggtggtagtggcggtgagctcaggcggggcatcagcggactgcaacatcgcagcgctagcgagctgcaatgcggcggtcatccaaggggcgaaacccacggcgatgtgctgctccagcctacgagcgcaggagccatgcttgtgcacataccagaacaacccaaagtacggcaaataccacccaaatgcccggaaaatggtcacctcctgcggcatggccatccccaactgctaggctacctcttgtgtgcatgtaacatatattatatatacatataaataaatcatcaatttattgaagatgcatttagc

SEQ ID NO: 20212 - DNA, 764 bp, Sorghum bicolor
  unsure (1)..(764): unsure at all n locations
  Clone ID: LIB5050-003-R1-XP1-C2
ccgggaccggcacacgcaccgcagcaccgtggatgcatgaggcaatcagccaaataacttacaagcactccaaattcccaagcaaagctcgttcacaagctgccagcccgtcccgtcgatatggcggtcaacaacaacgctgctgcgccggtgacgccggcgacgagggcgtacgtgacggtcctggcgaacgacgacggcgccgatgacaacttcaagggcgtggtggggctggcaaagggccttcgcaacgccggctcggcctacccgctggtggtcgccgtcctccccgacgtgccggagtcccgccgccgcgtcctcatggatgagctgggctgcgtcgtccgcgaggtccagcccgtgttcccgccccactacaacaagctccgcgtctgggagttcgtggagtacgatcagatgatgtacctggacgcggtgggttttcaagggtcgttggagaacatccacgagcagttcgagcccaacggcggccggccgcgggcgccctacatcgacgccgacatgttcgtgtacaaaccaagcatggccaccgccaggctcctccgccacgcgatctccatgatgatgaggccgcgcaccaccaccacctccgatgaagtcatggtgtggccgtgcatctccatcgccgatcacgtgatgacgaggaggccgcgcaccaccgtcgccgaagccgaagacggcgccatgatgaggaggncgcgcaccaccaccaccgncgatcatcagcagggggcggccagcag

SEQ ID NO: 20213 - DNA, 470 bp, Sorghum bicolor
  Clone ID: LIB5050-003-R1-XP1-A10
cctggcctcacaacttcccctggttgtcccatacggatcacaaagaaccttcgtgtttgcggtgattgtcacagtgcattcatctacatctccaagattgtggaccatgagatcattgtacgagattccagtcgcttccatcatttcaagaatggctcttgttcctgcggtggctattggtgatatcttgtcctgtgaaagcagcaggtgcagaagaaatactaatgtttcccgagagaaagaaatactaatgtggtcatgaattttctcagtaggactaatttgttcatgactttattacaatgattcacacagaattctggttaccattattttttctcactttggttttagttcttctgtcacatctcacatgcacctgcaatggtgtctatgttgtttgcctctttattcatgacttatgtattatgttgtttgcacctacacagtatgctggtgtttgttctccg

SEQ ID NO: 20214 - DNA, 371 bp, Sorghum bicolor
  Clone ID: LIB5050-003-R1-XP1-A12
cctcgcccgacgcgggcgactacgacatgtcctacccgtcttcgctgccgtccacgccgctgctgacggcgttgcccaccccgacgctgctgcggcctcacgagctgctgctcaccggcctgggcggcttccagtgagctgctgcgtctgcgtcgtgtgcgtggctggcgctggcagttgggcgaatccgatccgtggcaaggcaaaccgcgtcctcgatgtcatgtgcatgtgcggcccaccccgcccggtcggtcagacgggtgaccgccgccaaacctgctcgatcttcggtcgtgtctccgttggtgaaaggcgaaaccaacggcagaggagagcgctctggtttttacagctagcggctcccaagc

SEQ ID NO: 20215 - DNA, 690 bp, Sorghum bicolor
  Clone ID: LIB5050-002-R1-XP1-G7
ccgggataacaggaacatctcacactacattcgtcacttgtgctctgcagtcttacttctgagattagccactgtgaaaattaatgactggagtactactattagggcaacaaaaacaatagggcgactatgttggcggtaatgatctccggaggacgggctggcggcgctggtgctggacgccgtcgtgctgtgctctgtggctgccatgaatccgaagcaacaagcgtcgaacgtgcctacgacctaccactactacaaccctaatgaaaacaactggaacctcaacgccgacatcgcctactgctccacctgcgaccccgacaagccgctggcgagccgatacaaccactactgaacggccttctgcgcgcccgctgggcataaggttcaagccgcctgactgaatgcactccgggtgaccaacctcgcgacggcttgcggccatcacccctattatcgtgtaccagtgcagcaatgacggcctcgacctctactactagacgaagttcaagaagatcgacaccaacgtgcaaatataccacatgagacacctcaacgacaactaccaaatcgtctgctgctgattgacgatcactttcatcacccactccatcatcaagtactactgtacacatgtaataacaagccatgatatatatgatgcatgcatcacgtgatcaatgaata

SEQ ID NO: 20216 - DNA, 500 bp, Sorghum bicolor
  Clone ID: LIB5050-002-R1-XP1-G5
ccgggaggttcatttctctcctgtcctgccccttcaccctcttcagacccagcagagaccagggacgaagggcgtggacggcgccggtgcgcgtgctcgcccgtggcagagcgcgccgccgtcgagcggccgtgcgactggcgccctaagtcccgccgcgcgcaacgcccgtctccggcgagctcgggctcggacgggctgagttgtcccgtcggcggcgggctaagaaagtcgacaagatatgagataatggtgacttgctttcgtgtggattgagtagtatgaactcaaaggggcaacatttccatctgagtatgtcctagacatgatccttttaaatctggttttgctttgaaatgaatgcaaaaggagcagtaaagtcaaagtatgatatgagtatgactggcatgttcagcatcctttccccataccaggcgaatgggcaaactattaataattagtaaattcaatcaattgagcactttgaggttgtgctcatc

SEQ ID NO: 20217 - DNA, 616 bp, Sorghum bicolor
  Clone ID: LIB5050-002-R1-XP1-F3
ccgggctgtccggcccctgctgaagtgctgcgtgctctccctccctgctcttctggttatctggtaacactatgaaggtcaagattcttcagtggtatgcagtggcttcttggacgtgggatgcacaggatgagacatgtggcatatgcaggatggcttttgatggctgttgccctgactgtaagttccctggtgacgattgcccgctcatttggggtgcctgcaaccatgcttatcatcttcattgcatactgaagtgggtcaattctcaaacatccacacccctttgccccatgtgccgtagagagtggcagtttaagggctaaggtattatgggcatctagaactatatcagcgccaagcgactctcagttctcctcagagaagactattgattttctggtcctgcttatgtgatcctgtgtatgcttcttagcttgtgatggaacaaatgaaatgattgcttttcttagggttgacttcctgatcttatcccaaattggtttgttcttattgtttaccttctgaaggattacaaaaagtctagtatcagagctaggcaattgattgaattctgtatgggactgttactgcttataagcatcccacattgcac

SEQ ID NO: 20218 - DNA, 795 bp, Sorghum bicolor
  unsure (1)..(795): unsure at all n locations
  Clone ID: LIB5050-002-R1-XP1-D3
ccgggataattgattagattatttttcgaatcctcccggtttttgaaaaccaaagcacctcagattcaaacacaactttagatcatagatgtggccgtcagatcggatgcctcctgcttgccgatccaatcacatcacgcacacgcttccggcgaatccagcacggaacaaattgcccctcacccaccttgactcgccgccgccgtcgcaaaccacccacccgatccccaaatcgccccccacccgccttgactcgccgccgcggtcgtaaatcccgcacccgatcctcaaattctccggtggtgatggcagccagcctgtggcgcgccgtgatggacagcgtcagcggctcctcctcctccccctcggcgctggacgcgcctccgggcggcggcgtcgagttctggcacggtgcggagcgcgcgggttggctaaacaagcaaggcgagtacatcaagacgtggaggcggcggtggttcgtgctcaagcaggggaggctcttctggttcaaggaccctggtggtgacgcgggcctcggtgccccgcggcgtcatccccgtcgcctcctgcctcacagtcaagggcgcccgaggacgtgctcaaccgccagttcgccttcgagctctccacgcctgccgagaccatgtacttcatcgcggactccngagaggagaaggaggagtggattaactccatcggtcgctccatcgtccagcactcccggtccgtcaccgacgcagaggtcgtcgactacgacagccgcccccagnccccgncgcagcctaaggctagcga

SEQ ID NO: 20219 - DNA, 528 bp, Sorghum bicolor
  Clone ID: LIB5050-002-R1-XP1-C1
ccgggatttcctgctttcccagtcgcagctatcgtcggaacagcggccgccccctgcccttcccaaggaaaccccagcccccccgcggcgcaaaaaccctagaggcggcgcgggatgctgcttgggttccggtgatggaggaagaaggcggcggcggcgccagtggcagcgaggaggtggtgaacctggaggacgcggtggagcagctggtggagcacctcgtggtgccggtgctgccgcgcggccaggtcaaccaggaggaggccctgtcgcctgagactcaggaggacgtggcgcgtcaggtccacgcgacggttatcctgtacaactactaccaccggaagcagttcccacagctcgaatttgccagccctgatcggttctgcatgtccgcctgcctcaccgtcagcaacaaaaatctgctcatgtacgtgaaccaggcccagagccgcctttctaatggagtaggggtggggctctcggttactgacaaggcaatcattgacgcctgtgacattgccgaggcgc

SEQ ID NO: 20220 - DNA, 427 bp, Sorghum bicolor
  Clone ID: LIB5050-002-R1-XP1-B1
tccggatcagccaccggatcacccccggcttaggcttatgtgtactcctctctcccgccgccacctcgccagagctcgccaaaatgtctgcccacagggtccattagcagcaggtggtggctcgcgcgctgacaacctccgctgatgaccaccccactatctaccggatgaagctgtgggctaccaacgaggctagctccaaatccaaattctgctactttttcaggaagatcaccaaggccaagaagagcaacgtaaaggtcttcgatatcaacgagatattctgagcgtaaccctaccacaatccagaaccatggcatctggctcccataccagagcaagaccggttaccatcaacatgtacaaggagtacggggataccacccttcatgctgctgcggagcagatgtacaatgagatggcttcc

SEQ ID NO: 20221 - DNA, 752 bp, Sorghum bicolor
  Clone ID: LIB5050-001-R1-XP1-H6
ccggggcagcattctgcatcccaccgcacgcacggtgctcgtcctcaacatttcattcctcatctctctctctctcttccccctggtgacggcgaccgcgagctcctccccggtgacctcctcacgcctgcgccccaccgcctctccatgcccgcgccgagctcgttgccgcccccatccgcgccggccatggcggatccatcgaacattggggactgctgccccaaccctacgccaagtgttcatcgatcccttggccgttcgtcggcgacgagcacccaccagatctgtgtcatatttgcagtggcggcaagccgaccaaccatggtggccaagaggttggggcggcatggatctgctccccctaggtgctgggggttggcccaggtggtggccagccggaccatccagcccgtggtggccggcctacctcacggccgcaatcgaaggcgccacggcggtagcggaggaggtgggctctcgatcgttgacatggaggagcgcatggatgtcagaatcctcgctgtggacatctagttccctcccacatgtgtccagtaggtgacaaggggaagcttgagattccatttctcaagtagtagggaagcacagattgggaggtgctgactaatgcagattgctgagggtgtatcctagaatctgtggagcccctctggttgtgcagcctctccagtggcggtgcccccctcctcttccttacaccagatgcgggctcgagcttgtttttcaac

SEQ ID NO: 20222 - DNA, 659 bp, Sorghum bicolor
  Clone ID: LIB5050-001-R1-XP1-G9
aggccgggttatccctactagctcgctgccagtggcagtaataaccaggtctcgatcggataatccgatctgtaacctagcgcctgacagattagatagatagatcagctagccatgaatatgatcaggtcggtacggcgccggttcaccgtcggccaccacatggccacggccacggaccctgccacgctccgccgcgccgcagccgagctcctcgccaccgccatcttcgtcttcgccgctgagggcgccacgctctccctcgggagaatgcaccgccatgacaagggcggcggcgtcgtgggcggtctggtggtggcggcgctcgcgcacgctctcgcgctcgccgccgccgtggcgtgcgccgccaacacctccggcggtcacgtcaacccggccgtcaccttcggcgcgctgctcgccggccggatctgcctcgtccgctccctcgtctactgggccgcgcagctgctcggcgccgtcgccgccgcgctcgtcctcaggctcgccaccggagggatgcatctgccggagtacgcgctggcgggctgcgtgagcgggtggcaagcggcggtgctggaggcggcgatggcgttcgggctcatgcacgcctacttcgtcacggtcatggaccaccacacgcggaaggtccgcgccgg

SEQ ID NO: 20223 - DNA, 653 bp, Sorghum bicolor
  Clone ID: LIB5050-001-R1-XP1-D4
ccggaggtaacaggattcacaggagactcggagatcgtgtcgagacactcgactcagtggggaagcccaacaaaccccgcagcagccggcgcaggcaaagatggcggacgtgagcggcagcggcttcgggggccggcgaccgccggggctgctggcgaacgcggcgaagcgcaaggacgggttcgtgcagctcttcctgatggcgggcgtcttcatgatgagcctgcggtctctgggccagaagcaccgcctccgcgacctcgacgacgacaccgccgacctccgccgcgagcacgaggacctctctctccgcgcgcgatgcctccaggacgcgctccgcagggaggctgacgccgactcgtccggcgccatcgcgtcccacctccgccgcatcttcgccgctcaccctgcgcccgccgccggcggtggcggcgaggaccagtagctggctaacccttttcttctccgcgttcttgttctacgatacgtatatctagtgactagcggtgagactattgctgctgcctcaagatccatggcagcgcacgccatgtgtttggggaaatgccgcaatgcagctaccttgagatgtatcgttgactgagacctcaaacttcttcgcgtttcggatggatcaatccatgatcctttta

SEQ ID NO: 20224 - DNA, 510 bp, Sorghum bicolor
  Clone ID: LIB5050-001-R1-XP1-D1
ccggcatatgtacacagctcatagacaccggttcctatagacaagtaagtttgtatagattgactgagtaatccagcgtaggtgagctccatcatggatatgaccagtgaccagaagaaatcatgttcttttgaggaaactcagaagaaaacatgttggcctgagtttgtaggcctgtccatcacacaggcagtcccaagcattctaaaagacatgcctaacgccgaaattgaagtgctggctcttggctcgcctatgactcatgacttccgccccaaccgtgtccgcatcttcgttgataccgttgctcagaccccgatggttggctgatacagttagcctctacctgctggatctaccaaataaagaagccccatttcatttcctagttaataaatccagtctttcttggttgttcttgaagatcagggatctagatatacaacccatgtatggctgtccttaataatcttgatggaataataaataaacaatgattcaggtgcatac

SEQ ID NO: 20225 - DNA, 614 bp, Sorghum bicolor
  Clone ID: LIB5050-001-R1-XP1-A6
ccgggcgatcctcgagagcctgtggcacggcgtgccgctggtgccgtggccgctgttcgcggagcagcacctgaacgcgttcgagctcgtgtccgtgatgggcgtcgccgtggccatgaaagtggacaggaagcgcggcaacttggtcgaggcggcggagctggagcgcgtggtccggagcctgatgggtgggtcggaggaggaggggaggaaagcgcgagagaaagccacggaggccaaggacctttgccggaaagccgtggccgacggcgggtcctcggcggcgtcgctgcaagaacttgcgcgtgagattggagagcacagagaacaccaaggaagaacggaagcaacgccgccgcttcctcaacaagttcgctacgccgctgccacccttggagctgcacgccatgggtgacctccgatcctgaatggtcgatgatgcagaccatgtggctcttgactgtcaccaggtttcaacatgtcgtcaatctaggtaatgttagtcgagagtggttccagataaaaggggagtcgtagggtggttctttagtaggaggcatttggctgagagaggtgtgtaaccgggcattcagcgttcaaagtaaaatcggttc

SEQ ID NO: 20226 - DNA, 540 bp, Sorghum bicolor
  Clone ID: LIB5050-001-R1-XP1-A8
tcgggaaatctagctagccccaaaggctggaccaagaagaatccagtagcggtagacagtacagtggtgacgccaagaatggcgtgctgcaccagccgtcgtcccgtcctcgtcgtcctctcggccaccgccgtcctgctcgccgtcgtcttcttcggcgcggccacgacgaccgccgcctccgccgcggcggcgagcgccgccccgagctactgcgcggtggggaaggcgatccccggctgcgtgtggtacgtggcgagccggagctgcgacgtggtggccgccatgctcccgaaccgggcctccctcagggcgacgtgctgcggccagctgcaccccgcggagtgccggtgccgggcgctgcgggtgatgatggagacgacgccgctcgtcgtgggcgcggacccgggcgcccagcggaggtgccgcgccgcgcaggcccgcttcgcccccgccgtggtcgccgccggcgagtgcagcctgcgaaccgtccacggaagacccgtctgcaatgcgctcgacgccgagtaatggtgatgc

SEQ ID NO: 20227 - DNA, 566 bp, Sorghum bicolor
  Clone ID: LIB5048-012-R1-XP1-H11
ttccgagtcaaaatgagcaacttaatattaaatctttttttcttccttatgccagtggccagtgcaccaccctacctccacaattgcgtcgcacctgccaccggctggtgaacttcatgcctaccttgaaacgatacccgtcttatgagtatggactctgagacattcagagcctgtttggtttaaggccatacttcgccacgcattcctgtggcgagccgaagttgcggcgaccaaatcgaccgcctaagttgtggcgagttttttctgcatcattcaggtgaaaaagtggtggcgagcctaaagcttttaatgaaccaaacacatgcgtcagaactgtggctgcctaatcttagttgtggcgcacaacggcggccaacccaacgtcccctcaatcataccaaggcataataccaattatctggaaaggggtgttggaagagtactttggactgtgacatatttaaataagcatacataattctcatatttcgaaatttccagcttctcaatatcgacaagtaagtctctagttctacacaaacactacgatttctagcctccgt

SEQ ID NO: 20228 - DNA, 600 bp, Sorghum bicolor
  Clone ID: LIB5048-012-R1-XP1-G9
tccgggaactttttgttacctcactctgattcatactttcgtcgctagcgcaccatgtccacccagccgctcctgcaacgaacagccaagaagaggatcgctcttcccgtgcgggtcgagcccaaggtcttcttcgcgaacgagcgtaccttcctctcatggctccacttcgccgtcgtcctcggcggtcttgccgtcggacttctcaacttcggtgacaaggtcggcaagatctccgcggccatgtacaccatcattgctatggcggtcatgatctatgctctgacgatatatcagctccgagcccggtcgatccgcttgcgaactggcgcgccgtacgacgaccgtcttggccctaccgtcttatgtctctgtctccttgccgctatcatcaccaacttcatcctcaaggccgtttacgagtaggagctcgacggcatcgctcatcgtgagcgtccggacggctgaacatagcctggcgcgagtccggctcgaagaacaccgtgccctcccttcacctttacacagatataaattttaccatccgtcccatgtcggcacgactcgacatgggatgtctgtatgcatggcattgtggtg

SEQ ID NO: 20229 - DNA, 777 bp, Sorghum bicolor
  Clone ID: LIB5048-012-R1-XP1-H10
ctgcagaacacggttaactctacaatcatgtctttcggaaagctctacagttactcgggtaacccgcgtaccacctctctcctggccgtcgcgaaggagaatggtctcgacatcgagttcgtcgacaccgagcctgccaagggtgtctctgaggactacctgaagctcaacaagctcggcaaggtccctacattcgagggcgctgacggctttgtcctctctgagtgcatcgccatcgctgtctaccttgcctcccagaacgagaagaccagccttctcggcaagaccaagcaggactacgccaccatcttgcgatggatgtccttcgccaacactgaggtcctctctcctctcggtggctggttccgccccatcctcggccgcgacccttacaacaagaagaacgtcgacgagtcacagaaggccactctcaaggctgtccacgtcattgaggagcaccttcttacacacacctaccttgttggtgagcgtctgactcttgccgacatcttcgctgccagcatccttgcccgtggcttccagtacttcttcggcaagcagtggcgcgactccaaccccaacactacccgttggtacgagaccgtcttcaaccagtccagctactctgctgttgcccccaagcttgagttcatctccgaggcgttgaagaacgttgcacccaagaaggagggtggcgagaagaagaaggagcagcccaaggccgcccctaagcccaagcaagaggaggctgaggaggaggaggccccccctgccccc

SEQ ID NO: 20230 - DNA, 576 bp, Sorghum bicolor
  Clone ID: LIB5048-012-R1-XP1-E8
tcgggatccctcaagtttcggtaacactcgtcaaaaatgtccaagaaagccgctgccaccggtaccaagttccgaatgaccctcggtctccccgtcggagcggtcatgaactgcgcggacaactctggagccaagaacctctacgttatctccgtcatcggcttcggagcccgactcaaccgactccccgccgccgccgccggcgacatggtcatggcctcggtcaagaagggaaagcccgagctgaggaagaaggtcatgcccgccgtcatctgccgacaacgcaagccgtggcgaaggagggacggcatgttcctctacttcgaggacaacgccggtgtcatcgtcaaccccaagggtgagatgaagggatccgccatcaacggaccggtcgccaaggagtgcgccgacctgtggccccgtatagcctccaacgcgggaaccgtcgtctaagcaaattcgcaatctcgaactttacgacacggtatccgggtggaaaaggagacgagcagacagggagacgtctgcccagctggggctgatatgagctgtactttcatgcacggtctgcttatg

SEQ ID NO: 20231 - DNA, 677 bp, Sorghum bicolor
  unsure (1)..(677): unsure at all n locations
  Clone ID: LIB5048-012-R1-XP1-E3
ttcggggtgtgctgctgcctngatcggatgttacacgagacgaggcccccctctgcctaattaaggtactgattacccctaccaatgcgtctcggcggtatctaggactcactggcttccgtcctacgatgccgcagctgcatgccatccggcttatgaagacgcatgctccgacgccattcttccgtctgcacgtcatggattgcgacggcagcagagccagacaagctgtgggagaagcgccgacatggtggtcgtgaacatcgccttgctgaccactctgcacagggacgcggcttgcgacagcggcaccgaaacccgcatgagcatgacctctggggagatccccaccagacgccaatgcggaatacgagaagattgtacagcagacgtggacttagatgtggcatctcgacaagtgatgttacggttctggctgccaactgcccagggcttgggaacattgagcagctgcctactgagattggagatcgggcgcgccaccgcatcaccaattcccgccagtagatgggagctcaccgccagcgacacatgcgtggctgagccactggtaacacaatctaggctcatgtgactgccaccgtggcttgctaccagggttgcggcaaaactcatccaggcccccaagaatgccacctgcgcctggctcacgcctg

SEQ ID NO: 20232 - DNA, 828 bp, Sorghum bicolor
  unsure (1)..(828): unsure at all n locations
  Clone ID: LIB5048-012-R1-XP1-C2
tcgggggacttctctctctctctccgcctacaaggaccgatgccgagggccacggagcgcgcaatgttaggttgcttccctgtcgccggccggcggccgtccttgtcgtacgaggagggctccacgtcggcggcgtcgacgtcggtgagcacggcctcgccgccgacgtccacggcgtccacgtcgtccccggccttcctcgacgacgacgcgctctaccccgacgacgccgagcccgagccggacgcttgtgggctgtccaccgcaatcgccgcccgccgcttcttcctcgcgacgcccggcctctccaactccatcgtcgactccgtcgagcacccggcggcagcctcccacgcgtccaacgtccgcgcgctgcggcgcgcggccaccgccgcgttccccgcgtctgccgccgctgcctcctcctcctcctccgcttcctcttcctcctcggcgtccggcaccaaaccacacttgcatgacgacggcggcatgcagccggtgcggaaggtctcggtgtccacggacgcgccccgggccgacttcctcaagtccatggtggagatggtggaggcgctggagctggacccgcgccgccgcgacgccgacctggnccgcctgcacgatctgctgctctgctacatcgcgctcaacgagcgcgacgcactcagggacatcctcggcgcgttcgcggacctcatgtgcctcctcgacgtcacgaccgctgccgtcgtcgatggcggngagaagcgcaacgccgacgatcgagcaggcgggagcgggtagatagacacagcgcgcgcggcgcgttcgcacgcgacggcgtcg

SEQ ID NO: 20233 - DNA, 612 bp, Sorghum bicolor
  Clone ID: LIB5048-012-R1-XP1-C10
tcgggttcgtcgagaagttctccgtgacgtcgtcttatacaccgagcacgcccgccgcaagaccgtctccgccatggacgtcgtctacgcgctcaagcgtcagggccacaccctctactgcttcggtggataggctgatggttttggctcccccttctgcggctgcgacgttgactgggcgtgcccacaagtcttgcggtcaagaaagtctcaggaactcttggtagttcatctctggatggagaaagtttatctgaattgtaaaactgcaacaggcatgaagcaataatgaaattatgtgtgtctaatgtgcaaataaacaaaaaaaaaggcactccgagggcgcagccagcacatgaactacggaagcctcggctctcgagtatacgacgtcgacgctaacctcaacacgcaacccaagaggggggccagcaaccaattcatgcaataagtcgtcaagttactcgactctactggccccaccgtttaacctacagaagatgtgcgagaccatggacaacttcaagtgacaggtcttggacatgtacccccttccgcagttcgtggaagaagccatgaacgcctccacatccctcttcacgaccgataccg

SEQ ID NO: 20234 - DNA, 725 bp, Sorghum bicolor
  Clone ID: LIB5048-012-R1-XP1-A7
ccgggacgcctagaatagcctcctcctgtgtctcgaaccaaccgcatcgtaccccgtctccttccccctatgatcctacatccccgactacatgcggactaaggccgagaagaaatcagagaacaagaacgcggtcgccatggatgaagttctgaacgcggccgctcgtgaataaccccaaggcctgctacttcctggccggctccaagtcctcctatatgagtgctggtcatataatatatataaactaggtcactaaatagcgtggaagaccttactcatctacgtcttcgaggggctgaaataggtgcaccccaatattctcacatcgtcctccatggtcttgtccgtcatgaactccttcatcaatgacctcttcaatatattcgacgtataggccgtcaagatcgctgcgtgacaagaagaagcccaccgtcacctcccgtgagatccagacgctccgtgtatctcatactccccggaaagctcttcattgacgccgtctccgagggaacccccgtcgtcaccaagttcatcaacaactgagcgacctgcagggttcacggatttgatatgcctccctttctaagagggctcttcgatgtgtgctctcctcctccctctccctatgtatgggctcagatatcgctgatgctctgctcgtcaacaaagactaataggtatgttccctgctttataaatcgcgactgattggaatggctctc

SEQ ID NO: 20235 - DNA, 816 bp, Sorghum bicolor
  Clone ID: LIB5048-012-R1-XP1-A4
ttcgggcatccaccaaacactcctccgacacaagccacacaccacctcccgacccactcttcaccaccaccaccctacatccactacaacttcttcacatactgccaaaatggacgccatcaagcagcgcatgaacgctctcagggctgaggccgacgagtccgccgccaaggtcgaggagctttccgcaaaggtcaggaccctcgagcaggagaacctccagaaggagcaggagatcacttccctgcagcacaagaacggtgtcctcgagcaggaggtcgagaagcttgagggcctccacaaggacgcaaaggctgccgtcgacgagagcgcacagcacggcacccagaacgagtcgctgcagaggaggctccagcttcttgaggaggaggccgaggagaacgacaagaacctgagggagaccaacgagaagctccgccagaccgacgtcaaggccggccactacgagcgcaaggtccaggctctcgagcagtccgccgaccagtgggagaagaagtacgaggatatggccaagaagtatagcgacaccaagaaggagctcgacgacttcgttgcggagattggtaacatctgagcgacatccatcatcaagcccacccgtcatcaaacgcgcactttcacatggcatccaagtgtgctgaccttgcgtgcctcctgttagccttctacaatccgaaaggagcgcagcacgcgacgaccaagcctgtcgcccaccagaagggcacaggcaaaagtttcttgtgaaacgcgtccggacgggtcgtgggctattggtacattcacttgctatggcat

SEQ ID NO: 20236 - DNA, 742 bp, Sorghum bicolor
  Clone ID: LIB5048-011-R1-XP1-G8
ccgggattcaactcaaacacaatcaaatatcaacactacatctacaaacacccattcctaaaacacttcacatcaaaactccaactacaatcatgaagttcaccaccgccgctgtcatcgcctctgctgctggcctcgccactgctctccctaccgactccaagatcaaggatggcgatgttttcacaatccaaaccatccgctcaggcaccgccgatctacagtacaacactattcaggctgtccagaactctctcgtgatcaacgcaggccaacagaatgcttcctgcggcccggagccccacaactacgcttccttccagctcaacaacggcaccctctacctctacactgccaaccctccccagcagatgttcgttgacaggtcaggcatgggacagggcgtcattcagtacaccactggcgtacaagatatggtcaagaacggagagaggcgaacctttgccatcaacgacgacggtcacctcgtcttcaaggaccagactggtcaggagattggcttccaggcttgcaagccttctcttaatggcggctactccgtctggctggacgacgtgacaaacccggctggagctgatgagtgccttggattcgctgctcgagctatcaaggaggagaaccctgtcaagtgctcgtacaccacctacccgtaagtgcagacactctagttctgtgactggtggatttgagaaatttactttggatatcgagcgacatttct

SEQ ID NO: 20237 - DNA, 614 bp, Sorghum bicolor
  Clone ID: LIB5048-011-R1-XP1-G2
ccgggcttccgagtcgtcatgccagactttttagatggtaacttggccactggagacatgttctctggcaccgaagagggaaacaacaagcgaaatgcctacttctcaagcttccccggagcggccacttctcaaaaggaacagtttggcaaggtcgccgacgagctcaagaaagatggagccaaggttgcggccgctggagcctgttggggatacaaggtcatcgtctctgccgatgctgcactcagcgccatcgccggcttccacccatcgttcatcgcaccagaggatgtcgagaagatcaacgccccacttgccctccttccttccgagggtgaggacaaggatatcatcaacaagatctacgagggtgtcgagaagaagaacccaggaaagaacgtcttaaagtccttcccagactctgttcacggctggatggccgcacgaggtgatctcgaatctgaagagggcagaaagactttctctgagggataccagatcctttccaagttcttccagagcaatctctaaacagatagggctcggctgtgaatatccttagagtacatgcatcttgagttgatacacggaaaaaaaaaaaaaacaaaggcccc

SEQ ID NO: 20238 - DNA, 529 bp, Sorghum bicolor
  Clone ID: LIB5048-011-R1-XP1-E6
ccgggacatccttcaacaggcgtgatgatagttgtctaggtaaaaactagaaaatcatcatgcagatcttcgtcaagagtgaggagaccttcgccctagaggtccaaccctttgattcggttgagacactcaaaggccagatccaggagcgcgaaggcattcctgctgatcagcagaggctgatcttctccggcaagcagttggaggatggacacacccttctagactacgatgttcaaaaggaatccaccctacaccttaccctcaggcttttgggaggtgccaagaagcgcaagaagaagaactactccactcccaagaagatcaagcacaagaagaagaaggtcaagcttgctgtccttaagtattacagggttgatgagaatggaaagatccaccgcctgcgtcgcgagtgcccctctgaccagtgcggcgctggtgtcttcatggctgccatggaggacagacactactgtggcaagtgtggttacacccttgtcttcacaagcctgaggagaaataacctgtt

SEQ ID NO: 20239 - DNA, 725 bp, Sorghum bicolor
  unsure (1)..(725): unsure at all n locations
  Clone ID: LIB5048-011-R1-XP1-D6
ccggggcaaaacacacgacacttccccatggagatcagctggctcgtcctcgcgggcggcctcctgctctcctcgctcctcgtcctgcgccgccacgccaagaaccgccgcctgccgccgggtcccccggccgtgccgctgttcggcaacctgctgtggctgaggaactccgcggcggacgtggagcccctgctgcggaagctcttcaagcggtacggccccgtcgtgacgctccggatgggctcccggctcgccatcttcgtggcggaccgccgcctcgcgcacgccgcgctcgtgggcgccggcgccgtcacgatggcgaaccgtccgcaggccgccacgagctcgctcctgggcgtcagcgacaacatcatcacccgcgccgactacgggcccgtgtggcgcctcctgcgccgcaacctcgtcgccgagacgctgcacccgtcgcgcgtcaggctgttcgcgcccgcgcgcgcctgggtgcgcggcgtcctcatggacaagctgcgggcggaaagtggtgccggcgacgacgacgagcccggcgacgtcatggaggcgttccgctacaccatgttctgcctcctcgtgctcatgtgcttcggcgagcggctggacgagcccgcggtgcgcgccatcgaggacgccgagcgcacgtggctgctctacatctcccagcagatgagcgtcttcttcttcttcccgtccgtcacaggnacgtcttc

SEQ ID NO: 20240 - DNA, 487 bp, Sorghum bicolor
  Clone ID: LIB5048-011-R1-XP1-E1
ccgggtactgaccatgtcgcaccggggctccaccctcgcctcgaagggcaaagcctcgacgggcggcggcggcggcggcattcgaaacgatgtcgcggcagccgttgtagtaccatcttccggcccaagacccggaccaacacccactggtcagacgacggcggcggaggaggaggcgcgcgccaggcgcgaggcggagaaagccaagctcgcggaggagatcgccacgctgaaggcggaaatcatcgctctggaggaagagctggccaagatggatggcgccgccgctgctacgcgcgcgagtgcttcccattctcgtgtttcagctaggccattgtgattgactggagcggttgttgtagatttgggaggagctaggtagatggaattccccttcgcaattacttcaggtcatgttcgtctgaaacaactgcgatgttctcgaattttattgttcttagcacgcttggcttgggattatattcac

SEQ ID NO: 20241 - DNA, 478 bp, Sorghum bicolor
  Clone ID: LIB5048-011-R1-XP1-E11
ccgggatactgcatctgcatagacccttagggtttctctcctaccgcctcacttccgctccaagcgaccaatacctcctcccttgacctttgccatctccggtgcgctgcggggcaagatgactactctatagcgaacacttacggaagaggagccaatgctggctgcgatccacttcaccgcctagatcatctgggacgacgcggacccggaggtcgccgaccccgaggacacccgcctgtggctcaaggtgtacgacgacctcctcgcggggggctggatcgacatgaactgcctcatggtcgcctacatcgacctgctcctcaccgccccgatactcatgaagcacatacatctgcagggggatctctcggacatctgccgctgcacaaacaaggtccgattcaaggacgaggaaatagatatcatcaacctcatcggcaaggagctcatcgaggacactggcaacaagacagag

SEQ ID NO: 20242 - DNA, 521 bp, Sorghum bicolor
  unsure (1)..(521): unsure at all n locations
  Clone ID: LIB5048-011-R1-XP1-D2
ccgggatacttccacagtatctatcacaccacatctactacgtactactggccgacgtatgtcaatcgtctccggaaacaagcccaacttccaatactcatcagcttgttgaacacagacgtccattgcatatcagaagggcatggaccccttgaccaatatcactgttgtcgcgctcctatactccgacttgggctgcaataaggccgatgacaatctgaccaagcgcgctggtgacctctcctccgaacatgttggagcgcatccctaccatcatacatagaccctctccagtacaagattccttcctggatcctcaacctgacgcgtgatatcctagatggcaagaacagccacngtctcgccaacggtgtcgcctccaagctccgtgacaatctcgagcgcttgaagaatatccgcgctcaccgtagggctccgtgcactactgnagtctcccgtgtccgcggtcagcactcaaagaccaccggtcgccgcggccgaaaccgtcggtgtctccaaga

SEQ ID NO: 20243 - DNA, 595 bp, Sorghum bicolor
  unsure (1)..(595): unsure at all n locations
  Clone ID: LIB5048-011-R1-XP1-A3
ccgggcagcgtcggcgccggcgtcctcggccggctcggcaacaagggcgcggtgtccgtccggttcttgctccacggcacgagcttctgcttcgtctgctgccacctcgcctcaggcggcgaggagggcgacgtgctacgccggaacgccgacgcggcggacatcctcacgaggaccagcttcctcagctccggcggcgcgccggcagcaccggatgagctccccaagaagattcttagccatgaccgcgtggtgttgttcggggacctcaactaccggatcgccaaggacgacgacgaggaagcacggcagctggtgcgggccaggaaatggagcatgctgcgggagaacgacgagctgctgctggagctctccagtggccgtcagttcgacgggtggcacgagggccgcgtcgccttcgccccgacctacaagtatcgccgcaactcggaccaattctgctggtgcgctgacggtggcgtcgccaccggccggctggacaaggagnagnaccggcaccgccgccgcgcggcggtatggtgtgaccggatcctgtggcgcgggaaggggatgaaacaagtccggtaccagcgct

SEQ ID NO: 20244 - DNA, 687 bp, Sorghum bicolor
  Clone ID: LIB5048-011-R1-XP1-A10
ccgggaaaaaaaaaacaattaaatcgactctcaccaacgactaccgaaaaaatgggctctgttgaggttaccgcgtccgcctggaggctcgtcgaggtcggccgcgttgtgctgttcgtttccggccctttcgccggcaagctcgcagccatcgctgagatcatcgaccacaagcgtgtccttgtcgagggtcccgcctccaccgctgaggcctctgtccctcgccactccgctcctctctccagcgtctccctcacccgcttcgtcatcgagaagcttccccgtgctgctggcaccgccgccctcaagaagcagtgggaggcccagggcatcgagagcaagttcaacgagagcgactacgccaagaagcgcgagcagaccgtcaagaggaggaacctcaacgacttcgagcgcttcaaggtcatgcgcctcaggaagcaggcccgcttccaggtccgcaagacccttgccgctgccaagtaaatgcgcatgtctcgaaacgaaaatccaattacaggcttgaacgagtcgactcaggccaggagcatcttttagaccgaatgctcttttccacagcagggtcgcaggcgtcaatcaggtggagacgacaggcatgcagcttcagtagcgtttcggaaaatgagagcttgaaactgaaaaaaaaaaaaaaaaaggccccctagggcg

SEQ ID NO: 20245 - DNA, 608 bp, Sorghum bicolor
  Clone ID: LIB5048-010-R1-XP1-G6
ccgggaaggccgcactgtcctcacggaggccgtacgcatggtgcagctgctcaagatcgacggctattgcgccaccaatgtcgtggagcaatctgactacatcaagtccaaatggaacgtcgatggccacgagtgggaggtccgtttctatcctaactactacaactactacgattataggtaccctttggtagctgtaaagctcattcttcttggtgaaccccggaggaacaagttgaaagtgaatctaagctgccggcttgtagatacgagccatcgtcttgatccttctgctgagttgagtgagtcccatgtatttcctagtcgcgacggatgtacagttaccttgatgagaagaaatgatatagcatcatcaggttatattgtgaatgattcattgaccgtgaagtgcaccatcactgtgctcaaagaactaactgatatagaagtcccagctaacactgaggcgccgccactgccaccctctgatttggaacggcacttcggtgagctctggcagggccagaggggagcagacgtcgcttttgtgctcgacaccggcgagcgttttctcgcacacaaaatcattctttgccgcgaggtctcct

SEQ ID NO: 20246 - DNA, 652 bp, Sorghum bicolor
  Clone ID: LIB5048-010-R1-XP1-E12
ccgggaagtcaccattcccgtcacctcccgattccatacatctcccctctaaatgcttgccccgaccctccctccggtgcacaagcaaattccttttgacatcgacctccccatcgtcccctacagcaccacggcccctgcggcatcccaaggaaggaggacgagcatcttgcaacatcgtggcgtctttaattattgattttggcacaacattgaactcgattggaggattgagtcggccacgcggcaacacttctccatgagcgtgaatgagccgaccgtgctgctcaaccactgtgcttctcggcctcatgcaaaccaggtgctgcatggtcagccaccctaaggagaaggtttcactaaggcgttgctgcagcagggcgatctccatgagcgcctcaccttggcgtcgtgcgtgcatgcgtgagacgggagatgcgcgagaacaagctggacgtgccgctcgaccaccgccccttctttgagcatgcaaaccaggtgttcggctaaatgtctgatagggatataaccttactagaatagtgaagtggtaattgtatggaatacaaatgagacaaccaaacacactcgatgccagctatgcttagacaatacatgcaatgaaataactaaagattgacttgatagaacc

SEQ ID NO: 20247 - DNA, 387 bp, Sorghum bicolor
  Clone ID: LIB5048-010-R1-XP1-E2
ccggggcacaacgcagtgacagcatagctgtggcggagacgcctccgctccgcctcccaaccacacgaatcacaccaacatccaccgaaatggcgtcggcgtcgcggctgctcccgcccgcgcctcctccttccgcccagctccgcggcccgcgggaccgccttgccgtgcggcgcctccggtgccgcgcctccgcctccgcctcggccactgatggcgccgtgctgctggagcgtggcggtcccgcggcggtggccgtgcgcgagttcgtcacgcttgacgagctccgcgccgccgtgcgcctccgcgtacgcaccttctacgagtatgccgtcgactccggcggaaccgaggatcacagaaaagctcttggagatagggaggttg

SEQ ID NO: 20248 - DNA, 676 bp, Sorghum bicolor
  unsure (1)..(676): unsure at all n locations
  Clone ID: LIB5048-010-R1-XP1-E4
ngcccgggcctggtctccctttctgttccaaaatgccaccgaaacaatcgaagccgggcgataaagctggcgctgccaagccagaggccaagaaggctgaaaggaagcctgcggctaccgccggcgctggttcatctggagcatctgctcccaaacaggccaaacctgcagctgccaagcctgctgccaaggatgccaaggccaagcctgccgcaaagcctgcggctaagcccgctgccaagggtgctgccaagggagcagctaagcccgctgctaagggtgctgccaagggagcagctaagcccgctgccaagggagctgccaagggcgctgccaagaagccagtagccaagggagccgctgctaagggagctgccaagccaggagtcaagaagactgtcgccaggcctgtgaagggtgtcgcacccaaggcacagaagggtgtcaagagcgtgaagcctgcagctgtgcagagggcacttaaagttcagaagaagatcattaagggcccccatggcaccagggttcgcaaggtgagaccctcagtgcacttccaccttcccaagaccttcaggccaccaaggaacccaaaatatgcccgtaaatcagtgccgaggagaaaccgtatggatgcattcaatataattaagttccctctgaccactgangccgctat

SEQ ID NO: 20249 - DNA, 645 bp, Sorghum bicolor
  unsure (1)..(645): unsure at all n locations
  Clone ID: LIB5048-010-R1-XP1-D1
ccggatcactcgacacatccacccgatcgatcgatcgctatcccctctctcactgtcacgtcacgagagctcgagtgtcgtccaataatgtctcggagctgcagcatgacgccgacgtcgtcgccaccgctcgtcgtcgtccgcctccttgcgtcggccgtggcgacgatgttggtgctcgcgtccggcggcggcgtgtgcgacggcgccgcgctgaaggcgcacttctaccggcgcagctgccccgcggcggaggctgtggtccgcgacatcgtggtggcgcgcgtcgccgccgaccccgccgcgctccccgccaagctgctccgcctcttcttccacgactgcttcgtcagggggtgcgacgcgtcggtgctgctggactcgacggcggggaacacggcggagacggacgcggcgccgaacgggtcgctgggaggcttcgacgtgatcgacacggcgaaggccgtgctggaggccatctgcccaggcaccgtctcctgcgccgacatcgtggcgctcgccgnccaggacgccgtgtcgctgcagctcgggcgggacctgtgggacggcaanctggggcggcgcgacggcgtgttgtcccgggcgtcggaggcgctggccgacttcccttcgccgtcggacaac

SEQ ID NO: 20250 - DNA, 427 bp, Sorghum bicolor
  Clone ID: LIB5048-010-R1-XP1-B8
ccgggaaagtgtcatttaccagtgcactgtggaagtaactatggccgacgaagacaactcctccgatcgcgtcgacaacgagactcctaagccagagaagatgttcacgctcaagaagtggaatgctgtcgctatgtggagttgggatgtggagtgcgacacttgcgccatttgccgtgtgcaagtcatggatgcttgccttcgttgccaggcagagagcaaagcaggcagtggacggcaagactgtgtagtggtatggggtgaatgcaatcacagttttcactattgttgcatgtcactctgggttaaacaaaataaccgttgtccactgtgtcagcaagaatggagcattcagcgcatgggcaaataatgagaaggagagcatgtaaattaggttaaatcaataaactatttctcttgatatttt

SEQ ID NO: 20251 - DNA, 677 bp, Sorghum bicolor
  Clone ID: LIB5048-010-R1-XP1-C4
ccgggagaaaagtctcttgccccagcggccgtgccgagccggcatccccttccgttccccccagcagcgatcgcgacgacccgagccggcaagggtgaccggcggctgagagccgccacggcagacgagccccatgggagacaacaagtctccgctgagcctgagcccgatgggcgggcgcgaccgggaccgggagctcctcatcccggtctccggcggcggctcggcgcccggcgacggtgtcgaggacggcgacagggcctcctccgcctccgccgcgccctcctcctctggccgcgaggctttccataaggtcgtccgtagttgggcttcaaagaagttcatgactggatgtgtaattctcttccccatagcaataacattctacatcacctggtggttcatccattttgttgatggattcttctctccaatctatgctcaactgggaatcaacatattcggtcttggcttcatcacatctgttactttcatatttttgattggagtctttatgtcatcttgggttggagcatctgtccttagccttggcgagtggattattaagcgcatgcctcttggtcgtcatatctacaatgcatcgaagcaaattagtgctgcaatatcaccagatcagaacaaacaggcattcaaggaagtggtcatcataaggcatc

SEQ ID NO: 20252 - DNA, 750 bp, Sorghum bicolor
  unsure (1)..(750): unsure at all n locations
  Clone ID: LIB5048-010-R1-XP1-B2
ccgggaaattcgacatctccatcttgccgccagctaaccacaggtaatcgacaacagcaagatcgatctctgtccagtcgaatcttcccaacatggccgactctcaagttactctgcgcacgcgcaagttcatccgcaaccccctcctcggacgtcgtcagatggtcgtcgatgtcctccaccccaaccgcgcgaacgtttccaaggacgagctccgtggcaagctcggtgagctgtacaaggccaagaaggacgatgtctccgtcttcggtttcaagacacacttcggtggcggcaagagcaccggcttcgctctcatctacgacagcgccgaggccatgaagaagttcgagccccgctacaggctagtacgctacggcatggccaccaaggtcgaggaggccagcaggcagcagcgcaagcagcgcaagaacaggatgaaggagttccggggcacagccaagaccaagggtggtgcgaagaaggacaagaaataagcgggtgcacactgatgatgactacgaaggtcatggctggagtcgattggcggtttctctacaactactggttcgcctggttcttcatcatggtggatacggagttgcttctgcgggcatcggcatgtatatctacgagcgcctgaaaaactcttgcggatgggaacgacaagacggatggcgtttgagatcaattgtctgctaaccatcaatgcatatcatggactttacgatcctccaantattttgcctc

SEQ ID NO: 20253 - DNA, 700 bp, Sorghum bicolor
  unsure (1)..(700): unsure at all n locations
  Clone ID: LIB5048-010-R1-XP1-B1
ccgggatcgctaagaccaccgccatcatgcctcccagattacaactactcaccaacgcggtgaggccgctcgctcaaccagcctaccagcctgttgcgcctttcctataccctttcctccaccagcaatcacgcccagcatccattctctcctccctttccgacaccaagggagcatacaaccaccgcattcgccgcggtcgtggtcccagctctggcaagggcaaaacatctggaagaggtcacaagggtcagaagcagcatggcaaggtgccgttcggcttccagggcggtcagacaccagaaatcgtggtacatggcgagagaggtgaagtggaccacttctccgtggacatgagcccagtcaacctcaatcgcattcaagaatggatcaacgccggccgcctcgacccaacacagcccatcactctgcgcgaactcgccaattcccgttgcatgcacggcgtgaaagacggcgtcaaactgctcgcccgcggcaaagaggagctcacaacgcccatcaacatcatcgtctcccgcgccagcgccgaagccatcgaggccgtcgagaagctcggcggcaccgtcaccacccgcttctacacaagttcgccatccgcaagatcctcagggacgagatggaccccgtgcactcgctgcagagcaggattcaaatggcgcctgtcnaggctgagggcgct

SEQ ID NO: 20254 - DNA, 676 bp, Sorghum bicolor
  Clone ID: LIB5048-010-R1-XP1-B6
ccgggtaaaaatgggatcagcgccgaggaagcagtccaagacgtacaaagtcccaaagcgaccttacgaggccgcccgtctcgatgctgagctcaagctcgctggagagtacggtctccgaaacaagcgagagatctggcgaattcagcttaccctctccaagatccgacgagctgcccgagagctcctcaagctcgacgacaaggactccaagcgacttttcgagggtaacgccttgatccgacgacttgtccgaatcggtgtcctcgacgacacccgaatgagactcgattacgtcttggccctcaagactgaggacttcttggaacgacgattgcagacccaggtcttcaagctcggtcttgccaagtctgttcaccacgcccgggtcctcatccgacaacgacacatccgagtcggaaagcaggtcgtcaacgtcccatctttcgttgtccgactcgactcccagaaacacgtcgactactctttgggatccccatacggcggtggacgaccaggacgagtcaagagaaagagagccaaggccgccgctggtggtgagggtggtgatgacgaggaggaggatgacgagtaaactctgagctctgttgtttgggttacatcagggtttggtcttaacgcttccagagtggcatgcattgctgtcgcgacatcc

SEQ ID NO: 20255 - DNA, 606 bp, Sorghum bicolor
  Clone ID: LIB5048-009-R1-XP1-E3
ccggaaataacaataccgacctattctccaaccccaaagtcgccctacctgcagaatatgcatttctcacagctggttggaacagcactttcacaatcaacgacctatctgctccaggccgccagcagctttttgaccatggagtggcgttgaagctcgagtatcccgagctatacaccgacaaactcttagtaggaaaacaagaccgcgtgatcgagtctgctcaatggttcgccgatggttactatggccggaacgtcaactcgactgcgacgctggacctcatcaatgaagacaacaccactatctcatggattacaccaatggatgtgtgcgagacgtgggagtacagtgacggcggagacttggtctcagagtggggaagcgtgtatcttccgcctatcgcagcgcgtatcaacaaagtgcttgcaagcgcatacccttccgtcaatttcacagctggaaatgtccacgggatgttctacgcatgtgtctatggcactgccgtgaacggtatcgggtcttcgccatggtgcccggtcttccttcctgaagaaatcttgcagaacgagtacgagtacgatcctctcatgcgaggcgcttttg

SEQ ID NO: 20256 - DNA, 457 bp, Sorghum bicolor
  Clone ID: LIB5048-009-R1-XP1-E4
ccggcaccccatctcatcctaagcaaaccagccaagatgagagctaagtggaggaaaaagcgcacgcgccgcctgaagcgtaagagaagaaagacgagagccagatccaaataagcgactcgcccctactctgcctgcgatgacactcagcaccacccacagataacaacctcaatcacgcgaccacaagctgcgccgcgctgaagaagcgatcacgacttcgcgctacgaatgacggcttgccttttacgactttgcaatggctttgactgaggattggggtggagactggaaggatttgcttcaatgcacccagagttgatgtgaagaagtttatgactgcaccaaccggagcctgtctaacaccggcctgatctgcacaccgcggaagctgcctttgacttgcattcggcgtgcgaatttcaagtagtctgacaatcaatgatttctgctgctg

SEQ ID NO: 20257 - DNA, 772 bp, Sorghum bicolor
  unsure (1)..(772): unsure at all n locations
  Clone ID: LIB5048-009-R1-XP1-D4
ccggaatccctcaagttagtgacgatcaaaaaccggcaagatggtcaagcacaacaaccagttgcagaagaaccacttccgaaaggactggcagcgacgggtcaagacctggttcgaccagcccggatccaagaagactcgacgagtcgctcgatccaagaaggccctcgcctccggtgccgccccgctccagcgactgcgacccgccgtccgatgcccgactcagcgatacaacatccgaatcagggagggacgaggattcaccacttccgagctcaagctcgccggcatccgaaagaaggaggccaagggtctcggcatcgtctttgaccaccgaaggaggagcaagagcgaggagggacaatcgctcaacgtcgagcgactgaaggagtaccgatcccgactcgtcgtcttcccccgaaaggccggcaagcccaagtccggcgacgctcagggagaggacctcaccgcccacatannccccgagttctccccgccctccccgcctcgtacaccgccgaggccccgcgagccatcacctcggaggagaaggagttcaacgctttccgagcccaccgagaggcccgagccgagaagcgaaaccttggaggcaagatcaagcgtgccgaggccaagggcgccgaggaggctgccaagaagtaaaggctggcggagaccgataggactggtttctccctggcgcttttgtacattggtctggacgggcatgcacgatttaaccgacagaaaaaaaaaaaaaaaaagggcccta

SEQ ID NO: 20258 - DNA, 692 bp, Sorghum bicolor
  Clone ID: LIB5048-009-R1-XP1-C7
ccgggagattcatattctaaccgtttaatcatgacacctaaaatctttctcaccggcgcaactggctatattggaggcgacaccctctttgcgctgtacaacaagcactctgattacgagattgcggctcttgtgcggacagaggagaaagccaagtctgtcaccgaggctttccccaaggtacggatcgtcattggtggtttggacgattctaagatcctggaaaatgaggcagcaaaggcagatgtagtaattcacactgcggatgcatctgaccacgaaggcgccgcgaaagcgatcgcaaagggcctggcatctggccactccaaggagaagcctggattctggctgcacactggtggcactggtatcctgtgctgggagactatgcgagacgacaacaagttgggcgaatggtcggagcgtgaatacaacgattggacagccgtgcaagacttgactggattgccaaaggatgctttccacaagaacgtcgatgaccttgtgctggcagctggatctgagtcggtcaagacagctatcctctgcccaccgaccatttacgggcgtggacgaggcccgctgaacactagaagcagacaggcatacgaacttgcacacttgatcttgactggtcaatatatccccatcattggccaaggaaaagcggggtggaacaacgtccacgtctc

SEQ ID NO: 20259 - DNA, 550 bp, Sorghum bicolor
  unsure (1)..(550): unsure at all n locations
  Clone ID: LIB5048-009-R1-XP1-D10
ccgggactttccccgcctccatcaccaattcaccatctcctcctcccgcaacgcagcccgggtcgcccgtctcgcaactcccgagccgaattcccctccaccgcaaccgccatgggcggctcccacagccgcgaggacatcgacctcacctcctccgacgaagagaaggagtacgaggacgactacgacgcccgatcacccatcgcggaggccgccgcgagcgcggggcagcgcgacgacgacctcctccgcaccgccacaccttcgtcgcttgaggccatcgacgccaagctcaggtcgctggatctcaagtaccagcgtccgacctccgccaagctctacctccacgtcggcggagcctcgccctccgcgcactgggtgcctgccgagcgccgcgcgacctacgccttcgtcgacaaatcgagcgacaacgactcttcgcccaggtggttcctggaggtcggtccggngccgcgggtctccgcgcccgnggactcggcgctccagctgaagacgatccccgcgcagcgccgggcggacttcgccgcga

SEQ ID NO: 20260 - DNA, 563 bp, Sorghum bicolor
  unsure (1)..(563): unsure at all n locations
  Clone ID: LIB5048-009-R1-XP1-B4
gcctggggccgggagcaaccacacacaaccgacaaaatggcacctgcagcaactggaggcaagaagcagaagaagaagtggtccaagggcaaggtcaaggacaaggcccagcacgccgtcgttctcgacaagcagaccaacgacaagctccagaaggatgtccagtcctaccgcctcatcaccgtcgctaccctcgtcgatcgcttgaagatcaacggctcgctcgcacgcaaggcgcttgccgacctcgaggccaacggtcagatcaagaaggttgtcggacactcaaagctcagcatctacacacgagctatcggcgccgaggagtaagctttacgtagccgacaattaaacgaacgtaaatgcgaatctcggacacttctttcagtttctctacggcattcctctttccattacccatcggcgtcttcatgaaatgaacgggtcatactatattgggatgcatgcttcatagcggatatgaaatgagaggaacgggctcgggtacagtacctagagtccattnggaggtgtcggttatgtactgaatngaaagacttccg

SEQ ID NO: 20261 - DNA, 516 bp, Sorghum bicolor
  Clone ID: LIB5048-009-R1-XP1-B3
tggccggggtgtatcaggatagagcggcagcgccctaacagagaccacagagagcagtgagcggagaagagcagaatgaggttacaggcgagcagatcgtggagcagacgcgaccgagcgcacaagagcgagagatgccgcagacatgaacccgtccacctagacccgaacctggaggaggagcacacctcctccatcctcttctaagactccaaggcaccctgccgacatacatcattcaagtcagacatcgatgctgatggtcgtgcatcaaaggatcggtatcgcatatgagatatgaccatgacccagagcgcatgcatgctcacgatcgcagctcacttccgtctatggtcagagacctaatgtgaataaaaagctgagggatgcaattgcttctatgctggagtccaagatgtgctgttcccaaggcccgcttctacctcgagtactatgtctcgaagggctcggacttctactgaaacgtttccaccttctacacttgaaggccatatc

SEQ ID NO: 20262 - DNA, 678 bp, Sorghum bicolor
  unsure (1)..(678): unsure at all n locations
  Clone ID: LIB5048-008-R1-XP1-H8
ccggngaatcccattcccatcccatatagtttgattatatacactacgtgtgcgcttgttttagcaagtttctgagtggattagtagccatggccaagcacctcaattttctcctcgtcaccgtggcttgcatccaccacattgcgtacgcagcgagcttgaaagtggcggctgcgacagggacggcatacgagatcctggacaaaaacaacttaccgcgtggactcctcccccagggcgtgcgatcatacgttctcaacccggacggcaaactagaagtgaccctcgccggccagtgtgagattccagtcaacttcggcggccaacagctcaagttccgtttctccagcacggttggaggagtcatcaaccccggttccatccatgaggtgtacggcgtggatgtgcagatcaagttcgggtggctcggcatcagacaagtcgaccgtgccggtgatcaactcacatttcaggccaagccgttcacacagtcgtttccggtcagcaccttcgccgtgagccagtcctgcagctgatcgaacgaggtgctggttgatcccaatgctggaatgccgcagcagtatcgggctttcgttgaattttcttatttgtttttactatacagaacatgtctgaataattagtttggttataataaatagtgttttgtgtttggac

SEQ ID NO: 20263 - DNA, 797 bp, Sorghum bicolor
  unsure (1)..(797): unsure at all n locations
  Clone ID: LIB5048-008-R1-XP1-G12
ccgggacatacatctcccctgcaaccacccgtcgccacccctcaaactaccgacatcatggataccgagaagctggcccgcatgcagaacgccgtccgcactggcggcaagggtacccccagacgtgtgcagaagaaggtccacaggtcttccggcgccgatgaccagaagctccaggctaccctcaagaagatgaacgtccagcccatcactcagatcgaggaggtcaacatgttcaagtctgacggcaacgttatccacttctccgcccccaaggtccacgccgctgtgccttccaacaccttcgccatctacggccacggtgaggacaaggagctcaccgagctcgtccccggcattctcaaccagctcggccccgactccctcgcttccctccgcaagctcgccgagagctaccagagcctccagaagagcggtgagggcgagaagggtggtgacgacgacgacgagatccccgagctcgtcgagggcgagaacttcgagagcaagaacgacgtcgagtaaatgtcgaaaccaaccgaactcccctcgattgttgattggaagcttctacctggacagatctcgggtgtgatctagtgcatcctcctcttcttgngcgtgtctcggcagggatgatgcgcacatgaaagtaacggcctgggccctgcgagcatgatcccgccggactgtacatggggtttgagtgtacatttangactccgcgacgccatcatgaaaaaatcaagttgcctgccatttccccgttaaaagaaaaaaaaaaaaaaaaaggccct

SEQ ID NO: 20264 - DNA, 317 bp, Sorghum bicolor
  unsure (1)..(317): unsure at all n locations
  Clone ID: LIB5048-008-R1-XP1-G2
ccggggatttcatcgtctccctcggcgaagcttcagcttccctttcgccgaacccaacggcagccatggccgctccctccgccgccctctccgtctccggtgcggcgcatacaaattcattcgtctgcaggaacaagaagctaaagtcaaacagaaatcgtttacatcttgcagttccttcaagttctgagagtacaaattactgtagaaagttaaccatctgcagagcacagagtgaagattctaaaggtgggggaggatttttggntgggtttnttatagggggagtaatctttggaatatttggatatgtattt

SEQ ID NO: 20265 - DNA, 537 bp, Sorghum bicolor
  Clone ID: LIB5048-008-R1-XP1-D8
ccgggaaaaaaaaaaaatatcaaggaagtggtcatcataaggcatcctcgtgttggagaatatgcgtttggtttcattacatcgtcagtatccctccagagttattctggtcaagaagatctttactgtgtctatgtgccaacgaaccatctttacattggtgatatcttcatggtgaattcaaaggatgtcataaggccaaatctttctgtgcgtgaaggcatcgaaattgttgtatctggtggtatgtcaatgccccaaattctgtcaaccctcgacccgcagatgatccttggggacagaaccggaccaagcagaagttgaagctgctacgagccctttgtgtaacctttctactggttgctagtaacattttcatacaggctaccacgagtacggcaaactagactccgagcacaagtatctgtatattaaagtagatgtaggtgactcgcatggtttgactgtttgctggactctgtaccatggtttgtactttgtacttcaccctatgcaagaaagaagcatctcatatcc

SEQ ID NO: 20266 - DNA, 584 bp, Sorghum bicolor
  Clone ID: LIB5048-008-R1-XP1-D11
ccgggaacaccaccaccagaaacatcagctagaaaccggtccaacactctcacggtcgaatagtttgctcaggaatggccgactccaccagtggcgatctcctccacgaagatggccgtgacccccatcaaagagagctccttcgatggaggggcgcatcaccgtgcgcaagaccgcaatcaagtccaaggagtgggagcccggcatgaccctggtacgggaccgaccgcgtcaagtacctcggccccttctccggaggagcccccgaggtacctcaacgacgagatccccggcgactacggatgtcacaccgcgggtctgtcagacgaccccgataccttcgccaagaaccgcgagatgcaggcgatacactcccgctggaccatgctgcactggctcggctgcgacttccccgagatggtcaaccgcaacggcgtaaagatctgagaggccgtgtggttcaaggccgtttcccaaatcttcagagaaggcgacctggactacctgagcaaccccagcctgatccacgcacacagcatgctcgacatctgttgcgaccaggacgagctcatgagcgccgtcga

SEQ ID NO: 20267 - DNA, 615 bp, Sorghum bicolor
  unsure (1)..(615): unsure at all n locations
  Clone ID: LIB5048-008-R1-XP1-C1
ccgggaaccacaacatcaccaccaccaccacagcaacaaccaaacgcaacttctccgccaccatgtctacctccaccggcgtccacaacctcaccaccaaggccgacttcgacgccgctctcggcgagaagggcctcatggtcgttgacttcttcgccacctggtgcggtccctgcaaggtcatcgctccccaggtcgtcaagttctccaactcctacaccgacgcccgtttctacaaggtcgacgtcgacgaggtccccgaggtcgcccaggagcagagcgtgcgcgccatgcccaccttcctcctcttcaaggacggcaagcaggtcggcgaggtcgtcggcgccaaccccgtcgctctcgaggccgccatcaagactcacagcgcttaagcgcttcgcctcgccttcactgcttccccgaccccagcggcaagagatgaacaaagggatatcttggaaatggggaggatgacaacacgatgacgctggaattatttttcctcctttttttttctgtgcttgcacttgcaccatgagcagataccttatagatgcgctgtgtgtggnctaactgagcgccgcgcgagcgaatggaatttgaggtcatgaataa

SEQ ID NO: 20268 - DNA, 730 bp, Sorghum bicolor
  unsure (1)..(730): unsure at all n locations
  Clone ID: LIB5048-008-R1-XP1-C11
ccgggtgctatcctgcaatggaagatgatgaatggcgcattattactggcagtgatcctaagaataccccatggtcatatcataatggtggatcttggccaaccctattgtggcagttcacgttggcgtgcataaaaatgggtagaccagaattggcccggagagccattgcagtggccgaggagagactctcagatgacaagtggccagaatactacgacacccgatctgggaggttcattgggaagcaatcccgatcttaccagacatggactattgctggttttctgacctcaaaaatgttgctggagaacccagagctggcttcaattctgacctgtgatgaggaccttgagctgctcgaaggctgcgcttgctgcctgtccacgaagaggaccaggtgctcacgccgggcagccaagtcacatattgggtgaagctgtgaaggtcatgttgttctttctactgtggacgcacaatgtatactaccgactgagaattaaccaagacacagactcttcagctgtacattagtataggtttatgttagatacccatccattcatttcctcggtggctgctcattcttttttgctgagctaccactgatgngaactaccctgngtggatacgggtggttgaaagaagagagcaancatatttcgatgtttgtgctctcatgtacacagaaaatgaaatatgttattatttgagccgcctgctgctcgtt

SEQ ID NO: 20269 - DNA, 641 bp, Sorghum bicolor
  Clone ID: LIB5048-008-R1-XP1-B4
ccggacaactctttactttttctctctataccccaaacaactcaattgcaatcatgtctctcggaaggaaggttactctcaacactggcgctgccattccccaacttggtttcggcacatggcaggccgagcctggtcaggtcggcgccgctgtccttgaggctctcaaggctggttaccgtcacctggatctcgccaaggtctatggcaaccagaaggagatcgctgaggctctcaagaaggcctttggcggcgaggtccccaacctcaagcgtgaggacgtcttcatcacatccaagctctggaactcccagcaccgacccaaggacgtccccggcgctcttgacgactgcctggctgagcttggcctcgagtacctagacctttacctcgtccacttccccgtcgctttcgatgagcgtggcgatgtacacaacaacctcttccctctggagggcgaggacgttaagatgctcgacgacatctccattgtcgacacatggaaggccatgacacagctgcccaaggagaaggcgcgtgctgttggtgtctccagccacacaaaggagcacctccaggccctcattgacggcactggtgtcactcccgctgccaaccagattgagcgtcacccgcgtctc

SEQ ID NO: 20270 - DNA, 662 bp, Sorghum bicolor
  Clone ID: LIB5048-008-R1-XP1-B1
ccgggacagacgacaaagtcaccatgatttccgtattatcactcttgctactattaccaagtatcctcgcggtcgaatggcacgcgctccaatattacactgccaacaaccaacagttgacttctttgagtggagaaatggtagttccacccattacgaaggcagcgacatattacctctggcctgggttacagccttctgacaactcaggtgtcttccaacccgcattggacggtcgatcggggggttggtggatcggttggggctggtgttgctccaatccctctttaccgtggggaggaggatttggtgtttcagcaggcgatgtagtgaggttcagcgctacgaagaatgtgaagagcaataactgggacacgacgttgagtgtttcagccaaaaacttgaacgtcacaaattcattcgccctcggcgacaaattcttcaacgaagcagtattcgcgatcgaactctacgacgtcagttgggactttggcccattgaagttcaagaatgtggtcatgacgacgacagggacagatacgggatattgtacgtctccccctgccaatttatacgattcgacaaattacacttcttccgtgcctaaagcgtggacggaccgtaaacagaagacggcttgtcggattgatagtctcatcttg

SEQ ID NO: 20271 - DNA, 674 bp, Sorghum bicolor
  Clone ID: LIB5048-007-R1-XP2-F5
ttcgggaccaccaaaaaccacatcatcaccacccctcacccaccccaactcatcaaaatggacgcctccaccgaacgccagaacggcaccgtcaagtggttcaacgacgagaagggctacggcttcatcacccccgagaacggctccgctgacctcttcgtccacttccgcgccattgagaaggacggcttcaagtccctcaaggagggtgagatcgtcaccttcgtcgccgagcagggccagaagggcatgcaggcctccagcgtccgcagcgccacccagtaagcgttgtttcgatgatgacacgacaagcatgaaacgaaactctcgacaccattcatgacgcgatgagggcaaagcaaacgggtgtgaacaaaaactgggacttttttacgatgtcgatgttgcatgcaatgggagcccaccacaaacaacataagggtggtgacggattttctattgcggctttatgatgacggacgaaggataccagcagcgccggtcctgttggaaaatgtgttgcagtccatcgtcctcgatgactctttggcagtagcgcctcgataacgggcgcgaccccgagggaaatatcttggatgattgttgcaggatagatacgacggatcgatactgacgtatcttgcgagcgagaattaatgccatgctctacctca

SEQ ID NO: 20272 - DNA, 653 bp, Sorghum bicolor
  Clone ID: LIB5048-007-R1-XP2-F6
tcgggctcccatctcctccctctcatctggctgccgctctccacgctcctgtctcctggcctcctgtcttccccaaacctcgcgtaaaccccccaactccacgcgcatagacgaaaggggtttgccttgccggatgaagacgaggtcgcagacggcgccgaagcctctcaagacggtggcgatggctcccagaccgagcagccccaagcggaagtcgaggcccaagccggcggggaagggcgaccgccgcgcacccaagaagccgcccaccgccttcttctacttcatggaggattttcggaaggtttataagcaagaaaaaccaagtgtaaaatcaatgcaggaaatagggaaggcatgcggcgaaaaatggaatacaatggcatttgaggaaaaggtcaagtattatgatatagctactgagaaacgtgcagaatttgagaaggcgatgattgaatataacaagaaaaagaaaaacggagaaatgtctgaggaatcagattacgactagagctgattagctgaatatttatctgttccaaattcctgatggttcaccgtaactggatgaatcaatcaactgtatattacggaactgtgatttgtaactaaatttatacatactactagttggaaccttcagctcatgcaga

SEQ ID NO: 20273 - DNA, 614 bp, Sorghum bicolor
  Clone ID: LIB5048-007-R1-XP2-F9
tcggggaagacccggcgacaacgacgataccgacgacccatcccaccctcgacgtccacaacaccgccgcgatgacgaagatcaactcccacctccacagcagcaggagaaagtcccgcaaggagcacttcaatgccccctccagcgtgcgccgcgtgatcatgagcgctcccctctccaaggagctcagagaaaagtacaacgtccgctcgatccccctccgcaaggacgacgaggttgtcatcaagcgcggctccaacaagggccgtgagggcaagatcaccgcctgctaccgtctcaagtacgtgattcacatcgagcgcgtcacccgcgagaagaccaacggccagagcgtccccatcggcatcgccccctccaaggtcgaggtcaccaagctccacatggacaaggaccgtgagagcatcctcgagcgtatcgccaagggccgtgaggccgccaaggagaagcgcacccaggcttaagcgttttgtgttgttcgaggcatggtatgacggggtttatggagggattctcggtgctgctacggccggctcccagacggagctcgagccttgcttttcttcggcgctctgaatgggaaaatagcgaggtcg

SEQ ID NO: 20274 - DNA, 762 bp, Sorghum bicolor
  unsure (1)..(762): unsure at all n locations
  Clone ID: LIB5048-007-R1-XP2-D8
tcgggataccacacctacaccttttccaatctcaatttctgaattctacaatccaacacatacccataccccaataaacaccaattacaatcgcaaacatggttcaagcttccgaggttctcaagggaaagactggtgtcatctacggtgacgatgtctacaacctcttcaagcacgcacaatccgagggatacgccatccccgcgatcaacgtgacttcctcctccaccgtcgtcgcatccctcgaggctgcccgcgatgccaagtcccccatcatcctccaaatgagccagggtggtgccgcatacttcgccggaaagggcgtcgacaacaaggaccagagcgcttccatccagggagccatcgccggtgctcactacatccgcgcaattgcgcccgcatacggtatccccgttgttctccacaccgaccactgcgccaagaagcttctgccctggttggacggcatgctcgacgaggacgagaagttcttcaaggcaaatggcgtaccgctgttcagctcccacatgattgatctctcagaggagagcaaggaggagaacattgagaccaccaagaagtacctccagcgcgctgctcctatgaagcaattcttggagatggagatcggaatcaccggtggtgaagaggatggtgtcaacaacgaggatgttgacacaactcgctctacacccgnctgaagacatctttgacatctacaagaccttgagcgaggtctcccagtacttctcgatcgccgct

SEQ ID NO: 20275 - DNA, 566 bp, Sorghum bicolor
  Clone ID: LIB5048-007-R1-XP2-D10
tcgcgatactgagtgaaacggtccaagtgaactgatgtgtgtacttcatttgtttcaattttcgtgtcatacgatataaaatttttagttgaacatctaaaattcaatttatttccaagcaaaacaaagtttttaaatcaaagttggttattacatttttatattataaaatttatgtaaagtgaatgtcaaggcaacatttttttgattaaaaaagagaagaaaacgaaaattgcaaatatttttcgattggattttctttaattttttttttattttgcttattcaactcaaaagagaaattgatttaatgtatccagcaagaaagcaaaagaaaagaatttattgtttttgatcacgaaaaatacagggaaaaatattggttttcattcgatttcaattcaattgttggatttaatccattataaccttaataatactttgagttctaagtgattgaattacggaaattacgatacaacaagagtgcactgaaagtggcttttgctcgaagcttgaacatttttcaatcatcaaaaggagaaacaaagtgaaatacattttag

SEQ ID NO: 20276 - DNA, 712 bp, Sorghum bicolor
  Clone ID: LIB5048-007-R1-XP2-C3
ccggggagaattaacagagctctcttgggacaaatcgtattttctgacccatcaaaacgtcaacttctaaaccgtcttctggcaccacatatttcttctggcatagtctgggagatagcaaaactgtggatgaaaggctgcaaggttatcatccttgacatccctctgctatttgagacaaagatggatagatggacaaatccagtcattgttgtctgggttgatccaaaagtccagattgagaggctcatttcaagagatggatgctctgaagaacaagctcggaataggatcaatgcacagcttgcactagactggaagaaatcagaagcagacatagtgattgacaattctggttctttggatgacaccaaacagcaattccaagaagtgttgacgaaagtctcggagcccttgacatggaaggaacgcttgagatctagagatggcctgatctctgttgttgtttgtactgcagtgggcatattacttgcccagaagaatctgctatgatcattattggctgataagtcatggctgagagtactatttgctgatttgttgtgacagaaaaatattacttaatggctggcagattcagtagataagctcaagtgaacgcgctgaaccggcacaattaagctcatctaatgtctctgtctggaaagtgaagggaaacatttgagacttagaaatgaaataaatttcaccg

SEQ ID NO: 20277 - DNA, 771 bp, Sorghum bicolor
  Clone ID: LIB5048-007-R1-XP2-C10
tcgggacttatgtccgcaacttcaattgcaattcgtcgcttacactattgacgacctcaagagctgtacctcgtgcatgacttgtagcttctcacctcacgcgacagcaccccacattctccacaacttctttcagaatggacaaagagcaagttaaggaccagagccgtggccaggagacgactggaaagtcggagtggaaacaacgcccaccctaccgcgtccacgagaagaacgaggactttgacgtcaagtacgaagccaactgccattgcggaaaggttcagtaccagctcagccggagagagcctctagacagcaagctgtgccattgtacaacctgtcagacccagcatgctgcacccttccaatgggcagccatctttcacaaagatgacatcaacttcaccaacggccaccacgatctagaatggtatgacccaaccgacaagtccatcgagcacaagctcccctgcaaagttcgttgctcctactgccattcacccatcatggacgagggccgcaacatgatccttcttttcccctccctcgtgcacctcaagaccgacgaagacaaggcatacttcaagccccgctgccacatgttctacggccaacgtgtcatggatatcccagacggtcttcctaaatggagcggtctgagtggcgattctgatctcattgaggacagcccaccggatatggttcgcgagcatgagcgtaaacgcgagggagagaggaataagaagttggaagagggtgagccggatg

SEQ ID NO: 20278 - DNA, 761 bp, Sorghum bicolor
  unsure (1)..(761): unsure at all n locations
  Clone ID: LIB5048-007-R1-XP2-B12
ctgcgctttcgcttggctatattgaatcatttaagcacgtgtgtaaaagtgccaaagtaattttttttgaaaaatgggtgacgaggaatacaaaaatggaccagcaggcttggaatctgaggttttgatcgagagcaactggaatgaagtcgtcgataacttcgatgacatgaaccttaaagaagaattacttcgtggcatttacgcttatggttttgagcgtccgtcagctattcaacaacgcgcaattttgccatgtatcaaggagcatgatgttattgcccaagctcagtctggtacgggaaaaacggcaacattttccatttcaattttgcagcgaatcgataccaacttgcgtgaatgtcaagctctcattttggcaccaacgcgagaattggcaacgcaaatccaaaaggttgtcatcaatttgggtgaatttttgaaagctgaatgttcggcgtgcatcggtggaaccaacgtacgtgatgacatgcgcaaattggactcgggcgctcatgttgttgttggaacaccaggccgtgtttttgatttgattaatcgtaaggtcttgcgtacgaattatattanaatgttcgttcttgatgaggctgatgaaatgttgtcacgtggtttcaaagatcaaattcatgatgtcttcaagacactttcatctgacgttcaagtcgttttgctatcggctactatgccaacagatgtattggaagtaagtaagagcttcatgcgaaatccagcacgtattt

SEQ ID NO: 20279 - DNA, 847 bp, Sorghum bicolor
  unsure (1)..(847): unsure at all n locations
  Clone ID: LIB5048-007-R1-XP2-A10
tcgggctccttaacggccagaagatcgttgttgtgcgatgcgaggccctcaacatctccggcgagttcttccgcgccaagttgaagtactctgctttcctgcgcaagcagacccgtcacaaccccactcgcggtggtcccttccacttccgcgctccctccaagatgttctggcgaaccgtccgtggtatgattcctcacaagactccccgcggtaaggccgctatggagcgcttgaagaccttcgagggtgttcccgctccctacgacaagaagaagcgcgtcgttgttccccaggccctgagggtactgaggctcaagcccggacgcaagtactgcactgtcggtcgtctcggtcacgagttcggctggaagtaccaggacgtcgttgcccgtctcgaggagcgcaggaaggtcaagggtgccgcctactacgagcgcaagaaggctgtccgacggcagttggctgaggccaagaagacggccaacgtcgactccaaggtccagcaagagctcacatccctcggatactagaaatcggcagtcgatgaacagtgtcggtttcagtttcggtgacgtggttcggcgtggattgcattgggctcatgggatgtttatttcctctactatactccgaccattcgaaagggtgtccaggctaaaagagcacatcaataccagggtgcttacgtgttcatgggtctcttcgcggtcggtctgctgtgtcttcaggtactctttcggctagaagcatacgaaatgaaaaatccagctgatgtaaagcatggtgacggcgttgagcgttcagcaatagacttgtggntatgtncattgacttacgattcccc

SEQ ID NO: 20280 - DNA, 669 bp, Sorghum bicolor
  Clone ID: LIB5048-007-R1-XP2-A2
ctggggagcacccgcagctaacacaaacaaggtcccagccagagccagcagcagcagcagcgactccactccactctccctccctcgctcccctcggacaggccgacatgggccgtcgccgcagcagctcttggccatccgcggctcctgtcctgctcctcctcctcctcctcgtcgtctgcttctcccacggcgtggcagcggctcgcctcctgcctccgctgcagccagctccagccgttcctccgcaggttcttcaccaagcggagaatgttgtcatggcggcagctgccgacggcctcgtgcttcaggaaggtgaggccgtgggcaatggcgacgagctctccatctcagagatgatgggagcagaggaggagggggcggcggcggtctgcgagggcgagaacgacgagtgcctggagaggcggctgctcggggacgcgcacctcgactacatctacacgcagcacaagggcaagccgtgatcgtgtcaccgtgaggactggaggaagacatgcatctcgccttgccggtttggtttggtttggtttggtttgggtagagtgcgtacatgcatgcttggaagttgatactacatatcaggctggaatggaatcgtatcatgataccatattatattggaaatatatctatatatatgctcgtttt

SEQ ID NO: 20281 - DNA, 687 bp, Sorghum bicolor
  unsure (1)..(687): unsure at all n locations
  Clone ID: LIB5048-006-R1-XP1-H1
ccgggttatttttgggaagagaattgcaatcgcaatgtgcagaatgtgtcgtcaacacggctacaagatgagcgttctgagctaaaaagaacgcaagcttcacttgagaaagcactcaatttaaacgcagtataccgacaggaactggcatctcgctgttctgttgagcaagacaaggatgaaacccataggcaggtcgaggaagaattggctaaggtgattacatcgttaacagaagaggtgccatccctgcgacaacagctagacgtcggtaacaaaaaagaagattactatgtttcattactaaagaggaaggaagaagagatttgtcagatggagtcccaactggaccagtcaaagagactctgtgaaagtagacttgaagaactgaagacaaagactcagaatggctgctgctgcagcagcagcacatggatgattaggatgcaaatatatttagttgttctgactttcagtcgttcttattatcagatagtgatgctttgcaacatttccatttttttcttatctaanagtcatattgtttgtttggatagctatgnggttcttttcattgatctcatgtaattttctaatgttatttagtggttaccaagttttatttaagcaaagaactaccataatttattaaggggaaagagtaaggccctantaagctttgagatc

SEQ ID NO: 20282 - DNA, 339 bp, Sorghum bicolor
  Clone ID: LIB5048-006-R1-XP1-H11
ccgggaagtgaatcgcggctcgtcaagtccggcggtgccgtccagagagctagagcgctagagctagagcacagctatccccgccatggcggccgcggcgcgcgcgatcatctgcgagctggcgccgcagaaggtgtcgtcgtcgacggcgtcggggcccgtggcgccgaagaagcgcgacgccgggacgaaagtggtgctccagccccggctctgcacgctgcggtcgtacggcgccggcagcggcgtggtgacgtggaggattctgttcggggtggaggatctgtgttggctttctttttttttttttttctttttttttttttttttttttttttt

SEQ ID NO: 20283 - DNA, 741 bp, Sorghum bicolor
  unsure (1)..(741): unsure at all n locations
  Clone ID: LIB5048-006-R1-XP1-E8
ccgggaacaccctttacgcgttcccacgatctcatttcgcgcaggaacaccttccatatacaactatggctattgtggagagctggcttccaccgtcgcgcgagaattgggagctgatctgctacatctggcaattcttccctattatcactgcagctcaatgggttctggactggtacccacagggcaagacgtcgattgaatcgcgtttcaacatcgacggcaagatagggtgggcaacgatggaatcggcgggatttataaccctgctgtacatcatgtactcgctcccgaaagaattgggtcttggagagctaccctggggtaattggactatggctggctgctttgtgttccactatctctaccgcgccgttgtatctcccctcttgctcaatcctagcatgtcgccaatacatccttttgtttggatcatggcatttgggttccagatgttcaacgcaatctccattggcgggtacctcgcaggctatggaccgacatcacaatacgaatgggcagcacgatcagagtacatgtttctagggctcgtaatctggtgctggggacttctagcgaacatgttccacgacgacgacctgcgcgagatcaggagagcggcagatcgcaaacagcgcaaggcagccgccgaacagggcaagccagtggagagcgtgngacagatctacatggtaccgaagaatggtctgttcaagtactcgctgcacgcgcactacctct

SEQ ID NO: 20284 - DNA, 690 bp, Sorghum bicolor
  unsure (1)..(690): unsure at all n locations
  Clone ID: LIB5048-006-R1-XP1-F3
ccgggaaccaccgcaacaacttcacttcttcctgtccgactaaataacacccgtatatcacggcaacggcttagccgtatacttcagttcatcgatctctccagcctccaatccatcaaccagcgcaacaatggcgctccaaccctccgccgccgacaaggtcgaccgcgagtccacaccacctttcctactccgagtcttctggcgctccaaccgcacccttgatcctcatgagttctccgtcgctcctccaccagatgccactgcaagcatggaatacttcgaaatcttacctgcgaacattcaacaatccagtctggaactctaccaatggtccgattgcacactgggccaactcacatcaacaatgatgagcgaattacccgccgatgctggcgtagacgttggatcaaggctcaacttcaagctgatcttcccggacacaagagcacaaatgggtgaaggcggaagaggaaagtggattgacaagccactcggctcagtggttgtcggaggaagagacgcggaaatggaagagaacgacgtgctggaaggcgatgcgaacaanactttggctgatgccagattcgtcattggcgactttgtcgcctgctctatctatcctcccagccccgatggaagagtggcgccaatgcctgctgnnaagagcccctagagatcatatgctgc

SEQ ID NO: 20285 - DNA, 627 bp, Sorghum bicolor
  Clone ID: LIB5048-006-R1-XP1-E10
ccggggcaattttccaaaatttccagctcgacaagttggacctaacgagatcagtccagtagctgccattcatccactccacgctcttcttgcttgcctgtcccctttcccttttcccatcggaggagagatccgtcctgcggtggcggtgccgtacgatggactccccctgccaaagctgccggctgtttggtgcccagagatcgccgcacgacctcctcggcggcggcgccgtggcggatgtggtgctgtggaggaggaaggagctggccggcgggatgctggcggccgtggtggcgtcatgggcgctcttctactgcgtgcccggcaacacgctgctctccttcgtgtcccaggtgctcatgatccttctcaccgtcctcttcgtctgggccaaggctgcgcagctgctcaacagggcacctccacctattccattgatgaaaatttctgacgagtcaatgagtgaagcagcagaaatagttggtagcttcatgaataaggtgctcaaggattttgaaaacattgcacttggaaaggattccagcctcttctacaaggtggcttttgtgttgttgctgacctccatagttggccgactgactgatcttatcactttggtatata

SEQ ID NO: 20286 - DNA, 793 bp, Sorghum bicolor
  unsure (1)..(793): unsure at all n locations
  Clone ID: LIB5048-006-R1-XP1-E5
ccgggcccccttccctttgcaaccatccttcctgtctccactgctcactctaaaccccctgtgacagaggattgaggaacaagaacatatggccggcagcggaagcggaagcgggagtgggagcagcagcagcagcagcagcagcagcccgccatgcgcatcgtgcaagctgctgcggcggcggtgcacgcaggagtgcgtgttcgcgccctacttccctcccgaggaccctcacaagttcgccatcgtccacaaggtcttcggcgccagcaatgtcagcaagatgctgcaggagctgcctgctcagcagagagcggacgccgtgagtagcctagtgtacgaggcgaatgcgcgcatgagggacccagtctacggctgtgtcggcgccatctcctacctccagcagcaggtctctcagctccaggtgcagctcgccctcgccaaggccgagatcctctgtgtccagatgcagcacgacgagtcagcttcagctgccgccgcgccggctccggcaaagcaacaactacatcatcaccaccaccagcaggaggagatggaatgcgaggcttatggcagcctgctcgtgcagaatggcctgatgatgaacacgttgaacagcactggtgcagttcatcatcagcagcagatgctgggcagcttcggctccgcaggggacacttcaatgatgctgcnagaggcgtgcctcaagaaagagaccctttgggcatgaatgaatgaaatatgtacttccatttgtncgatagaaaaaaaaaaacttcttgtctcccaaaaa

SEQ ID NO: 20287 - DNA, 367 bp, Sorghum bicolor
  Clone ID: LIB5048-006-R1-XP1-D4
ccgggtctttcagctaactctgagatcgatcactttgtcaaaattttccctggcgtggcgcatggatgggctgtgagatacagcgacgatgatgcatccgctgtcgcaagtgcgaaggaagctctgcaagacatgagccactggttcaataagtacctggactgaaacctgtagcggcagttctccatgtaataagctcctgatatgaacattatgcaaccataatgtatttctattttatacagttgaacttctgcttgcgtatgcgtgctatgtattttagcagtccacttgattgtggtatttatactatgtaaggaataaggcctcttataatgccacttttatagtaatttttgttattgag

SEQ ID NO: 20288 - DNA, 231 bp, Sorghum bicolor
  unsure (1)..(231): unsure at all n locations
  Clone ID: LIB5048-006-R1-XP1-C2
ccgggaattgcttctccatcctgatcgatcgtttgattattggcgagcttcattccattccatcagttccctttggcggaggatgtcgtgcttgcggaggcaatgcgcggtgcggttccggcttgcagtggcggcaccgnctgcgnaggggtgcaagatgtacccggacatgcttgagcagcaggtgaccaccacccccaagactcccgtcatgggtgtcgcaccatcgtc

SEQ ID NO: 20289 - DNA, 755 bp, Sorghum bicolor
  unsure (1)..(755): unsure at all n locations
  Clone ID: LIB5048-006-R1-XP1-C8
ccgggataagcaaaagctcaatcttctttactccattgctcttctcattcaaaccaccttccatcacacatacattcgccgattgacaaattcttcgacgaacaaacaccgacttcacaagcacaacaccccacgtctgcgcccaactcagccttccgcacacaataaccacaacttcatcccctcatccttcaataccacattcaatatgtctgacgactggaactctgttaccaagatcggcagccgcactcgtggtggtgccgctggacctcgcgaaaccgtagttaagggcaagtcagctttgaacgcggcccaacgcagcggcggcatcgtcgccacagagaagaagttcgcttctgccaacgccggagcttcatcagaaggccaacgcctcaccaaagtcgaccgttccgacgacatcgtcaagcccaagaccgttggcaccgttgttggccaggccatctccaaggcacgctccgaggcgaagaacgacaagggcactaccatgacgcagaaggatttggctacaaagtgcaacagcacacctacaatcattgcggactttgagcgcggtactgcggcaccagaccagaagctcctaggaaacatggagcgcgtgctcaacgtcatcctacggngtgacaagaatgggcagnctaaattccccagaagaaatgagcgaattatttgccaggtcacatgctagccgcagatatacggtcaggctctgacgntgcaatcttttgcgcttc

SEQ ID NO: 20290 - DNA, 349 bp, Sorghum bicolor
  unsure (1)..(349): unsure at all n locations
  Clone ID: LIB5048-006-R1-XP1-C1
ccgggatccaccaaatcctcttccgcctcttcctcgattaacaaatccccccacccactccagatccccaaaaccctagaccccaccctccggcgatggggaacacgagcgtcttcttcgacatgacggtcggaggagcaacgggcggtagtattgtgatggagatctacgacaaagaggatccccgcacggacgaaaaattccgagagatgtgtacgggagaagaaggangtgggggaaganggggaagacgctccactacaaggggggcgaagttccaccgagtggatcncggacttcatggggcaggggcgaacgacttcaccagggggaaacgggaagggagggg

SEQ ID NO: 20291 - DNA, 651 bp, Sorghum bicolor
  Clone ID: LIB5048-006-R1-XP1-B11
ccggggtttccttcatccctccatatactttcccttgtaaacaagcttcttccctggctctcaaagtctcaaagccagcagcgtcatctgatctctccccgtatcctctcacaattcccaacaccgagaaaggagcatggatccaaggcacctagtatgtcctctctctgctcatcacaatgatttatcccagaagctcacagagatgctctcctagcacctggagactcagtctcacagactgaggagtgaagtagctaccatctcgcctcgtttctcccagtctgccgttgctgctgctgctgctgccagagcccagagctcgtggtgggaggcaatggcctcgtcaccgcttgcaatctcggggggacagcctacctgggtcccctatgagccaaccaaagattgctcccagggcctgtgcagcatgtactgcccgcagtggtgctactttatcttccctccgcctccgccgttcgacgtcggcggccccagccccgacgactcctccggccctgtcttctccccgcttgtcatcgccatcatcggcgtgctggcgatcgccttcctcctcgtcagttactacaccttcgtctccaggtactgtggcaccttcggttccttccggggcagagtcttcagttccacttc

SEQ ID NO: 20292 - DNA, 439 bp, Sorghum bicolor
  Clone ID: LIB5048-005-R1-XP2-G7
tcgggactccccacattattctccactccacccccagcaccgccttcacaatgtctgctcaggcccctcccacctccaccggtagcgtcaaggtcgacgctatcaagcagaacatccaggctgctgagcccgagaagctctctggcgtcgccctctactctcgtttcgccttcgccggtgccgtctgctgctccatcacccacggtggtctcacccccgtcgatgtcgtcaagacccgcatccagctcgacccccagacctacaaccgcggcgtcatcggcggcttcaagcaggtcatccagaacgagggcgctggcgctctcctcactggtgccggccctaccttcgccggttacttcctccagggtgccctgaagttcggtggctacgaggtcttccagcaccagccccttgacctcctcggctacgagtccgctgc

SEQ ID NO: 20293 - DNA, 463 bp, Sorghum bicolor
  Clone ID: LIB5048-005-R1-XP2-H11
tccggacccacaccacgatcaacaccacttttcgcccaccattaatttcctacgcagcttcttcagcggtgcgcgctcagcaagcccaaacacaatcatggccgcaaggacaaaggcacaggagatcatcgacagcaacgcggttgctgtcttctccaagtcgtactgcccctactgcaagtccgctaagagcctcctcagcgagatgggcgcaaaggcctacatcctcgagctcgaccagatcgacgacggtgccgcgatccaggatgctctcgaggacatcaccaagcagcgctccgtgcccaacatcttcatcggccagaagcacattggcggcaactccgagctccaggcaaagaagagccagctctccaacctgctcaaggaggccaacgccatctagacgagatggaaacatgcggcggctgtaggaatacacgttatcatgaaatgaacatattac

SEQ ID NO: 20294 - DNA, 626 bp, Sorghum bicolor
  unsure (1)..(626): unsure at all n locations
  Clone ID: LIB5048-005-R1-XP2-F5
ctaggnaccctcctcctctggccctgctggctcctcttcttcctgtttcactccctttgacccaccaacgattgacgtcattagagtctgccgctcttgcgctccttcgagtttttttctcggcacaccgctcgctcaatccttttgcatttgtgccatcacgattcaccgtagtggatagttgcgcatctaccctgctctgtctctagttcattagtcccgaatccctcgccttcccatctctttactatccgactctgctacccgcaccgatcaccaatgtccttccgctccaatttcatccccgccctacaacggcgacctcgtctacggtcaccctcatcgtaaacatcgtgacctttgtgctccttgaccctcgaccacgagcgtatctcgacctacttcttcatgctgtgagctgctctccaaaggcaagatcatcttcggtatcagtgaagcctacgcccgcactgtgagagagtattgctccgcccatcccgagatcaagatcaatgtcctcttctgtcctgcctactagggcatacctctctgcgccaccactgccgagaagcttgatggtattgacaaggcaaagtatgaatacctcgttctctgttacgaccaca

SEQ ID NO: 20295 - DNA, 580 bp, Sorghum bicolor
  Clone ID: LIB5048-005-R1-XP2-G10
ttgcgatccaaacatcccgaatccaactttgtctgatctgcttcactcgcgggcgcgctcctctccactcctccgatggggtcgccgcccaccagctcctcattcatccgtccggcgacgctgccacaccacccggaccctcggctccatttccgcccaccctccgcctccttccgcgtctccgagatacttggcggacgcggcctctgcaacggcgaggacggcgaccgcaaagaactcacctccggctcctgcgtctccaccaccacctcctcgcccgcgccgactccttctccttcgacggagcctcctccgcccgcgggtgatctggacgcgttcgagaaggagatgatgggcctcacaggtggtgttccccggcggagaggccgcgctcaaggacttcatcaccaggaacccgccgcctcctcgatccgagaaagcaatatcccagatggatgccccccaagccatcacggtctccgaggcaccgcggacgtcggagatgacgttgtacctgacgcagatggcggaacagtgcaagaaccccaacaacgcctactacgtggactgcggaagcatg

SEQ ID NO: 20296 - DNA, 721 bp, Sorghum bicolor
  unsure (1)..(721): unsure at all n locations
  Clone ID: LIB5048-005-R1-XP2-D6
ctgcggaagcttcctcaccccaaacaaaccatttgacgaccattacagtcgccaattacgcaccttttcaccacacaaacagaaagagaaagacaaattatcagtcaacatgtcaatgttcttcggtcaaaaacctcaaatctcttcggagcaaaagattacgcaggcggaagctgagattgacatggtgagcgacatgtacagccgcctcgtcaagtcttgcacagccaaatgcatagacacaaactaccgggaagccgatctcaacaagggcgaatccgtctgcctcgaccgctgcgtatccaagttcttcgaagtcaacgtcaaggttagcgagaagatgcagggagaggcacaaggaaagcagggtggaggtggcggcatgttcggtggtggaatgtaaggaaagtcttattatattgaagaggtggaatgtggaagttaggcgatatacgggcatgtctagttgtgcttgtgctgggccgctggacatcggacattcgagggcaggacaccttgctatggggacggttgctgctgcataggtctttggaacggtcggtgttctggatcaaaatgttgaaggattgctttgcccactccgcttcagcctttgaatgcctggatgccttcatggccacattcacaggaatgacatcatgatatgaaggacatgtancatacaaagcttgtatttctaaccaaccgatcgatcntacag

SEQ ID NO: 20297 - DNA, 570 bp, Sorghum bicolor
  Clone ID: LIB5048-005-R1-XP2-D9
ctggacgcctttcctccaaatacctacttatctctgcaccacaacaccgcacacacacacacctatcatgcatccacccgacactacgtacatactagcttgatggcgggatccacacgacaagtccggagtatcaatgcctgcacttgctgtacgaggactcatgctgaccacgtgacctgcttcttcagagggagagcagcttgacctaactgacactacctcgactactatatatacagctagactgactgacagacatgaataacttactcccgtctgtgagtgcatgacttgtatgcatggacagactatttcacatggtacacttgctatacacgtcgaatcgttgggatagttatgaccgctacctactatatatgatatatgcgcaataactgaccctcatgagatagcgatgaaagaaatgacactacggccgataccgttctagaactaacggaacccacctgatgcaagatatcaatattgagcttatcaatacctcatagcgcaagactcctgccaacacccaattcgcgctatctggagacgcattactacctgtca

SEQ ID NO: 20298 - DNA, 680 bp, Sorghum bicolor
  Clone ID: LIB5048-005-R1-XP2-D11
tcgggaatatcaagacactcaccatcgtgccaaacgtttccctcttgagcgtgagcatcctcctcctcgaccctcctcgctaccgcccacgagaacacctggaacggcgcacgcgtaagataaaccaaacataatcgtgatagcttgcatgtcgcagacggtcttaactagactagcagccttcgggagacaaccgattctccaaaacaatttggatcccccgcatttgcaccaccccgaatgcacctctgcatcttgcacgacgctgtcgatgccgaaccagctacacatcttgacaaagaactccccttcatgagcgtctaggagttgaagaacctcgacaacaacagagatgctcgacgagaagctcgcccagaaatacaacgctttcttggcttccgaggctttgatgaagcagatccctcgtctcctcgggcccggtctttccaaggacgacaagttcccgaccccggtctcgcaccacgaggacctcgccaagaaggtcaacgaagtcaagagcaccatcaagttccagctcaagaaggatctctggcttggtgtcgccttcggccacgtcaacatgaccgaggaccagcttgtccaaaactgcatgacgagcgtgaacttcttgatctccctgctcaagaagcagtggcaaaacatcggatcgctccacatca

SEQ ID NO: 20299 - DNA, 745 bp, Sorghum bicolor
  Clone ID: LIB5048-005-R1-XP2-D2
tcgggattataagggagaaactaaggctagccagttgtgttgttcagataagatagctttttagatatggaataaagattcagaatgtgctgtcaattcagtcaaaaaaaaaaaaaaaaaaaaaaaaaaaaaaaaaaaaaaaaacagcaccctctggaacgggtgacgtcttccaagctcgaaccaaggccctcgtcaagggaacgatcgcatcaccactatgtcgggtataccgcgctcccacaccccggccggcggttcgcgcctcagcactgttccgtcgcagaaaccacgccagctctcacacctacaagcgcaactcgcgcagttgacggcgaatatgtcggatctggagagcctgatgcgtatgacggctggccaggcgcaggacatgcgtgggttaggtggctatgctggtgccatgttcatggcagcgagcaaagtcttgggtgaagagacggtcaagggtggaggcagtgataaggaagggagagagggagataagtgaggctgcagagcgattatgcagtatatcccaccaacacctcgagagcgataccacgatacgaccctgcgaacaacgcgccgcggagatgcatcgaaactatctacacgaaacgacaatggcggaagacatcggaagggaacatgtccgcgaagagatacagcatccttgtcagcaagcaagcaatcgaatggggacagtaacgggaacaaatctcgcgtttgatgcacctatgatgct

SEQ ID NO: 20300 - DNA, 292 bp, Sorghum bicolor
  Clone ID: LIB5048-005-R1-XP2-B5
ctggggaggataataaggacttttcctgactttaaattgttgtgttggctaataacaagctagttcaacaaacagatttcaaaaatccacgagaaatgcgcatctttttgaaaaaaaaaaaatcgatttgaaggccggtaaccatgcatgtgaaaggaccttcctggtccgccccatgggccgtaccgtacattcctccaatatggcccaatctagtcaaatcgtcgcaaggcccatgtacatgcatgggctaataacatgcaagcctaatgtagcccaacaaccatttcgc

SEQ ID NO: 20301 - DNA, 781 bp, Sorghum bicolor
  Clone ID: LIB5048-005-R1-XP2-B6
ctggggacaagcgccaactaaccccacgacaacacagattgcaccaggagacccgacatcagcgtcttctgaacaaccgcaatcatgggtatctcacgagactctcgccacaagcgttccgcgtccggtgcgaagcgcgcatactaccgcaagaagagggctttcgagaagggccgccagcctgccaacacccgtattggcacaaagcgtgttcatcttgtccgcacccgtggcggcaaccgcaagttccgtgcccttcgtctcgaagccggtaacttctcctggggctccgagggcatcgccaagaagacccgtgtcatcggtgtcgtctaccacccctccaacaacgagctcgtccgtaccaacaccctgacccgctccgctatcgtccagatcgatgccgctcccttccgacaatggtacgaggcccactacggctcttcgctcggccgcaggaggcaggtcaaggccggtgagaaggaggaggacaagaagaagtccaactcggtcaccaagaagcaggccgaccgcttgaagaacggaggaaagattgagaacgctgttgagaagcagttcgaggccggtcgtctgtacgccgctgtctcttcccgtcccggccagagcggtcgctgcgacggctacgtcctcgagggtgaggagcttgctttctaccagcgtctcctcaggaagtagaggtgatatttggggcttcttcggtgcattggtcaggtcaaaatggtggttagtcatgtatctgggctgcatagtcgccggacactga

SEQ ID NO: 20302 - DNA, 291 bp, Sorghum bicolor
  Clone ID: LIB5048-005-R1-XP2-B7
ctggggcgtgcagcccctggcaggctctcccttctccggctctcccggccgccaccatcgccgccatgcctttccgattcgagttcccatggctcaagaatcccaacacgacggccggtacctccaaccgagacactaaccctagcccccgcttcccgaaccccttcctccccatccaagcccacgtcacctccttcctctcctccctcccccaggaccccccaccaccacgacggcgagggcgagccccacgacgcggaggtcgcgacgccccgggaggggcagcctctg

SEQ ID NO: 20303 - DNA, 333 bp, Sorghum bicolor
  Clone ID: LIB5048-005-R1-XP2-A3
tcgggctcgcctgcaccgcacttcttcgccccttctcccgggaggtggggatcagtctgggcgcactgtcggccgccccggaggccctcaacaagaccctgagcactcccggaggcggacacatcatcggtctggtggtggggggcgccgccgaggcgctgctctcgcgccccgacaagtaccgcatcctcatcaagaagaggaaaggcttctgcaagatggcactcaggcacgggtctccgctggtgccagttttctcctttgcggagcacgtgctgtaccaccaggcgcagagcgagcccaactcgcggttcttccacttccagaagatgc

SEQ ID NO: 20304 - DNA, 507 bp, Sorghum bicolor
  Clone ID: LIB5048-005-R1-XP2-A4
tcgggatccgactactcacacaagcagtcaagatgccgtcccagaagtctttccgcaccaagcagaagcttgcgcgcgcgcagaagcagaaccgccccatccctcagtggattcgtctgaggaccggcaacaccatcaggtacaacgccaagcgacgacactggcgcaagacccgtctcggtatctaagcgtatcgcccccgacaaaccatccctcactcgattctcgattcccaatcaccacttgttcctgcaacgacaatcttctctacacgaaacgagcgattacattgggaatttcgcacatggcgggaaccgagcgaccagtcttctaagcgaagtacatctgcaaacgagggatgctatgggtggtatttcttttcacgttaccggatacctacctacctctcattcatggcgctttgggtctgtaaatgggaatgaagggaatcgattcatgatggtttagatcctaggcagtgatgaatgaaagcacatgctgggtcgc

SEQ ID NO: 20305 - DNA, 590 bp, Sorghum bicolor
  Clone ID: LIB5048-005-R1-XP2-A10
tctcgatatccggagccgtaagcgtaagcgataggaaataaggcgtgcaccatggtgaacgtacgcacgggacagagctgcaggctctacgtcatggtgaaccatcctcggatagctcacgctcaagtccaaccactaccagaccacgtgctctcgcgcactatcgactgccggtcgaacaccaccgcacgcacttctcgtggtacgctgccaagcgcatgtcggacatctacaaggccaagaccaaaaccactcacaccctctacaggagcatctgtggcaaggtcacccgatctcacggcaactcccctctcgaccgtgccaagttccattccaacctcccgcctgagtccatgaggccctagggcacattgttcatgtaccctagcatgatctaatgacttattggagtacagataggactaagagtggccatgcttatttcttacttttctctgagcttacaatgccatgcgatggcaagttagattgttcaatgactgaacctgtggaagtactgccaaaatttgttgtcaaacggatgaactattgtcataatgttatgccatcatcatatctcattttgctca

SEQ ID NO: 20306 - DNA, 294 bp, Sorghum bicolor
  Clone ID: LIB5048-004-R1-XP1-H6
ccgggtttagaaatcctaattattcttgattatggattgaaaagggatgttatgacttgaatgtgtaaaagaaacagtatattgataaagagactgtattccaaagtcaaaagagcgattggcctgcaaaaataaaagatttgttcttgtttgttttgtaattagaacaaacataaactaattagatagaaaaggagcggaaaaagttctatggattagactccctttctttcctgggtttgtattatgcaacaccttgttctgaccatattgcactatgtatcatcatttgac

SEQ ID NO: 20307 - DNA, 566 bp, Sorghum bicolor
  Clone ID: LIB5048-004-R1-XP1-H8
ccgggccaacaccaatctatatcttcagtacacaactgcacgcagtattccacaatgactctcatcagtctcagggcaagcaggctaggcttggtgctgatgctgtgcttcgcctctctcctcctcctctcgtcgtcaacccacggagcgcatgcaggagggaggaggatgatgtccacaggcacaatcatctgtggccagtggtcttgccaggtgtggccgaggccgaggcccccgacgacgatcccaccatcatacggcccgccgcgaccaccatcatacggtggcccgccgcgaacgccgtagtttcctgcaccggcggatcgtcggagagtgcctgcgtcatgcgtatatgcacgtacctatacaagtaaataaaatgatcggaaatcagcattatattgtgcttgtttcaatgcacacacacacacccgtgcgcgcttggcagcagattggcctatgctattgtaaccaaatcattatatatactagctagcatatacgtatccgcgtcttgcaacaaagagaacatttataataatatacgtgatgtttgtgcctgtgat

SEQ ID NO: 20308 - DNA, 329 bp, Sorghum bicolor
  Clone ID: LIB5048-004-R1-XP1-G9
ccgggaacctaccaatatgagagagaagtggagaaagaagcgaatgaggaagctcagacgaagaagaagaaagttgagagcaagatccaagtaattggatcgctgctcgttaactatctctaaaccgctctgcaacttttgaaccgactcgacaatcttatctgatatatccttcgaaataggcgtatccactgtcaatcaatgcgactgttcgatcatgtcttttggagtggtatttggatgtagggtggatggaacgatttgaagggaaaggacggggaagaggtagtacaacgcttcgattaaactatgaatcaaccgtgaaggcg

SEQ ID NO: 20309 - DNA, 171 bp, Sorghum bicolor
  Clone ID: LIB5048-004-R1-XP1-E4
ccgggatccccagtgtagccgcgcacagtctctccctctcctcgctggtccggggaaaagcgccccccccatcacttgataatctttctcacggggacatggggggttctttcgctaacgtcaactctgacgcatggctgaaaaagcttgatgagcaccttttggctcgca

SEQ ID NO: 20310 - DNA, 489 bp, Sorghum bicolor
  Clone ID: LIB5048-004-R1-XP1-E7
ccgggccgacgactccgacctgtggcaggcgtccgtgaggcacgtcgcgcacgagggcgggtgcttcctcctgtccgccaaccagttctgccgcaggaaggactacccgcccccgcccgagtacgccttcaccgggttcgacgaggagcccaagccggacgacgtcctctgccgcgggggcagcgtcatcgtctcgccgtccggcgccgtcctcgcaggaccaaagtacgacggcgagggactcctcacggtcgatctagatttcagtgaaatcgttcgggccaagttcgacttcgacgtcgtggggcattcctcgcgcccggaggtgttgacgttggtcgtcaaggaccagccgcaggtccctgtggtctacacttccgcttctccaaattaaaggcgcgctgcatcgtctgtataactagcaaacagtatgacatcatgttgtatggtcatatagatcgagctagttatcatgttcatgattcaacc

SEQ ID NO: 20311 - DNA, 462 bp, Sorghum bicolor
  Clone ID: LIB5048-004-R1-XP1-E9
ccggaaggagactacagttttattatatgattagtattttttaagcttctcgcgcaacagtcgccacacagtacactctcacaggcaggcaggcagctagctagcttagctataatggagcatcatcatcatcaggagctggaccttgagctcagcctccagcccttctcggcggatgcggcggcggcggcggatgaccctcccggcttcttcgtctgcacctactgcgaccgcaagttctacagctcgcaggcgctcggcggccaccagaacgcgcacaagtacgagcgcaccctcgccaagcgccgccgggagatcgccgccgccatgcgcgcgcacggcgcccggcaggtcgacgccgccgccgcatccacctgcagcaggccaggcggggaccgagcgcccgcggtgcagtctgccgccgccttgctgcgcggcaagagcagctctctggagcgcggc

SEQ ID NO: 20312 - DNA, 653 bp, Sorghum bicolor
  Clone ID: LIB5048-004-R1-XP1-C8
ccgggaattctcttacgctgatactaaaaagtaacgaccatggtcgacgctgttaagaagcccaaggatgccaaggcgttcatgaccgacttccttatgggaggagtgtctgccgccgtcaccaagactgctgccgctcccattgagcgaatcaagctcttggtccataaccaggatgagatgatcaagcaggttccacttgctaccccttacaaggctattggtgactgcttctcgcgagtctacgccgaggagggccttgcctccctctgacgtaggaaacaccgccaacgtcatccgatacttccccacccagactcttaactttgccttccaggactacttcaagtgcctgttcgaattcaacaactctgaggactactgaaagcgtgtcaccgaaaacatcgcttccgtggctgacgccgttgcctcgacgctcttcttcgtctactcgctcgactacgacctaacccgtcttgacaacgactacaaggctgtcaccaagggtggatcccgacagctcaacggtctcatcgacgactaccgaaagaccctcgcctccgacggtattgacgttctctaccgaggtatcgtcccgtccgatgatgctatcgttgtctaccgaggactctactgccgactctacgactcga

SEQ ID NO: 20313 - DNA, 649 bp, Sorghum bicolor
  unsure (1)..(649): unsure at all n locations
  Clone ID: LIB5048-004-R1-XP1-D11
ccgggagtcttactatcgctacaaaccaaattcaaaatggcgacagatgacattacgatcccacaacacgtggccatcgcagaggcaccccgcgatgtcgaagccatcaagaagcaagagaaggctgctctactctcacattgggattctgatgttgcgttcaagctcggttgcaacctccgcacacgcctgcttacctttgagcgaccagcggttgtagatatctctaccatcagtacaccaggccatgtgcttttccacgccacaacacactccggcaccgccctagataacgacttctgggtcagccggaaacgcgcagctgtcatccgcttcaacgcgagtacatggcgtctgcagaaccaatttgagggcgatgaggagaagttcaaggccaagatgggactcggcgagacggcgaaggacgatgcaatccatggtggcggtgtgcccatcttcatcaagaactgtgatggacccgtcgcggtagttgttgtaagtggattgaagcagtgggatgaccaccaagtcgtgattgaggagctgggtaagctttgcaaagagatggagaaaggaaatggcagtacgccaatctaggaaattgacgcctatataagtatcttcaatcatgactgacttctccacttnc

SEQ ID NO: 20314 - DNA, 561 bp, Sorghum bicolor
  Clone ID: LIB5048-004-R1-XP1-B5
ccgggattctgtggccatctttcttttgcagtcttctctaaagctgttgtcgaataaaaactaatcaatcaaaatgcaatttcacattcgcggaaacaaatgccacgtcttggacgttgaacaacatgaaaccgtcgccgaaatcaagaacaaagttgccgttttggaacaagttgatgctgctgagttcacattatcatgtgaaggcactattttggatttattcaccccagctagtgcattgagcagcttcgaattggacatgaacgttccattattgggaggtaaagtgcacggttcattggctcgtgccggtaaagtcaagggacaaacaccaaaagtcgaaaaacaagaaaagaaaaagaagaagaccggccgtgccaagagacgtatccaatataaccgacgatttgtcaatgttgtccaaggattcggtcgtcgtcgcggtccaaactcgaacagcgcataaattttgaattctggcaacattcgatgatggagaaaaaaatttgaattttttaaaaacatttatgtgcattcaataaacatcttctgtttttg

SEQ ID NO: 20315 - DNA, 190 bp, Sorghum bicolor
  Clone ID: LIB5048-004-R1-XP1-B2
ccgggaagattgcatctccatcctgatcgatcgattgattattagtggagcttcattccattccatcagttcctttggcggacgatgtcatgctgcagaggcaactgcggatgcggctccggctgcagtgcggcacggctgcgagggtgcaagaggaccggacatgctgagcagcaagggaccaccaccg

SEQ ID NO: 20316 - DNA, 429 bp, Sorghum bicolor
  Clone ID: LIB5048-004-R1-XP1-A11
tcgggacagcaacttcacatcacatcacaacactcaacaaacactacaaaacactttccaccacgtcgatcaacatgtctgactacaagcccactgagcacgacggtctccgtcaggacggccagcccgacaagcgcgtcggcaccggcgagttcgcaggcggcaaggtcgatccccatgaggccggcaagaagggtggccagactggcggctcggccggtggtgcttccagcggcggctccagcggtggcagctctggaggcaatggccagtttgctggtggaaaggtcgaccctgttgaggctggccgcaagggtggtcagtcctccaactaagtctgatggaattcattcaacggcggttcgagctgagaacacgctcgctgcatagttgatagttgaatgcatgaattatgaatctatcacaacc

SEQ ID NO: 20317 - DNA, 527 bp, Sorghum bicolor
  Clone ID: LIB5048-003-R1-XP2-E4
ttggagagtattctctttcgtgccggacttctgccaccacctccaatgctagctatggcacggaagggtgggccacgcgataggcgccccattcatccaatgactgggcgccccttggatctcgagggcgtcacaattgtcgatgactccaatgctcctgaaggcgacgctgaagagcctacagatgaggtggcttcataagcctcttatattagcatatgaaaatatgatgtattttctatttagcatatgtagtggtgctgcaaaagaaaacttgtttgttgtgcttctgacaagacttgagtactagtacaatgtggcaaaacttttagacaggtaatctttcatccgattttcttctaaaaaatggcagtgccattgtttgttctcatagaaaatgtaaaaccaatgccattgtatgcatctttagcttttgttctgcagcaccatcagcttgtggtctctagtattctctgcgctttttgaaagaaaaagggcaggagctctgccttgcatttaagttctct

SEQ ID NO: 20318 - DNA, 643 bp, Sorghum bicolor
  Clone ID: LIB5048-003-R1-XP2-F11
ctgggcttttagcaatatgtgcggatagccgccgaggataggctacttggaatgaaggaaggtgtgatccctgtgctggtggacttgccgacgaacggaatcgaagaggcgaaaaactgctcgacgaagctacttcatcttctccgagacatgaggcgaagcgaccagttcactaactcatgctcacaagaagtggctgccacaggaacggtagaggatgctcccaacaactcagttcacaagcagccggtgtcaaagtcgtccaggtttttccaaagaaagctgaacatcttctcaaaaccccggtcactcacgctgttctgagaaccggatttaagtttgttggagttggtagtccattttagtgggaagcgagtagtccttgactccttgtacatgctacaaaactaaccaccttctctatagatggtagcgcttgtattgtcccgaatgagatgcttgatgagatgatagtttttcatcctcatgtatttcagtatagcttgtttagttgctatagcactgttctttgtgttaaagtcagtcagtagatacatctcttttctctttggcagaaggtctgccgttttgtgttctcttgttcccaagatacctttaaagcctgaatagaagcttgtttttt

SEQ ID NO: 20319 - DNA, 684 bp, Sorghum bicolor
  Clone ID: LIB5048-003-R1-XP2-D6
ttttcggaacaaccacatcaccagcatccatcgacgtccatcaccagctcataccaccttcatcacccacctctaacccacatccaaaaaccgcgtcaaacgacccaaatctctcgaaatggctcccaagcaggcacagaagactcccaccaccgccggcaaggcccctgccggcaaggctcccgctgagaagaaggaggccggcaagaagaccgccgccgtctccggtgacaagaagaagcgcaccaagacccgcaaggagacgtactcttcctacatctacaaggtcctcaagcaggtccaccccgacactggtatctccaaccgtgccatgtccatcctgaactccttcgtcaacgacatcttcgagcgcgtcgcaactgaggcctccaagctcgctgcctacaacaagaagtccaccatctcttcccgtgagatccagacctccgtccgcctcatccttcccggtgagcttgccaagcacgccgtgtctgagggcaccaaggccgtcaccaagtactcctcttccaccaagtaagcgcatcgtcatgatgtctttgcttttgggtagtacttcaatcacaatcacatgatgaagggcggggtttcaaatgggcgttgcgcgcaatgaatgcgatcaatcggggtgttatgtttttgggtttccacacaccagggggcttt

SEQ ID NO: 20320 - DNA, 565 bp, Sorghum bicolor
  Clone ID: LIB5048-003-R1-XP2-E10
ctgggattgtttataccacgatcggggacgtctgcctgtacattgttggcaaggatgaatatgatgagcttgctttggccgaggtgatttttgcagttacatcagcagtcaaggatgtttgcggaaaacctcctactgagcgcctcttccttgacaaatatgggaggatctgcttgtgcctcgatgagattgtttggcagggtttgctcgaaaacacagagaaagacagagtgcggaggttgattagactaaagcctcctgttgagccatgaattgcatgtaaagcatttgttgtgtgtcgctgtaatccaaattgaatctcatttacatttgtaggcaaattttcagagtttccatctgcactttgtatctacaaaatcatcatcacttatttgaggattgcgtgcgtgacatcaaaaatagtgtatcatctgtgtacttgctgtgttcatgagcatgttactgctttgtattttatgctactgctgcagatgctcccgggatatgcataccccttttatagctgatatgggattttttataattgagatgagtttatcttgag

SEQ ID NO: 20321 - DNA, 502 bp, Sorghum bicolor
  Clone ID: LIB5048-003-R1-XP2-E2
ttcgcggaaaccttcccttctcccgcaaactccacaccactcaaccaaacaagaaaacccgacgacgctgcttcctcaggccagcaggggaccgagatgggtggatcccgccgaagatgcccaaaaccaatgcgaacttcatgaaaatccaagagccccccggagaacgcgagctgatattacacattacagggccaggataacgctcgtctactgcacaaccacaatcaccccacagccaagtacaatatcttggtgtgtccattcaccaactcggatatcactgcacaactcatcacccctaggatagcccaagatataggccttgcttctgcccactcccatgcagttgccacgatatggacgttgaagtgcgaactgaacaactatgcacctggctactgcactggtcttctgttgggtaaacgtgagctctatatccgcggttaggatcacgaggataatgtcaatgatgaggccactgttgaagacttctctgctg

SEQ ID NO: 20322 - DNA, 641 bp, Sorghum bicolor
  Clone ID: LIB5048-003-R1-XP2-D10
gcttcgggaaaataaaaatatttatataagtttcagtaaaatataaaaaaataaattatttaaacactgataaggaataaaaaatttaataaagaattttttaaaaattgttccttgtgtatcatgatttaaagaaataaaaaaatatttttatatctcgaaaaaagaagatctagaagattttaagttttatgttacattataataaaaaaaaaattcttgaagtgaaatacctccaattctattgatatctagttattttagaaaagaattaaatttaatttaaataaagagcaatatttaaaagaaaaatttaagggattaactttaaattttataaaaatttttttttaaaaaaatttcaaaaaaaggaattaaattaattttaaatgtaaaaatttaaattgaaaaaaaaaaatttcataattttttatttatataaaataaattttaaacaaaaaagaaataataaaattttaaaattagtaaatatataaaaaaatgtaaagaacttggcaaaaagattttcgaatgtttaacaaaaacattgtttcaagaatttattagaaataaagcctgctccagtgaagattaaacagcaagataaaggaaggtagcataataccttgtcttttaattga

SEQ ID NO: 20323 - DNA, 774 bp, Sorghum bicolor
  unsure (1)..(774): unsure at all n locations
  Clone ID: LIB5048-003-R1-XP2-D11
tcgggagtcgtgttcagcacattcaacaaccttctccaaaacccaatctctcagaaacttcgccaccatgcctaaggagaagaccaccacccgcactaagcgtgccaccaagaccgagggcggtcgcaagaagaaggaccccaaccagccgaagcgcggtctctctgcctacatgttcttcgccaacgagcagcgcgacaaggtccgcgaggacaaccccggcatcaagttcggcgaggtcggcaagaagctgggtgaacagtggaagaacttgtccgacaagcagaaggagccgtacgacgccaaggctaaggccgacaagcagcgctacgaagaggagaaggctgcctacaccgccggcggcgtcgatgacgacgaggacgaggagtaagcgcttctgcgcaacaactctctccacctgacagcgtctgttttcttttgctttctgtgtttcatcatngctagctcggggttttttttctaaaggaaagggaacaacggatgatcgcctcattttgaaagcaacatcttcaaacggcgcatcgatctcccaagggcaaacgacatgataccaaatcggtttttactaaatgcgcgccggaccacctcttgatggctctgccatcgggacctgtgtgtctgagcttgttgtgcgcatgagccctgtttcctgactgaaaagggttggttattcgcggagtgtaccatagtgggcgcgaatgcagtatttcctaaagcaactccctcgtcgaaaaaaaaaaaaaaaaagcccct

SEQ ID NO: 20324 - DNA, 726 bp, Sorghum bicolor
  Clone ID: LIB5048-003-R1-XP2-B5
tcgggatcaccgtctcgccctcaccgatcgatcattggattattgtctacctttccatcattccctctggtccattatggcaggatgccgagctaactgcgcaacgggctccgcctgtccgggtgcaagcgcctgcgcaggtggcaagatggacccatacacccctgcatggctgatgaccaccagccccccaactcccagactctctgcctgaccgtcgcaccatcggcccaccgacaccccgatcgaggcgtcgacccgccccgcagctccgaaccacagaaccaagggcgcacccgactgcccatgtgacccctgcacccctgaaccagctggagaactgccccctagcccgctgtgctgccctgcagaccgacggaatcacttactcccctaactacaatatcagcgccgtcactgcggtgtgagtcgtgcatgcatccgacagccatgccaccgtctggtaacgatatgcgtaacggatgtggaactgtagtaaaccaactgtaattgtgctgggcatgtgtcgttccgccgctcctcccgtggtccttctactactcatctactatcgagctgtggtgtgttgggtgattgcagcaccacagcaggacatgaccactgcatcgcccctgctctgatggcacgccgactctgtgcgactctgtcaccatccagccatcatccataaaatccccagactatccccccgtctttgaataaaaa

SEQ ID NO: 20325 - DNA, 782 bp, Sorghum bicolor
  Clone ID: LIB5048-003-R1-XP2-B1
tcgggcttcccatcaacacatctcacatctcacacacattcacaatggttaagcaaaaagtctgcctcgcctactccggcggtctcgataccagctgcatcctccgctaccttctcgatgagggctacgaggtcatctgcttcatggccgatgttggtcaggaggaggactttgaggctgccaaggagaaagccctgaagatcggtgccagcaagtgctacatcgaggacatcaggaaggagttcgtcgaggagctctgcttcccggccattgcttgcaacgccatctacgagaacacatacctcctcggcacctccctcgcccgccccgtcatcgcccgtgcccagatcgccgtcgcccagaaggagggctgctccgccgtctcccacggctgcactggcaagggcaacgaccaggtccgcttcgagctggccttctacgctctccagcccagcatcaaggtcatcgcaccctggagagaccccgtcttctacaaccgcttcaagggccgcaacgacctcctcgactacgccgccgagaagggcatccccgtccccagcaccaagagcaagccaaggagcatggacgagaacatggcacactgccgctacgaggccggcatcctcgaggaccccaacgtcactcctcccgaggaaatgtggaagttgaccgtcgaccccaccaaggcacccgacgcccctgaggacttcaccgtccacttccagaagggtctccccgtcaagctcgactacgagaacggcaagagcgtcaccgagcccgtc

SEQ ID NO: 20326 - DNA, 685 bp, Sorghum bicolor
  unsure (1)..(685): unsure at all n locations
  Clone ID: LIB5048-002-R1-XP1-H5
ccggggattaccagctgcttgcgttcaccatcgttccacctttgtccatccacagcgtcttttgcatcgacttataactcagcccggtctctacggctcagcacccgcgcagcactcactcgcaaacgcacacaacaccccagcgcttgttttcgagccttctcaacgtactttcgcctcacccacattcgtcaacatggccctcgactcacatccgacggggacagccgatcttcttcggtctgctctgcttcttcgccttcattgagggctgtatcacttcgtggttggtctcgcagtacaaccgacacgacaactacccgtctggctccgcccgggacaggctccgcttcctcgtgttcgtctcgtggtggaccttcctcttcaccgccgtctacatcggcgccttcctcaccagcgccctctcgttcctcacctcgatcgcctcgcacgctgcctggctcatcctgacatggatcttctggacggccggagccgcgtcgctcacggcggcgtacgacggcggacagaactgctccaactcgtcccttgtctactgcaaccagaacatggctgccgaggcgtttgcctggattgaatggatcatcatcaccgtcgcgactgtgtttatccttctcattggaggcgcgngcatccgacgagggtgacggctgactggctcgct

SEQ ID NO: 20327 - DNA, 544 bp, Sorghum bicolor
  Clone ID: LIB5048-002-R1-XP1-H7
ccgggatgtactaacaattgctcacttgtattccgatgctcactacaccaactatgaggctcctcaaaaccatcctgaatagcaaattccactagattgaacgtccactgacatagggtcgcgctcgttgagtcatttacgtgatcctcaagtgacctggcaaatactgctgatacaaagacaatgccctgctgtgtgcccaagtacgaatacccgcggtaccatttcgtcactgaggtcttccaagcttccacgaagtaccttaacaagcactatagctcgcgtgagtcaggaacggtgacctctctctcaatgttagaaagctgaatctggactcgacatacaacatctgccactactgtaccaagccttggcgcgcttcaactgcaggagggtactgaggaataacttgctgggcatcgactacggacgtctgctcgtgcctcatccatgtgaacgacttcagcgtcatgctcaagctcatgaagctggccgacatgatccgtgccctcgacgaccaatccatcctgccgaactacgagat

SEQ ID NO: 20328 - DNA, 665 bp, Sorghum bicolor
  Clone ID: LIB5048-003-R1-XP2-A12
ctccggtgcactagctctatgtgtcgttgcgtgatctatgtacggtgtgtatggtactcatgcgtggcagcctgcctgcctcggcttgcatagcctagctcctccggccgtgccatgcatgggtgctgtggatgttaatttgctccagtgaaattgacagtataatgcttgaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagttttgcaacgtcaaccgaaattgcaacggccgcgtcaatttcgggaaatttaaaaacatgatgcaggggcatccccgtggggggggtttagttgaagaactccttcgttgccaccccctcaactggggggtttcatgttctggagcatcaaaaaactaaaaactggggccaggttaaaatgaacaaagggttctgtaaattttgaaccttggagtaagggatgttgggggccctacgggggccaaaatgcaggggatgacttgggatttcagggcgttcaaaattctaaaactttgggggttctgcccccaagggaaaaaattctgcttctgaacgaagggccttccttgctcaaaaaaactctcggaacacaaaacatccagtttatctatcg

SEQ ID NO: 20329 - DNA, 650 bp, Sorghum bicolor
  unsure (1)..(650): unsure at all n locations
  Clone ID: LIB5048-002-R1-XP1-H11
ccgggctaacctcccactctctctctcccagccatcctctcgtgcattcacccaccctcaagtgaaagcccaactctccctccctctgtctctcgtgtgcgtggatcgagcacgggggctccttcgacggcgcgcccctctagcagcggcgcgagtgcgactgcacatagccggtgtagcaaggcggcatggcgacgggcggcggcccacgttcctgcggtcgcagcgcggggctggagtctggtggccggatcgacatgccccacagcacctccggcggcgctgaggctagatccgccgtcgatgaactcggcagccagggatccgtcagctgcatcacgaaggtgggaggtaatagcttgaggtggccatgncaggaagcagttggctgaagtgtgcatgactagtgcattattttgtacatcctaactagagatgaatgcttttgttaagacttaagttatgaatcattttgtaatgagtgcaagcaaaccatgagatgtgtgctgtgcaactagttcaagcatctatgcgctatgcatatatcttgatggccaaaccgtacgtatgccatgtaacttatttgtgcaagttgtggaaaaaacacaagacaaatgtttatggatataatataattgtgagctatgact

SEQ ID NO: 20330 - DNA, 482 bp, Sorghum bicolor
  Clone ID: LIB5048-002-R1-XP1-H3
ccgggggagagcagagcagcagatcgagatcgacccatggatgcttcggccctcaacaacccgcgcctcaaggcgatgatcgaggaggagagaacaaaggccatggcaaacgagctgttggcaaagctgacttttctttgctgggacaaatgcgtcaccgggagcgtcgggagcagcttcagcaggagcgagacctcgtgcctgtccaactgcgcaaaacgcttcgctgaagtgaagatgatgaccatgcaacgcttcactggccgcagctgaagtcacacacatgtacacataggcatttctctgcatcgacggaacaatgtttagtatcctctggaatgtccaaatgttgtacctgtcttctgaattctgaagctccgatgcagtacgagttttgttatttttatctttatattatcattgcctcgttcgagaggtggtaaaaagatatttcagtgttcaaaatgacctgtttgtttatt

SEQ ID NO: 20331 - DNA, 639 bp, Sorghum bicolor
  unsure (1)..(639): unsure at all n locations
  Clone ID: LIB5048-002-R1-XP1-D6
ccgggattcgacataccagcagccattgaacgccgcaactatgctgccactccgctgcgctcggtcgccagtggcgctgtcggcgcaaatgcccttgaagcgtgtcgccaacctgtccacctccgtctgccgacaacaactcaactcggacgtcaggataactaggactggaaagccgattctgactgtctccggtggacgatcctcgctcggaggatataccgcgactgttttcggagccactggattcctaggacgatacattgtgaaccgattggcccgttcaggatgtacagtggtagtccccttccgcgaggaaatggcaaagcgtcacttgaaggtcgccggagacttgggcagagtcatcttcgtcgagatggacctccgaaacactgcatctatcgaagagagcgtgcgacactctgacattgtctacaacctcattggtcgcgactaccccaccaagaactttgacctggaggacgtacacgtccacggcacagagcgcatcgtggatgctgtcgccaagtacgacattgacagatttgttcatgtctcatctcacagcgcacgcttggattcaccatccgagttctaccgcacncaggctcagggtgagcaagtagcacgctccatcta

SEQ ID NO: 20332 - DNA, 711 bp, Sorghum bicolor
  unsure (1)..(711): unsure at all n locations
  Clone ID: LIB5048-002-R1-XP1-C6
ccggggtacgcgcctactgtgcaccgttacctcgtcggaggcggaaaacattctcgccacccgccgccgtgcgacgccgccgtatcccgtaggtaacccaacccaccttctcaccgcgagagccgaggtagccgtggcgagatgtccatcccaactcatctccctccccgcacccaatctccattccactcgcctgcctctgccgctgccgctgccgccgccgcgcgcctgacggccgaattggctccaccgcgctaccaggatgccgaccggcttctttcgcttcgaccaggcgatacattggtcactcagtccgttgactcatagtctcatacaagctgttcaaggccaacataattgtagctgagtgcagataatagtcatttctgaagcaaactgatgtgataaggtgaattgaaggcaagtgcaagttttcaagatttttctttgatatctatccatattgataattgaaatggatgtttagttatctggacctcagtgaaatcctgttcgctgggaaagttggcacacccaaaactgttggctggcaacccttttccaggttactagatttgcaaaaaggttctggctaattgtcttctgcgtccaccaaccacggagactcacacactgagtgggtgggctaaacattctccctttcccaattnggngtcgcactcaatccctctatgatcctaggtcctacca

SEQ ID NO: 20333 - DNA, 532 bp, Sorghum bicolor
  unsure (1)..(532): unsure at all n locations
  Clone ID: LIB5048-002-R1-XP1-C8
ccgggacatttcaagataggtgtgatccttgatccaattggcataggaatttaactntgagaacaaaaatcaacatttcgtcaaatgaatgacactgatttattgtatagcgggcacttattttacttgccctatacgtcttcattgttcatagatgtgacatggattacttgtttcgctttttttagggctttgggatattttctctatcttttcattcatttcatttacatttcttgtctgctgggtgtcgtgtgaaaatgtgatgaaagaaattacttatttggtgaggtagatgaaatatgttttttgaacttctgggattcaatatattgcatgtttaatataacactatgcagcactaaggaaatttgttttctggtgctgctattaattttgcattggtacagttatataatacaattggataatagtatagctgttatttgatcaattattctccagttctctattttgtggatggttattggnacattttgatanaaatttaaagaaaactcccttcaaagct

SEQ ID NO: 20334 - DNA, 527 bp, Sorghum bicolor
  Clone ID: LIB5048-002-R1-XP1-D11
ccgggacgcccatcacccgccatcccaccgcccacaccacattcgccgccatgttctcccagtcgctcatgagggcctcgcgccaatcgctcgcccgtgtcgcccgccagcagactaccaccatgcgccgtaacttcgccgtctcggccgtcgtcaaggccgacctcgtccaggacatgtacctcaaggagctcaaggcctacaaggcacccgccgtcaaggcctccgacgctgagggccacgttcagaagttcgccctccccaaggctcccccttctcccgaggaggccgacattgccagcgagctcaaggcctacgagagccaggaacccgaggttgagggccagtctggtgaggctggtgcggcgcccgcagagcaggactggttcgaggagcccgctgaggaggaggagggctctgctgctcactaagcggctgggttgcaagatgtgtgagagagacgaggtaaaacatattagcgaaccgtttgtacagtatggcaatacgatgaggaagttgtgttgagg

SEQ ID NO: 20335 - DNA, 662 bp, Sorghum bicolor
  unsure (1)..(662): unsure at all n locations
  Clone ID: LIB5048-002-R1-XP1-D12
cctggtggtgttaaggnatcttgagaaatacgacaaggatggcatcattgataagacgagtggtgttcatggacttggtcgctctgttggaaaatttctggatggaagatttactgtcttttgtcttgaaaacttgaggccattttctggtgatattaacattggcgatccgcagagaaaacttattttacatagaccaaggttacctggaggggagtctcctcctggttttctggattttgcagtaaatatgatccatctggaccgagcacacttgagttgcctcacagccagtggccatggtcttagggaaactttgttttatactttgttttcccatttacaagtttataagactagagctgacattcaaagtgctcttcctcttataaaagatggtgctgtttctctagatggtggtatactgagacccaatggctcattctgccttggcgatagcaaaaatcttgaagtgagatttcctgtaaacattgaggtttcaagtttacctgaaaatatcgctgaaatggaggagcaagttaaacttaagaattgngagaaggaaagggttcttgaagatatgaaaagggaggaggatttgctgaaacaagttaaggaatatacaggaagcagaaccagagctcatggattatctcactcat

SEQ ID NO: 20336 - DNA, 625 bp, Sorghum bicolor
  unsure (1)..(625): unsure at all n locations
  Clone ID: LIB5048-002-R1-XP1-C4
ccgggagcattttgttaccagtgactcattgaggcagtgaccaaccaaaccaaccaactgaagagaccacgagacgcgacaaatatcgtgtgcagtccgtgcctgtgagactggccgctgattttcctgaggcaattaggcataaccctgcaacgacagcctatattcctcaagaatttccttccgcgaaaggcatcgctgcaagcaacgttttctcgcgtcggcgtcccgttccggcgctccccgcccgcgccaccgtgtccgacaggaaatatcccgcaacggacggccggccgcgacgcaaaggcggcgagggggggcccggcgtccggtgtccggttcggccctgccgaagatctcccgcaccgaatcagctgcaagctttccgctgcgaattcgacggtcgaaacgggctcctaggctggggaaaagaggccccgcgctcggggggggaaggagaagaccagtccttgcaatgatcgatcgacggtgcacccgggggcgcctgggccacaccgagacgtacgccagcagcgacagggtgagtgtcccgctgggggcctagnccagccggagcaagctgcaaaactagggagtgcaagttgcatcgccatcactggcgcgc

SEQ ID NO: 20337 - DNA, 747 bp, Sorghum bicolor
  unsure (1)..(747): unsure at all n locations
  Clone ID: LIB5048-002-R1-XP1-A8
ccggactagcaggcatcaacttctcagttctcacaggcaaagagaagtctcctagcatcagagcagatttgtagatagacctccaaggctccaagcaatggagagtttcacccagaagcacgtcattggaattccattgacttcgtttgcatacgccgatgaggaaagacaaggaaaaccttcctgttccaccatggttcataaaaaaaataagaagagttccttcatttatcggatgaacaaactgagcgataaaacagataactacatgcaagggttcaaagaacacttaactctgggaccaaaaatttcagaaactataaaagggaaactaagcttcggtgcaaaggttctccaagctggcggtattgataaagtcttcagagaatacttttctgttgagaaagatgagaaactactgaaggctttccagtgctatctttcaaccacagctggtccaatagctggaatgcttttcatctcaactaagaagattgctttccatagtgataggcctttgaatttcatgtctcccaaaggaggcagtacaaaggtgccatacaaggtgttgatccccacaaagaggataaagagtgcttcagtgcgggaaaatttatacaatccagacgagaagtatattgatgtagttactgttgatggctttgatttttggttcatgggctttgtcagctatgagaagtcattcaatatcttcagcatgtaattccngagctgagatgatgcaca

SEQ ID NO: 20338 - DNA, 316 bp, Sorghum bicolor
  unsure (1)..(316): unsure at all n locations
  Clone ID: LIB5048-002-R1-XP1-B1
ccgggatcgcagcaaggagcacactccttcagtaacaaagatcacctgcttttccttcgcctgtgatcattcaccgaagatgtcttgctgcacggaactcgggtgcggctccggctgccctggcgcagcggttgcgcggctgcaagagtccctgacatggaaccccgccaccgtcggctgaagcccatggtgctcgctgcaccgaccaccaggccaccgccggcgggttcgaggcggccgtcgagggtggcggctgcgactgcaaccttcgcaggtgcgggagcagctgcngctgcagctgctgcagctgcaactg

SEQ ID NO: 20339 - DNA, 368 bp, Sorghum bicolor
  unsure (1)..(368): unsure at all n locations
  Clone ID: LIB5048-002-R1-XP1-B2
ccgggaagattgcatctccatcctgatcgatcgtttgattatntggcgagcttcattccattccatcagttcctttggcggaggatgtcgtgctgcggaggcactgcgggtgcggctccggctgcaagtggcggcagcggnctgcggaggngtgcaagatgtacccggacatgcctgagcagcagggtgaccaccaccggcaagactcccgtcatgggtgtcgcaccatcgtccaagggcacccgaggcgggttccagcgcggccggccccggggctgagnaacgacgggntgcaagtgcggccccaactgcagctgcaacccctggcactggcaagtgagctgtataataaccccctggactgcact

SEQ ID NO: 20340 - DNA, 539 bp, Sorghum bicolor
  Clone ID: LIB5048-001-R1-XP1-H8
ccgggactctgcttagtcaaaagtacctgtatcacttcgtcgcacccctcctcactttctcatcactacaagtttctacagcatcgcacatcaacccctcgcatacatgtcgtggtaagaatacgttgacacacagcctcgtcggcaccggcaagatcgacaaggccctcatctgcgacgacgagggcgcaactgtctgtgtcgcatacgacgacttctcggtgtccgatgaggagagggctgacgtcaccagggctttcggtgactaggcagagcccaagaatgctatctcgtagggtgtcgaggtcaatggcgtaaaatacttgaccatctagggaagcgatgactcgctcaaggcaaagaagggcaaagagggcgttgtcgccttcaagaccacccaaggcgtcatcatcgctcagcacctcgagaccattctgaccccgaacgccttcaactcagtagttgagatcggagagtacctgaagaaagacggaatgtaaagcgacttcgattcgagactgtctgtacgttagggatat

SEQ ID NO: 20341 - DNA, 681 bp, Sorghum bicolor
  unsure (1)..(681): unsure at all n locations
  Clone ID: LIB5048-002-R1-XP1-A3
ccgggcttctttgggtaactttcgtcgctgccaggtgaagtttcaattcagtatcaaggtttaaattaaaccacactaactaaaatagagatcgtgtaaattgcaaaacactggcaggaaatggatgcgttagaagtcttggttgtagccatcggcatcgccatggcaactgcggctacggattattgctcgatatgttcggatcatacgctgtgcctttaccaaaatgcatcatcgtcttgtcaaaacctaaccacacgtaatctgactaccagcgagcagtccagtgtcgttgccgctcataacaacgtccgcaatcagattgccagtggaagtgtgaccaacgggacaaacggggcgcagcccagtgccacgaacatgcactcactagtctgggacgatgagattgctgctatcgctcaacgatgggcaacgcagtgcaagtttgaacacgacacctgccggaacagtgccgacggtacctatgttggccagaatattcttatcacaaccgacacatcgagttcgctaacttctatactagaagggagcgtgcaagcttggttcagcgaagtagcanaagtcaactcatcaactgtatctcagccctatgtctttcacgagaacacgggccactacacccagctggcgtgggcttcacgacacacgntggatgcgggt

SEQ ID NO: 20342 - DNA, 727 bp, Sorghum bicolor
  Clone ID: LIB5048-001-R1-XP1-F9
ccggggtccgtgtcgcatactcgcatcgcatcccacgcaacgcaatggcgtcgtctcctctcgcacccacccggacctactcgcccctagtgcccaagctgccccgcccctcgcccccatccccgtgtagctctcctcgtcgcagtgcacggtggccgcgctcggcgcgagccagagcgactcccggcagcaacagcagctcgacggcggcggcgacggaggagcagaagaggtgcctcagatgcggcggcgtttaccgagacgaggagaaccacccgaccgcctgcgccttccatggccacatcacaggcgagaagggtctgttctccatgtcgccgccgcaccagggcatcgacggcgagtggagcgacaagagcgggatcatcgtgtaccgctggaacgacgaggggagccggcccaacaccggccgcgccaactggaagaagcgctggagctgctgccaggagcgcgaggaggacgcgccgccgtgccagcgcgggtggcacgtctcctacgacgacggctacaccctcttctaggtctctgctagtgcccgtgaagaccaccatattgccctgccagctgtgccaataaaatcttttgccactaagatgacaaacttgcttgtcgcctattacttggagttgaacaaaagacaagcatctagttgagctgatgatggtgggtgccccgacgctgaaaaaaaaaaaaaaaaaggccctagggg

SEQ ID NO: 20343 - DNA, 496 bp, Sorghum bicolor
  Clone ID: LIB5048-001-R1-XP1-G11
ccgggctccgtcggcggggagaagtgaaatgtcgtggagatgggcggcggcggcgagaaagctcgccggaatgccccagttgcgcactccaggagcctttaccggcggtcttctctaccgctcgttcggaagcgactccatcggaagccgcaagagctcgctaccacggagggtcctgtcgatcggggccatcagccttgctggcgggctcgtgctcagcgccgtcaacgacctcgccatcttcaatggatgcacaactaaggcaatcgagcatgctgctgacaaccctgcggttgtggaagcaattggagcgccgatagtcagaggaccgtggtacgagtcttctcttatggtgggccatcgacggagatctgtgtcatgcacattccccgtatctgggccacatggatcaggatttctccggattaaggtaacccgaaatggagaggatggtttgcttttgtttctgtggcatcaccactggggagatccttat

SEQ ID NO: 20344 - DNA, 121 bp, Sorghum bicolor
  unsure (1)..(121): unsure at all n locations
  Clone ID: LIB5048-001-R1-XP1-F4
tcgggnatcggtgccattctgtggtagatcgcgaagtcgcgcctcgtctccgtgagaagtagncgaggngccgcggggtgcgattccattttccataatgtgcttcctccaaggatcccac

SEQ ID NO: 20345 - DNA, 683 bp, Sorghum bicolor
  unsure (1)..(683): unsure at all n locations
  Clone ID: LIB5048-001-R1-XP1-E6
ccggngacaccaccaacaagcacaagttagagagatagaatattggcaaagtagctatggccggtcaggggtgcaagataaccgcagtggcgctgctgcctctgctcatcctcctgccgctggcgatgctctcttccatggcgtcggctacgggccgctcgccggcagcgctgagcggcgagggcttcccggtgctgaggaaggtcccaactggaccaagcaatgagaccagcgacccgccaccgccaccgtatcaagtgcccgagagccccgtcgtcgactttccagtgctgaggaaggtcccaactggaccaagcaacgagaccagcgatccgccgccgccaccgtatcaagtgcccgagagccccgttgtcgactttccagtgctgagaaaggtcccaactggaccaagcaacgagactagcgatccgccgccgccaccatctcatgtggctgagagccccgtcgtcgacttcccggtgctgaggaaggtcccaactggaccaagcaacgacaccagcgacccgccgccgccgccatcatctcaagtggctgagagccctattgtcgactttccggtgctaagaaaagttccctccggaccaagcaacataacaagcgatccaccgccgtccgccttcaggggccgcgagcgcttgaatcccaaagctgcacagggggcg

SEQ ID NO: 20346 - DNA, 667 bp, Sorghum bicolor
  Clone ID: LIB5048-001-R1-XP1-E7
ccggggagacgagaggattccggcgagaagagagacgggatagcgggagtggggaagaagaacatttccggttcaggggaaggagagacactcgcttccacctcctgctgtcctgcggcgtgattcgggcaatcgggctctgccgctccttctctcctcccagcatccatcgccgccgcttgagctctgcggctctgcctccactccacggctccactcacctactacagctacagtgcagtctcctgggccggaactaggaaggcatgctgagtggccacgccgtgacactgagcgagaggagcgcctccggtacgcgcttgatcgaggatgtagcgcgcgaggcaggagatgaagaggaggaggcggacgccgccgcgagggttgtgtaccgggcctcgttccaagagctgatgcccaactaccttcagtacgacaccatcatctgggcactcatatccctgctgcttgtcctggcgtgggggatcgggctgctcctgcttctctacctcccgtacaagagatacgtgctgaagagggacatcctgtcccgccaactctttgtcaccgagaataagatagtctacaaggtgactaggccttcgtactggccattcatggggacagttaagaaagagattaaagtacctctccatttgattcttga

SEQ ID NO: 20347 - DNA, 639 bp, Sorghum bicolor
  unsure (1)..(639): unsure at all n locations
  Clone ID: LIB5048-001-R1-XP1-F11
ccgggtttaaatccagtacttttgaagttgatgttttgtatgtcgacccagatgactcacaaatttcacaaaaaataagcacttacacaattggccctttccaaacctccaaaggagagaaggccaaactgaaagtgaaagtgcgtctcaacatccatgggactgttacagttgattcggcaatgatgctggaggagggngatgtggaagttccagtctcatctgcaaatgaagctccaaaggatactatgaagatggacacagatgatgcaccaagtgatgctgctgctggatctgatgtgaatatgcaggagcctaaaagtgctgagaccactgaggctgctcctgctgctgaaaatggagcacaagatactgagcaaaaatctgttccgatggaaactgatgcaaaggttgagctgtcgaaaaagaaagttaagaaaactactgttccagtccatgagttggtctatggggccttggctgcaattgacctgcagaaggctgtagagaaagagtatgagatggctcttcaagacagagtaatggaagaaacaaaggagaagaacaatgctgtcgaagcttatgtgtatgacatgcgcaaccagctatatgacaagtacagtgattttgtcacacctg

SEQ ID NO: 20348 - DNA, 663 bp, Sorghum bicolor
  unsure (1)..(663): unsure at all n locations
  Clone ID: LIB5048-001-R1-XP1-D8
ccaggaccgacgactttcgacacgaccagatccttgatcaaataccggcacaatggcagtcaagggcaacaaccccatcttgaagaaccacttccgcaaggattggcagcgtcgcgtccgcgtgcacttcgaccagcccgtcgacaagctccgccccatcgttcgctgccccaccgtcaagtacaaccgccgtgttcgtgctggccgtggtttctccctcgctgagctgaaggaggccaacatcccccgcaagcttgcgcgcaccatcggtatctccgtcgacccccgtcgccagaacctttccgaggagtcccttaaggccaacgttgagcgcctgaaggcctaccagcagcgcctcatcctcttcccccgcaactccaaggcccccaagaagggcgaggccagcgccgaggaggtcaaggctgtccgcgacggcgaccacgttctcttcaccaactctgctctccccatcaacaacaaggccgttgtcaccgaggagaaggtctccgagaacccctccaccgagaacgcctaccgcaagctccgcgacgcccgctccgaggctcgcccttgtcggtgtccgcgagaagcgcgccaaggccaaggnncgaggaggaggccgagaagaaagaatagatgtagagcgtgtacatctgcttcacc

SEQ ID NO: 20349 - DNA, 594 bp, Sorghum bicolor
  unsure (1)..(594): unsure at all n locations
  Clone ID: LIB5048-001-R1-XP1-D9
ccgggaaatgcctttcaccaagttggtcaagaactccgcctacttcagccgctaccaggtgaagtacgctcgtcgccgcgcgggtaagaccgactactacgcccgcaagcgtctcgtcacccaggccaagaacaagtacaacgcccccaagtaccgcctggtcgtccgcttcaccaaccgcgacatcatcgcccagatcgtcacttccgagatcaccggcgacaaggtcttcgtctccgcctacgcccacgagctcaaggcctacgacatcacccacggtctcaccaactgggccgcncgcctgcgtcggtctcctcgtcgcccgccgcgctcttaccaagctcggcctcgacaaggccttcactggtgttgaggaggctgatggcgagttcaccgagactgagcccgccgaggttgacggtgaggagcgccgccccttcaagtgctacctcgacgtcggtctcgtccgcacctccactggtgcccgcgtcttcggtgccatgaagggtgcctccgacggtggtctctacatcccccactccgagaagcgtttccccggttacgacatcgagtccaaggagctcgacgccgaga

SEQ ID NO: 20350 - DNA, 266 bp, Sorghum bicolor
  unsure (1)..(266): unsure at all n locations
  Clone ID: LIB5048-001-R1-XP1-C2
ccgcggaacttaacaatcaccacttggcttttctcataccttaacaggaccatgtctcagcccagccccttcgtttccaggcccagcggaaacatgtcaagttccaggatagcccaagcaatgctatgaaggaaccggaacccatgggtatggctatgtggatnaaagaggcaggaataagggatgtggatacaannagcttcggacntcctcaagctaaacgacaggggctggggcggctccagaagagcacaaccatgtaccaa

SEQ ID NO: 20351 - DNA, 154 bp, Sorghum bicolor
  unsure (1)..(154): unsure at all n locations
  Clone ID: LIB5048-001-R1-XP1-C5
ncgngatctctctggcagcgacattctcgatactaaccacagcaccaagccgccaaaatgaggtaaattcactccgaggaagacctgaaggtccctggagggcgtcaagggtcactatcaagaacccgccaggtacaaccgttggaggggtccc

SEQ ID NO: 20352 - DNA, 563 bp, Sorghum bicolor
  Clone ID: LIB5048-001-R1-XP1-C9
ccgggattatcaatcatccaactttcacaatgtctaagccaagcattctcttcgtcctcacctcgcacaacaagctcggcgacacaggcaagcccactggctggtacttgccagagctcgcccacccctaccacgtcctacgcaacaaagccaacatcaccgtcgcatcccccaagggcggtgaggctcccctcgaccctgcatccgttgaagccgcgaaagacgatgtatccgtcaacttcctcaagaacgacgagcaggtctggaagaatacccagaagctgagcgacttcaagggaaaggcgaaggagtttgatgccatcttctacgttggtggtcatggacctatgttcgatcttgtcgacgacgcgacgtcacaacaacttatcagggagttttgggaggcggacaagatcgtgtcggccgtatgacatgcacccgctgtcttctacgacgctaagctgagcgacggaagtctgcttgttgttgcaaagggagttaccgcattcacaaacgctgaggcagagaaagtgcgcttgccacaggtggacccatgttgcctt

SEQ ID NO: 20353 - DNA, 366 bp, Sorghum bicolor
  unsure (1)..(366): unsure at all n locations
  Clone ID: LIB5048-001-R1-XP1-C1
ccgggaaattgcatctccatcctgacgacgtttgatattggcgagttcttccttccatcgttcctttggcggaggatgtcgtgctgcggaggcaactgcgggtgcggctccggctgcaagtgcggcacgggctgcggagggtgcaagatgtaccccggacatggcctgagcagcaggtgaccaccaccgcccaagactcacgctcatgggtgtcgcaccatcgtccaaggggcacgccnagggcgggttccgaggncggcggncccggcngccgggagctgagnaacgacgggtggcaagtgcggccccaactgcagctgcaaccccggcacctcgccagtgagctgtataataaccccctgcact

SEQ ID NO: 20354 - DNA, 203 bp, Sorghum bicolor
  Clone ID: LIB5048-001-R1-XP1-A2
cgcgcgggcggggaaacaagcagaagagggaaggctaaaaccaccaagagggagcaccttcagctacggcaagttaagtcgatcggctgatcactgaagcaatggtctccgccaacatcgggaccctcagatccctctcgccgatgtggcgcgggacctgtcccgtgcaccgcgagatggactggcacaccctcgggacccaa

SEQ ID NO: 20355 - DNA, 595 bp, Sorghum bicolor
  Clone ID: LIB5048-001-R1-XP1-A3
ccgggccctctcaacatttagtgtctgcttctcattgacgtggaagaccagtctctgctgtctttcgttgaggagagaattacaatttcgccatggatcaagtaaccaagttcgtcaagcccggcaagcagttcgccaaggactcaattcgtcttgttaagaaatgcaccaagcccgacagaagagaattccagaagattgctgttgccacagcagtcgggttctgcatcatgggcttcattggattctttgtcaaacttattcacatccccatcaacaacatcattgtgggctcatgaaacaaattgttacttgatttacatctaatgactggagcacatctacgtatggcatgtattttgtgtctgtgttaaattattctatctgtatatatttaagttgtatgtgtgtgatgggtgaatcacatttctaataaatttgttaaaatcatgacagtattttttttcatgatctgaaatgaattgtgaacaacaaatcctagctactgtactaggcaggttttgaatacaattaaaagtactttcagtcaaaaaaaaaaaaaaaaaaaacaaaaaaaaaaaaaaaaaaggcccct

SEQ ID NO: 20356 - DNA, 771 bp, Sorghum bicolor
  unsure (1)..(771): unsure at all n locations
  Clone ID: LIB5048-001-R1-XP1-A5
ccggggtatctttttttccggtcatcccatctcatctaacaacacatcttctaggtcatacacgagccttgatcagcaagaaatctctagacatgccattacctctgtctgatgcgcaaatctccaatattaccgggtacatgtccctggcatgctggattgtcgtgtattcacctcaaatctgggaaaactatcaattgaaatctggcgaaggtctatccgtcacttttatcgtcttgtggttattgggagatatcaccaatgctctgggaggcgctttggccaatctcttacccacggtggttatactagccgtatactatacagcatgtgatatcgtcctgttgatccaagtatactattaccgacacttggctcgacaaaaagccaaaaaacaaggcaactcagaatcatcacctctgctcgaatctgaaattcgtcaacccccagcccaacctaaaccgctcttaccgccttcgctggagtaccctctcttactcctctttgtgctaggagcaggcgtggcggcttattacctctcggatacacctgacgatgtctctataccggagaaaccaggtaaagggtctgaagtcgagttggagtggaagagtcagactttgngttggttatctgccgctctttatcttggaagtcgagttccctcaatcgcacacaactaccagacgcgatgtgncggtctttctctcgccatgtttctcttttccatctctggnaatatcacctatgtcatttccatcctcatcatct

SEQ ID NO: 20357 - DNA, 639 bp, Sorghum bicolor
  Clone ID: LIB5048-001-R1-XP1-A7
ccggggcatccgcactcgcaccgttcgtcacctgcagcgcctccgtcctctctgtctgtcatgactagctgccctaccatggccgccctaccctgtcagctgacggattcgatgacctcttcgccgctgatgcaacgtccaccagcaggcaagatagacaatgtcctagatagcgacatcagtaatgatcaccccctcgctgtacacgcataattgtcctgtccccaccgcgcggtcgactgaccgctgccttgctggatgctttctatcaagcggctgatagctccagttcatgatagactatggaagaagcagcgggcgccatcgtatgagtattcgaattcgtatgcgccgatcactgagctgaggaggatgacgcatgcatgtgtgtgcgttggtcttgcgggaacgtgctgcgcgccacgatcgaggtgccggacgccggcgaggtgaacttccactgcacgcacctggaccacctggacgagaggtggaggatgaagcaggtggacgccatcatccgctccggtgacggaccgcacatcctcgccggcggcctcaacgcgctcgacggtaccgactactccgccgaccgatggtccgacatcgtccagtactacgaggagatcggcaagccga

SEQ ID NO: 20358 - DNA, 275 bp, Sorghum bicolor
  unsure (1)..(275): unsure at all n locations
  Clone ID: LIB5048-001-R1-XP1-B1
ccggggnccgtcgccgccgccctgctccaggggtcaggtcttcttctggnccttcgccggcgggcacccacaggaagggggaaattattcaggagatccagtaactagaaatgaaaagggaagattttcaagttgggctaagggatttagaggaagggcgaagnaattgcatcaggataacaagggagagggtcgagaaagccttgcatattcgtacggggacaggggtaacaagaaaggggatatgagacccctttggattgagcgcatcaatg

SEQ ID NO: 20359 - DNA, 709 bp, Sorghum bicolor
  Clone ID: LIB5050-012-R1-XP1-H3
ctgcgagccttgcctctaaaccctaattcgacctagcaccccgatggccgatgacatgccggtgtccgtgtaccctcccccgccgttgtcgtcaacacctgcaacgcagcctccgctcaacctctccgcaccaccgtccccctctccaccatccatcccctcagcctccgtgacacaaatcccaagcacccaaaacaccctggtgtccccagatctggactcctcctcttccgaggatgcacccggccagcctgtgctcctctctcgcatcttcaagtccgagcggatcgagctctctgatgatttcctctctgcagctagcaacaagggctaccgcatggtgcgtgccacccatggcgtcacagcgggggcctggtacttcgagatcaggatcgtgcacctcggtcccactggacacacccgccttggatgggccaccaactgggctgacatcgatacgcccgttggctatgatgcctatgggtttggctatcgtgatgtcgatggcgccaaggtgactaaggcttggagggacaaatatgctgatgaagggtatggggaaggagatgtcttggggttctacatttctatgcctaatggggagcaatatgaacctaagtaacccaacaagggaatgcccctccatgcgtaagtccctaagaaggagcagaaaattccagatcctgctcccggaagtggaacatgctat

SEQ ID NO: 20360 - DNA, 836 bp, Sorghum bicolor
  unsure (1)..(836): unsure at all n locations
  Clone ID: LIB5050-012-R1-XP1-F5
tttcgcttccgggttccggcgcgcgcccggtcggtcgcccccctcgctacctctctctctataaagtagaagcatccgcaccggcaagagaggtagctagctcccctccccctgggtcgtgtggtgcattaacgacgtgcgcgcgccggccgtgagctggtggccggccggggtgggggccggtgcggtcgacgcctcgtcggtcgggacccattattatattcctgtgggcagcctgtgctctggtctggagaggaggaggacgacaacgacgacgacgagacagcgcggcagcagggagcgtcgtcgatccagcgatcgagcggcgaccatgcagcgcggggacccgctggtggtggggcgcatcatcggcgacgtggtcgacccgttcgtgcgccgggtgccgctccgcgtcgcctacgccgcgcgcgagatctccaacggctgcgagctcaggccctccgccatcgccgaccagccgcgcgtcgaggtcggcggacccgacatgcgcaccttctacaccctcgtgatggtagatcctgatgcgccaagccccagcgatcccaacctcagggagtacctgcactggttggtcactgatattccggcgacgactggagtttcttttgggactgaggttgtgtgctacgagagcccacggccggtgctgggaatccaccggatggtgtttctgctcttccaacagctcggccggcagacggtgtacgccccagggtggcggcagaacttcagcacccgcgacttcgccgagctctacaacctcggcttgccagtggccgccgnttacttcaactggccaaaggagtccgggaact

SEQ ID NO: 20361 - DNA, 589 bp, Sorghum bicolor
  Clone ID: LIB5050-012-R1-XP1-E3
tccggctccccaatacattcggcaccctctacttcggcgcgggcacgaggtcgccgtagtcactagcgactgacctggacgccggcacggcgcgagcatgaggccgccgagggcaccgacgaccgtccgggaccccggtgtggcacaggcatgaggtcaccgcgaggaccggcgaccggtccggaccccagcgagcagtcaggacaccaacgtgtgttcgagcgtgagttcccttaagcgcctcggatactcgctggtgcaggcacgaggccaccgcgggcttgggagatccacgacccgaggctcacggggaagcgccactggctaggcaccgccgccgccgccgccgtggtttggggatggaggcagcccgccgaagcgagtgagcataccaaatgtgctctcatgtcatcagcatatgtacatttacactgcgagaactacttcaagtgattgatggattattggaatttcatttggaagagatgacaaggttgttgataattcacacctagataacttattttggatgatgttcagttctgtttgctgatgttaggaaaccaattttgttgcttaaagtttgcat

SEQ ID NO: 20362 - DNA, 576 bp, Sorghum bicolor
  Clone ID: LIB5050-012-R1-XP1-D11
tttcccatacatgacagattcacttaacacctctacaccatcaacaggtcaccaacccccactgttcttctgtcctgaaatggctgctccacgcctaaccctggaggtcgcgacaactatggaggacctggcggggctgctgctggagtcctctgagccagaatcagggatgtcgagctgcagcgacgtgacatcctcggtggcgccatgcctctggtacgagatgagcaccacggagtccccctccccggcacgctgcaacggggtgcgctcgctcaacagccgcccgtaacccacggacgaccgccacggcacctgcgcctgcctcaagagcatgacaagcaagctcagcatcagcaacgtcttcatcatgatataacgccgccaacatcccctccaagagagtggtctccggcgtgatacccatcacccccaacgtcgactgatcctagatcaactgatgatcgatcataatgacatgcatgatgcatgctcattggaaggtgatcaaaatgcagtccaagttgttctacgagacgacgaccatgactccctccgtggatgatgcatgcaatg

SEQ ID NO: 20363 - DNA, 740 bp, Sorghum bicolor
  Clone ID: LIB5050-012-R1-XP1-A8
cctcaagagaagaggcccccaacccatccgccttcctccacctccccggtccagcagagagcgagtgggatggcgccgcctccgccaccggagctcatggatgacctcatcggcgagatcctcctccgcctcccaccagaagacccggcgtgcctcgtccgagcctcccttgtctgcaagctctggcgccgcctcctctccgatggcgcgttcctctgccagtaccgcgccttccaccggacaccgcctgtgctcggcttcttccacaaccagtaccgaaagggcacctctgttccccagtatgtccccacaatacaggcatccccggttccccagcctgcaatcgccgtcaccggcagccccaccacctcctaccgtaccatcgattgtcgccacggccgagtgctattcgaaggcaaggatcagccatcacagacactcatcgtctgggatcctatcaccggcaatcagaagctcatctacccgcccgtgcacccgtataccaagttcttggctgcggtgctctgcgctgcagacggctgcgaccacctcagatgcagcgggggggctttcctcgtggttttcgtgggtatatatgatgccgaggaggaggacaatgatgacgagggagttgaagatggagatcctgtgggatgggctagtctctacccatcagagattggggtggtggagcgcatctacctccattagtgtcgattccttcatcgaccttgtcctgc

SEQ ID NO: 20364 - DNA, 724 bp, Sorghum bicolor
  Clone ID: LIB5050-012-R1-XP1-A9
cttcccaaaagagagcccaaagccgaaagcccgtaaccaggagcaagaccgcgggtagggttctagctgccggcgacggccatggccgcctcctccgccgccccggccctgcttcgccgcctcctctgcagctccaccccagcctccgcctccgcctccgttgtgctgcgcgctgccttttgctcctcccccggcttcggcccgtctcctccgtcctccatgttcggcgacggcaccgaggtcgccaacgtgccaccgctcaccacgcccaagctcttcgtcagcggcctttcaaggttaacaactgatgagaagctccagggtgcatttgctcctttcgggaggattctcgaagcaaaagtggtgacggatagagtttctgggaggtcaaagggtttcggtttcgtgagatatgccaccatagaagaggctgagaaagcgcggcaggagatgaacgccaagtttctggatggatgggtcatcttcgtcgaccctgccaagccaaggcagccaaagcccgctcctgagcaggacaccagttcctcgcatgttggcttcacgacgaacaagactgtaggatggtgcggctaggtggattgatctttgatctttcacagcacaaaacttggatgatggatacccgagagtaggtctgattgaggatactatcagaaacagccaagtgtagacatggccgggcaatgcagatagctggggacagttc

SEQ ID NO: 20365 - DNA, 333 bp, Sorghum bicolor
  unsure (1)..(333): unsure at all n locations
  Clone ID: LIB5050-012-R1-XP1-A6
ttgtctttcactagaanagaggaaaaaaaaaataacaaaaaaagaaaaaaaaaaaaaaaaaaaaaaaaaaacaaaaaaaaaaaaaaaaaaagcccccacaggaccaaagggcgctttagaacccggggcttcccccattcatgaggaaattcccatttaaagcgttatcccaacccgcgcgccccccgggggggggcccccgcccccgagtggccccataaggagttgttctgagggcggtcactggccgcccctttaccggggcgagtttggaaaaacccgggggttacccctcttaaacgccttgcacgtcatcccccttttgccacccgg

SEQ ID NO: 20366 - DNA, 562 bp, Sorghum bicolor
  Clone ID: LIB5050-011-R1-XP1-F7
atacgagaatcgtctcactctctccactctaccactagctcagatcgaggaaggctgcgcgagccaagaagctaccggtacgcgtgcaccaagcaagtgccatggcgaagcaggcggtggcgatgctcgtggccctagcgctggtcgtggcggcggcgatgagcgccggcggtgcgtcggcggtgcagtgcaacccggcgcagctggtggtgtgcgcgccggcggtcatcaacgggtcgccgcccacggcgtcctgctgctccaacctgcgcgcgcaggagtcatgcttctgcgagtacgcgcacaacccggcgttccgcaagtacatcgacagccccaacgccggccgcacgctcacctcctgcggcatccccatcccggactgctaggcgaccggccggcggtcgcgcgttgtgtgtcgtgcggctgcggcgtatgaataaattagagttgtgaaatcagttctatagagatgcatttgtgcctgtcgatcggtctagtattatcgtactgtatttgtactatctcgaaatatggacaatattaccaagagtgatggtgt

SEQ ID NO: 20367 - DNA, 168 bp, Sorghum bicolor
  unsure (1)..(168): unsure at all n locations
  Clone ID: LIB5050-011-R1-XP1-F11
tcggggaaaaaagggaagcgtagttggttttcttcgccgccagatttccccgctgcactgccgctgctggtggtcccgattcggggcgggtgtatctgttggtatggngaaaagtggatcaactcttcgggagattgctgggtctggggtagagacaggtggatgccc

SEQ ID NO: 20368 - DNA, 711 bp, Sorghum bicolor
  Clone ID: LIB5050-011-R1-XP1-E11
ccggggttcttcttgcattgcctgaatctgcaaaaactaaacgcaaaccgtggacgagactacgagagagaatccgatcatggactacagcatgcagggctccaaggactcgtactcgccatcgccgcaagttcacaacttgtacccggacgctcagccacagccagggctgtatcctcctccaccgccgccggcggcgaacccggagaggggctacggctaccagtaccagggctacttcggggaagcggcgaaccctcctccttacgctggcagatggccggagcaggcagcagctccgtctgatgggggccctttctactaccaggacgatgccgactgcatcaccttcctcagaggatgtgttgctgggctgtgctgctgctgcttgctggggcgatgctgctactgaggaggagcgtggtgtgaaaaggcttcccggagcacacttgcttcagatgatcagaaccgcagccgtgaatgtgaatgtgatgtacacatgccgaatatataaagctaataataataataagcccgggatcatgtacccccccacaaaaggcgacggtttcctgcgttgacgccatccatgtaaaaccatgagccagctaacttgcccccacaacatggctccccttggctggccaaaaaaaaaaaaaaaaagggcccctaagggcccccggcccctccaaaaaaccaaaggaacccccc

SEQ ID NO: 20369 - DNA, 419 bp, Sorghum bicolor
  Clone ID: LIB5050-011-R1-XP1-D10
tcgggggcacacatcttctgcatggagcaggcgtccatgtccggccgcttcctctgcgccgccgggtaccccaacatgcgggacatcgtcgaccacttcgccgccaagcaccccgacctcgagataaagctgacggaggtgactggggaaggcattaggattgtgcccaacaccagcaagcttgaggacttgggattcaggttcaagtacggagtggaggagacgctggactgcagcgtcgagtgcgccaagaggctgggagaactctagatgctgctacacatgcatgcgcagcactggaaaaattgcggtatcgtgttcgtcggtgtgcatgttgctccattgtggtcgatttctccccccatagtttgaactgttcggtgtttccctactatatggctttttttactgatttgccc

SEQ ID NO: 20370 - DNA, 371 bp, Sorghum bicolor
  Clone ID: LIB5050-011-R1-XP1-A6
ctgcggcctctcctgtcctcttctttctctactccacatggcctaggtcttacccgtctgctgctatcgcaatggagaaaaaggcagctgatgtagtagttggtgaagcaatgtattcgagtggttgccctatctgggccgagccgacagatctcgagattcacgaagacacgacaggcgcttcgctgtcgacggagacatcgcctaccactgaaagcataacgttgataaatcctagaataaatctaggaaaatgcgagcacctgtgccaagtcagtgacttgaacccgggtggacaggttctaccacaaggaatccaaccaactgatccatggtcagttcgctgttcggatgaggacctgaggaaggag

SEQ ID NO: 20371 - DNA, 760 bp, Sorghum bicolor
  Clone ID: LIB5050-011-R1-XP1-A8
atccaacatcggcaacttcttcgcatctttgcaattactctcaaatcacacaacatgggaggccatcacaaacaaagttcagaaccttatgggcaacgtcagcggggctgctgctggagcatacagcggaaagaccgctctcttgctcggtgctggtttcgtcacacgacccactgttgacgtcctcgcaaagtccggtgtcaaggtcacagtagcatgccgtactcttcagaaggctcaagacctggccaagggtatccccaacaccaacgccatcagcctcgatgtcaacgatgccgacgctctcgacgctgaagtcgccaaggtcgacgtcgtaatctccctcatcccctacacattccacgcgaccgtcatcaagtcggcgatccgcaagaagaagaacgtcgtcacaacctcctacgtctccccagcgatgatggagctcgacgcacaagccaaggaggctggtatcaccgtcatgaacgagattggtgttgaccccggtgtcgaccatctctctgccgtcctcaccatcgacgaggtccacaaggccggtggcaagatcctgtcattcaagtcatactgcggtggtctccccgcaccagagtgctcagacaacccgctcggttacaagttctcctggagctcgcgcggtgtgcttctcgcactccgcaaccaggctgctttctaccaggacggcaaggtcaagtctgttgaaggccccgagctcatggccgaggcgagccatacttcatctacc

SEQ ID NO: 20372 - DNA, 605 bp, Sorghum bicolor
  Clone ID: LIB5050-010-R1-XP1-H7
ttccgaaaaggcttcgcattcgcatcccccagcggcggaaggaagggagccgaacgagcaagccaccggggaaggttgctagggccggagccgtatggggttcatgctgcgggtcaggctggcctccttcttcgccggcgcggcggccgccgccgcgagcgggggctacttcctctacaaggactacaagctcgccagcgactccatggccctcaaggtgaaaggtgtccaagattctatagacactcgctacaaggcccttgaaaagagactcgctgctttggaaggtcagcaaagcactggggctgcaccggatgtggatacaccatctgattagtctgttcactacgaggcttggacacctatgatttacggctgttttcgtcatcctcacttgtcttctcctttgaaatcaagaggcctgactgacaacaaaataagctagaatacttcttttgtactgcaaatgtctgaggctgagattttcccgtacattctgcctgtgtttcatgccataaaagcacatgatcagaactctgattgctcaggcatacttagcgtggacccaacccaatttgagacaacgttgcaatgatttttgccgc

SEQ ID NO: 20373 - DNA, 592 bp, Sorghum bicolor
  Clone ID: LIB5050-010-R1-XP1-E10
atgcgatgagggacaccgtgtccacggcggtgtcgtaaaagaggaggaagaggctcccgaagccgagaactgtgtggctaatgatgaacgcgctggaaaactggctggtgaagcagtgccgaaaaccgctcgggcgacttcaaatgcacggcggctcctcgcgactcaggaaataggggcttaggtactactacctgcacgacccatacttccacggggaaataaaggaggtgctcggtgggctgcctagggaggtgatcgatgcccgcatccagcgccgctggcgcggcatggacctcgacgtgaagcaccagtacctccgctagcacgcgcatgaagagcaggtgccattgagaggatatttgaggagaatggtaactctggagagaaaagaaaacgccgagcgtgaaatactggcagcccgtccactctaccggagaagacttccgtatagcgttgatagagatgggagcaaatcttctctttacggtaaaatgacaagggatgaaataaaatgcagtggatgagactgaatttctttggttccaacaaaggaccattttacttgttcatgcaatggtgcattgacgat

SEQ ID NO: 20374 - DNA, 428 bp, Sorghum bicolor
  Clone ID: LIB5050-010-R1-XP1-D2
ttcccgactccgccagtcagtcagccgagcggtgggcagagcggcacgcctctcgctcgactccgccccgctccgccgctccagatttcgcccacccaccacacgcccatggcgctcgccgactcccaccaaggcctcctgcccgacgcccccgcccccacacgacacccttaccccgacgcggtgtcccctgcgccttagcgacgcgtgatctctgcggcatccacccccaccaaaaacttgtagccaccctaccaccccccataacgcgccgccaccttctccccacacaccccgcccccgccacccccctccccccccgccccccatcccccaccaccccccaccccccctcccccccccccgcgccccccacctcctgcccacccgccccggcgcccccacctccccccccccccacccccccc

SEQ ID NO: 20375 - DNA, 582 bp, Sorghum bicolor
  Clone ID: LIB5050-010-R1-XP1-B5
tgtgcggcgctcgaggcggccgggctgcgatactccccacctccattcctgcttcttggccgtctcctcctccatcgcctaaccctagacaacccatacccaccaaccactagatcgagaaccggcatcactgggcgcacgagaccagggatttcccatggcggatgctgaacctgttgatcagaagaataccttgaggaacgttgcaagccgcaatgcgtaaaatcattatatgattatgagagatgcgtcaagagagtggagaacgatggaagtgggcagaaacactgcactggccaatatttcgactactggtcgtgcgtcgacaagtgtgttgcaccaaagctctttgacaaactgaaatgataatggaatgcgtcttttaaggcgtgacttatttcaggaagccaagccccaataaatccatcccctggcctctggactttatttgctgaacatgtaacagctaacagcaagctatttgattcattttgctaaactgtttgagcggggcatgaaaactgtactgctctggtggagattctttcagttcttgtattgaaagtttgaaatctcgttttt

SEQ ID NO: 20376 - DNA, 648 bp, Sorghum bicolor
  Clone ID: LIB5050-010-R1-XP1-A4
tcccaaaaagggaaaaccctcacgattttggagacgggcgaggccgtcgtctcacgagacgacgatgccggctcgtgctcccaagctcagtcgtcggtggaggacgcgttgtacggcgtcgtcgtctgcgaacgacaaggggtggatcagcctgtgcacgcgccaaaatcccccacccatgcattcatattttctccatcatcgtgcaatatcagaaggtgcgtggcggagacagcaccggagccccggttcacgatggtcgatggcggcagcgctggagcgatggcggcagcgctggagcgatggcggcagcgctggagcgtaggtgcgcgccgacagcagtggcggctgcagctcccatctcctgcggtcgcacctcatcgtgagcaaggcggaacaagactgcaccaacgcctgacgattacgtggccatggtggctaggcaagagctacgacgcgtgtatgcgctagcttgctcgacccaactgcccaagtcatctttgtttcttgttgctgtgagactgcatcatgtagcaacatttgatctgctcgggctttctggatgtatttactccatgatgttgtttgcatactaatgcttcaacaattcaaaaaggaacgcccaatagctgttcgatgcaatgcctc

SEQ ID NO: 20377 - DNA, 851 bp, Sorghum bicolor
  Clone ID: LIB5050-009-R1-XP1-H11
ccggtggacctgaacagccgctcttgatgcaggtcttcttcggtggcttcagcaaagacttttacctagagcaagtgcaccgaccgcgtcactacaagggaggcgactctgcgccattgttcggtaacttcttggagccgcttagcaagacgccatggtggatcgtaccatcactgtggtggccttgcgttgcagtcggaacagctgtagcgttcggtggactgtcatctaccatggaactggcgggatactgggcttttgggctgggtttctggaccattatcgaatacgttctgcacaggtgcttgttccatctcgatgaccaccttcccgacaaccgcttcgctatcaccctgcacttcctccttcacggcatccaccactaccttcccatggacaggtacaggctcgtcatgccacctacgctcttcgtcgtcctcgcggcgcctttctggaaatttgcacacgcagtcatcttttggaactggtacgctgctttggctgcttactgcggtggtatctttggatacacctgctacgacatgacacactacttcctccaccaccagaagctacccccttactaccaacaattgaagaagtaccacctcgcacatcacttcgcagactaccagaacggtttcggtgtcacgagccgcttctgggaccgcatcttcggcactgagctcgagatgggaccttccaaggtcatcaagtcgagctaaattgatgaggttcctattagacttttgttatcagacacccacctgtcactacgttgtcaagaccagcattgcgagaaggcgtttagtgcgtctgcgagacattttgggtccagcagcttgatgttt

SEQ ID NO: 20378 - DNA, 588 bp, Sorghum bicolor
  Clone ID: LIB5050-009-R1-XP1-H12
ggccggggcccgggaaaaaaaaaaaaaaaaaaaatccagtccagtgagggaaattgctttggacggtgcagcgccggctagcaagggcgagggcggaccggcagagggaggggagatggaggggctgacgtccagcgagatctccggcttcgtggtgggtgccctgctgctcggcgccaccatcgctgctcccaaggtcgatggcttcattgcctcctcgcagagaaggtcactaggtatgtgcaagaggtgtggtgatcttcggattgtagcatgctcgcagtgcaaaggaacaggctcagctcggaacggagggataggcgtgctagatgatctctacgagtctcttggagctgaagccaagactgacaatttggttccttgcacaaggtgcagatccagaggtcgtctcttgtgtccagagtgctctaagatcgcatgaacctgtaatcatgtactcaggaccatccctaacgagtagtttggtcaggagtaccatacacaaaaagtgatatagaagtactccctctgtctcgtaaagactctatcccgtaaagactgcaattctagagttcaaaattttcttcc

SEQ ID NO: 20379 - DNA, 804 bp, Sorghum bicolor
  Clone ID: LIB5050-009-R1-XP1-F10
ccgggaaaaacacgtgacgactcgcctctgcttgttgatagcagcatgcgacgacagaggtgaaagcgaaaaactgaagaagctggagtccatgcccctgaggccccgattatgagcataaacaattgtgtgttcttcatcaggaggatgacaatcgatatgtgcttcaactgatataagaacttcatcaggctgatgcaaacccctgaggtgcacaagaaggttatagcacggacatcttcctctgcagaggtgacactacaggcaggaaagctagacatattgcccaccgatgatgttgctggtgatgctgatgcagccgcagatgaagataacaagctggtagcacaggaggatcccccaaaggcgccgaacaagctcaggatgaactgccgcaagaacgtggggttgactgtcttccagcgccactgcgtcgaacaccttcatgctccatgcaccgctacacggactcccatcagatggaacttctattacaagatagagggcagtgagtacatagccaagcacaaccctgtcgggatggcccataatatcatccagatctgactgatgagcgagcattcatcgacgaaggatgaatctctggattacggtgtgatccgcgactgggttcagtcaagagttcgctcggattaatatgtttcttctcgatgccaaccaagtagggtaggactgactataacaggtaaaaactgggccgggaggaataatttcagtgcccgtatcatactctgtgctgttgcttaaaaacatgctagtctgatctcctagcgcagctttgtg

SEQ ID NO: 20380 - DNA, 571 bp, Sorghum bicolor
  Clone ID: LIB5050-009-R1-XP1-F3
ccgggactcttctcgcctccgattctccggagattcgtcatcagaatggcggtggcggcggcggctcgtgccgggttccggcggctattctccgtgtcggcgttcgctgcaccacctccacccgctgcgcgccccgcggcggagccctgcaacaacctcttcgtctcagggttaaataaacgcacaacatccaatggacttaaggaagcattttcgaaatttggtcaggttattgaagcaagagtaatcactgatagaatatctggattctccagaggatttggctttgtcaaatatgcgactgtacaagaagctggtgaggccataaaaggcatggatggaaagttccttgatggttgggttattttcgccgagtatgcaaagcaaagagaagccacacagccgtcacaacaaggagcaccatatgaatactctagctaatgattgaagttgccatgcacagtcgattacatacactgtattccttttttttctgccgagagtgtaatattggatgtcgcttgccatccaaaaatttacagagagaatgtagcttgctgtgctccactcg

SEQ ID NO: 20381 - DNA, 447 bp, Sorghum bicolor
  Clone ID: LIB5050-009-R1-XP1-C9
ctcggggtacccaccacagtactctctcctataccaaatactgaaaagaagagggtagaaaacctgaagccatgactagcaacaagaacactgccgccaccggggcgaaggtggcaatggtgttgcttttactagcgacgacgctcctgttgacaacggtggcggatgcacggccttatttggatgtgctgcctccgtcgacatcacatagcgtggctgggaatttgctgccacacaagatcataccgccctctgggcctagcgatttctggggcggcgagccactaccgccgcatgtggaggtgaaaaccaaccatggtaattgagtgcaaggagtggtgtgaatgagaatagttggtgatgtagggatgaatgcatcacaagggccatagtgccatgtaatgacttatgcaagaacttgaataacaagagcgcatggtcttgacc

SEQ ID NO: 20382 - DNA, 810 bp, Sorghum bicolor
  Clone ID: LIB5050-009-R1-XP1-D4
acgggacctccgtcccgtccgtatataagaagccagacttcgaattcccccctcctcggctcctcctcctcctctgcctcggtgcctccctcagcgcctctcctccttcccctccccggcgctccgcgtccgtccgtcaagacccgccgttcctcgtcgcccgatccgtgcacgtccgatccgccaggggatggccaccttcgagctgtaccggaggtccaccattggcacctgcctcaccgagacgctggacgagctcgtctccagcggagccgtcagcccagagctcgccatccaggtccttgtgcagttcgacaagtccatgactgaggcgctggagatgcaggtcaagagcagggttaacgtcaagggtcatctgcacacctacaggttctgcgacaatgtctggaccttcattctaacagatgcaaccttcaagagcgaggagattcaagaaacactgggcaaggtgaagatcgtggcctgcgattcccagttgctgcagcctcaacaaccataaaagaaccaccacctgcccaatctcgatcccgtccagtttaattagctcagtttcctgctattactggcgccacccaaactttcctagttcatgtgaatttgcccccctctgaactttgtttgggggaagttaagccatcggccgtggaccttgactagactagagtaccctggctgccaacatgttaatccgaactggaaatggaaaatggattttgctgccttcccgctggaaaattcacactggaatggcttaaaaaaaagcgttgaattttggactttattttccac

SEQ ID NO: 20383 - DNA, 736 bp, Sorghum bicolor
  Clone ID: LIB5050-009-R1-XP1-B9
ccgggctccctgagaaaagggggaagaagcttgtgcttcgacaagcgccagccctagcgcagccccccggcgccggcgacggcgatgagccttggagccgaggtaatcgagctctccagcgacgaagaggaggagcccgtgcccagcaccaccgccctagctcgccacgccccctcctctcctcccgacgtcaagccgcacctgttcgccgacgtcgatgtgaagccactgctgctcccgccgccgctccaccccccgggctacggcgcgctcgtgcccgtgaagaccgaggagcccgtgcccgtgcccgtggccaccgtctcgccgccgcccagagcgctcccgccgccgcgcctctgccgccagttctggaagtccggcgactatgtcgtcgcgcgccgcaaccccgacgccgacgtccccggtgggcggaaccggttgcggataaaccccaagttcctgcactcgaatgcgacttcccataagtgggcctttggcgccattgccgagctccttgacaatgcaatcgatgaggtgaacaatggggcaacatttgtccgtgttaataaatttaaaaacccacgggatgggaacccctcattgttggttcaaggttgccatatttataatgttaatctgtttattttcatatggactgttatctggattccggattgtaaccttgtggtgtttcacattgataagatgcatgcaggggggatggatcctgaggcac

SEQ ID NO: 20384 - DNA, 653 bp, Sorghum bicolor
  unsure (1)..(653): unsure at all n locations
  Clone ID: LIB5050-008-R1-XP1-G5
ccgggatcgtcacctccggattccccgaaatagacaaactctcccatcccctccgcgccgctgcacgcccacccatagcctatagccggtagatactttcatcaaacatagcacacaggatcgcgccgcccgcgtgataaggagccgacgaatccacctacctacccgcattcgtgcgccagcgccaccccgtgccatcgccgctgcgtccgcgagccacaccgccattcgtgagggagggaggggagcaatgggcgcggggatggaggcggaggaaggggtgatggcgacggacttcttctggtcgtacacggacgagccgcacgcgtcgcgccgccgggagatcctgtccaagtacccgcagatcaaggagctcttcggcccggatccgtgggccttcctcaagattgctttggttgtgtcgcttcagctatggactgctacattcctccgcgatgctagctgggtgaagctactgacggtggcctacttcttcggctcctttctgaaccacaacctgttcctcgccatccatgagctgagccacaaccttgccttcacaaccccatccctncatcgctggctgggcatctttgcaaacctccccatcggcgtccccatgtccgtcacgttccanaagtaccacctggagc

SEQ ID NO: 20385 - DNA, 726 bp, Sorghum bicolor
  Clone ID: LIB5050-008-R1-XP1-G12
ccgggatagtatctgtgtcgtccctctcgggcgacacggacggacctcccatctagcgccgccacccccttccccatccccctctgccttgccgccgccagagcgtgtcgccgaaagcctacgcgggcgcaaggaaggcggcggcggggccttcttcctcacctcttggtgcatcaacggtttggaggtgtcgccgaggtggcggctatggcggccggtggtggtttctctgtctccgcggtccgatccggtggtccttggaccggatttgtgcggtgctccggcgtcttcccttcttcgaccgtagtggcggttcgggcgccgccagtttgggggcgtcgctgaggcggtgactatgacggccagtggtggtttccctgtcctggcgtttggatccagtggtccttgggccggatccgtgtggtgcttcggcgtcttcccttctttggccgcggcggcagttcaggcgttgccggcttggtggcagcaactgcccggggtgggttcccttcccggtggctggattccttccacggaggccagatccagcagccctggggccagatctgtgcggtgccagtgtgctgcgcagaggtgggcgaacatgttgttcgtggttctttcaccggcatagcagtgcagaggtggtgcgacggccgcaaggttgtgcgatgaaggcgtcgcagggcggagaggtgaatgttgggctatggcataccgtcactg

SEQ ID NO: 20386 - DNA, 704 bp, Sorghum bicolor
  unsure (1)..(704): unsure at all n locations
  Clone ID: LIB5050-008-R1-XP1-C7
ccggggtcgtctcttctctagtgccgacggctgggccaccgccgccgccatacgcaggtatccatcttcggacccttcgccggcgacgaccgcccaccaccagtgaaaacttcaacccaggaatggcgatgtcttggacaagagggttaaagcatggcgttgttccgaggcatgccgctcaattgatagagagtagaagccttgcaattgcaagcaagggaaagaagggtggaaagggcggtgcggctgatgctgccaaaactcctgcgctcagccaagagcttaagagtacaacagtgtttggggcaaacatcctcaaggagggttctgatccaaaaattcaaccagactctgagtatcctgactggctgtggcacatgctcaacaagcgtcctgtgctgagtgagctgcggaggaaagatcccaagacactcccttatgaagacctgaagcgttttgtcaagttggacaaccgatctaggatcaaggaaaagaatgccctcactgctaagaactgacctggagtctcaggacgaaacaggccctgttctactgttctttttattcatatagtgctagacgacatgaacaatttttctgtgggttttggcaataacatagtgacctgngatgttaaaatgttttgatttgctttggtttggtactattttangcagccaaaaaaaaaaaaaaaaaggccccta

SEQ ID NO: 20387 - DNA, 695 bp, Sorghum bicolor
  Clone ID: LIB5050-007-R1-XP1-G9
ccggggatgtacaatagcactaaggcacgaactctagctatataatgccaccgcatccagtgctggacagccggagagcacactgaagctcgtcgcatcaagcagtaggggctagcaagccatggctcgtgtcgccgccatagtggagctggtgctacctcctgcaactggcctcctcctcataccaccaccagcgccacgactatgctgatagcgggcttggcactgcaaggacggcgacgtcgacgagcgctcccttaggagaacgcgccgccgcttagctcagaacagaaacgccaacatcttccacaactgcagcagcaacacctgaacgtacaattgaactgtatacaagcacatggaacttcactgcatcccggatgaaatacaaattctcctcaatatgaaaccagggctgacatcgcatggtggagatgctcaagaggccgcaaagtccatactgcctcttcttgacaaggaaagcgcattgtaccgttgtgaattatgaaaaggacaccactgaagcttgcagcaactgctgcattacgcctcatcgcaaaccaacaagcacaacaaattcttgatgcgctcagagatcttgtccacaaaaagagcaaattccagtgcaaggccaactgtatcaatgttcttgagggatctcacgaaggatcctacctatgggctgctctgaatta

SEQ ID NO: 20388 - DNA, 452 bp, Sorghum bicolor
  Clone ID: LIB5050-007-R1-XP1-H3
ccggggaacaattaccacattgttagtaagatcttatcacctatggcgaagttcctcaactacaccagcgtccaagtactcttcatcctttccatggtacttctggcatcatgtgtcactcatgcacaaataataagtggggaagccagagaggttagcaaaactgggagcaccacgatgaccacgatggtggcaccaagaaagataattgatgataacaaaaatttattgtgctatctgaaaggcgcactgtactgctgcgatttgattagaaagtgctggcatgacataaaggagtgctggaagcgttgccatggtggaaaggtgtaataaaaggacctgctttctcgagtcattcttggaaatcagaaaactgttctaccaattcatgcatgtaccgaaggataatataagctacttattaaaatcaagattaataagagtttcttgac

SEQ ID NO: 20389 - DNA, 490 bp, Sorghum bicolor
  Clone ID: LIB5050-007-R1-XP1-G10
tcgcggccgggccgggcctcttcgactcttcatcgcccagcaaaacaaacctctgcttagtttcagatctgtcatgaagggtaaaattgcagcgacgactggcttggtcctcctcctcctgaccttagcaggtgccgaggccaaggtatgccaatgggtggcaccgacggatgttgtgtgccaacaatcgacttgtctcccactttgcatcagcaagggctacaccgacggctactgcacccaacttgacaggaagtgtgcgtgcacaaaggaatgcacaggtgatggaggcagcggtaggggtgaagggagtagcggtgatgatcgagtttaacgctggacatgcgagaagatagagctgctcggacatgcttgaactttcgttattgtgtgtccgagagtcattttcttgtggtatttgtgcatgtcaagattagctagcagatcttgagttagtgataataatgaaatggttgtgttaaaaaacaac

SEQ ID NO: 20390 - DNA, 728 bp, Sorghum bicolor
  unsure (1)..(728): unsure at all n locations
  Clone ID: LIB5050-007-R1-XP1-C7
ccgggaagaagcatggcaggacactacagaacccacagtcgcagccagaatcccatgggcaacgaaagcttcggtcaccacggcctgccgacggcagtgcaggccccgagcgccaccggccgtatgtctgtggctgttgtaccttaccccacttcctttccatttatttaccccatgactaaccaggtgatgatgagggcgccgtcccgcttcgcactgccgagtccaagcatgcctttctggatgatggcacaacaccaaatccagccacaaccacaggcgccgcttatctacggcacggtgtttcattcatacactgtcatgtcatgtccatgccatgctgcgacggctgttgtgccaagcccgcaccatgcttacccggcgaatcagtcgggggttgtgcaagctgatctcaccctacggctcggctccggcattggaggtaatagtcgtggagacaacaggcagttacttgaagatgggtgccatggcaagaggcctatgctggtgatggatggtggtgatcgaagtggtgaggagggcaacaatgccgacggcttggatctggagctgcgtctgtgactctgtgtggctagagccatacacaattggaatgtaataatgagtgataggaaggctcttggagtctcgtgggcaagtttaatgggtctgctgtaaagtaattggttgagtaataaacattgaaatacttgngcccatgtttgtgg

SEQ ID NO: 20391 - DNA, 634 bp, Sorghum bicolor
  Clone ID: LIB5050-007-R1-XP1-C9
ccgggcatcatcaccactggttcttccttcactcctattaacttatatctatctactcctgagcacataacaactcgacaccatgaaagagttgctcgttgcgcctcgctctcctggctctcgcggagagcgacgcctctacgcttacaaccggagggtgcggttgccagacacatcatctactaccgccgccgtgtcatctgctgccgctgctgcatctgccaccggcggggcatctgccgccgtcggtacacgagataccgccgtaaccacaatgccatgcacgcccaactctacacgcctctctactccacgtccatgtgcatagatacccaccgcatataatttgctgctgccctgggatgctcggatcctggggtgcaggtctatcacctatcaccctgccgaacctgccacagggacttgaagaacagagagatcgaggcccaacagtagaagagggcatgactgattgccatcacgtgatcaatagagaaactatggtgggcaaaacattcattctgtggacacagctgtcaccgattagatcgtgaattggtggcgacactgcctttaatgaacatgcagcatttgcatggtcgcaaaatatgcgttaccaaatttgatgattcct

SEQ ID NO: 20392 - DNA, 758 bp, Sorghum bicolor
  unsure (1)..(758): unsure at all n locations
  Clone ID: LIB5050-007-R1-XP1-C11
ccgggctgcgtatccttcgacacgttccctgtttagaggttcccaacctgcggaagcttgatctgcatctatttgatgcgtctgaaatggaacttgatgacatgctgtcaggttgtgctaatcttgagtggttgagcttcattagatgccaagtgaatgatgaattaaaggtaaaacagccactgtcccgtttgctgtacttgcgcattgcgcattgcagcattaaaaaggtagaattacatgcaaagaatctcaagacttttgtataccgtggggtgcaattacctattgaccttggcgaagttaagaaactagaaacagcagaacttcgtttgtatggtgtcacttttgagtatgtcctaagtgtacttccaagtgtgctcccaggtgtgcaaaacttcaccttgaagactagttatctaccagagatgcccttattactggaaaacattggcaaattttcccagctgagatttttacggctgttactccgagtacattgtagtgaaagcaataatattctctcgctggcatccttcctcagggctgcccctttaattgaggaggttgaggtgcattttgatgcattttgcttgcaacgtgtgggatggggatctctccggagtcttccgcctcattcatataattatctaaggaaagtgcatatcacagggtttattgggattatgggacaacttgaatttctggcacatattgtgngaaatgcccctgccctacggattttaaatatagatcca

SEQ ID NO: 20393 - DNA, 620 bp, Sorghum bicolor
  Clone ID: LIB5050-007-R1-XP1-A6
ccgggatattctatacctgctcgtttgccgacgctgtcagtacggctacatagagaactacgcagaacagtgggcaggagactgtccggagcattgatgcttacgccttgctcctgtatactgccccatgatccgcaccatgatctgcgggtgctgcacggtgggcaagagactcctacatcgtctgcctaactggatgtcaagggcacgttctgcctcctgccagtccgcctgcccctcctacatatgcatgttcacgcggtcataaagaaggcacctgcctcttgactgtgcgcctggggcaccacgtagattgacaacgccaggcgcgtggcacaaaggtgcgtatgctagctgaactatgtaagatagatgttggagcctggctgccccccgaggacctactgagatgctagtaatatacactggatcatcattgaggagaagagcgtgcatcgacacttctcgttatatctcttgctacagaactgatctaccttgccagggatcgtggatatgaggtcatggtgagactaatataaggcgccagagctccattgatgtatcgaaaatatactgagctaataatacagccttccccagaaacaaaaaaaaaacat

SEQ ID NO: 20394 - DNA, 616 bp, Sorghum bicolor
  Clone ID: LIB5050-006-R1-XP1-G9
ccgggcttccccgacccaccaccatcaccactgcggcggcggcggcggcagtgcgtgggggcgtgacgccgaccaaatccgcaaccctagcatcgcggtgggcggcggggacgggcggtcgacggctcgacgcgacgccgacaggtgtggccgtgtggtgcgcgagcacttgcgggggttcgcggcgccaggctgccagcgtgtggcctcccggctttccgccactgtcagttatatggtgagctgatgtcaaaggcacgtaatgctttagttgccactggattactggtcttcgctggtgctggtttatcatttccgttccttttcgtgaaatcaaagaacaggcctatcattgattcgtcaaaacctctgccaccacaggctacattccgaggaccatatgtgaatacgggatcacgtgatattggacctgatcctaccaactatcccaagaagtgatttaatcttccatgatgtttcgaggtcctgtgtgagctatgtggaaaagttttgagtctatgtaatttgcctcactcatatttggtccctgtatgagtgaggatcatgttttggaccaccctttttctctttaatacaatgaaacactgcgttttcg

SEQ ID NO: 20395 - DNA, 664 bp, Sorghum bicolor
  unsure (1)..(664): unsure at all n locations
  Clone ID: LIB5050-006-R1-XP1-H2
ccgggactctcatctctctccgcacgggcggcggccgcccggccgaccgccggctccgctccggtggctccgcctgcgattgagcatctctacagcgcagatgcttggtctgtagccggcggcggcacatgtcagctctccccttgtgcgatggaactgccaactcgccgtgctggtcggagtgctccggatcgaggctttgctgctgcgccccgtgttgggaggggagctgccgtttcctgctgctgggagaagccagggaccctctgcttgctgagggcaaaatctccttccttgcccagacactcgaggaaggtggaatgggccatcagaactatgtcagacgacagtggtgaccagtcaagcaacagcactcgccttttcagtgcaattcgatcattttggaacaaattgtctgccaagctgaagaaagcaaggaaagggttacccgtgaagatcctattctttctgattggattctattgcgctactgcgttcgctaccgtcattgngcaaacgggtgactgggacatactgtcagccggacttgctgttgccgttgtggaggttattggtgcgctgatgtacagggcttcctttgcgttacttggtaggatcaggaacatgattaccatatttaattactggaaagctgggcttacac

SEQ ID NO: 20396 - DNA, 621 bp, Sorghum bicolor
  Clone ID: LIB5050-006-R1-XP1-H3
ccgaattaagtcagtcaccagcgcaaatcatccgcaccaagaaatggcttcgtccagcagcagcaacctcctcgcagccgccgtgctgctctccgtgctcgcagccgccggcgcgagcgccgggacgacctgcgtgccggggtggggcatcccgcacaacccgctgccgagctgccgctggtacgtggccagccggacctgcggcatcgggccgctcctcccgctgccggagctgaggaggaggtgctgccgggagctggcggacatcgcggcgtactgccggtgcacggcgctgagcatcctcatcgacggcgtgatcccgccgggcccggacgcgcagctggagggcaggctggaggacctgccgggctgcccgcgggcggtgcagaggcgcttcgccgccaccctcatcacggaggccgagtgcaacctgcccaccatcaccggcgtcgccgagtgcccatggattctcggcggcgaaaccatgccctccaagtacgactagtaactgtccagagcatcctattcctacctacctacctacatgctgcaaataggatgaggagaaatgcatgtctccaaacggattttccatccgaaacaaaaaaaaaaaggcacccg

SEQ ID NO: 20397 - DNA, 474 bp, Sorghum bicolor
  Clone ID: LIB5050-006-R1-XP1-D9
ccgggataagccttgcgttgttctccaagtgtcttaagttgatcattgggctgcatgcgaaggctcgagttggcctttaggcccacttccccacatggagtagaatgtgggattgatatattggattgagctgcttctgtctccagaggcatggattcaagaaagacccagtagaggactagcagatcgaatcatgttgatggcagcttggtcagtgctcggctgccgaacagaggacgaatccttacaagatagagccatctttagattatgttttacatgtaaccgttttatttgcttccaagttaatgatagatgtcataccaaatttttcatatgccccacagtgtacttttctgcttcactagttgctcatatcgtaccacatatgtctagctattccaagcttctgctgctttgccgaggaggcaaagtcttgcttccatcttctatgccactctccctgctacctgc

SEQ ID NO: 20398 - DNA, 537 bp, Sorghum bicolor
  Clone ID: LIB5050-006-R1-XP1-E3
ccgggaaaaaaaagtcaccttctcggtcctaaggctgtcaccgttcgcaggagggccgccgcttccgtttgcagcccgaaggggcgccgctgtctagtccgagtcgcagacggagccccctctcccgcagagaaaacagtcacgaggtgcggaggccgcgtaggtctgctggccgtcgatcgcgcaggcgctagtagctagagcgggaaccggctgcagcgcgagtgtgccgcgcatgcggagagccggtgaagggtgtatctacacaccggccgccaatcgttcgaggtcgcgggctcattggctgcaagggaccaaccatgggggcgcggaggttgccggctagcggccttgtggcagacgacgtcgggtgaggccctggctgtttatacttcattttttgtgctacatggttgatggcctcggtttgctatgtttggtctcgatctaaagtatatttgatggttctgatttggtattgtactctatttggtcttgatctaaaccgtgatgggcttgatttggttctctgatccc

SEQ ID NO: 20399 - DNA, 650 bp, Sorghum bicolor
  unsure (1)..(650): unsure at all n locations
  Clone ID: LIB5050-006-R1-XP1-D4
ccgggaagagcacacctggccgccgcgctgcctcccctccctggtccctgcccacttccccggtaccacccacctgccacctccaccagctgcggtgccgctcccccttccgccctagtccgagcacctattgagcagcgcggtgggcagtcgagcgagcgcggaagggtcgggcatggaggcgagcggcgagagggctgcggtggtgcggcgcctgatggaggtgaaggaggagtccgggaagaccttctcggaaatcgccgccgagacgggtctcaccaacgtctacgtggcgcagctgctgcggcgccaggcgcatctcaaggccgacacggtgcccgcgctgagggcggccctgcccacgctcaccgacgaactcgtccaactcatgatgcagccgcccttccggtcctacaaccccgacatcgtccaggagcccgccatttacagattgaatgaagctgttatgcattttggagagagcatcaaggaaatcatcaatgaggagtttggtgatggaatcatgtcagccatagatttctactgttcagttgacaaggtttcaggngctgatggaaaagatcgtgtagtggtcacatttgatggaaagtatctgccatacactgaaacagaatctgaacatatgatgt

SEQ ID NO: 20400 - DNA, 722 bp, Sorghum bicolor
  Clone ID: LIB5050-005-R1-XP1-G11
ccggggttcacctccgtattcttcagagaagctcttgcggtcttgcattgcctccaggctagtcacgccactagctcgccaccctgtagtccaaggaccgatcgaggatgagctctgttgggagtcaggactccatggacagcttggattattcctacctcttggatggcctttacctctcggatggccttgtggaggcgcccaccctgacctccaaggaaatcgaggatgctaggaaggaagcgttgaagatcctgaaaaccagttccccagaagaggccttgaagattttcaccgagagttcagaggtcatcaaggctgacctggcgagggagaaggcccacaccccggcgatgcctccaaacggtgctgatgcgaaggccaacggcacggtgcagcacccaccgccgaagaactgagacaaagaggcctgcctgcctgcctgtctgctcctctcgtcgatcaggagcaaattaaaataacagcatagtctgcttttcattcgatccaaaccaaatggacgccttcctctagtgcatgtggtggcttggggtccggcctcacatcgcgtagatggggtttctccagtttgctggatcgttttcgattcttcgacttcttcctctcgtgatcatctcacctgaccatgcatgtgtatatcgttctcgctaagggcctgttcggttcctcaggaataaagccttagaataatttttagttgc

SEQ ID NO: 20401 - DNA, 128 bp, Sorghum bicolor
  unsure (1)..(128): unsure at all n locations
  Clone ID: LIB5050-005-R1-XP1-F8
ccgcgctcgtacccacatnngctgacaagnnnatcaaggnacgctaccctananagggnacccccggaagcaagttttgctgttgctagccctgtcgncggtgcggactctggtgctgcagctgctcc

SEQ ID NO: 20402 - DNA, 552 bp, Sorghum bicolor
  Clone ID: LIB5050-005-R1-XP1-D4
ccgggaaaagccagcaccgccaccgccaccgccgatccgccgggcggcgaccgtcgatggcgaacccgaggcgagccatcgcgctgcacatccagacgcagccgccgcctctccccaccaccgccgcctccgcccttccacctcactcctctgtggcgtcgtcgctgctccacttcctgaagcggccggcgtccttccctttccttctctcactcttcgtcctactcacctggctctcgctccgcttccaccacccctcgccgccaccgtcgctcggcggccgcccctccgtcgtgcacgacccccaggcaaatctcgttcgcttccccgcggagctccaccccacccccatcgcccgcgacgggcgcgggtggctcctggaccccgtcgccgccgcccgcgacgccggccttccaggtgtagttggcgaatgcatgacagaacacaactattatatcagatctattgttgattgaactgggaaagtgggaatacaacttgtttatgtcagagacagacattgtgttttaaacagaaggaacctttgtattg

SEQ ID NO: 20403 - DNA, 619 bp, Sorghum bicolor
  Clone ID: LIB5050-005-R1-XP1-C6
ccgggcagaggcatgctaggtctaatggtggcgtgtgtctccggccgggatcccgccatctggctcatcaccatcacctgcagtaaggcatcagctaataatggtgtgctcaattcaggatcttcgtcgctcgccatggctagctggcaataaagggttaacgattcagctctgtgttctatccagactcagtttgaccagatcatgcaatgcaaacaagtgggggcactactctcaggctctaaggcttgatggacaattcaagctgaccatgtgaaacagaagttttggagcctatacacttatagcatggaaacaatcatggaggacagtggtggatgtaacagggagctcgtcgtctgtgtgttcatttggctcttagctgccaaacatggatgtggtggtcgttccttcttttgtagtgttgtgcttttgcacattaactagtaggaggctataatctgttatctttgattttacctatatgactcaatgatgcatgctggtatcttagtcatcttggctaaaacttgaactgcgagatgagatagcaatgcttttgaatgttttgagtacggaacatttggacatcatcaatgtatgtgctgaacatttggac

SEQ ID NO: 20404 - DNA, 699 bp, Sorghum bicolor
  unsure (1)..(699): unsure at all n locations
  Clone ID: LIB5050-005-R1-XP1-D11
cccgagaagatagcatctgcatcctgatcgatagtttgattattggcgagcttcattccattgcatcagttcctttggctggaggatgcttgatgcggaggtaactgcgggtgcggatccggctgcaagggcggcagaggctgcggagggggcaagatgtacccggacatggctgagcagcaggtgaccaccaccgccaagactctcgtcatgggtgtcgcaccatcgtccaaagggcacgccgagggcgggttcgaggaggcggtcggcgccggagctgagaacgaaaggagcaagcgcggccccaactgcagctgcaacccctgcacctgcaagtgagctgtataataaccccctgcactgcactgcagcccggaggaaggacggactcccctagctagtatagcagtgtcgtcactgcagtgtgtgtgtgtttgagtcagccagtcagtcgagtgccatggcaccatatgctagntggttctgggactgatgggaaccaataataattgtactgggatgctaggcgtcgatgtcgtccttcccgtgctcctccggnggctcatctactagcagtacggtgttgtgttgtggtgcttgtgggtgcagtgcagcacagcagcaagccatgccccctgctctgagggcacgtcgatcgcgtgcgactttgattgtgctctgtcaccatccatctattac

SEQ ID NO: 20405 - DNA, 622 bp, Sorghum bicolor
  Clone ID: LIB5050-004-R1-XP1-F7
ccgcgctgcgatggggggacggagaaggctaggccagcttggcgttggttgtccaagtttaaggtggtaggctgactgagcccgaattcgcactcacggccgcggccatggattccggcgtgcctgcccctgccctttccgctgccaaagtcaagctgtgccggcggtgcaaggcgagctacgacccctcggccaacacgcgcctctcctgcaggttccacccttccttcttcgtctgccgccgacacgacgaccagaagaggtactacgagctccgcgacggcgaccctccgtacgccgccaagttctacgactgctgcggcgccgaggaccccgacgctcccggatgcaccacagacctgcaccgttcctacgacgacgcccaggactagcaagcaaccctccctccctcttccacttccacacccaccacaggcctcatcttaatctccctctttagtctcatctaccgtttgcttttgcctcccctcccatcctatcctctctagtctgtagaggaggagataaggagagcagctgtcctgctgcagccatcaaattaaaccatctatgtacaataaataaagttgcaaaataacccgtgcttgctttgaattcatct

SEQ ID NO: 20406 - DNA, 368 bp, Sorghum bicolor
  Clone ID: LIB5050-004-R1-XP1-D6
ccggggagtttacagtaccattatctcttgctccggaagggcagaacctcagcgcaccatgtgagatttcagccaaccacaaaaagggtagagagttgtatgctatatcggagacttcaactcatgtcttttatttgcatcgaagatgatgattgttggccttacagaaatattcaaaaggagtcctgtttgtgtcctattttgcaggtattattttgaagacaaggacaatcatggagtgtttgcgccggttttgtagggactgcatatatagatcaatgtggcatgggtatagtgccatatgttctttgtctaatataccttgtgtccgtctcatttcttaaaaaatcgagtcctaccctggttcg

SEQ ID NO: 20407 - DNA, 505 bp, Sorghum bicolor
  Clone ID: LIB5050-004-R1-XP1-E5
ccgggaactcttacgaagcgagccgacgcacagctcacgttaggttatgcacccacatctccgctgatctacgcgttcgtggcgaggggaaccgtgagaggtgcaccactaccacaaatacccggaagttacacgcaccatcagccctcagagcctgaagacatctccccggcaggaacaactagatctgctacaactgcaacaggaactccttagactacctcaggaacatacacattcacgatagttgatgcagatgctggctaatcaggatgaggacagaatgcccattgctttcctcgcatcaccagcctagggaagacctctccagaaaatatgtgaggtgggtacacagctactggcacaacaaacagcttgaataggatagtgttggatcgatagcctcaaagaggattgcgagacctgcgcggaccaccctgagtaggtcagcaagctctgcaccaggagtatgactgagtgctcataatgccatgagttatgatgg

SEQ ID NO: 20408 - DNA, 626 bp, Sorghum bicolor
  Clone ID: LIB5121-004-A1-PF1-G4
gaatgctgttgtgtgccaatccacccgcacctccgatcccatcttccaaaccggcaaaccctacccccgccgcctccgactccgactcgcccgtgatggcaagacaagccctcgagtgcgagagcagcgcttcccagaacggccgctccgccgcggggtcgcagccggtctccgatctcgatccggccgcggggaaggatgcggcgccgcgcgggcgcgccgccacggctgctgagctcgaggagcgcctgctcaagaggctggacgagttgtacgcggcggccctggcccgcctcgccgacctcggccacggcgaggaggcatcgctcgaggccgttctccactcaggccactgctacggcaagctcagggaccccgtttccaacatcgtcgccaacacccgcgcttatttatccgaccctccccacgccagcagggccggtggcttcgccgacctccgacgcctcgaggagtactccctcgcggggctcgtctgcctcctccagagcagctgccataccctcacccgcgccgagggcttccagtgccttctcgccagtgacctccgcctcgaggaggcgatagccatggcgctctctctcaatggtgaacgctcacccgcttct

SEQ ID NO: 20409 - DNA, 471 bp, Sorghum bicolor
  Clone ID: LIB5121-004-A1-PF1-F10
acagatccccaagcccgaggcagcgctagatcgcgtctccttccggagcatcagccgcgagggcgtcgagctgcacagccacgtcgatgtcagcaatccctactcgcaccgcatccctatctgcgagatcacctacaccttcaagagcgctggcaaggtgattgcgtcgggcacgatgcccgaccccgggtggatcgcggcgagcggcagcaccaaactggagctgccggtgaaggtgccgtacgacttcattgtgacgctgatgaaggatgtgggaggggactgggacattgattatctgttggaggtggggctcaccatcgacctccccatcatcggcgccttcactatcccgctcaccactgaaggcgagatcaagctccccaccttccgggacttattgttttaagcaattcagatgtttggaaaatgaatcgatttgtttatttcatatcataattagtgttgttc

SEQ ID NO: 20410 - DNA, 408 bp, Sorghum bicolor
  Clone ID: LIB5121-004-A1-PF1-F7
atctccttttctcttacatttcggtcagcggaaggagtcggaaaacatgcctgctcaacaacctaccactttcaagcgattcgtcgaggtcggccgagttgtcctcgtcaacgacggaccatcagctggtaaactcgccgtcattgctgagatcatcgaccacaaccgagctttgatcgacggaccaaccacctctgtccctcgacaagctttcagctaccgaaacttcatcctcaccccttacaccattgccaagcttccccgaggagctggatccggagccatcaagaaggccgtcgagaaggctggtgttttggagaagtgggagtctagcggatgccccaacaagctcgctgccagacaggtccgaaagaactctagcgacttttagcgatcccaaatcccact

SEQ ID NO: 20411 - DNA, 444 bp, Sorghum bicolor
  Clone ID: LIB5121-004-A1-PF1-E10
aagagttgatcttgatacattttcacaatcgaaacagaataacattcacccaaatccaaccgaaacatcaaccgagtccatcaacatgcccgtcctccctaaggaagaagaagccaccggcaacatcaccgaccaggtcgcaaaggagtctagcgactcgaccgcctcttcccactctctgcacgacaccgataccaaagctaccagcggcggtgccgccaccttcgaacaccacaaggccaacccaggcccggccatcgccgacaacctcggcgagccagctagcaaggaggagctcaagaagaggtctgatgagctgaacaagaagtaaacaagcagtccaacacgatgaaacatccaggacgtcagtgtgcaagatgcacgtgaaggccatgagacacgattaggcacgacataccataatgcaaacacaagctgttgatg

SEQ ID NO: 20412 - DNA, 450 bp, Sorghum bicolor
  Clone ID: LIB5121-004-A1-PF1-D4
ttctgcccctacgcagctgggtgggtaacagaatgtgggtgcctcatccaaggtcgaagggaccgtggcgctgatggctgctgcggcagctcggagaggggcggggcgatcggtatttgaaagttgaaacgctgacaacttggaccggggtggccacagcgaacaggcattgcgcggagcctcttgccgagcgcgggggcagagaagacgtgcaatgtaacctgatcgttgggaacgcgatgccgctggcagcatgctgtgggtgaggctcgaggagcacgcggtgctctctgcgcttgtgcctgccgctgaaagattaacctgcaacgctgcgtgagctccaatgctcagggcgtatagtttctatacccattaatttttatagacactatgagcctgtttagatgcagccaaaaaccaaaatatttttgagaaatgtacactttttgg

SEQ ID NO: 20413 - DNA, 692 bp, Sorghum bicolor
  unsure (1)..(692): unsure at all n locations
  Clone ID: LIB5121-004-A1-PF1-C9
gccgctcgaggccnnggccgggcccgggactctccactacactctctagcaacgtccaaaatcacccaaacaacaatctcttaatcccaaaccgttaccatgaagttcgtcaccgctgctgctctcttcgctgacgccgctgttgcgctccccgccgcctccaagtgcggtgagatggtcaccatcactgactactccctgcgctggaactttaatcaggtcgaatctgttagcttcaagctcagcggcaacaacgccaccgacctcgaatgcacaagccccagtggagccattcaggaaattccaagtcctgtctacacctgcggtgacagcaagtacaggtttggtctccagcccgtgcaatctggcttcaacatgaacgacccccagtacaacatcgctgtttaccacgagactggacctgccgttggtttgtgggccgagactcaggttcctacctactgcagggctggaggcatcagcaccagcgaccgcatttgcgaccaaattccggatacctggtcctttaaccttaactgttcctagaacgcttcttgcgaatacactggaagcgttacatgatgtatcgataacatatatatattaagcctccatatgtagatatatacatctacactttgtaaataactaataatatatagttataatagaaatcattcttgaacattttc

SEQ ID NO: 20414 - DNA, 711 bp, Sorghum bicolor
  Clone ID: LIB5121-004-A1-PF1-B6
atatctaggttagacaccaaaagtgcatccgccgtcaccaccatagaccactcgacaccagccaccgccgccacctccactgcctcaactggtgctaccacctatggttctttgttctagccgcttcttgtagaactgctggtctacgaaccttgggatctctctcaacatctggcatagactttgtagtatggcgccttccaaagcacgccaaaagaggtcacttcctcagatcactaccatcgccggcactgggcccatcgcaaactcgcaacccgccagctcgacattgacgaaggaagtggatcagcaggaggagcagtgtctaaaggaaccaaagatccctccattaccgccgatcacggtgaatgtagtcccgcaacaagggttgggctgtgaagtggtggaagggctactcctgcctagccgaaagcgagagtacaagtccaatggcaagtatactgtgggaaatcacccaatctatgccatcgggttcaacttcatggacgtgcgctactacgacgtctttgccactgccagctccaatagtgtgacagtttaccggtgccttgagaatggtagttttggtcttctaccagcttatgttgatgaggataaggatgagtccttctatacttctagctggaccatcaataaagttgatcgcaaaccactgttggtggctgcaggaaacaatcagatcattccgat

SEQ ID NO: 20415 - DNA, 791 bp, Sorghum bicolor
  unsure (1)..(791): unsure at all n locations
  Clone ID: LIB5121-004-A1-PF1-C12
cttcccgcgcggcaaccaccattctcccgtgcgtagcttccctccccctccctctatgtccgccctgtccgccgtccgtcatgttccagtcgaagctagggcacggcgcgtagccccttcaccagagccgaagctagagcacagcgcgagatccaatcgccatggatccgccgccagcagaggattcagggcgacgccctcctcgcaaaggagggaaggcgcgcgaacaccggcttggactgaagaaggcctccattctcgcgccatcaccacctccaagttcgtcgctagcgccgccaccgattcctccaccgccgccgccgatttcgtcctcaactgtgccgactacaatgcctgctgtgccgattccctccacagcagcgccgactcccgccccaggtttgcctagttcatcccctgctgcgctgacatcgaccatgccgccacaggcactgcaaggagcaggatggggtgccatacccccaaaattttccatctctttatggaaaccatcgaggcccaaattcatgggtgggaatctggcatggataagttatcttcaaagtcatcttgcggagtaaggatgaaagcaactatgtggtgaaactactgaagactatatctgtgttatctgaatttttgtgacctgaactactgaaggctatcggttatcttagtttagtatatgcactgctgaaggttatctgctggggactggagttatctgaactttttcttatatcgatcttangtccaattttntacagctcacaacagctttatgagctatt

SEQ ID NO: 20416 - DNA, 645 bp, Sorghum bicolor
  Clone ID: LIB5121-003-A1-PF1-H8
taggtcttttaggtgtcccggggtcgtacccagccgggcggtcgggcggagcgcggtgacgcgggagacggcagcgtcagagaggcgggtggcggtgctgccgaggtgctcgaggatgcggcggtccagatcggcgacctctctctccagctcctccacactctccagctcctccgcctccgcgtcgtcctcagcggctgcggcggaggccggagccttgcgcttgcgctggttgggcgtcgtcctcagcggctgcggcggaggcaggagctcaatttgcaccggtcttcttgatctcaatttgcactcgggcgtcgccttcttgagctcctccgctccagtgcgcatgcgcaggcgcggcagtgacggcggcgtgcgggcagggcgtcgttgctggcggcggtgacggcggcgcgcgggctgataggttggactcgcgtcgttgctggcggcgcggcgatgttgggctgaagcagataggtagttgggctggagttggactcaattttgagtccctattgtatgcagcccagcatgcaaatggaataaaataggggcccaatttgcatgctgggctggagttgctctaacaaatggcctatttttttgggttattacattcctgttactccgtactgcttcttt

SEQ ID NO: 20417 - DNA, 377 bp, Sorghum bicolor
  Clone ID: LIB5121-004-A1-PF1-A5
cattccatctcctttgacggcgtcatctcaattattggattccttggcggtgtcaagggcgagaagcagcccaccttcctcgagtgcctgaacaacatctgcaccgtccgcggcgtcctcgtcggcaacagacttcagttcgaggagatgaatcgcgcgatcgaggcaaacgatatcaagcccgtcgtcgatgagaaggtcttcactctcgaccagaccaaggaggcgtacgagtacatgtggaacgcaaagcactttggcaagctctgcatcaagatcgactaaatctggtcttaaggtgtcttactaggataatctgagacgtaaccgatgcgcacgtaaaacacgcaatgaattatgatcaacaatactaccac

SEQ ID NO: 20418 - DNA, 531 bp, Sorghum bicolor
  Clone ID: LIB5121-003-A1-PF1-H2
tctgctccatcgtcagcatctacttcatcgaccgcacggggaggaagaagctgctggtcatcagcctcgtcggcgtcatcctctccctcgccgtgctcaccgccgtgttccacgagaccacgtcccattccccggccgtcagcgccgccgagaccgcccacttcgacgcctcgctgacgtgcccgtcctaccggtcatcgtcgtcgtcgtgggactgcacccggtgcctgaaggcggcgggatcgagcgagtgcggcttctgcgcgtcgggcggcggcgagctgctcctcccgggggcgtgcctggtgtccaacaacacggtgcgggacgcgtgccacggcgaggggcggctgtggtacacgcgcgggtgcccgagccggtacgggtggctggcgctgctggggctggcgctctacatcatcttcttctcccccggcatgggcaccgtgccatggatcgtcaactcggagatctacccgctgcggtaccgcggcgtgtgcggcgacgcggccggcaccgccaactgggtgt

SEQ ID NO: 20419 - DNA, 844 bp, Sorghum bicolor
  unsure (1)..(844): unsure at all n locations
  Clone ID: LIB5121-003-A1-PF1-H3
aattccctcggcagagctcgccgccggggatggaggcggcgcgggagtccatggcggcgctcctcgacgccggcctcttcgggcccgcccaaacgctggggtgtttccttgtgtcgtcggcgggtgcgggcaacgatgctggcatgtccatgaaggtggagagcctggtccagcatggtgatgctttgtatggagagagagaatttcgcagggcactgaatgcgtacaagcaagctatgcaatatagtagaagtatccctaggcaagcaacaagtagcaccagaagttcagtatccgccacaggccgatcaccttctccgaattcttcgaatctcttatcattcaatgaaaatgaggtgaagttcaagattgctctctgccattctgctctatgtgagcaccgtgaagcacttcatgagatggaaggtattccttcgaaagtgagaacattaaaaatgaatatgatgttagggaagctatatcgaatatcaagaaatagtcgcacagctgctgtctgttataaggagtgcttgaggcaatgcccttatgttttcgaagctatcacagctttggcggaaatggggctttcagcaaaggaattttctttattatttccacaagcaccaaatagaggaggcaaggtgccgggtgactttgtagatgcacaacgttggtggactcgttatgttgaggcacagtgctgcattgcttcacatgattataaaggtggccttgacatatatctagaactaatgcaacggntccccaataatgtgcatatcttgctggagattgctaaggttgaagccatcataggcaggaatgatgaagcaataatggactt

SEQ ID NO: 20420 - DNA, 630 bp, Sorghum bicolor
  Clone ID: LIB5121-003-A1-PF1-G4
acatctcactgcaaaatggctgcccggacttcaatcgcacgcgctgcgcgccaattcacctctgccgccgcgaggagaccatcacctttcgtgtgccagaggtggcagcaggcgacttccaagcaacggctattctcggtatctgccgctctgaaggagaagaagtacaccgaggaccatgagtggattgagatgtctgcggacggcaagacctgcaccctaggtatctcagaatacgcagcaaaggcccttggcgacgtagtctacatcgagcttccccaggtcgaaatggacgtcagcgaaggcgatgccattggcgctgtcgagtcagtcaagtctgcttcagatatcctcacacccatctccggagtcgtcgccgaggtcaactcggcgctagagcagacgcccgccaacgtcaacaaggaccccgaaggcgacgcgtggattgcaaagatcaccgtgtctggtgagccaagcggcaagaccatgacaaaggaggagtacgctgcttttactgaggagtaaatgctcgagcaagagttgggaggaagcatcaatgcatgacatagagatacctaggcgcatacttcaacacggaatgcgaaaataacacagcaaaaaaaacaaaaa

SEQ ID NO: 20421 - DNA, 454 bp, Sorghum bicolor
  Clone ID: LIB5121-003-A1-PF1-F10
ggttctcctcctcctcacgcacgcacgcacgtgagcgcgtgccacggcagaccaccacgaccgcccgaccgtcccgccactgagctccgccgctctggtactgttaccacccctgtccagcccagagattccaaaattgacgccaagatgtgcttccccgatgtggtactcggacatgctgctcccgcgcgtgctgctgcaggagctcctcctcctcagtcaccttcaccgcttcctcctctgagccttccactgcgagggtgtcgaagacctcatcaacctcgtgtgaaattactaacccccggcgccccccacgtcacacgtcgacatgagcaccatgacgcgctcgagtacgcccctctgcactgacggcgagacggagttcacgcccttcccggtacttgttcatctaggaggttctcacgttggtgcgctgcaacgatttgtttatttc

SEQ ID NO: 20422 - DNA, 806 bp, Sorghum bicolor
  unsure (1)..(806): unsure at all n locations
  Clone ID: LIB5121-003-A1-PF1-F8
ttttccctctcctttaatctggacagcttgcactacaagccaaaacaaaaatccacgaaaaatatcaccacaaagcacaaaaaaccaccaaaatgtcgaagcccgtccaccccgctaccgtccacttccccatcgccttcctctctctcggctacggcctcgacatcctgcacagcctgggcggcaacctgcccaatgtcatcgccaatgccctcccaccggccaacgacctctctcgcgccgcctactacatgctctcactcggcctgatcacctccatcccagcagtcatgtcaggaggccagcaggcagtgcaactattctccaagcagggcatgtacgaggccgatggcaagacgctgaagctgaagtccaaggccgtcattgctcacgccgtcacgaacgacctggtgctcgctgtcacaacctatctgtggtactcgcgccgccagcaggccgccaacactctggctggaaagctgggtgttgagagcctggctactgctgaggctgcttacgcgccgcagatgtggcaggtgattgcggaggtcctggcattgggtgttcttctgtttgctgccagcattggtggcgctcttacctacaactacggtgtgggctttgcgccagctggtaagtcgggcaagaagtcgcagtagaggatgggaaatggggtgnntgatgatatcatgtgaactgctttgggctattgcgtatgcgaatcgcgaatcgagtaacgtagcgtagcgtaagcattattgggatttatgatggcatccagaaaaaaaaaaaaaaaaaggccccta

SEQ ID NO: 20423 - DNA, 636 bp, Sorghum bicolor
  unsure (1)..(636): unsure at all n locations
  Clone ID: LIB5121-003-A1-PF1-F9
accttcgttattcgtccacacgaacacaatggcatccaagaatcaagttgatctcgagtcccagaagcccgcgccggcgactgctgacgccgtcgttgcatcggcggctcccataaccgtaactgccctgccggtttcttctggtggagcttcatcagtggggagaaactcaggctccgtcgtcgtcggcgtctccgacggtcggcacgtggcgccggagacccagccactcctcctggctgagctgccgaacggcgacagccacgacgacgagggactgggagacgacgacggtggggctaccagtaccaccggcgacgaggcgacgaggctggagcgagcaatggcgaaggcattccggagcaccgcagagctggccaagcacctccccaccggcgcggttcttgtcttcgaggtgctgtcgcccgtgttcaccaacggcggcaagtgcgacgacgtgaaccgcgtcatgacggcctggctcgtggggctctgcgccgcggggtgcttcttcctctgcttcacggacagcttccacgacgccaagggcaccgtgcggtacgtggtggccactcgccgcggggtgtggntcatcgaccgcacgccgccgccgtcgccggagaagccgccgagaaa

SEQ ID NO: 20424 - DNA, 395 bp, Sorghum bicolor
  Clone ID: LIB5121-003-A1-PF1-E10
gtgtctcgctggatcgcggagatcctctcggtgcaccgccccggcggcgtcggctacaacatcaccgtcgggctcgacgtcgagtggcgcccaagctaccgctcgtaccagaacccggtggccacactgcagctctgcgtgggccgcagctgcctcatcttccagctcctccacgccgactacgtccccggcgcgctggcggagttcctcggcgaccgcgggatctgcttcttcggcgtcggcgtggcggcggacgcggagcggatcaccgacgaccacggcctgcaggtggccaacgcggtggacctgcgcggccgcgccgcgaagtgcatgaaccgcccgcgacctccgccaggcggggatgcgcggcctcatgcgagccgtgatgggcgtga

SEQ ID NO: 20425 - DNA, 750 bp, Sorghum bicolor
  unsure (1)..(750): unsure at all n locations
  Clone ID: LIB5121-003-A1-PF1-E7
agctacacgcaatccaatcccaatcccggtcgcttttcgctccacccctccactagcgcgatacatacacccccgtcgtctttgacaccgcctacgacttattcttcactaccgtcacctctaaacaccccgacactatcaccatgaagttctccgctgtcatcatctcgcttatcgccgcctctgcctcgggcgtctctgccgcgccggttgcccagactttctcggccgcccccgccgctagctccggtcccgccggtcagtgcttcggacgtgcctgcggtggctacccttggaagcgagaggccgaggccgaggctgaggctcagaccttctccgccgcccccgccacttccaccggccctgctggtcagtgcttcggacgagcttgcggtggatacccatggaagcgagaggctgaggccgaggccgccccccagaccttctccgccgcccccgccgccagctccggacctgctggacagtgcttcggacgagcctgcggcggatacccgtggaagcgagaggccgaggctgaggctgaggccgccccccagaccttctctgccgcccccgccgctagctccggacctgctggacagtgcttcggacgagcctgcggcggatacccgtggaaacgagaggctgaggccgagggcgccccccagaccttctccgccgcccccgncgccagctccggacccgctggaaagggcttcggacgaagtttgcggggataccgtggaagcg

SEQ ID NO: 20426 - DNA, 522 bp, Sorghum bicolor
  Clone ID: LIB5121-003-A1-PF1-C8
gtctcccagccatcgtccccagtcgccggccggcgtcgtcgtcgtcgtcatcatcaccagggtcaggagggaagccggtgatgtgatggtggtgggcatcgacgacagcgagcacagctattacgggctggagtggacgctgcagcacttcttcgcggtctttttgatgcaggtgatcgacgtcagctacgaagccatcgagggtgacgccaggagcgtcatctgcgacgcgtttgatcggcaccacgccgagatcctggtcgtcggctgccatggctacagcaagtggaagaggtccatccatcatctctttgacgctcgtcgtaattaagtttggttgaaagacacacacacacacacaacatgttttgatccaaatggggcgtcattttgcttcttggcctatattcattctaccttggagcaatgtttatcaaaaacagtttatatcagagcaaaatgcttgcactacaagttcattagtttttaacaagggatgtcattttgcttttttttgctaag

SEQ ID NO: 20427 - DNA, 291 bp, Sorghum bicolor
  unsure (1)..(291): unsure at all n locations
  Clone ID: LIB5121-003-A1-PF1-D4
cggccgctcgaggccnnggccgggccgggaatgttcagacgaggactacgtcatgcgccgtaacgccgtcgactttggtgtgccgctcttcatggagcccaagactgctgtgctcttcgctcagtgcatgaacgtcaagctgcccaaggccgagggtgtccctgctgaggtcaggaggtggtccgacttcattggtggcaagcctttgtaagcgtacagaggttttcatgtagcatgtttctttatcacgatgatatctttatttactgttcaataaaaatttactgttcc

SEQ ID NO: 20428 - DNA, 372 bp, Sorghum bicolor
  Clone ID: LIB5121-003-A1-PF1-D5
aactcccatcgagaggaaagtgttgtcacttcgttcctcactccccatcctccctccctctctccctttctcgactccggccgccgaggtcaaaccccaccacgatgagcggcggcggcgcggccagcgcaagcgcgagcgggagcttcgagcatcatcacgcgaagcggcgtcccccgacgcctggtccgccccagcagccgccgccgcagcagcggaagctgctgacgctgtcggtgcaggacaacgacggcgtggccgcgggcgtggtcccgccggtcaccgtggtcctggacgggcgctgcatctgccaccgcgtccacctccaccggcataccgggtaccgcagcctcggggacaccactccccgca

SEQ ID NO: 20429 - DNA, 452 bp, Sorghum bicolor
  Clone ID: LIB5121-003-A1-PF1-B9
atttcaaataaatagccaagagccaccagtttccccaccaccaagaacgatcaccgatagcgtgcgacgatgtatccgagagaacatcatcagagggctggaccgcctggaggtagcaggggcgaagagccgagaccgcaagcgtctcgactgctcacagccatcgtcgcggagacgtgcatgtgcgtctgtactctactcgtctcagtgacaaagccacgcggagggttgccctcaagggttcagtgcctatgaccgtttcgatggaccaccagccagcagcgcacggtgagctggtttcaatcgcaggactgacccttgacgtgaataagaagctgactgctggcattgattccatcctgaagccacagctgcctgttcccgagtcccgcttctacctcaagttctatgaatcaaacgcgctcggacttcgcctgaaacctatccacctt

SEQ ID NO: 20430 - DNA, 682 bp, Sorghum bicolor
  unsure (1)..(682): unsure at all n locations
  Clone ID: LIB5121-003-A1-PF1-C11
cgctcgaggccnggccggggcccgggaactacaccccaccaaagcaaacgacatgccgtcgtcgtcgtcgtcgtcgtcgtcgtcacaaagccgcagccgcccgtgctgctggctgccactgcttctcgtcctccatttctctcgcagggccaccgccgccggcaaggtgccggcgctgatcgtgttcggggactcgacggtggacgccggcaacaacaacttcatccccaccgtcgccaggggcaacttcccgccgtacggccgcgacttcgacaggggcgtcgccaccggcaggttctccaacggccgcctcgtcaccgacttcctctcggaggcgttcggcttgccgtcgtcggtgccggcgtacctggaccccggctacaccatcgaccagctcgccaccggcgtcagctttgcctccggaggcaccgggctggatgatttgacagcggaaatcgcatcagttatccccatgagccagcagctggagtacttcaaggagtacaaggcgagactgcagctcgcaaagggggagaccgcggcgaacggcatcatcgccgaggccgtgtacatcttcagcatcggcaccaacgacttcatcgtcaactacttcaccttccctctccggcaagcccagtacacgccggcggagtacgccgcgtacctcgtcggcctcgccgag

SEQ ID NO: 20431 - DNA, 639 bp, Sorghum bicolor
  Clone ID: LIB5121-003-A1-PF1-B7
ctcttcgaattggtcgccaccgtggtttcggtaagaggaagggtaccaaggacgctcgtatgccaagccaaatcgtctggatgcgccgtctccgtgtcctccgccgtctcctcgtcaagtaccgtgccgccggaaagatcgacaagcacctttaccacgagctgtaccacctgtccaagggtaacaccttcaagcacaagcgtgctctcgttgaacacatccacaaggccaaggctgagaaggcccgcgagagggctatccaggaagagatggacgccaagcgtgcgaagaccaaggcggcgagggagaggaggcaggagcgtgtccagcagaagcgtcaagctcagctgggcgacgaggagtaagcacgggatatcatgatgaacacctggcgtgggtcttttcaaggttaaaggagggcgtcattctcctttttatctgggcatatgcggtcatgtttcatgctacgtctgtgaaggactcttctctccatgcatactcgaccgacaaggctgcccccgctctgatcaccgatgctatgagtgtaccaaaaagggaatgagcatcggaattagaaaccagtagtcaaacttggagttggtctgctttcatggaaaaaaaaaaataaaaagggcccta

SEQ ID NO: 20432 - DNA, 653 bp, Sorghum bicolor
  Clone ID: LIB5121-003-A1-PF1-C3
gttgcgaccaatttcttccttgcagagtgttgggcgatggacgttgccttaagcaccaccatggctgtagctgtagtcatcgcccttttcatccctgcactgctgctgacactggtgcaaagaagacagcacactggccataataagccacctccggatccgccggagcccagaggcattcccctagtggggcacctccacctcctgataaagaagccactccaccgcaccctcgcccacctcgccgaccgccaacgccatggagacgtcctgggcctgcgattcggctccaccacccgagtcgcggttgtgtccttcgcctcagtcgcccagcagtgccttgtcgcactggacacctcgttcggcaaccgcccgcgactgccgtccgcgaagatcctctcctatgactggtcgaccatggggcattccaactgcggggcattctggcgccaagtccggcgcaccgccgccacggagatctcctccgtggaacgagtgcagcacttcgccgatgtccacgagcaggaggcgcgggccatggcacgccgcctttgtcgtgtggcgcttgctgcttctgaggggcgagctcttgtagacgtcaaggcacggctgtgggagatgctaatgaacggcttactgcacatgctctgcaa

SEQ ID NO: 20433 - DNA, 694 bp, Sorghum bicolor
  unsure (1)..(694): unsure at all n locations
  Clone ID: LIB5121-002-A1-PF1-D8
aagtttcttctgccctatgtccgtcttcgagtcgcttgaaacctggcggagtatctggggcggcggggcgagaggcgcacccgaccgtcgcggtggccgcggaaggggattgggaggagcgctggagaggccgggccagcgccgctccacgggcgcgccctccaacccaaaatgatcttagcagaggcccaaagggggctcgggcgtcgtcttcaacttctactcgccgtcgtcggtgcatcgatccttcgcgccccacgctgccagctacctgcggctgccgccccacgctgatgtagcgataggtttgcccctgtttcgctcagtttccgcgcggccgcagcaggcagagccagccgccacgggcgcttctccgacgaagccggtgctccctgacctcgacgaccctggtgagagctcctccgtcctcctctttgctgccattttttgtctcctctttgtttccctagccaatgcgaccctcttccttcccggccgtcggccgatgcgtcgcgtggccgcgcatgcttttgtcccagagtcgactccgccttattgctgcccactgtgcccaaaggtactggagatggagatgaggttgagttgngagaaggggaaaacgagattgggatgggaagaagtgtggaataagagaagttgctcctgtttttttgctgatgttcttgctgacttt

SEQ ID NO: 20434 - DNA, 462 bp, Sorghum bicolor
  Clone ID: LIB5121-002-A1-PF1-E10
gaataacgaaaggcaaaagcctctcaattgattaagattgattaaaacccaatcgaagtcggttgcgagacttttgtaaagtcggtgacggcacccgcgactccatcaatcccgattcagttcgaattgatagagccggcggtccctgtctagtcgccgcctccattcctcaggcgtacccatgccaccctccgaagattgtctggccccctcaagagatcccgattcagttcgaatctcttgaggggtgcttattcacggctcggatgggggtggtatggtggcgtctgaggagcctccaaagttgtctagcctctcggggcgtacttaggcactgaggaggtttgggggcggaattgattaggctgggaccacgggtgccgccctggccccctgccctttcaaaactcgtcccaaattcgcaaggaccatttacagggcctcgaggagccggatacgacg

SEQ ID NO: 20435 - DNA, 565 bp, Sorghum bicolor
  Clone ID: LIB5121-002-A1-PF1-D12
catggtgcgatgacattctgccaagcggtcaccgggtgcgccgtggtgaagtcatcctggtctccatctatgctattggtagaatggagagtgtgtggggcaaggattgccatgagttcagacccgagaggtggatctccgaggatggaaccaggctacagtatgtgccatcttgcaaatttttggcttttaactcagggcccaggatgtgtctgggcaaggacatcgcgatcatggagatgaagactattgttgccgcagttttgtggaactttgatgtggaggtcttggaagggcagagcatcaggcccaagttatcgatccttctgcagatggagaacggactcatggttactgtcaaaaagagaacataacgcaatatgctatagataaagctatctgctatgcgttctcagtaaaataaggcagctgttcattgcaatcctcatatattttaaatcatgccgtatcttatacttatgtatgttttgccacatatatattgtaataagggtatcatgtattactgttgaaatgacaagcactaatcttgagtcttagcatc

SEQ ID NO: 20436 - DNA, 494 bp, Sorghum bicolor
  Clone ID: LIB5121-002-A1-PF1-C6
gatccaaaaaacaaccgccgcctccactctcgctgtagctctcctctcccttccccttgtctgccacgactccagccagaccttcgagtcttcgacgacgacgacaggccggggagaaaacaggccgtcgtcgtctccgaggtctctgtctctccatccatggaggaggagacgcccaaggccaagaagcggtcgtcggtgctcgggagcctccgggaggcgatcgccaaggtccggttcctgctctccttcagcgcgacgcggtggatgctgctgaggtccctggccggccgcgcgcggcgcctcagcttcgactcgcggccgggcctgctggacgtcgaggacagcatcatcgcgtcgccggcctcctcctcctcctcgtccagctccaggatcacgtccaggtcggcgagcctgggcacggcgaccaccaggagcctgtcgcggaccagcagcgcggccacggcgtcgcccgaggcgctgaagagggcgtc

SEQ ID NO: 20437 - DNA, 451 bp, Sorghum bicolor
  Clone ID: LIB5121-002-A1-PF1-B9
actccgaaacggcgacatggtttccgcggctgcaaggctcgggctccgcgcccctgtgctcggcgcgcgagcccgcgctcggcgcgcccgcactcctccgcaaccccgcgatcggcgcgcccgcattcctccgcaaccccgcgctcggcgcgcccgcactcctccgcgcacctgtcctcttcggcgcgcccgccctcttccgagctcccgtcacgaccaacgccgccgacgtcgcgaaaaagcccaccaccaaggtcgccccggacagcgccaacctcatctggctgcagagggagctcaccgaagtctctgcctcatccgccgccaggtttggtgctcttcatagggagatactgagcatgtcggcgcagctgaagaaggcacaggccgatcacgataacactattttacagtgcccgcgggatgtctgccatgagacatgaaggactga

SEQ ID NO: 20438 - DNA, 683 bp, Sorghum bicolor
  Clone ID: LIB5121-002-A1-PF1-A4
gactcccccccaaaggacaggcacagcgcgcctgagccgggctcgtcggatggcgtacggaggcgccgcccgcggtcgcctcgccgaggagcgcaaggcgtggcgcaagaggcacccccacggcttcgtggccaagccggcgacgctgccggatggctccgtcaacctgatgctctggaactgcgtcgtccccggcaaggaaggcactgattgggaaggtggatatttcccacttactctccattttactgaaaattacccaagtaaccctccaacctgcaagtttccgcgaaggtttttccatgtcaatgtctatgattccggggatgtatgcctgtcaatacttggtgatgcatgggcgccttctatcacagtgccgcaaatccttgtaggcatccaggggctgctggataacccaaatccagcctctcctgcacaggattttgcttatgatgtctttgcaaagaatatgccagaatacaagagacgtgttcgtgagcaagccaagaggtatccttcactcgtgtagccgtggacctctacaacacacttgctgctaaccaagtagttattttagtgtagtggaacttgtcgtgattgtgcttaagtatgttgtctagttagccgtacgcttattggaactgctaaaatgcactccgactgtattattgttatgccctact

SEQ ID NO: 20439 - DNA, 832 bp, Sorghum bicolor
  unsure (1)..(832): unsure at all n locations
  Clone ID: LIB5121-001-A1-PF1-H12
ttactacccaacagcgacgacacccagcacccttcagtcttgtctttcgtaccgcggaagactcttacacagaaggactcagcgaaaatgtctgacggcgaggtcgaggttgaggcgccccagggctacccggtgctgcccaaggatgtctcccaggagatcggctctaccaagctgttcaacaagtggagctacgaggatgtcgagatcagggatatctccttgaccgactacatccagatccgcactcccgtctacatgcctcactctgccggccgctacgcccagaagcgtttccgcaaggcccagtgccccatcattgagcgtctcaccaactccctcatgatgaacggccgcaacaacggcaagaagctcatggctgtccgcatcgtcgcccacgccttcgagatcatccacatcatgaccgaccagaaccccatccaggtcgccgttgacgccattgtcaactgcggtccccgtgaggactccacccgtatcggttccgctggtaccgtccgtcgccaggccgtcgatgtctcccctctccgccgtgtcaaccaggccatcgccctcctgaccatcggctcccgtgaggccgctttccgcaacatcaagagcattgccgagtgcctcgctgaggagctcatcaacgccgccaagggttcctccaactcttacgccatcaagaagaaggacgagctcgagcgtgtcgccaagagcaacagataanaagggtatgggtctgcatgggctggtgtttacgctgtggctgcgggattgaggtacctgctactgcnctttttctgcgcatgcttcgagtatccgtaacctg

SEQ ID NO: 20440 - DNA, 481 bp, Sorghum bicolor
  Clone ID: LIB5121-001-A1-PF1-G12
gatttcaaactggcgactccgagtctccgactgtccgtctcggccctgaggacgagcggcgcgaggatccggttgccacggccccctggccaagccccgacgacgagcggcgcgaggattcctcgtcggcggccgcccactggctactcgcacgctgccgtcgcctgcccacctcgtcaagcggcagcctcgacgcggcgccgcccccgcggccctgtgtggccacgctccgccagtccaacggcggcgggcgcgccaaggagctggtcgggatagccggcgggcgcccagtgctccagtccgccgtgcactctacctccgcgctggcctactgcagtccccggtctagtgcgcctgttgaaaagaagtgaggaaaaacaattgattcatatctctcgactctcgtagcctaaacccctcccctcttctcctcctaacttctctccaaaatcatctatattttatcttagattattgtcag

SEQ ID NO: 20441 - DNA, 698 bp, Sorghum bicolor
  Clone ID: LIB5121-001-A1-PF1-E7
agtttctctcccaagcagactctcaactacgaccacgaccacattacctcttaccacttcacctccaccaacactcaatcttaccaaaaccaacctcacatcttcaaaatgggtttcgagaagggcgattctaagaagggtgccaacctcttcaagacccgttgcgctcagtgccacaccctgaaggagggtgagggcaacaagatcggccccaacctacacggtctcttcggccgtaagaccggtcaggtcgagggcttctcatacaccgacgccaacaagcagaagggcatcgagtggaacaacgacactctcttcgagtacctcgagaaccccaagaagtacattcccggaaccaagatggctttcggtggtctcaagaagcccaaggaccgtaacgacttgatcaccttcctcgctgaggagaccaaataagcgtctctcgtcatacgaacgtttattccatcctctcgacacgccatgacctttctctaataccttttcgacccaaaatctgtttggattgtaccatcatcgatgatagacgaacgacggaggcggtaagcgcagtagagcgcattattcctccatgtagattatgttgggtgtatcatttcagggcgtctttcgactttggtgcagcatagagccagtttggaacttagtggcactttcgaaataccaaatctcctctaccg

SEQ ID NO: 20442 - DNA, 462 bp, Sorghum bicolor
  Clone ID: LIB5121-001-A1-PF1-F10
gttttcctcaccgctctggcctccaccacgctatgccaagcccgtcttccgccccgcggccgtccgccgagcacgccgcgctgcattggccgcggcccggccggcgtgcactggcaaggcagaagcgccgccacctcgacaggcgcgcggcgactaagtggattcgagactcaacttcaagttattttcaggggagcgttttggcttcgcttctgggcaccactgcagcgtgatgagcaagctaaagccatcctttcagcgataagcaaaaagttggagattatcgtcttagacatttcaaataaagggtggaaacatttatacagtttattttagtatcctggccattgtttaaggccatgccttgctctttacttttgtatccaaaattttgtaataattgggctgccgtacattccctgggatgaaacaggcttggattttttatatcccatttatctt

SEQ ID NO: 20443 - DNA, 580 bp, Sorghum bicolor
  Clone ID: LIB5121-001-A1-PF1-E11
atcttccttacgaaccaccagccgaacgccggtcagcgcccaaatacagcaaaaggcatggacttgccgttcttcgtcgccttctccggcatcctcctggtgggccggtacctccccttcgcgctccccgtgcacgcgcgcgccgtcctcgcgggcagcgacgacgcgacgccggcaacccgcgccgcgaagtgcgccgtcacggtggccttcgccggcctcgtgctgctggtatccagcgcgcagtgttccggcggccggcagtgccaggcggaagtggcgatggaggggagggcgctgtggttcaactccgccgcgctgttcctcggcatggtcctcggtggcgccgccgtggcgctgcacccgcacgctcggtggcgccgtccgatcgtcgatgtggccgtcgaacatctgacgcggttcacggagaccgtcgcgatcaccgcgttcgcgcatgacgtttgcatcttcttcaaggttgtcgagatgatgcagaagtgagacggcatgcaaggactgaagcgcgcgcgtgcgccgggcagcatgcactggccaatgatccaccattactcctaatttt

SEQ ID NO: 20444 - DNA, 712 bp, Sorghum bicolor
  Clone ID: LIB5121-001-A1-PF1-E12
tgaatttccacaggtcgccagggcgcctcagccagcagcaaagccccattctgcgactgcaagcgagatcgtgcgcgcccgatctatgcacacacgtcaatggccggcctccgcttcaccgtcctgttgacagcctattccttcggcgtcctcctcctcctcctcctcgccgcctccgcgtcgtcggcgtcggcgtcacgtccaccggcagtgtacttcgtcggcgacgagtggcggaccgctccggcgagcaacggcggcacccacaagacgctcagcaagtgggccatgaggcaccgcttctacgtcggcgacgtcctggatttcaagcgctccaacgactcggtgctgcttgtgcgctggcgcgactacaagcggtgcagcgcggcgagcccgccggcgcgccggttcgcggacggtggcgacacccggttgaagctcgcccacccggggctcttctatttcatcagcggcgcgccggcgcgctgcgaggcggggcagcggatggtcctgcgcgtcgtggacgcgcgctcgtctctcggcggggacggcgccccgacccttgccccagcgccggcgccggggccgtggacgatggagcccaccaacgtcactaatccgccgtccgaccgcccgatacctgtgtggttcaagctgctcgcgccggcgctgctagggtttctggccgggtgttccttgcaggggtaatcat

SEQ ID NO: 20445 - DNA, 528 bp, Sorghum bicolor
  Clone ID: LIB5121-001-A1-PF1-C11
cagtccctcatggccgccgtcgagaacgactaccgccgcggcgccaaggtcacctctgcccagtcgaattccatgggtccggcgccgcggccctcgtcctcgtcccgcgcgcggctccacgatttctccttccccaccctcagctggggcacgcaccgcgtgctccgctgctccaagaacggccccgcctcctcgtcgcccgcgtctccggagcccccgtccccggacaaggagaaggcccaccgccccgagggcggcggctcgctgacgctgcagcgccagcgccagcgcgccgctcggcggccgtggaaccttcggacccgccgctccgccaccgccgccacgacgcgtcaggcgggatcggacgacgcggacgaggcggctcaggccgccgtggaccgcgcgcctacgccgacggcggaggcgaagaagcgggccttctccttctccatcgcgctgtccaagcaggagatcgccgaggacttcgcggagattcccgggacacggcccccgcgccggcccaacaag

SEQ ID NO: 20446 - DNA, 630 bp, Sorghum bicolor
  Clone ID: LIB5121-001-A1-PF1-B12
acacatgcgccgacgaagatccattccacctttgctgctatcgcgaccggacccttgtttaaccatcccccctcgctcacttcttctctacccacatcaccaaaacggcgtcaccagccccaacccccgacaagccccgcccgccctcacctctgcgcattgctagccagctcacgaccgcctcggccatcctctgggaccccaagtttacctcgcgagcgcccccgggcagtctcaagccagtccacgccggcactcttgtagccccgcagcgcaccgactcgtccatcagcgtccgcaacctcggcgacggccacactgtgcccattgtacctaccatggacaacagaagacaccccagctccttccagcagctggagaagcttggtgagggaacatatgctactgtgttcaagggtcgcaaccgccagacgggcgagctggtagccctgaaagagatacatcttgactcggaggaaggcacgccctcgaccgctatccgcgagatctcgctcatgaaggagctgcgacacgagaacattgtcctgctacacgatgtcatacatactgagaacaagctcatgctggtcttcgaattcatggacaaagatctcaagaggtatatggact

SEQ ID NO: 20447 - DNA, 564 bp, Sorghum bicolor
  Clone ID: LIB5121-012-A1-PF1-H9
acactccatcgctgatacgcttagcacttgagcagcagccgggctgctactctgctgctacgtaccatggcgacgagcaccaacaacgcgcccaacggtatcgggccagtgccgttgccattcaacaacgccggtaacggcgtcgacgccgacgcggacgccgagaagaaggatccccgagtgaaggagtacgagagcttggcctcgtcgctgccgagcaaccccaagctgcggctgcgctgctaccagggcacctgggtgctggcgccgtgggtgccggggataatggccgtgcagcgcgggctgttcgcgccgcgccggggcgacgtggtgctcgcgagcgcgcccaagtgcggcaccacgtggctcaaggcgctggcgttcgccaccacggcgcggggagcgcacccgccggcgcacgacgcggcgcacccgctcctccgcctcaacccgcacgactgcgtgccgttcatggagaagctcttcgccgcggggtgggggagccggatggacgcgctgccgtcgccgaggctcatggccacgcacatgcaccaccttgctcct

SEQ ID NO: 20448 - DNA, 726 bp, Sorghum bicolor
  Clone ID: LIB5121-012-A1-PF1-H10
ccgctccgagccggccgggccgggattttccccttaaagaatatgacagggcgtcgcctacggcccccgccgcccaccggtgatctcgacgccgcgcgcgaagcaacgcaccacggccggcgccggccgccttcctccagcaagtatcccctgtggtcctgtgcgcctgaatcacctcttaatttcgtgcttagccgccgcctttcgctgaggtcgcgacatgccctcctcggcgtctcctcctgcccagcccgcggcaccgccccctcctcctcctcccgcttctcctgcccctccggaggaggtggaggcgactgccggttcgccttcgagggcttcggcagtggggacggtgaactggggaacggccaccctcgttggggtcttcgctgggctgctatacggcgggagcagggaggcctccgcctccgtcagtaaggatgccgaggtgatgctgaagatgggaagcaccactgacaagcgtgaacagtatagattgatgagagatgccatggagaaaaggttcatccgggttgccaaaggttcactaagtcgggggtgttcgagctggggatgtttactgcgactttctttggcatacagaactttcttatcgatactcggggagttcatgatgtattcaatattgccgcagctggatctgctactgcagcttgcttttgggcttatattgccaggctcaatgaagtggccgtgccgaggaat

SEQ ID NO: 20449 - DNA, 472 bp, Sorghum bicolor
  Clone ID: LIB5121-012-A1-PF1-G1
ggccgggccgggagctcccaacaaactacgcagagcctcagccgtcacctccctttcggccgtcaccgtcctgtcctccatcgcaagaaaccatggcgtccttgtgccgctccgccgccgccgccgcgaggtcagcggcggtccggtcgagatcctcgatggcgaggccgttcctggccgcgacgtctcctgtctctccgccacgcatccgcaggccccttatagcagcggcgctggcgagtctagagtcgctcatgccgctgcacagcgcggtggccgccgcgcggctgcggtcctgcatcgccgtcgactccgcgtgctggagctgcctctcacaaggtttgaccaagcgcatctgagcatggtagggacaaaattctaaagagaatggctcatgtgctactgcatcatgatttagcctttcaataccttcatgttatcctgtaaggattagctgacagtatttaaatat

SEQ ID NO: 20450 - DNA, 578 bp, Sorghum bicolor
  Clone ID: LIB5121-012-A1-PF1-F10
cgctcgtagccggccgggccgtggaaatccgtgagcagcgagccaccattaatcatcaaatttaagaggagcgaacaatcaccaaaccaaggcagctctcccgtctccagctctagctagccaccgccgccgcccagcaggaggaggaagagatcgaagagctactagatcaagcaagcaaagcgacgtacgatcgagtgaccagcagcagcagccacaccatgagcgtggtggtcctggacggctcgacggtgcgcgggttcgtggcggacgagccggcgttcgcgcacagcgtcgacgcgcgcttcgcggcgctcgacgccaacggcgacggcgtgctgtcccgcgccgagctccgccgcgcgctcgagtcgttccgcctcctcgacggcgccggcttcgggtccgcggaccccgcgccgctccccggcgaggtcgccgcgctctacgacgccgtcttcgagcagttcgacgccgacggcagcggcgccgtcgaccacgccgagttccgcgacgagatgcgacgcatcatgctcgccgtcgccgacgggctcggctcccagcccctccaggtcgcc

SEQ ID NO: 20451 - DNA, 144 bp, Sorghum bicolor
  Clone ID: LIB5121-012-A1-PF1-F12
cacctcccttcctctagccctctctccccacccacacccgtacctctgcgtcctgtgcgttgtatattgttatggtaggggcgagcaaccagcgaaggcgcacagcaatgagaggttcggtgcgtagagctggttggtgtagtt

SEQ ID NO: 20452 - DNA, 648 bp, Sorghum bicolor
  Clone ID: LIB5121-012-A1-PF1-E3
gccatgcgatccagcccagttgtcgtcaggtgcgcggcgcaccgcagtggcagcgccgcgcgggtggcggcggcggctcaacacccccgaccaaaaaccctagcgccgtcctcgcgcctcctcctatataaacacagacacttccgcggcccggcaccgcgccggagacagagcagagcacgccgtcgcgactccggagacagagcagagcacgccgtcgcgactccctcggccccctctcacacgctcccctgtgattccgagaggacagagcgacgatgccgcgcgccgccgtcaccacgctgctctcgctcagccggaggaggggctacgcggccgcagcggaggtgcgtgtgcgcgcgccggcggcggcaatggcggcgagagccccgggcgcgggcggtgccgctgacggcgcgtcgtcgtccaaggaggtgttctggatgagggacccccagacggggtgctgggcccccgaggaccgctttgccgacgtcgacgcggccgagctccgtgcgcgcctgctcgccaggaaggactagaggaggcttggcgtcgcatctaatccattgatgaacaccttggttggacgcaaaaattcaaactggctagtatgctaccttcgctagaaaccgacgtagcgagtct

SEQ ID NO: 20453 - DNA, 660 bp, Sorghum bicolor
  Clone ID: LIB5121-012-A1-PF1-D11
ccgccactcatttcctccccatacggatcacacagagtagcaccggcggcgcctcctccttccccaccgccggcggcacctcctcctccttccccaccggcggccgcggctggttctccctcacggtggcggcgactcctcatccttgcaaccagttgtcgtggctgctcctcccctgtgcgcccccgccttgcgcggatgcggttgggcgtctgcgcggctcgacccacgtgcacatggctccccggcagcgacacaacctatctctcttggatggaggccccggcagaggagcgaccgtttcgtatcgatgccgacctcaactgcggagcgactcacctcgcgtggatctgtcggtacaaggtggcgcccctctctttgccggcggcggtgcagcccgtctccatggtggtgccatgctcctcgcggaggcgcatgggaagccaggcaacggatctagcatctaagcatgtggatccggattcctccctgtccgctgctggctttggacgctagagaggccccaatcttccatcggaagaggctgctggaaaggccccccatcatccacgccggagagctgcatgctcatgactctgctggctactggaaagctgcctggcttgtacacatcccccatcaggctagccgagacaggct

SEQ ID NO: 20454 - DNA, 552 bp, Sorghum bicolor
  unsure (1)..(552): unsure at all n locations
  Clone ID: LIB5121-012-A1-PF1-C3
ccgctcgagngccggccgggggccgggcctctcacaatcgcgccaccaccaaagcacccgaccggttcccatggcctcccatctcgacttccgctacctggatgagggtctcggcggcgagcgcggcaagcgcaagcgccgcgaggaggccgatgcggcggccgcggactccatggacctcgacgccgacgcgccccggccgtcgaagctccgcgccatgccttccctctccgacccctcgaagccggcctctttcggccagcccacctacgacggcgtcatcgcggggcgcgtgtcgggccgccggtggaaggagccccgcacccggcgggcgtcggccctggtggtgtcgcggaagccgaccccgctggagcagcgcgtccgcgagaagtcgctgaagcgcgcgtaccaggaacgcaaggcggagctcaaggaggagatccggcagaacaaggtggcgaagcgcaaggcccgcgaggagcgggagaagcgcaagcaggagaacgtgctccgcccgcacaccaagctgccgacgtgacaccacccccaaga

SEQ ID NO: 20455 - DNA, 835 bp, Sorghum bicolor
  Clone ID: LIB5121-012-A1-PF1-B4
attgtcattggatgtcctccagcctaccgaggtggaaccaccaaaggaaccgacctcgagatcaacttgatgaaactcttccccaaatcctcctacttcattgagaagcccgtcggaaccggcacagtttctgccgccaaagaggtcactcaacaactcatccaaaacggtaacattgtatccgttggatacatgttgcgataccttcgatgtgttcaaaagatgaagcaaatcatccatgacaacaacctcaccgtcatggctaccaacgctcgatactcgtgtgcttacgagtctattggcaagcccgcttggtggaacaaggcgatcgatatgggaccagtgatcgagcaaggaacccatttctgtgatctttctcgatactttggaggtgatgtcgacatcaactctgtcgtcgcccattccgtcgagcattacgaagctcccggaaagctctccaagatccccatcgacgagagcaagatccctgaagaactccgaatccctcgagtgacctctgccgtatggaaatacgacaatggagcagtcggttcattcacccataccgtctcgctccagggtcacgcctatgcttgtgagattgaagtctgggcggatggataccacatgcgattggtcgacccttaccaagctccaaccctctacgtccgacgaccaggagatgatcacgaggagagacacgtttacactgacgacgatccattcttctctgaaagttcaaactttgtcgattgtatcgagggtggccagaccatacatttcttcttcttcgaggagctaccagacttataattgacttggcgatcgactcctg

SEQ ID NO: 20456 - DNA, 483 bp, Sorghum bicolor
  Clone ID: LIB5121-012-A1-PF1-B2
gtcgtacaaaaagcgcgcagctgtccggccccttcgccggatacgcgcgtgcccgcgttcttctgttcaggcggtcgcaaccgccatgcctccatcgccacctcctccctcctcgctccaccaccaacgaccaacgacgccgcttcctgccctctcccgcttcccgtcgggcgcgctggcctcctagctgactgaccttcccttccctgcatctcctccgagcctgcgtcttccgctccctccgcgatgggcggcctctgctccaaggagggcgtcgtggaggcgccgcccgccgagccccaccccgtggcgcagctgcacaaggcgtcgagccagtccctgaagcagctcatcacgctcaccgccaaggaggacgacgccgccgtcgtgcacgccgtcatctcccggacggtagtccaacgccaaggccaacggcggaatctgagcgcccgcgcccgcgtcggagaacaccgcgcctcccgt

SEQ ID NO: 20457 - DNA, 731 bp, Sorghum bicolor
  Clone ID: LIB5121-011-A1-PF1-H9
aacctcgcacctcctcgatcagccctgcttcgcggttacctcttacctgcttgctagctccaaacagatagatcgacacaccaacatacaacccccggctggcccttcacatcagtctacccaacaggctcaggcaggtgaagaagctgctaatagctaagctagcccccctgctactagtagtgtgccttgcaccaaacacttgctaacctctccagtctccaatgagaaggcacggcggcagcgaggcctccccttccatcatccacacgtcttccatagctctcctccaagagaggttcagaaacctgcagaaggtgaaggagatgagagaaggaagggcgttgcagagggtgcacactactgataccgaccgcaccggttcgtcgtcgtccctgtcgtcggctctcagccttggtctccaagccgccaacagcaacgagcagccgaggtggttcttgcacccggacttgatccgtccgtctaggccgctgcgcggacctgcgtactaccatgggcttggcgccaacggtgtccagacgtcgccgccaccggcgagctcatggggaggaatgcagaattcaggctatagggctgatgtagatgtcgatacctcgcttcatctgtaatctgctataagcacgtatgggccttgctggtctttcgttattttgtatggcatgtcagttccggacttatttgcagcacttctgccggccctggaacttctt

SEQ ID NO: 20458 - DNA, 247 bp, Sorghum bicolor
  Clone ID: LIB5121-011-A1-PF1-H1
cggccgctcagccggcgggcgggacttcctcgaaagcccggcctttcttctcgctttgcggcattgaattgtgcatggcgacgatgaacgtcagagcgctgtgcctcgccgtcgcgatcgtcttctccgtgctcccacggtaggtcctcgtcgtcggcgaaggttccaaggaggccgacaagatcgccgcgctgcctggtcagccgacggacgcggtcttccttcagtattccggctacttttacct

SEQ ID NO: 20459 - DNA, 622 bp, Sorghum bicolor
  Clone ID: LIB5121-011-A1-PF1-G12
tcttcgagacgcctctctcatcggctacgagcgcaactccgaccgcatccccgcgaccttctacgctcctgtcctccgcaacatgaaccgctggcaatgggccattaccatcatccagttcgccgccgaccctgccctgaccacccgctccacctcctggtacgtctggtcgctcttcgcccaccaccccatctccgagaccctccccaccacaggctcctacggccccgtctggtggggcgccggcaaggacgacgcccgcgacgctctcgtctggaagggcgcgtgctacaacaccaccaacggcgaggacgagcccgtgaccgtgcgcttcgacggcgtcaagcgcggcaccaaggccactctcaccctgctcaccaaccccggcggtgacccttaccagtacaacgacccgctcaagggcaacaacatcgtcgagtccaccaccaccgtcatctccgccgacaagaagggcgctttccacttcagcatgccccagctcagcgtcgctgttctcgacactgacaccgaggttgaccagcctggccaccacggcggccaccacggcaaggcacctaagtacggcggtggtaacaaggacaagaggaaatgctaggcatgg

SEQ ID NO: 20460 - DNA, 559 bp, Sorghum bicolor
  Clone ID: LIB5121-011-A1-PF1-G2
acctcctttcagctgaatacttcacagtctatacactttgtaactcaaaaacttcggacctcttgctactttccaaaccaatccacacagattacatatcaagatgcctcgcatggtcgcacccccgccgtctggagagttccagatcgttcttagcaagcctttcaatggcgcaccaacacacatgatcgaggttatcggcgagcccaaccgcccagctagcattcgcatgtccaactacaacggtaactccaagtcatcagaaaagaagggtgatgtaccacaagacgatgttaaggagctcatgtctctcatctccacactacgcggcttcccttcgcacccaagcaaggacgtctacggcctagacaccaaggttgacttcaacacaatggagatccaatggggcaaccaggacgacgatgctgccatggatggtggtgaccttgccggagagcagaaggatgaattcaagaggatcgcggacagcattgaggcgttggcgaggcaattcgctaagcaggactctcctgtatagaatggacagggagtgttgaac

SEQ ID NO: 20461 - DNA, 679 bp, Sorghum bicolor
  Clone ID: LIB5121-011-A1-PF1-F2
tcgagggccggccccgggccgggaagattcccttctgccatgtccatcccctataaatgtattcttttcagcctaatggaagccaccctttggttgtttgttggtgaacaactttgcttttcatcagaaaccaaaaatggcagccaggatcccttgccatcgtcacccttcttcctcctcctcctccatggccatgatctgcccaaggtcatccacaaggcagtcatccttcaggttcaggacctctgctcatggtagcagtgcttcaccacacctctcctttactgctgtgacagacaagaaggttcaggtgtttgaggaccaattgagagggatcgtatgctacagagatgagaacggagagatgatatgtgaggggtacgacgaaggcccgaggctcggaatgcggttgccagagaaggcctccttcccatggcctgtgggggttcgggtcactgatttcatccagctagcgacgctccaggttttcgaggacgtcgatgttcgtcagctgaggagtgaccagaagaggcagctctgagcaaggaactaatcatgtaagcatagtggtgtagtactatgatgatatgcaagaataatgtgtggtgttgcacttagttgctcatatttgctcgtcatattcggttcagcgttttgggtttcacaaagggggggaaat

SEQ ID NO: 20462 - DNA, 786 bp, Sorghum bicolor
  Clone ID: LIB5121-011-A1-PF1-F8
atctccaccatggcaagctcatcggcccaagcatcgtcgtcgacgaccccatcggaaaaccgcgcatttgagagatggaggcagtcgctctcgaatatgaccggccttggcatggccgcctcccccgctgaaggggaggcgcggcaggtagaagcggatcgcgccgcgatggaacgggactggtctcggtgcgagcggtggaagaacaagctcatgaccggcagcccgatgatcgtgttcatgctgaaacacctcgagcgagcaggatgccccttcgacgcctcggcgatacaatgccacccttgcccggaaaccacggcgggcggcttctcgcctgatcacggaatcttgctatgccagaaccgatatttcagcaagagacacatggaggatacactcgcgcatgagctggtgcacgcatttgaccactgccgattcgatgtggactggatgaatctgcggcatcaggcctgttccgagatccgcgcgggcaacttgtcgggagactgcagactcttgcgagaggtgcggagagggttctacgggttctcaaagcagcatcaggcctgcgtcaagcgtcgggctatcctctcggtccaggcaaacccaaattgcgaatcgagggagatggcagagaaggcggtcaacgaggtctgggagagctgctcaaaggatacgcggccgttcgacgagatatactaagactcctcattactcctcggtggatgagcttcctctacacacacccagcatagttgtactctacatgcatccacttctcgctgt

SEQ ID NO: 20463 - DNA, 797 bp, Sorghum bicolor
  Clone ID: LIB5121-011-A1-PF1-E12
actctccggatcctcacccttcactcccttaggagccgcacttaggcctgagtgtgatgtgagcgccgggaccgacctcaaggtagcggctctcatggcgacgacagcgacaacaactgcgtgtgtgctctgagatctcgtggcgtgtggcgcttgcggcgcgcagctgggtacgatgtaagcattggtgggagcccagctcgcggccgctaaggtacgaggcccgggatgcgcagatcagccggagcggcacaacattcgggcctgccctgctgcacctggctggaggagtgcagcaagtggttccttgtcgtcatggcccgcctcgcgaggaaggggagcgccgcatcgcgaaggccgcgtcaacgaagatgacagggaccatggcggatgtcggccgagctcagctggccgtcaccatcgagtccccatcaaagaagaaggctcagaggtgcagcgttctcgcagggccctattccccgaaaaaattggttcattctagcaggagcaaagcaagcacgaggagatccacgtctcctccagcggcgtccatgcctacatcgactatcacgacggcgactgcagcaggcgcccctttgttcaggacttgttaatctgaccatcagagtgttaatgtgaccgtttcttttttccgagacggaggagtctgcactcgtcatcaccagcataagggcaggatcaacacggccgtttgggggccgctgaacaggaccatcatcactgccggggaggatgccaccattcccatctgggattgtgtgctacatgtataatga

SEQ ID NO: 20464 - DNA, 498 bp, Sorghum bicolor
  Clone ID: LIB5121-011-A1-PF1-D6
gactcccacgtgcgtcagcggctccgcgcaagggccacatctctccatggcgacggcgatctcgctcccgtgcacgccggtgatcactccccgcgcgtgcaactgcaacccccgccggcttgtccacgtgtcggcggcgcgcggctctcgcacgcgcggaggcgggcgcgtcggtctccgctccccgacggtccccgccgcagcgggagcctcggcctcctcccccggcttggcttcagacaccggtggcgcgcccgcgtgggacgctcttggaggagtctccgtcgtcgccgcggcaagagaggatgcatgatcgacctgagtgaccatgctctctaagacggcataaatggcacagtggagctttctggaatacttgacgacatctgctctggagaatcaactgacgcatatacaaatgacgcacctctcatcatatgagattgaatgaggtccattgactaactgttgctgactagatacctgtgctattgctta

SEQ ID NO: 20465 - DNA, 731 bp, Sorghum bicolor
  unsure (1)..(731): unsure at all n locations
  Clone ID: LIB5121-011-A1-PF1-E1
ccgctccgagccggccgggccgggagcttcctnacctgaacagacaccacagtccacagctcagacaatagtatcatctatcacgcagcagcagctgaaactgaaaggccgagcaaccaggaatgaagggaagcaaggtccacgagcacgaggccgacgtccccgcctccgacctctgggcgatctacggcaccctccgcgccggcgagctcctgccggagctgctcccgcacgtgctcgccaaggtcgagctcatcagcggcgacggcggtgttggtaccatcttgcagctaatacttcctcctgggattcctgggctgcagagctacaaggagaggttcatcaaagtcgacaacgagaattacatcaaggagacagaagccatcgatggcgacattctgaagctggggttcctggcctacatggtacggtttgagatcatttcaaaaggggccaacttgtcggtgatcaggacgactatcgagtatgagattgaagatgcgcacccagagcttgaagctatggtgagcatcgcaactttggctgcagctgctgagaaattttccgagcatgctaaggagaagaaggtccctgcttcaacctcttcttgaaaaaacaaaatctcaagagccgattcgagtttaagtgaactacagtttcaacgcttttgtgtgtgtgttgccgtttcaaatgtactccctgcgttgcagcgaaatgggaaaccttgaacc

SEQ ID NO: 20466 - DNA, 665 bp, Sorghum bicolor
  Clone ID: LIB5121-011-A1-PF1-E10
gctcgagggcggccgggccgggctcgccgcaaccgcacctgtctctgcctgctcctgctttcattcattcactcgcaagaagaacaagaacaagaggagagctccgcaatcgcatagcatcccggctcaaagaagattcggttggagtttggattgtttgtctctgcaaattgcaatggctgccgctgctgctccgtcagtgtccccctccccgtccccggcgacggcgccggcgccgaaggtcgtgtcgcccaaggccggcgacaggaaggtggtgccggtggacgctgtggaggtggagctcaagctggagctggaggagaagcacgtgctggcggtggacgacagctccgtcgaccgcgccgtcatcgccaagatcctccgcagctccaagtacagagtgaccaccgtggagtcggcgacgcgtgctctggagctgctcgcgctgggtctgctccccgacgtgaacatgatcatcacggactactggatgccagggatgaccggctacgagctcctcaagcacgtcaaggagtcgtcggagctgagggagatcccggtcgtgatcatgtcgtcggagaacgtgcccacccgcatcacccgctgactggaggaggtcgtcgaggacttcctcctctagtccgtccgccccctccaacgcgttc

SEQ ID NO: 20467 - DNA, 782 bp, Sorghum bicolor
  unsure (1)..(782): unsure at all n locations
  Clone ID: LIB5121-011-A1-PF1-B9
cagcttccgacaacacaaggatactaaccaccagcaaaatggcccgctcatccgtccccacccagaatgacatcgctgtccccgagtcggtgctcaagaagcagaaggcccaccagaagaccagcgactctcaggccgctgagttgaagaagaagcgtgaggccagcaagcagaagcgcgaggtcatcaaggagcgcgccgccaagtacacccaggagtacgcaaaggcccagcgcgatgtcatcgaggccaagcgtgccgcgaagcgcgacaactctctcttcgtccccgctgagtcccgccttgcctttgttgtccgtatcaagggcatcaacaagatcgaccccaagaagcgcaagaccctccagctcctccgtcttctccagatcaacaacggtgtcttcgtccgcctcaccaaggccaccagcgagatgttgaagattgtcgagcccttcgtcgcttacggatacccaacttgaagaccgtccgcgagcttgtctacaagcgcggttacggaaaggtcaacaagcagcgcctgccgatcaccgacaacgagctcatcgaggccaacctcggcaagttcggtatcacctgcattgaggacatcatccacgagatctacaccgtcggccccancttcaaggccgtctccaacttcctctggcccttcaagctctcttccccccactggtggtttccgcacccgcaagttcaagcacttcattcngagggcggtgaccttggtaaccgcgaggagttcatcaaccagctcgtcaggcaga

SEQ ID NO: 20468 - DNA, 583 bp, Sorghum bicolor
  Clone ID: LIB5121-011-A1-PF1-C1
gtcttcccgttggatctggtgcatctgatccgagtgcctttttgaaggccgttaccgatgcgcgcagcattttcgaccaggctattgctctcggctttaacccgcacacccttgacgttggtggtggtttcgtatctgagaccttcaacgacatgtctgcagtcctttccgctgctgtggatgcccacttccctccgtccatccgtatcatcgctgagccaggccgttactacacttcttcggctttcacgattgcgtgcaacgtcattgcccgccgcactgtcgaagacccagccctcggcgtgaagagctacatgctctacctcaacgacggcgtctacggcaacttcagcagcatcatgttcgaccaccagcacccgatcccccaggtcctcagcactcgccgccgtcccgacggtttcaactacagcaccgactccctcgccgactccggatacgcttccgccgaggaaatcgactccacaaccggcggcgtcaagaccatcgagtactccatctggggcccgacttgcgatggcatcgactgcattcctccgagaagtggcttgcccgcgacaccgtc

SEQ ID NO: 20469 - DNA, 820 bp, Sorghum bicolor
  Clone ID: LIB5121-011-A1-PF1-C12
actctccgagtctaggcacacctacggacttgcgagctgtcagcaatccaacctcagctagctttctcaccgcccgcccgccagctcctcctcctcccctccttcgaccatcactttcttctcacgaccaacccttccatctgtacatctcgccttttcattgcattccactccctctgccattgcatctgcttacaacctcctcctccgcagtcctctaaacccccacctccacatcacacacaatgtccgcaaagtcaatcctcaaggccgacggcaaggccatcctcaactaccacctcacccgcgcgcctgtgatcaagcccactcctcttcccgcacaagcaacccacaaccctcccgcgaagctcgcttccatcaccttcaaggatggtgacaacgtccagggcgtccttgacgccgccgaggccacattccccttccttctcgctcccggtgccaagttcgtcgcaaagcccgatcagctcatcaagaggagaggcaagtctggtctgctcaagctgaacgctacctggcccgaggccaaggcgtgggttgcagagcgcgcaaacaagctccagaaggtcgagcacgttgagggttacctgaggactttcctcgttgagcctttcgtgccccacccccaggagactgagtactacatcaacatcaactccgtccgtgagggcgactggattctcttctaccacgagggtggtgtcgaggtcggtgatgttgacgctaaggctgagaagctcctgatccccgtggacctcaaggagtaccccagcaacgagcagatcgccaagggcctcctcag

SEQ ID NO: 20470 - DNA, 458 bp, Sorghum bicolor
  unsure (1)..(458): unsure at all n locations
  Clone ID: LIB5121-011-A1-PF1-B2
ggcgggncgggaactttcctctggtgcctcggnaaagnagnagtctgcccccggnccccgggcgtggtgtggtggagctttctcctctccggtacggtggcggtgtcatcccggttcttccgagcggttgcggtggtcgtctcctctcctgccatcctcctgccgcgcacatcctgaccattgcacctcaggcttgctcgagaacaagcaacaactttgagagccattcacattaaaggagaaactgcagccgaagtaacaaacagaagggcacaatggcactatcacgaagtatgagaacatgattgcagagtggaaggtttgcacttcttgccatattgttctatagagaaattgtacttgcaaatcttaggattgagctctctataactactggtggtcaatgctaaaagtcctgatgtatctcatcctaccaatgcccccccatatccttccct

SEQ ID NO: 20471 - DNA, 654 bp, Sorghum bicolor
  Clone ID: LIB5121-011-A1-PF1-B4
cttgtgcagagaacggccgtcgcgaacacaccaagattcattttagtgaaccctcaaaatggagaaactgtgctgtttattagccctgctgtctctggctggcctctccgccgccaattcagcgtgcagcaagccagaggtttcggcccagtcctacactacaccagatgccactattctaaccaacatcggcttcgtggcagagttcactctcaagtgcggcaacggcgttcagaatcctcccctatttgctgagctcggtggcaaaactcaacctgtcgcccgtatcggcgctaacaagtaccaggtgagctgggctgaggatgttaagaaggcccgacgaggagactacaccatcaacatttatgatgaagaaaactatggagtcctccgcaaggcaatgaggaacaacgaggatatctctgctgttaagcccctggccacagttgtcctgaactaccctggtgcctaccagggcccatgggtcaactctgaatttatggccttcgttctatcaattgctgtctggtatgctgccttctctgccaaatctaagctcttggcgtaggtttattatttcaattgttgtttttctgtgaaaaataactgactgttttttataaatccttatttaataaatttgtctggtttcta

SEQ ID NO: 20472 - DNA, 620 bp, Sorghum bicolor
  Clone ID: LIB5121-010-A1-PF1-H8
aagtcccatcactaacccggacaacagccaaaatgaagttcctcaaggtcggacgcgttgtcatcatcaccaggggccgctatgccggaaagaagtgtgtgatcatctcaccacttgacaacggcaccaagagccaccccttcccccacgcgctcgttgccggtatcgagacctacccatccaaggtcacccgccgcatgtcaaagaccaagcaggccaagaagagcaaggtcaagcctttcgtcaagcaggtcaactacacccacatcatgcccacccggtacaccatcgagctcgagaacctcaagggcgtcgtttccgccgacacattcaaggaggtctcgcaacgggaggaggccaagaagaccgtcaagaaggccttcgaggagcgataccagtccggaaagaacaggtggttcttcactcccttacagttctaggctttccttcggttacggctgggcgcagatgggcatgatttgatacggaagatgctgcatgagcggtggatatcataggaggacaggaccccaaaagtggcctgccatccaggcgtgtatttcggcttgataatcaaagcatgaaaaatccggcatccggctcaattcacgaacttcatg

SEQ ID NO: 20473 - DNA, 302 bp, Sorghum bicolor
  Clone ID: LIB5121-010-A1-PF1-G7
gagttcacagaaaaaacacacgatgtattagccatagccgtaatcgcatctgaatccgagccagacgcccgaaaaccattccaccatccaaaaataatgtagcccttgaataaaatcctccccggccgtggtgagttgagagttgaccaggtgctcctccgatccgacgccgtggtgatggcaccgccggcgatgtgctggtgtggccactgcggcgcggtccgccgcctccgagcggagggcgagttcgcgtcctgcgcgtcgtgcggccgggtcctcctggacctgcaggaggatgcggt

SEQ ID NO: 20474 - DNA, 525 bp, Sorghum bicolor
  Clone ID: LIB5121-010-A1-PF1-F12
cgctcgagacggccgggccgggatcttccagacagagaccacaggcctctccgcctcgagcgctttcggcaccgcggcacggcaggatggcggcgggagcggcggccccgcacgagggcagaggtggtggtgctcttccggtgcttactccgcacggcgaagcagttctccgactacaacatccgcgaggacacgcgccgacgcgtcgcggacgccttccgcgagaaccgtcgccctcgccgacgcgccggacgccgaggcggagttctcggaggcgaagaatcagctagaggttgcgaagaggcaggcgtaggattactcgctctacgcccccaaggccaagagagcgatggagctgaaggcgcagtgatggacgaggtgatgcggccttttcttcctcatcggctccctttccggattcgttccttatgtgtggcgatgaaactataaattgacgtcgtgattacctttgctcggatgaccgccatgacattgctaccttctgtgacaataactcgctaaatt

SEQ ID NO: 20475 - DNA, 474 bp, Sorghum bicolor
  Clone ID: LIB5121-010-A1-PF1-E4
agtcctaccctcccccgccgcgcagcagtcgcagcaccgccgtcgcgtcggcggcgcccggccccgacccagccgcctctccgacgtctccttcgccggcgaccgccccggcgacaacggccaccatcaataaaccccgccgacatgtcatcgtattcgtaggactagcactagtaacagtatagcactatagcagtagtaaaaataggaggaagaaagaaatctctcttgctgtaactctctcagactgaaagtgagtaagaacagaagagcttggagcttattattggagcgctggcagtggatcaggactagttttgggagcctgatccatggatggatcctcatccatgaaaaaaaaggctttcttgtgtacatagaattccagccgatgagctgcgagtacccgctttggatgaattttcttggatggataaacatgaccgaggaatggagacaactggattttgcccc

SEQ ID NO: 20476 - DNA, 424 bp, Sorghum bicolor
  Clone ID: LIB5121-010-A1-PF1-F10
attttcccccattccattccagtttcagaattcctggcacctcgttccgttcgtcctgagatacgcccccctactcgcgagcaggtggaaatgaagcgccacgccgagaagccgctcctcgcgctcctcgtgctgtcctgcctcctcctcctcctccccctcgactccgccgtccccacgccaagaagcctgcgcctggaggggaggagccagctgcagcagagcccgccggctctgaagctcacttctgctcaggagacggcgatcgcggcggagatgaacatgggcaagcctgcggcgaggatggtcgtgcaggtgaacgactaccaaccgtctggccccaacaaccgccatgacccacccaagggacccggaagagcttgaacaacggagctcagctagacggacgacccaataatccctc

SEQ ID NO: 20477 - DNA, 885 bp, Sorghum bicolor
  unsure (1)..(885): unsure at all n locations
  Clone ID: LIB5121-010-A1-PF1-B3
cggccgctcgagccggcgggcggggcattcactgtccgtcacccagaatcctctcgcggtcgcggatttgctcctccctccccctcttatacccttctcctctcctccctccctccaccccgcgccggcgccactatggcctcctccctcgcggtgtccctccgcgccctcgctgccgcctcacgcggaaaggctagggacgaaaacggagataagcgccctgatatggacgaggaggggggcgtcttggaggcgatagacacaaggaaggggggcggcatgataccagaaggacaggcaagtagttgcttgcgattcttaagagaacgaggaacataaaaccaaacctgtccaaacctcatcacgatgacgatacgatacgagaaaaatgaagacagatctaggcactaattgctcatagagatagttgataccaaataggcactagactgagctgattgcagataagttgatgaaaatatttgtgattggatgacactcgttataagttatataaagatgtgaataccagacaggagtcaacaatacagagggtttctgtctaaaaaaaaaaaaaataaaaaaataaaaaaaaaaaacataaaataaaaaaaaaaaaataaaaaaaaaaagaaatcaaacaaaaaacaaaaagaaaaaaaaaagaataaaaaaaaaaaaaaaaacaaagaaaagaaaaaaatgaaaaaaaaaaaaaaaaaaagcaaaaaactaatagaaaaaacaaaaaaaaaaaaaaaaaaaacaaacaaaatagaaaatatagaagagaaagagaaagaaaaaaaaaaaataaaaaaaagataaagagagagaaaaagaaaaaggaaaaagaaagagaaaaataaaataaaaagatntagt

SEQ ID NO: 20478 - DNA, 212 bp, Sorghum bicolor
  Clone ID: LIB5121-010-A1-PF1-A2
cctgatcgatcgccctgattatccggcgagcttcattccattccatcagatccttggcggaggacgtcgagctgcggaggcaactgcgggtgcggctccggatgcaagcgcgggagcggctgcgtacgcagcaagatgtacccggacatggctgagcaccacgcgaccacctccgcccagactctcgtcatgtgtgtcacaccatcgcccaa

SEQ ID NO: 20479 - DNA, 623 bp, Sorghum bicolor
  Clone ID: LIB5121-010-A1-PF1-A8
tactccataccagctcgagcgccgcttgcctcgcggacacggcctcgatccggcaagctagcatcttccggccccggcgggcgtcgcctctgtccaccgaccccgactccgacgccctcgtccccgaacgccctcgtccccgaccccgacgccctcgcccctgttcctgaagctgccctgcggctggtggtggcgcggcgtgcgacgctgctgaccggggaggggagctctggtgggaagatggcgggcgggtaaggcgccgttgaaattccagcagcagggcacacacgcgcgggagacgggtggaagaagaggtggtggagctgttcatgccaaggaggtgctcgatgaaatgcctcgccgacttactcttgcaccttgctggcacaatgaacgctctccaccattggaggcctccgagcagtggtgtgtggaggagggacgcgcatgattatctagggcagtggacttggcggcggaatgaagtcgcagcccgaattctgtacatgctgttcactaagagcccaaagcgtacagctccatgctctgagcacaacctggagatcaagacctcctctatgaagatgatgcgagaccgtcgacaccgtctcttatcccgaaag

SEQ ID NO: 20480 - DNA, 126 bp, Sorghum bicolor
  Clone ID: LIB5121-009-A1-PF1-H4
ccctcgcagttctcacactcacacacgactcatctcgtcttcacagcggcctcagctgcgtagtacagcgctacaccgcctggcatgatgactcgttctggggcggctttgccgctgccgctggtg

SEQ ID NO: 20481 - DNA, 712 bp, Sorghum bicolor
  Clone ID: LIB5121-009-A1-PF1-G4
acaatacagagatttgattcgaaactagacatcgcatccttcaacatgcccgcagcctcagtagcatccgcgcccgtcaagcgcaccgccaacaagaccaccgcctcaaggtctgcgaagaagcctgctcagagtgcgaacaagaagcctcagacaaacggcgcaaccaacggagcgtcgcaagctcagatgtcaccatatactatcatggcttcgagaatcgcgaaccgcgttgccgagatggcggagaacatgacttttgttgagcgtgagaagccccaaccacaacagcaacaacaacaatctgctccgtcaaactctggaaagaagccaccccggaaactcgagatgcgcatgcctaacaacggcgcctctccaaccaacatcacgttcagcgcacctttcctcgacaacaccctcgccaagctactcacgctccaaaaccgcatgttgacagtcagtaacgacatcgcagcgtgtgaggatgtagacgacaagaccaagcaagagcagtttgcccagagcgcagagttgagtcgtatcattgcgctaatctgcgccgagaaggctagacaaggtgcttagtttgtaatgttttgtccaaagcaatgagtagtaatgagcgtttcttttttttcaatggcgttatcggatatgtaacgaaaggtttcatagtagtagcgcactttgtacgaatagcatgatcgacggg

SEQ ID NO: 20482 - DNA, 715 bp, Sorghum bicolor
  Clone ID: LIB5121-009-A1-PF1-E12
aagttccacctttctgaacaggatttctgtatatccagctcctgctcccctctttctcatgtgtggctgaggtttttgtgcatcgccaacgagtcctgtcctgctccaaggaagtttgcagcgcagatacattgccgtcaagcgtcaaggggggaaggccatgccaatggcgatagcgatgaagggaatattcagaggtctgaagatcatagcacaaatattcacagtgcagagggatgagcatgagatcgagatcgggtaccctacagacgtgaggcatgtatcgcacgtaggcctgggcgctagcgactcctgtccgagctggatgagtgaattcagaggattagaggaggtgacaacagcaggaggacggggggcatccatcgtaggctctgctgcgctgtcgaggcacacctcctgggcttccctagacttcgagcaaccagcgacaggcgcgctgccggcggcggcggaggcctgcgccgcggacagcagctcgggccaggacggcgccgcgagaggcggcggtccagtgaccgtgaccacgaagaaggcggcgaggccgaggaaagcctcccgggcgtcggcgtcgcccggcgggtcgtcttcgtggcggtccacggcgttcgtcgccacggcgtgccacggccactcctgcaagcttcccttcccgtcggcctgcaagccgcctgatcgagcctgacacgtactacat

SEQ ID NO: 20483 - DNA, 479 bp, Sorghum bicolor
  Clone ID: LIB5121-009-A1-PF1-E2
acacttcacaaagacgacctcgatccacgacaacctcccatcatcatgtcggactctcaggtgaccctgcgcacgcgcaagttcattcgcaaccccctgctgggccgcaagcagatggtcgttgacgtcctccaccccaaccgtcccaacgtctccaaggatgagctccgcgccaagctctccgagctctacaagtccgacaaggaccaggtctccgtcttcggtttccgcacccagtacggtggtggcaagtccactggcttcgccctcgtctacgacagcgccgaggcgatgaagaagttcgagccccactacaggctcgtccgttacggccaggccgccaagatcgagaagcccagcagacagcagcgcaagcagcgcaagaacaggggcaaggagtctcgtggtgttgccaagaagaagggtggcgacaagaagggcaaatagacgagtcgatatcctcgcgctcctacttgctg

SEQ ID NO: 20484 - DNA, 665 bp, Sorghum bicolor
  Clone ID: LIB5121-009-A1-PF1-E5
tgggtaccaattcgtcgaacgacacgcattgccattgccccaccacttcgtccatcatgagctccctccgcatcgcccgagccgccctccgcgcgaggcccgctgccattgcccgccccatccagcgcagagggtacgccgaagtcgccaacgacaagatcaagctctccctagctctcccgcatcagtccatctacaagtcccaggatgttgtccaggtcaacctccctgcggaaaccggtgacatgggtgttctggcaaaccacgttgcctccattgagcagctgaagcccggcctggtcgagatcatcgaggagcagggtggcagcaagcagttcttcctgtctggtggattcgctaccgtgcagccaaactccgtcctcagcatcaacgccgtcgagggctacccattggaggacttcagcgccgaggctgtcaggaaccagatcgccgaggcacagaagattgccagcggaagcggcagcgaggccgacattgctgaggccaagatcgagcttgaggtcctcgagagcctccaggctgcgttgaagtaaatgtgtcagtaacgttccttgagcacggtatgcgtggtatgtatagtagcaattgcagagcatgcgtgctttccgcgcccaaagaatagaaggagctccatgaggtgacgg

SEQ ID NO: 20485 - DNA, 141 bp, Sorghum bicolor
  Clone ID: LIB5121-009-A1-PF1-D1
aaacgccaaccttcagctcatccacatccaaagctttttccatctcacacacactgttcacacgccactgcacctactgacttcagctcaactcacctctgcatctgcaacgagatccaagcctagcaaagcgacatccat

SEQ ID NO: 20486 - DNA, 824 bp, Sorghum bicolor
  Clone ID: LIB5121-009-A1-PF1-A8
gatttccgcaagaggaggacgccttgtctcgggaggtcgttccctcggttctgccgcttcctacatcaagatgagattttgatgcggttcgacagactgggaggtttttgtcctggttgggatattgtgaggttctgctatttagtgcctagagttgtcaatatgttcatgctcctggccaccatggatatttggtacttgcatgttctcttgactattcaatcattaaccagtaatctaggggttacttgaattttttttcagctaccaaaaaaagctcaaatttattttgattttgttggaatttcaaaagttcttgagttggtgaagtgctttggcacctctgttcaacttgcccagttaaccatagaggaagaattttactggcaccttttgtcacaactcacaatggacgacggagtagaccttccaagccaccaccttcatggctattgcttcgacgatttcatgaaaagtacagctgcatgtactcacacacacacttgcaatccgccgggtccatcggccgccatgcatacgcacagatgcctccacacgcacaggcaattcatagcctcctctagcgaagagctgaggacgcctcgaaaacctctcggaaaccgagaggctgtgcgcaagtaccgggagaagaagaaagcgcacgcggccttcctagaggaggaggtcaagaagctacgcgccaccaaccagcacctgctgaggaggttgcagaggcatgcggcactcgagggctgagtggtgaggttaagaaggcctcttgttgatgtccaggcaagatcgatgcagagatcgtcggcgccttc

SEQ ID NO: 20487 - DNA, 182 bp, Sorghum bicolor
  Clone ID: LIB5121-009-A1-PF1-A12
caccgaaccccaccggccacggacccgagcaacagaaccagagaaggagagccgccgaaacgcccaccagcacgaggcgaaacagaagcaccagaaggaccgcccagaggacacggccaccaccaccacgaccaacaagacccaggacgccaacacccaccgcgaaacacgagcccggccac

SEQ ID NO: 20488 - DNA, 781 bp, Sorghum bicolor
  unsure (1)..(781): unsure at all n locations
  Clone ID: LIB5121-008-A1-PF1-H10
atcatcctggatgccaaagaaacttctacttgacgtcccgccttcttgcgtctcgctcatatcaggcccagagtttacgttagtgttgaaccccgtcctcccgtccccgccacgggtacgaaagaggttcccatgagaaaatcgggcgtggtggcttgagcgaacgccacggaaggacctgcaggtgtctcttgttgtgagcgccggcgccgacctcttcccgcctccatcgtcgtgatagagcttctcagcccatcgtccacggtacgggcccgtcctcgcgtcctgaggggagaaaatgaagcgagtgaagacgcttcccctcaccgaggagtgccaccactggaccgacgcggccgaggtgccctgggacctccaaaagtactggcagcagcgctacaccatcttcccctactacgtcgatggcgtccacctgacgcacgatgcctggtacggcgtcacccccgagcccgtggccacgcgcatcgcccgggacctccccgagatcgtccacgacggcaaaaccacgctgatcgatctgttcgctggcgtgggcgccaacaccatcgcctttgctctctcgggccgctgggaccatattatcggcatcgagcgcgacgccgcgacgctagcttgcgcccagcacaacgctgaactgtatggcgtctccgagttcatcacctgggtgcacggtgacaattntgactntctcgatgctctgcagtccgactatgactccctcgacgacgatctccagatcgacgtgaccaaggctgtgctt

SEQ ID NO: 20489 - DNA, 365 bp, Sorghum bicolor
  Clone ID: LIB5121-008-A1-PF1-H2
gagtccggcgccgtcgtcccagtcccagtcccagcacccgtgcggtgaggtgacaaccagtgcgcgtcgcaactccgtcagcttgatggccgcgctgccgcgacccatggagctctgcttggcagggacgacgacgacggccgcgtgccggagggcgccgacaggcattccgaagaagcggcgcgccggcgggagcaccgcgcggtgcgtggcgacggcgcccatgggggagaagacggagcaccgagacggaccgctagagcgcgcgttcatgggtctgttcgcgcgcaagatggagaagtacgcgcccaagaagaagcagccgccgccgtcgtgaccgcagtcgaatagaaagtccgagagga

SEQ ID NO: 20490 - DNA, 541 bp, Sorghum bicolor
  Clone ID: LIB5121-008-A1-PF1-G12
gtttccgagtttaacggagggagccgcgactggaacaggcgccgcatccgcggcggacgagacaagccggcgccgccccgtcgatctgcgccaggccaccggcgctgcttcctccgtccgctcaagccgacgcgcttctgccccgacgccctgtccgcgagacgccgcgggcgcagcagcaccccatcgcgtccacgccacgccacggctccagcacgcgccaccaccccgacgcatccacactgaagcctgatgaagctaacttcggcgggatcgagcgcaagcggaactggaaggagtgagtgccccttttgccatgttccattggtccggattcagagcaagcagccggcgacattgggcaagtggtttctcaagtgcccatacaacatcaaggtaacgattggtgacattggggatctgcctgtggttttttggtgctgcttgtgattgatgtggtttggctgcagggtgatcccagtacctgtggttacattcgtccaatgtggaattggaaacaccagaacagggattccagggt

SEQ ID NO: 20491 - DNA, 625 bp, Sorghum bicolor
  Clone ID: LIB5121-008-A1-PF1-D9
acttttccatccacacaccatgcctcaattcctcatgggcagcacagtcgaccggctcgaccggccgagctcctactccacagcaaagtacaagcgcaaaggccaccgccgcccctccaactccgagcgcgccccctcccccgatccaatggacaagctccaaaacgccacaaccctctacgtcggcaacctctccttctacacaaccgaagagcaaatccacgaactctttggcaaatgcggcggcatcaaacgcctgatcatgggcctcgaccgcttccacaaaacaccttgcggtttctgcttcgtcgagtattacacccaccaggatgcgctggattgcatgaagtacgtgggaggcaccaagttggacgagaggattatcaggtgtgatctggatgagggattcgcggagggaagacagtatggacgtggcaagagtggtggacaggtgagagacgagtaccgcgaggagttcgatcctgggcgtggaggtttcggaaagaagattatggaggagagggagaggtatgcggacgagtatgattgagcttgatcttctagcaacgagcggagagggcaaattgtgttgttacttcggaagctcacttgaaggttggacgag

SEQ ID NO: 20492 - DNA, 687 bp, Sorghum bicolor
  Clone ID: LIB5121-008-A1-PF1-D8
gggcttctccaaacagtgccacctccgaccaaaacctctccccctcccctcgccggcggccgcggcggcggcatgacgaagggcggtcagtctgcgtcctcttcggggcctgaggacgagtcagcggcggcgacttcaacctccgctcccacacccgccccggggcggcggccgagggcgacgcagcagcggctggagatcgagggctaccacgtggagggcatctccatcgccgggcacgagacctgcgtcatgttcccttccctcaacctcgccttcgacatcggccggtgcccgccgctcgccgtctcgcaggacttcctcttcgtctcccacgcgcacatggaccacatcgggggcctcccagtgtacgtcgccacgcggggccgcaggcggatgcgcccgcccaccgtcttcgtccccgcctgcctcgcggacctcgtgcggaggctcttcgacgtgcaccgcgccatggaccagtccgacctcgaccacaagctcgtgccgctcgaggtcggcgaggagtaccagctcaccaaggacctcagcgtcaggccgttcaggacctaccacgtcgtacccagccaggggtatgggatataccaggggaaagcagaagctcaaggaagagtatgctgtcccccctgggaaagagctcagaaactcaaaaagtctggagttgggatt

SEQ ID NO: 20493 - DNA, 630 bp, Sorghum bicolor
  Clone ID: LIB5121-008-A1-PF1-B7
gtttaattcgaggcagatgctgcggccggtgacgcgaacgtcacatcgccgattggatcatctacggactccaccggtgtcgtcttcctcgtaccccgtctcgtctactagtcgtcttcctctcgtctcctgcgaaaccgagcgccgaccggcgttcatacggagggagggggcggcggccgtcgatcgggggatctttcggcgtgtggggaattctatcggctttggtttggaggagtcggacggaccgatctggatggagcgcttcgtcttcgtcctgctcgtcttcttgtgcaattcttccttccgattcacagccacagatgcctacgaccccgtagatccgaacgggaacatcacgatcaactgggattttcaggtcctcaacgtcaaggacatgtccccgtacacggtcatggtgagcatccacaactaccagatgtaccggcacatcgagcacccggggtggcggctgagctggaactggaccggcaaggaggtcatctggaacacggtgggcgcggagacgacggagcagggcgactgctcccgcgtcggcgccgccaacgcccgcccgcattgctgcctgaggcggcccgtcatggtggacctcccgcccggcaccccgta

SEQ ID NO: 20494 - DNA, 161 bp, Sorghum bicolor
  Clone ID: LIB5121-008-A1-PF1-A7
aggagtccgcaagaaccaccattttcgttccgaaggaggacaggcattagtagctagcatctagtgactggaaaaccatggcggatgccggcagcagcagggcttcggccgcgagaagcaagggcccgacgatggccgcgatgaggactagtacgggggtt

SEQ ID NO: 20495 - DNA, 665 bp, Sorghum bicolor
  unsure (1)..(665): unsure at all n locations
  Clone ID: LIB5121-007-A1-PF1-H6
ngtttctctttgctcatccacatcctccaagtgaacatggaacagggacaagtcctgctccaagtgaagaggcaacacgagcgggtcctgctgggatgtcacaagtggcacctgcacctcattcatcttacgccaccaggatgcagggcaatgttccctgccgctgggtcgtttttgtccttgcgttatgtaccctaacaagcctgctacgatgaaggaagtaagtggctggccagctagatgtatatcagcaaccgcggtggccactgttgtatgtaccaaaaagagaagaggacccatggtgctccaacggcggcttatctggttccggccgggccaggtgatcatcagctcccgggggcgggtgggcaaaggcacaaggaagctgagagctcaccgctcttgagtcttgccccttcggtgggatgtgtcatcctctcgttgctagtagttatcagttgtcactgcatgtaaatatggagggatgggatgggtataaaaggcaaggcgaaccgcaagacgggcggccgcgcgtggtggtcaaagccacagggggtggcaggcccttgtgtagcgcgcgcgcctctggtcaggtctgctgctgtgggtgtagtgtactgctgctcctgctcctccgacgggctcgtcaaaagtggaaagacctc

SEQ ID NO: 20496 - DNA, 447 bp, Sorghum bicolor
  unsure (1)..(447): unsure at all n locations
  Clone ID: LIB5121-007-A1-PF1-F9
ngataggcagtttagcaccgcacccaagcggcggcgtttgcgatgggcggagaggccacgaatgccggcggcgggggtttccgcgcacggatggagcactacctttacagtggcgagaagaagcacgtcctcgccggcatcgccatcttcgccgccgtgttcggcgtcccatggtacttcatgacccgaggggcaaaacatcaatctcaccaagattatatggaaaaggctaacaaggcgagatcagagaggctttcttctggtcagccatctgcactgaaagaatgaagtgtattgcctattctggtccctgacctcgaaagctcgtcatagatcatacactgttttgatttgcagtcaaaggatttgatctgttgttaaataagcagattatctttctttctaatatcagttatagaaaccaagtacgctacaagaattttgtct

SEQ ID NO: 20497 - DNA, 430 bp, Sorghum bicolor
  Clone ID: LIB5121-007-A1-PF1-G8
atcctccacctcgcgcgtacgggcgacgtcaccgacctgcgcgccgccacggaggtgctctgctcgcggacgccgtcgcagctagcggtggtgcggcacgcgtaccgcgccaggttcggctgccacctcgagcactacgtcaccgagcggacctccggcgaccaccagaggctctgctcgcgtacctggccgtgcggcggaggaggaggaggaggctgaggagcggcggagcgaggcgcggaggacgcgctggtggtgccgccgtcctcctcctggaacacgcaccggtacgcgctgtcctgggcgcccgtcagcgtgcgcaccacgcgggcgagcggaacctggccctggcgcgggacgtccacagcagcacggccgcgccgcccattcgaaacaggcagttgggcagtatcttggtgttctccttgct

SEQ ID NO: 20498 - DNA, 735 bp, Sorghum bicolor
  unsure (1)..(735): unsure at all n locations
  Clone ID: LIB5121-007-A1-PF1-F5
ccggctcgagggccggccggggcccgggacccaacacccacgcccgagaacaacacccccataccggacacgccatttgaagagtgatcgccagactttcttccccccatacctagctccgcatcgccccgtaaactccacaaccctgcccaatatggttcttggcaaagtcgcacactacgcctttgatgcggtactaatctccgctttcctcgccggcgtccggcgctcaactggcctcacacccagtctcaagtcagattccttcagcgaaaaccccagcgcccaaaagtggtttgagaactacctttgggtcggcgagaccgtcatggaccagagcgtcgccttttttggcgcaagctcctactttgagcgcaagcggtagattacccaatatctaacaccgcgagcgggagagcattttgggaaatcaagagaagggcgacacacttttgcgggaaattaggataaggggtggggtcatggaaagggaagctcaaaccgttctggctggaaaatgaaaagagagaaagaaagagacgcagactacgggagaagcgtggagacgtggacgtagtctatggaagtttgcctttgggtattcgcacagcaagacataagacggcagaaagagcatggacgatgcagactcggattttctcgtttcgctcagtaggcggccggcgtgtgaggcgcgcnaattcatccgctgattgatcgaaaaaaaaaataaag

SEQ ID NO: 20499 - DNA, 146 bp, Sorghum bicolor
  Clone ID: LIB5121-007-A1-PF1-F7
gcaaacgtgcaccatgcggctccctggagttctagtgtcgcgacctctgctgcagtagcagcagcatcccaaggcccgctaagcctcacggcggccggcggcatgtcagcgctccatggaccagacacaggatgcacactgcgccc

SEQ ID NO: 20500 - DNA, 360 bp, Sorghum bicolor
  unsure (1)..(360): unsure at all n locations
  Clone ID: LIB5121-007-A1-PF1-D1
acagtccagacctccaccgcgtcctcgtctccacccattcccgttgcagagtacgtagctcgacagtttctcaaagccacagcctcgagcggagcggggcgaggatcggatcggagagcctacgcgcgcggcgctcgcggcaggagctggctacccctcgaggtcgtcagggagcggcgtcgccgcgcccgcacgagacggcggagctggacgcggcggaggcgtcggngttcgtcgccggcgagtcggtggagcagcgcaaccgcttcctgccgctgcggctgcaccaggcgctcgacgcccgccaaccgcgacgggatcaagaggtgctgccgaccgatgtcatggggtggatccatg

SEQ ID NO: 20501 - DNA, 635 bp, Sorghum bicolor
  Clone ID: LIB5121-007-A1-PF1-B4
ctactctcttcgtcttcactcatgagaggcacggcaccggagctgcagcttcacctcgccagctctcggcccgcccctcgatcgcccaggccggtctcctccctcgccggcgccaccatggaccgcaagagcaagtccaccaagggctccgcggcgagctcggcagcggcgtccatggccgcgctcgctgccgccgcggcggccggcgacagcagcgcggactccggggcggaggacaacgtgcctgcgaagatggcagccgtgggagacgtctccagctcctccccggtggcggcgaggaggagcgtggcggccgcgggcggtgccgcctccagctcctccccggtgccggcggcggcgaggaggggcgcggcggcggcggcggcggcgtctgtcgcggcaggaggaggaggcggcggcgggccgaggtgccaggcggagcggtgcaacgccaatctgatgaccgacgagaagccgtacaaccggaggcacaaggtgtgcgaggcgcactccaaggctcccgtcgtgctcgtcgccggcctccgccagcgcttctgccagcaatgcagccggttccacgagctgtcggagttcgacgacatcaagcgcagctgccgcctgcgtctggccgggca

SEQ ID NO: 20502 - DNA, 832 bp, Sorghum bicolor
  unsure (1)..(832): unsure at all n locations
  Clone ID: LIB5121-007-A1-PF1-B2
acagtcagcaagcagacaacaaggacaacacagcaactgaaaccctagtaccaagaacaaacaactacaagagacttcgcaagttcacagaggctaggtgttgactgcgaatgaacatccagaggaagcctggagattggaactgcaagaactgccagcacctcaacttcagccgccgtgattactgtcagcgttgccgtgacccacgccctgacttgcagttcagtgacagctatagcacgggtggtgtgctgacctccctggacatccgtccaggtgactggtactgcagctgcggctaccacaactttgccagccgcagcagctgcttcaagtgcggcaccatcgtcagggacttcccagcaggacaaggtgcagccggtgctgaggttgacttcgctcgtggacgcgacagcgccgcagttcgtgctgggtggaaagctggcgactggatctgcacaaggcctggttgcaacgtgcacaactttgctagcaggatggagtgctataggtgcaatggaccaagggaggcaggcaccgggaagtaagaggcgaccgaggtgataccaagaccgtgagatgtgacgagctggccgagcgatggaaccaactgctgtcacacactcaccatcaggcatccaggaaggatgagtctactacgtacacaagtatattgttgattcccatttgccaagcgtagtaccgctgctgccgttgcgtgggntggagaagtaccaagcacaacaaccgttacgcgcgcngcgtgtgtggttgctctttttttttttgagggtgtggtgattcagtaactgctgaaatttacggcttgatg

SEQ ID NO: 20503 - DNA, 756 bp, Sorghum bicolor
  Clone ID: LIB5121-007-A1-PF1-A1
acctctctttgtcactcacagcgaggcttcgacagcttcatcacattccttccaaaacttccctctcttgttcaattgacggtctggacctacactctttcttcctcaatcaacacacggtctctttaaaagcagcttcgccacgctcctgtgtcgtcatcatacattatcacaaatctttgttacagaccctctcaacgaacaatatgctttccaagcttacctttgccatcgtggcacttcaagccagccttgccctagctggcaaagccgtcatcaccaaccgctgcgactacgacatctgggtctggtcaatctctactggccatgcctcctcatccttcatggtccctgcaggaagctcccacagcgaggcctacactggaagtagcacttccctcaaagtcagcaagtccgacgctttggtcgccggcaagcacacacagtttgagtactccatcgcggctggccagctctggtacgacatctcctttgtcgactgtgccaatggcgagtctgcgtcaaactgccctggacacgacgaaggcctggccatgaacgccagcaacgacagctgcggcaagatcgattgccccgctggagactactgccctacgcaggcctactacgtcgacacgcctctgcaaaagctgggtatcgccgagccagttttcatgtgccccttgtctctgggcaccagcgttgatctggtcatgacagtctgctccggaaacccaagatcagaggagcatcgct

SEQ ID NO: 20504 - DNA, 260 bp, Sorghum bicolor
  Clone ID: LIB5121-007-A1-PF1-A5
aattctggtgtccctttcatcttggattggattggatagattcgacgattccgcgggcgggcgtgccccggtgaatggtaagcgagatcgctgcgacaaacaattccttcctccccttcgtccgttcagttgattgatttggttagccagccactgtaaaaatgagattgctattacattcattgtcgttttactgctgctgtaatgaatccgttcatcctgtcccagttttgcccccaaacaattgaaatgaagtgcac

SEQ ID NO: 20505 - DNA, 720 bp, Sorghum bicolor
  unsure (1)..(720): unsure at all n locations
  Clone ID: LIB5121-006-A1-PF1-H5
ngaataagtcattgccaattaccgggccttcccctgcactcttggggtgcggcggcgcaagggtcgtccacaccttcaccgggccttcccctgcactcgtcgtttctctcaatcctcgctgctcccatctcatggctctcgcgttcgcatctcatgcccgccgtctcctccttgccggcgctggagctccggcgagatcgttacacgcccagccctaccaagggtcgacgtggcggagttcctcaacggcgtgggaaagcgggtggagaagcacgccgcgaagccggaggacgcagtgggtagcgatatccagaggctgatcgaggccggcaagctgcgccgcaagaatcgccgcatcccctgcaagcgtagaaagttgattttgagtcttgcccacaagtttcgtcttggtctctggaagccttgagcagaacccaagaaagacgaatgaagttgatttgttcttagaatgctcacatggaattatggacaacaattgactgaagcatgtttgagacaaaatagatactcttgtaatttggatgccacaatcttcattctctgccagcgcttattttccaacagtttgcgcagaattcttgaaaacttccaactatctgtagcatgtagcatggtttgttccttttgtaaaacgaaagttacctataacatatgacaattctccttgatggtttatcacctcaaatctgtattgtgacc

SEQ ID NO: 20506 - DNA, 677 bp, Sorghum bicolor
  unsure (1)..(677): unsure at all n locations
  Clone ID: LIB5121-006-A1-PF1-G8
cggcgggcgggattccgtaaccagttctccacctgcctcctccgatgaccctagctggagcctgtcgccgccggcgaccaccgcgaccccatctccctctcttcgtcctcgtcctcctaatcttctccactccaatcccacgcgcttcggcgctccgcgtccctctccgccaggcagccaccctcgtctccctctcccattcgctcctctcccgcgtcgccgccacacgtgccgcccgtggggacgccgcggcagccgtacgcgcccggcgaatcgcttccctgctgtcgtcccgtggcgcgtgggggctcggctgggactacctccgccactacgccttctcatcggccaccggatgcggcctctcctgcgcggccgcggcctctcgtctcatcgccgctgccgcggaggcctcgcgcctacgttccgccgctgacgctgcgcagtggatgcgccgccactacggcgacatccgcgacgccgccgcgcagctcctgaacggccttctcctcgccttctccgaagaggggccattgagagaggtggtcacggatgttaagtgggaagtggaggaaggngaattgttgaaggattgcctggaagtgggagntaaggacttacaggggttgcttgtcattgccaaagatctcttcgctggcgttccaggacttctacgc

SEQ ID NO: 20507 - DNA, 830 bp, Sorghum bicolor
  Clone ID: LIB5121-006-A1-PF1-F11
atcaactaaacgctttgtctctgtacctgcgctgttactccctgcatcgtcgcccgccctcgtcactctgccgccgagtcgatcctaccggagctcaacaacaagcccaacccaccgctgaccccgctatcggccactcgaccagcagacaccgctcccactacatcattccccatcgatcacccatccaccaccctcgacgttggcggcgccatctcaccacggccctactaccagctcgacagatcgcttactgaatacatatacaccattctttaaccagcatatcggagcactagctacccttgatcgcacgccgctgctgctccacaatccttgtctagaatcatggtagaagccgaaggcaaccccacgacgtggaagttcacacaatgcttcggcgacaaaggcgatgttgaagatataaccgaagccgacatcatctcaaccgtcgagttcgaccagacgggcaattacctcgcaactggtgacaagggtggccgtgtggtcctgttcgagaggaacgagacgaaaaaaacctgcgagtacaagttccacaccgagttccaatcgcacgagcctgagttcgattacctgaagtctctcgagatcgaagagaagatcaataagatcaagtggtgccgccggcaaaacgcctcacactacctgctctccacaaatgacaagacaatcaagctatggaaggtatttgagaagtcgctaaaagtggtggcggagacaacctgtcgcatgagtgacaccctggagtgggctgctggtggaggcgtcccgtcaggacccgacgcacattccgcagcgcacccgactga

SEQ ID NO: 20508 - DNA, 540 bp, Sorghum bicolor
  Clone ID: LIB5121-006-A1-PF1-F2
atctcactcaactcactcaacagaaccaagccaaccaaacaactccctcttccaacccatccattcgcaaatatgcagttctccaagatcttcttcgttgctgccaccatcgccagcgccgctgcagctcccgtcggagagttggagactcgcactgctgctcccatcaagtgccagcaccacggcggcaagtggaagtacggctgggaaggcgccgccgacaacgagaagtacacttgcaacactgcaggtctcctcaatatcctgacctgtgtcaacatcctcaatggcaacactgtcaacgtcgacctgctttccatccttggtctctgaggtgctcgacagaagacgaaagtgatgcgccccagacgctcactataggctcgcagagtcgaggtaatggatgtgttgttgggagatcgcggagtgttcctttcgtttgcgagtggtgctgccggcaaattaggcatgcgacggcatgccgacttacactcgctttatttgtagctaaagaagatgacgaattgatgagtttcggac

SEQ ID NO: 20509 - DNA, 459 bp, Sorghum bicolor
  Clone ID: LIB5121-006-A1-PF1-D7
atccatcaagtccggcaaaaacagttcaaaatgaccaagggtactccgtcttttggtaaacgtcactccaagtcgcacactctgtgccgacgatgcggcgaccgatcgttccacaagcagaagcaccagtgctcgcagtgcggctaccccgccgccaagcttaggtccttcaactggggtctcaaggccaagaggagaaagaccaccggtaccggacgaatggccaacatcaagtcggtcaaccagcgattcaagaacggcttcagggagggaggcgccgcccccaagaagaccaagtcccagtctgcttaagcggatcgctgcggtacggggttgattggactgggcgctgggcccagggcctgaaggggtcattgatcctggagggatggagacgagtcgacgacgacgacacagttgatttgggttatgtaccatcgatggatgcgtcgagttgag

SEQ ID NO: 20510 - DNA, 741 bp, Sorghum bicolor
  Clone ID: LIB5121-006-A1-PF1-C9
gaattccgtaccattcacttcttcccccacataaccttttatcactcttaatacccaccatgtctcccgttgcgctcgaaaaggaagaccatactcgcgatgccgagttcaacaaggccatgcacggcaagtctgcaaaggctcgcggtggtatgactgccatgttgcaaaaggacaaggctgcccaacaagctgccgtagacgagtacttcaagcactgggacaacaaagccgctggcgacgagaccgaggagacacgtaaggaacgacgagacgaatacgccaccctcacaaggcactactacaacctcgcaactgacctgtacgagtacggttggggacagtctttccacttcgcccgctacgcctatggcgagtctttctacaaggccattgctcgccacgagcactaccttgcccacaagatgaacctccaggacaacatgcgcgtactggatgttggctgcggtgttggtggccctgcccgtgagattgtcaagttcgctggtgtcaatgtcgtcggattgaacaacaacgactaccagatcgagcgtgccactgcctacgccgagaaggagggtctctcagacaagctcaagttcaccaagggtgacttcatgcaaatgtctttccctgacaactctttcgatgccgtctacgccatcgaggcgactgtccacgcgccatcgctcgagggcatctacagcgagatcttccgtgttcccaagcctggcggggtct

SEQ ID NO: 20511 - DNA, 798 bp, Sorghum bicolor
  Clone ID: LIB5121-006-A1-PF1-A8
aactgctacctcgtgtcggcaattcatcaattgtattatattccttgaatcttgcatatcgtgttgcatagcggcccgattcttcttatcattcctgtaccacccagagttagactcacaccccgcgctgcatcatgccccaccttccgagagcttctgctctttcagctttccgtgcagctccccaaatccgcgctcctatcaacaaacgcttcttcactccttcagcatacaacatggccatcaaggcttactttgattgctcctggaccgggcctaccattgaggtcgacaacgccggcaacgtcaccagccagggcgaggttaaggcgcaatccggtcgcgtcaacttcgagctcttcgacgatgtcgttcccaagacggccgagaacttccgcgctctctgcaccggcgagaagggctttggctaccagggctcaaagttccaccgcgtgattcctcagttcatgctccagggtggtgacttcacccgcggcaacggcactggaggcaagtccatctatggcgaaaagttcgccgacgagaacttcaagttgaagcacgaccgccccttcctcctctccatggccaacgctggccccaacaccaacggctcccaattcttcatcaccaccgtcgttacctcatggctgaacggcaagcacgtcgtctttggtggtgttcccgatggcgatgtcgagtcctacaaggttgtccgatcaatcgaggcttgcggctcaacaacggaagcatcaagtttaaggagggcccacctaccatcactggtgctggcgtcca

SEQ ID NO: 20512 - DNA, 810 bp, Sorghum bicolor
  Clone ID: LIB5121-005-A1-PF1-H11
actattctgaagggctttcacaggatccagtgcgcgctaagaggtggcttcaactagctgctgattgtggtcacaagaaagctctttatgagtgtggtattaaactttgtgcggcaggagacaaggtcaagtctctcatgtatctagagttggcaacacggcgtggagaatacgctgctgcccacatgagagatgtgatatttgaatcgctctctgttgtgaataaacagcgtgccatgtcggacgctgataaatggaagcctaggacactccatcctagaaggtgaggaaatgcaccaacgtcaaagtgtaaacaaccatatcgtcaagatgtccatacctacatcgtatgtagccaaaattgaagcatgccagacgccatggaagggtgaagtaaacacagcatcctcaagaatgttaacctgcagactgcagtagccatactgtggctctttgtataaagccatccattggcagatgtaatagcaggagaacctgtagttgtagtatagaaagttctgtagcgaatactagttatgaaggagatgccagtcgcacaactaaactgtacatgtgcaagttgctggtttcatcagtttatatccgaagcctggaggctttgtgtctttatgagttgaaagaaaaagcagaaatgtctgaacactgacatagacatttgtgtctggacatggacataagtagacatttgtgtctatatcagaaatatctagacatagacatagacatagtggacaaatgtctttatttgttgcagtcgagcaatgatgacctcccgatgagttccgggtg

SEQ ID NO: 20513 - DNA, 785 bp, Sorghum bicolor
  unsure (1)..(785): unsure at all n locations
  Clone ID: LIB5121-005-A1-PF1-F8
ggtcgagtaaagcgtgctcgcctgctcggtcaaggaaaggaaaagtttccgaaacaggggcagcgggcgccgggtgccgggcgcattttggttgcttggatcgggaccgagcgagcgcgccggagtccggatgggctcctcgtccactccggcggccgcggcagcggcggcgccgagccggcgcaaggtggcgctctacctggcgctcctcaccctgcagtacggcgcccagcccctcatctccaagcgctttgtccgccaagatactattgtgacctcactagttctcgcaacggaagcagcaaaggttatttgtgcaatcattttattgattgcagagggtagtctaagaaaacagttcagtaactggactctcactggatcactgactgcgtctggactgcctgctgccatctatgcccttcaaaatagtctgctgcaagtatcatacaagaatctggattccttgaccttttcaatccttaaccagactaagcttttgtggacagcatttttcacatttcttattttggggcaaaagcaatcttccaggcaaattttagcattggccctcttaattggtgctgccgttcttttaagtgtgggggagagtactagcaaaggttccaagagtggtggctctgactatatcttgctatatgngatcattccagttacagtcgcttctatgcctgtctggnttggcttcttcattgtgtcagtgggcatctcaggtttaaaaacatacctcttacatgatgactatagagatgtcatttattgga

SEQ ID NO: 20514 - DNA, 616 bp, Sorghum bicolor
  Clone ID: LIB5121-005-A1-PF1-E7
agttctcagcaccgcttgcggctttggttcgcagatggctagcaacaacaagtggactattgcaggcgagtggtctggtgccctcactgactgcgcgaagtggctcaacggccgtggcattggcgcacgctacgatggtacctacaacaagggcggtcagggatcttcatacatcggatcttgcgacggcaagtacatgggctctgtccaaggcttcagtgacgcagaccgcgccaacgtcaagcgcttcatcgaagcacaattcgtggcgttcgagaaggccgacggctggatcttctggacttggaagaccgagagcgcacctgagtgggacttccaggaccttgtcaggaacggcatgattcctcagccgttcagcgctatgaactacggcatctgcggttgaagtatcagactgcttcataattccattccaacagaacgcagctttcgtctttcctagacctctcttcctagcgaccgctcttttcagagagcacacacttgtgtcgcccactccttccactatcgcttaacgacgtcatgacactgaaccatagatggctccgatacccttttgtgtttatataccatcgcttacctgggggaagggcag

SEQ ID NO: 20515 - DNA, 393 bp, Sorghum bicolor
  Clone ID: LIB5121-005-A1-PF1-D9
cggccgctcagcggcgggcggggaatacccgtggaacgtcgtgggcggtaccgacaagggccacatggagcaccgtcccaacgaggatggcagcttgcccaaggcccttaccgaggaccgctcaaaggccatcccccactcccaagcatccgaagaggaagcgcgaaaactagaatctgaacatgaggccaacaagaaataggtcaacacaagccttcgctgatggacaagctcaaccctaaggttgacgccgatggtgacggcaaggccggtttcatgaaatagatgcatttcactacgcacaatcacgacgactgcatgcgagataccaaggaaagctttcctatgacattgtataattagcctagtaatgaagtaatcactacaaccttc

SEQ ID NO: 20516 - DNA, 801 bp, Sorghum bicolor
  unsure (1)..(801): unsure at all n locations
  Clone ID: LIB5121-005-A1-PF1-E8
gtgtcacgggagggcagctgacttggtttcggccgtcgccctcgccccgacccgacccgaactcagaagaaggtcgatccctactctccaccggatggccgcccacggcaagcccaagcccgccggtccgccaccgccaccgccaccgccaccgcccccacctccgccgccgcccgaggcgaggaagggcttcacgcgccgcatgctccctttcctcctagccgccaacctctttgtcggagcttatgtactggtgcggacctacaaaaaggactcaggaaaggactcaaccactgatcctgctactgcatctgctgcaactgctgagaagcctgccgaagctgtctctgtgcccagaaaggagctcccaccaatccctgaagatgaccagcgcaagctctacaaatggatgctggaagagaagcggaagatcaagccacgcaatgctgccgagaagaagaaactcgatgaggagaaggcccttctcaaggagttcatccgagcaggatccctcccgaggttatgagctcaccagttgtcatttggatcttttgtgtctagtgttccaccaggaaggtggttgggcctgattggactttgtacaagcacagtactgtgctatcttgtgtactgatgtcttcatgatttagcctcctggagtccaaaggttgtgtgggtgcaaactggtgttgtgtccattggtgctagagattctttaagactanaaaagaaagaaaaacttcagtgtgactgtgtgagaaattcttctgttcccaaaaaaaaaaaaaaaaaggcccctag

SEQ ID NO: 20517 - DNA, 564 bp, Sorghum bicolor
  unsure (1)..(564): unsure at all n locations
  Clone ID: LIB5121-005-A1-PF1-C9
aacagcgtcaccagtccccagccaaaatgacgaagggtacccccagtttcggaaagcgccacaacaagacgcacacgctctgcaggcgttgcggtcaacgatcccttcacatccagaagcacacctgcgcctcatgcggctaccctgctgctaagacccgcaagttcaactggggcgagaaggccaagcgaaggaagaccaccggtaccggccgcatgcgatacctcaagaccgtcaaccgcaagttcagcaacggattccaaactggcgctcccaagggctccaagggccccaccgtcaagtcctcgtaaacgtatcaagcataaggttgacgacgaggaggagtagaggcgcgatgaaggccattcggacgggtgcatgatcggaaagcgggttcttataggcaaatggtattgctcggcatggggcgttctgtcatccctctcccggttgctgtccatcccacatgacgaatgaggatggcatcaccgtttgagcgcatagctctggaggcataactacggaaaattcatcatgttctgtcacgaaatgggaaanannnaa

SEQ ID NO: 20518 - DNA, 590 bp, Sorghum bicolor
  unsure (1)..(590): unsure at all n locations
  Clone ID: LIB5121-005-A1-PF1-C12
gatttccaaactcgagccgccattgccgtttgtcgaggaagaggaggttcaggaatcaggaggagatgagcgggctggagcaggagctgggcctgagcctaggcgtcctcatcgacgtcgtcgacgagcagtggatgcgcgacaccctccccgccgacgacatccccgtgccgccggccatggcagtcaagactgaggacgccgaggatccagcgcctgccaatcaggaaaaccaaccagcacaaggggatgtatggcgtgattttgccttggaaaatctctgatctttcatgctctacattctacaagtgcctctagagctgaagattcaatgctaagggtctacgagctgcgtagtacattgcgctttcttcgccgtgctgcccgaatgtttgtctgaacttagtttaaaatatggtttatgcaagtgttccagatattccccccatgatggatttgagccttgtgttagcctgttataaaatctccggtgacgatgactgctatttgtctattcaagctctctaaaaaannaaannnncnnaaaanaaaaaaaanagcaaaaaaaaaaaaagccaaagacaataaaa

SEQ ID NO: 20519 - DNA, 648 bp, Sorghum bicolor
  Clone ID: LIB5121-005-A1-PF1-C5
tgttcgccagagagcaacaagaaaaaaacgtgctcgctcatgcgactgcccccccgcctattttgatgcttccggctctccgcatttagccatggagcggccaacgtcgtcgatcgaccgatggactcctcgatcgcatcctccgccggcggtcgccgacgactcgccggaccacatagctgggcgcggccgtactcaacgcgtggaggctgggacgtcgtcgtcgatcggccggctcgccggaccacattgcttcctccttccgttccagacaagaaatttgatgggccggcaggtcgtcgcgcgctaataatctaacgatgctggcgtcgcctggctttgtgtatctcgattatgccatcatcctaaaacgccaagcactactgccttgtctgctgcttagcttctccggttccggtacgttccttggcaatttatatataatatataggggaaatgtgtaatgtttgagcttttaaaaaaaaaaaaaaaaaaaaaaaaaaaaaaaaaaaaaaaaaaaaaaaaaaaaaaaaaaaaaattatccatcacagcttcacttaacaccactacaccatcaacagctcaccaccccccactgctcttttgtcctgcaatggctgctccacgcctcgccctggtggccgcga

SEQ ID NO: 20520 - DNA, 834 bp, Sorghum bicolor
  Clone ID: LIB5121-005-A1-PF1-B9
atcgccctttgcaattccccccaaatcttttcctcacacttcggcgcaatggcaccaatagcagataccgtggtcgatgacctcaagagcaccgtcaacaggctcgagaagcgcatcgctgagctggagaacaagctgtctggccagagtgggggtgcatcaacgtcggcggagagcgtcaggatgatcttgatgggaccacccggtgctggcaagggcacacaagcgccgcgaatcaaggagaagttctgcgcatgccatcttgctaccggagacatgctacgcgctcaagtcgcggccaagacagccctcggtcgggaagcgaagaagatcatggatgccggcggtctggttagtgacgagatcatgatcaacatgatcaagactgagctcgagggcaacgccgagtgcgcccagggattcatcctcgatggcttcccacgaacagtaacccaggccgagaagctcgacggcatgcttgctgcgaccaagaagccccttcaacacgccattgaactgcaaattgacgacggcctcctcgtctcgcgtatcactggccgcctcgttcaccccgcatccggccgctcctaccacaagatcttcaacccacccaaggcccccatgaccgacgacgtaaccggtgagccgctcatccagcgctccgacgacaacgaggacacgctcaagaagcgtctctcgacctaccacgctcagacccgcgccccgtggttgcatactaccaaaagacgggtatctggaagcccattgacgcaagtcaagagccagcccaggtatggaagagcctgctcaagatcttcgatgaccaggccatgg

SEQ ID NO: 20521 - DNA, 365 bp, Sorghum bicolor
  unsure (1)..(365): unsure at all n locations
  Clone ID: LIB5121-005-A1-PF1-A4
ngaattctatagtgtatatatatataagtacagcctgccagctgccagcattgatcacttttgctcgtgtggggagggatcggagctcctgctgcgcgccggccggaggtgcatgccgcacgcgcagtctatatgacgatcgagcaggccgtgtagttgtgcatagctaagctagccatcatcgtcgtcgtccatgcggtcctcgtcgtcgtcgtcgtcgtcgtcgtcgcggctgctgctcgcggcggcagcaacgtcgggcgccgcgtgcctggcgctggttctggcggtcggcgtgtgcacggccagctgtggcggcggactcatggcgcatggacgacaacagccgcgtccgccgtccacgg

SEQ ID NO: 20522 - DNA, 518 bp, Sorghum bicolor
  unsure (1)..(518): unsure at all n locations
  Clone ID: LIB5121-004-A1-PF1-H9
ccgtaccgacgacatggcgaccctcaccgtcccctcctccgtcccggccgtcgccgaggangatnagtagatggataaggggtgcgaagtgttggacacgatggataaggtgatgattgcgttgatgaaggaggagatagaggtggtggattggaagctgggcttcgccaaggtggacgaaaacttctccgcgctcgactacatgagcctctccaacatctccgacgaaaacgacaccgaaggctacctctccgtgattaagccggcgatccggtgatcgatgatggtcaagggcgggatcatcagcgtcatgggagggaccaagtacgcctaccacaacacccccgcgggcctaatggggatcttccccaacggacggtgaggtcgcgtgctacaagcacaagctgtactgaggattcagctccatctcagtatctcttttcgcaacagctgcaggctttttcctttccatgaactctgtcgttagatttttgaatcttgaaactgcagtgactcta

SEQ ID NO: 20523 - DNA, 231 bp, Sorghum bicolor
  Clone ID: 1000769
acgatatggccgccagggccggcgtatacatcgtgaaaaaggtggtaataatatcgtttttcagcgtgaaagtatagagggtagctagggtaggggtaaccaagatcgtcgtcgtccgcttccattggcagctttcactgcgtaagttccaatattggtgtagcaaactgtcaactccgttgcgtaattatcgtggctagagtacgtaataagggaatttgaagatcgtac

SEQ ID NO: 20524 - DNA, 348 bp, Sorghum bicolor
  unsure (1)..(348): unsure at all n locations
  Clone ID: 1000795
agcttcttttgnacnanaaggtngaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcncccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgcc

SEQ ID NO: 20525 - DNA, 533 bp, Sorghum bicolor
  unsure (1)..(533): unsure at all n locations
  Clone ID: 1000806
ggaaacccctgagaccgaagaagccaaagatgctgaaactggcaaggaggcagaggaggccccaagcgaagatgccgcaaaggagactgantggagatgaagcctgctgaagaggtgaagggggcctctgctgaaacagaagatgctgacatggctgatgctcctgcaccagcaccaatggaagaagataagaaacaaactgaagaactggcagaagctattgcagctnctcctgtgccatcgaggagaagaagatgaagccagctgagcctgaagctgcagcaagcaacccaactgaggatnggcccctgctgctgctgaacctgctgatgtgctgctcagctgctgagcccaaatcagacgccaaacctgctgctgttgctgctccagtgcctgagaccaaatcagacgccgagcctgctgctgttgctgctccagcgcctgagaccaaatcagacgctgagcctgctgctgttgctgctccagctcctgagaccaaatcagtagccgagcctgctgctgttgctgctcca

SEQ ID NO: 20526 - DNA, 284 bp, Sorghum bicolor
  unsure (1)..(284): unsure at all n locations
  Clone ID: 1000818
agctnnnactcttcttctgtactgaacngtgactagataacaataagagtgaaccatggcggacgagttacngccgcattgcggcttacggcaggttccggcnccgnnnacgaactaannncaggctggctacaacagcaagccggcatctgatgactacggccgnggcgaaggnggcacaacaagtcgggcggcnatgacgactacnnccgcagcggcgngatgggacggcaggtcggcngcgaacgactacggccgnggcaccgnggcggnggcacaacaag

SEQ ID NO: 20527 - DNA, 282 bp, Sorghum bicolor
  Clone ID: 1000819
atagtggtttatttctttcattaaaaataaaatatacagatgaagagaaagcttttattctcaaagcgttgataaaaagccgagcgaaaaccacgtgcacacatatatagacacaccacatatatactatatcagtagagagagaaaaaacgcgagtaggaaaatgtccatgcagagacacacacaccacacatcgatcaccaaacacgcgatcgaagtaccatgcacacacatcatcagtaacatcacatgagatatacatagcgggcaatcaaacccccc

SEQ ID NO: 20528 - DNA, 132 bp, Sorghum bicolor
  Clone ID: 1000833
gaattcggggccgcggcgtacgtgttaacgatgggaggccggcggcaaaagcaaagcaaagcaagcagcttggtagcgatggcgtccacctcctgcttcctccaccagtccaccgcccgcctcggcgcgtcg

SEQ ID NO: 20529 - DNA, 279 bp, Sorghum bicolor
  unsure (1)..(279): unsure at all n locations
  Clone ID: 1000835
gaattcggcggtcggtcgcagggcgtcctgcccagcaggcgcgccgccaacagggccagggcggccgccgtcgtcgtcagggcgtccgccgagggcgaggccgccgcggcgcagcggngccgtcgagaccgtgctacgggctggtggccaacgagacagatncgtcggcggcgccttgtcgcagccggtgcacgccccgaccgtcaattccatcaagatcgcagccccggcgacgncctncggtggactcccggcactgaaaatctgaccaggcgaggg

SEQ ID NO: 20530 - DNA, 205 bp, Sorghum bicolor
  unsure (1)..(205): unsure at all n locations
  Clone ID: 1000838
gggcgggcnncggcacgcnnccgtggccgtggcnccagcncccttcttgcnggcnnnccatggcccaggaggtgctgctgggcgcaaacggaggcgtgctcgtcttcgagcccagcgagttcacngtcaaggcnggcgacaccatnaccttcaagaacaacnnnggcannngcacaacgtcgcctccgacatggtcgaaacgccc

SEQ ID NO: 20531 - DNA, 715 bp, Sorghum bicolor
  Clone ID: 10419986
agccgcagctgctgaaaacgtggtttccatatttgatattgagacgcatgggaaaaaatacactctacagggccataacaccgatgtgcagtcagtgtgctgggacaacaatggggaatatattgcatccgtcagtcaggacctagttaaggtttggtcaatatcttcaggggagtgcattcatgagcttagctccaatggaaacaagttccattcttgtgtgttccacccgagctattccaatctcttggttattggaggctaccagtctctcgaggtttggaacatggtgaagaaccagagcctgacagtacaagctcatgaaggtctaatcgctgcgctggcgcagtcaccagtcacagggatggtagcttctgcgagccatgacaactctgtcaaggtgtggaaataacaataacaagaataatgatggatctaggtagcttttttcccgggtaagtgatatttctccggctgaggcataaaatgggggtgagcttggctgtcgtgggcgactcaggccaataaggaagagtagtaattagctggttgcctgtccccgttcagctgtccaagagcagtgagtttgttgatgggttgtatttatcctgataggctgtttgtgtagctcagaaacaagaaagaagaatagaatattggctgaaaaggtggccgcctgttttaatttgtttacgccgtatcatatgtaaccttt

SEQ ID NO: 20532 - DNA, 364 bp, Sorghum bicolor
  Clone ID: 10420048
cggcgcgccgtcccccgcgccggcgcccggaccggccgccgacgtgcccgcttcggccccggctcccgaaggctccgcaccggcgcccactcccaaggccgccggcaagaagaagaagaagaaggccaagtccccttcgcactccccgcccgcgccgccggcggactcgcccgacttggcccccgccgacgcgccagacgatgacgccgcggacaaggtcgaatctaaaaagaacggcgccgccgcagcggccgtgagcttcgtggcctcggtggcctctgccggcctggccgtcgcgctccttttgtgagcgagcggcaggcgtgttcgacgccgagcctcctccccgtagttttctctacca

SEQ ID NO: 20533 - DNA, 549 bp, Sorghum bicolor
  Clone ID: 10420142
gcacgaggttcgaaaggttttactttcagtgaagtgaactgttggcgcacaagcaacagcaaaattgtttgctgccacttctcttcagatggcaagattttggctagtgcaggacatgaaaagaagactgtactttggaacatggaaaatttccagacacagtatacgccagaagagcatggccttattatcactgatgttcgtttcaggcctaactctagtcagctggcaacatcttcttttgatagaactattaaactgtggaatgctgccgatcctggattctctctgcatacgttcactgggcacagtggccaggtcacatcattagattttcatccaaagaaaacagaccttctgtgctcttgtgatggcagcggtgaaatccggtactggaatgcaacccagcttacatgtttgcgtgccataaagggtggtagtgcccaagttcgattccaacctcatgttggccagtttttagccgcagctgctgaaaacgtggtttccatatttgatattgagacgcatgggaaaaaatacactctacag

SEQ ID NO: 20534 - DNA, 599 bp, Sorghum bicolor
  Clone ID: 10420146
ttcggcacgaggctttgacccaccattttctttcgcggcggggtgctctgctggtcttcctcttcacgctagagcaaatcgtttctcttctcccgttcaccgcgcctgcgcgaagccgacaacaaatctagggtgaccggcgacgccctgcgcccagctgcccatgtcttcgtcggcgcttttgccggcgacgggaactccccacactgggtcatgtggcaaaacagcctctacaagttttactggttctaccaaacatgagctgagcttgcatgggaatgttaagccgttgcaattagcagcaaatggatcctctcgtttggcttacagaagcctagtacttaaaaatcagtggaatctttctgctagctcttcctctgcaaatgcagttaccacctttgatgatgatgaagttgtaccttccagtgttagtgatgaaaaaattggagtactgttattaaatcttggtggtccagagaccctcgacgatgttcaaccatttttgttcaacctatttgctgatccagatatcattcgactccctagactcttcaggtttcttcaaagaccactggctaaacttatttctacttttagag

SEQ ID NO: 20535 - DNA, 518 bp, Sorghum bicolor
  Clone ID: 10420210
gcacgaggagaagctccactccatcggctccagctcccagctcaccacctcgctctaccagaccacgggccaggccgcaggcgacatgggccacgtcaacatcaccgacctccgcggcggcaaggtcgccttcgcctccgccgcgccaggcgccaagttccagtccacctacaccaagcgcgtcgccgacttcccgtccaacctctccgtcctcgaggtctccgaccccatcaccttccctggcctcttcggctccccgtccgcctcgtccgccaacatcaccgacctcctcgagaaggccgggtgcaagcagttcgcgcgcctcatcgtctcgtccggggtcgtcaagacgtaccaggccgccatggacaaggggctcaccctgttcgcgcccaacgacgacgcgttcaaggctaaggacctgcccgatctgagcaagctcaccagcgccgacctcgtcgcgctactgcagtaccacgcgctgccgcagtacgcgcccaaggcgtcgctcaaggtcg

SEQ ID NO: 20536 - DNA, 636 bp, Sorghum bicolor
  Clone ID: 10420216
aacaaccttacaagggaagatgaattcttgattgtaaacaatgctgccctgcttcccatgaaaaaccgcactgaggtcttcctgatgctacatgatagaattgtcaactatcttggtcagacaaaccgtgcaaagaagaacagaatactgcacaatctcccctacaacaacgactggttggatactgccacggcaaatgcaaagatcaaccagtgggttgtaaatgttaaaaacgagtacaaaaggactacaatcgatctactacggctcaacagaaatgtaagaagccacttgcatgagtacaaccacgacgacgatattgaggaaattctgtattgtgaatggcccatgctgctcactgtcatggagaccatgttacacttggaaggtgagctccaagacactggcatccataacaagttcggctagcatcctactgcaaaacagatgaaagatgtattcttcatttccatgggttagtaagctactgttcttcgatcttcagtgcgaaagtttatcagtttatggtgatgaagtgaaatgctacctgtagttgctttatctgagatgcatcaacttgaaggtaaagccggtcagcttttgtaaagcatactgaaagatatcaccttaaactta

SEQ ID NO: 20537 - DNA, 361 bp, Sorghum bicolor
  Clone ID: 10420268
gcggcgcgcgagatccgcggggccaaggccaagctcaacttcccgcccgccgtcggcgctggcgccggcgccggcgcgcgcgagccggcggccaagaggcgccggacgtcgtcgtccgcggcggccgaggagagctcgggctcgtctccggcagcgacgacgaccgtcgtggcgggcgtcggaggcggcggaggaggagaggagacgctgcgtgactgcatgtccgggctggaggccttcctggggctgcaggaggaagcggccgacgagggtggcgacgccgaggcgtgggacgccgtcgacctcatgttcgcgtagctaggcaggccgtcgtcgtactagtactaggggcgttcaggat

SEQ ID NO: 20538 - DNA, 430 bp, Sorghum bicolor
  Clone ID: 10420345
cagatgctcggatcaggaacaagttcagcagcatctcaatggcggtggaccgggcattcagactcgccctcgacaatctccaagaacctagatcgttgaaggaaatagccagggtgtgggactcctgtgtacggcgtgcagtcaccgagtatgtccaccagctgggtggtgacactaactcaagtctctgccggtgtcagggttgggtcaaggcatgagaattggagaatgcatatgcaacaacattttctgatctgatctgtgtgtagaaagtatgtggattaataggccagtgactggtgaggataaaaggaaagaaactgtgaataccatgatgtacgtagcagtagtgatattgcattgtcagtctgctagctacttatacgatgacctagtagtatacggtaaagttcatatatgtaatgttttt

SEQ ID NO: 20539 - DNA, 567 bp, Sorghum bicolor
  unsure (1)..(567): unsure at all n locations
  Clone ID: 10420378
gcacgaggacaagaagcagccacagcagtagcaagatagtgatcctccatgggnaaataccctcggcgttggcgtaggtgtcggcatcggcctcggcctcgccgtcggcgccgccggcctgatccaggctggtggtccaaaaattggcgacacttctcagtatcaatacaagtgagatgctgctctttgtttcttctactgaggacatcgacgagtattctactgagaggctgcgcgatgcggtgagctatgcgaaggacaacgcgatgctgatccaggtgccggtcttaggaacaaggaagacattctggcgattatctgacgaagccactaggattagcagaaaacttgcattaatactgaggaaccagcactcagtctgcaagtacctcactgctcctctgcaggtgtccgacgtctggattgggagcactgggaatgtcaagctaaggggtgtcagtttcactggcaaaggtttcttcagcattgagcatgtgagagatgactacaagcacctttccaggttcctggagctgttgattacgatctcaggtggggatatcaaca

SEQ ID NO: 20540 - DNA, 503 bp, Sorghum bicolor
  unsure (1)..(503): unsure at all n locations
  Clone ID: 10420509
gcacgaggggatcaggagcatggtggagctgaaacaccagtggccaagacgccagccccatcagctgatcaagcagaggatcaggagcatagtggagctgaaacaccagtggccaagacgccagccccatcagctgatcaagcagaggatcaggagcatagtggagctgaaacaccagtggccaagacgccagcctcaccagctgatcaatctaaggatcaggagcatcgtggagctgaaacaccagtagccaagaagcccatagaccgcctaattgctgcagtgctttcttcatcaccagcagtgatccgcagctcatttaatttgatgaagtcggcagtcattgatatggattcagtaccattatcgattggatccaataacaaaatgaaacgtgtgtatgctgttacatcgacttctgaatcaccaacactcagcagcacagatgacagtgctgtgacatctgagttcaatgcatcagatgctgcatctagcanatatca

SEQ ID NO: 20541 - DNA, 107 bp, Sorghum bicolor
  Clone ID: 10420633
gatcaacctggaaagaggtacttccttgccagaataaaaccttacacaacagctcgggttcaagaacagcatggaaaaaggtattggcttgtcagagtaaaaccatc

SEQ ID NO: 20542 - DNA, 617 bp, Sorghum bicolor
  Clone ID: 10420678
tgggtggagcagttgcattgaaggttcacttcaagcaaccaaatgaatggaatggtgcaatactggttgcacccatgtgcaagatagcagacgatgtggttccaccatggcccattcagcaagttctaatttttatggccaaacttctgccaaaagaaaagcttgttcctcaaaaggatttagctgagttggcattcaaggagaagaagaaacaagagcagtgttctttcaatgtgattgcctacaaggataaaccacgtttgcgaacagctctggagatgctgaaaacgacacaagagatagaaaggcgtctggaagaggtttctttgcccttgatcattttgcacggtgaggctgatttggttactgacccagcggttagtaaggctctgtatgagaaagctaagaaccaagacaagaagctgtgcctctacgaaggtgcatatcacgctatcttggaaggtgaaccggacgagacaatattccaggttcttgatgatatcatatcttggctcgatcagcattccacaagagaagaaggtatgtcgtcgtgaatcggacagcgctgttcaccaggattaggtgaattcatttggcattgctgtatccttaccggt

SEQ ID NO: 20543 - DNA, 568 bp, Sorghum bicolor
  Clone ID: 10420732
gagggatcagcagagccgctagccctcaccctcgtcgccctctgctgcaatcgcctcgcccgcctcgtccgtccgccgcggcttcccctcggcgttatcttccttcccatgtcatccataccaagcgaccgcagtcgctctgagcgttgttgatccgatcatcccttccctagttcctctcccgcgacatctcagttcttcatcacgaaaagatggtcggcggcggcaacgagttccggttcttcttgtcctgcgaagtcagccacccactcgccttccgcgtcctccacgcagagcatatcttgttgaccgaccaaaaagtcccagagctgtttgttgagtgcaagctgtacatcgatggtatacaatttgggttgcctgtaaagacaaggttggaaccttcaggaccgaaatactgttggaatgagctcataacactaagtaccaaatacagggaccttacatccctctcacagcttgcatttacggtgtgggatgtctcaactggtgaggaccctgcaattgttggtggagccaccatatttcttttcaacagcaaaaggcagct

SEQ ID NO: 20544 - DNA, 632 bp, Sorghum bicolor
  Clone ID: 10420748
gtaattttcatgctcttcgctttgtacacaaaattcaagaaactggtgcagttcttgtagagaggttgcatggccgtagggcctcttcgtcgcctttgaaggataatcttttaggccagtttgccatcaagtctgaccccagtgcgaacaagagtgatgcatccaaatatctggctgttcatctccggtttgagattgatatggttgcatactcattgtgttactttggtggtggcaaagatgaggaagacgaactagaagcttatcgccaaattcactttcctgttctgtcagaactcaagaagacaacaaagttgccctctgctgctttcttacggtctgaaggcaaatgtccccttgcacctgaagaggctgtgcttatgcttgctgctattggtttcaagcgcagcacaaagatatacattgcaggcgctgaaatttatggagggaaggataggatggctgccataagtcgtctttatcctgctttagtaactaaagaaacccttctgtctccatcagagcttgaaccatttaggaacttctcatctcagttggcagccctggacttcattgcatgtgcagctgccgatgcatttgctatgactgacccaggaagtcaattctcttct

SEQ ID NO: 20545 - DNA, 159 bp, Sorghum bicolor
  Clone ID: 10420808
gcacgaggatttatcacctagcggctgcctgccagccagccgcctttcgaaaccgagcacgagggagcagacgcggtctctggaaccttggtttgagcgagcgagttggggatttctgtgacgaggaggaggaggagggggatggcaatggtggcggcc

SEQ ID NO: 20546 - DNA, 609 bp, Sorghum bicolor
  Clone ID: 10420860
gcacgaggtgaaactgggaagaaaaatgagattgctcttgctaagagaattgaagagttgtcgatgaaagtttctgaaatggaggtggagatgcaggatttatcagctgatagaagagaattgtcaaatgcatatgacagcatgatgacagaactcgaatgcacaaaattaaacttagattgctgcaatgaagaaaagcagaagattgaagtctctcttgaagagtgcagtgaggaacgtaacagaataagggtggaacttgacctggttaagaagttattggagaatatggcattaacagacaataacgcatcacatgatagttcggaatcatgcacccctggaaccacatcgattgggcatattcttggagatggcaaggctgattctgcatcaaaggctacaccaaatacaacaaaaatggattcagggttacaggaacttgaaattcagagtagaagtttatcatcaaatttgtctcagggagcagaggatgctgtgaagtttggtgataatgaagagagcaagaacttggagaattgcgatgaggaaatggaatcgtcaacagagaacaatttgaatggtaacaatagcgtcaatggtatttct

SEQ ID NO: 20547 - DNA, 594 bp, Sorghum bicolor
  Clone ID: 10420880
gcacgaggattcagcttagaggccacaataccaagatccagtctatcgcgtttgcagtcaaaggagcaagtgtagtgtcttgtgcttctaatttattaaaggtatgggactgcattaccggttcttgcctctatacgctgggtggtgatgaccaaaattcagtggggcatactcagaaaataaatgctatggcagtgaataaatggcaatcatgtcttgttgtcactagtggagcaaaaggtgacgggaagcttctactatggaatgctttaagaggtgaacttgcttctgatctaaattcgaacttgaggtcccaggatatgatctatccctcagttgatacaatggagttctatagtgagaatcatctggcatgtggaagcgattgtgactatggtggctcagctgtggtacaattatgggatattgattctccagagtcttatttatctttctctgcaagtgactcttacattacttcccttaaagtcaaccctgctggcaacactctcattacaggttctggcgatgggactattggcttatttgacatccgtacttgttctgcaattagccacttgtcagtgggatctg

SEQ ID NO: 20548 - DNA, 524 bp, Sorghum bicolor
  Clone ID: 10420952
gcacgaggctctgcagccctgcacggctgcacgccctctccggctctgcataaacgtcgcccagcttcccgcccgctcgcctatccggcgccccaaagccccaaaccatttgaaatcacgccgcgttggcgtgtaatcgacgattcggcggcggcggggcggcgatggaggtgggcgaccttcacaaggtgtgggaggtccgtgcgctcaagaccaagcccgacgcggccgccgcccgggcgacgctcgaccgagtcgccaggcaggtccagcccatcatgcgccgccacaagtggcgcgtcaaggtcctctccgagttctcgccgcggaacccgaggctgctggggctcaatgtcggcggcggcgtcgaggtcaagctgcggctgcggcgcgccggccgtgaccatgacttcatcccctacgaggaggtgctcgacaccatgctccacgagctctgccacaaccagcgcgggccccacgatgcgcagttctacaaactctgggacgagctccgcaaggaatgc

SEQ ID NO: 20549 - DNA, 662 bp, Sorghum bicolor
  unsure (1)..(662): unsure at all n locations
  Clone ID: 10420978
gcacgagggacgtacccttccgcagctccgtcccagcgcgaaacgccgaaaccctaccttcggcttctccgctccgcctccgcctccgcctccgccctcgcccccgcccccgcccccgcccctccgcgaaccaggcgagatgtcgtcgggcggcggtggggggcagcagttccgctacgcgcagacgccgtccaaggtgctgcacctgcggaaccttccgtgggagtgcgcggaagaggagctcgtcgagctctgcaagccctttggccgtatcgtcaacaccaagagcggcgtcggcgtcaaccgcaaccaggccttcgtcgagttcactgacgttaatcaggcaatcgcgatggtttcttactttgcatcatcttcagaaccagcacaaatccgaggcaagcctgtttacattcagtattcaaataggcaagaaatagttaacaacaagagtcctggagagacagctggaaatgtcttgcttgttactatggagggtgttcaagctagtgatgtcaccattgatgtgatccatatgcaggctcatgttaactggagaaaatgtcgttatcaacacctgcaattggagagataccatgtttgttttgctgcctctatcttcntactagtacattcaacgttcttatgaactctcatgtctc

SEQ ID NO: 20550 - DNA, 567 bp, Sorghum bicolor
  Clone ID: 10421058
cgacagcctgagatgttgaagagcgacaccacttcagcgccgaagcatcggtttccagaagagtttgctgcaggcagctgcgctctggagtgtgcagagttacagttctgtgcggaggacatgagttctgcaggattacatgggcagcctggctcggcaatcgttctggacgccgtgccagtaaaggatctttcctttcagaagcttcagtatggcatgaatcagctcggtctggagaccaaaggacgcataagggattcgctataccggttggccaacaggcttgaacaaaagcatcgtgttgcttgttcaagtgaaggattgggatcatcgagttcagataggttcgaatcaggcagatggaccgagacgcagacgaaccccatggatcagtcagtagcacagctccttctgcagaaaccctcttaccggaagactgtcccgccgccgcaccgtgtgacatagttttctccactagagaccccctagtagcctcttgcatcagtgcaaaggatagtggtacttctactctgaaagcctgaagcatgtaatatatgaagatgcagt

SEQ ID NO: 20551 - DNA, 507 bp, Sorghum bicolor
  Clone ID: 10421086
gcacgaggcaacaacatggggagcatctacgtggactgtgacatgctggatgaggctgccgagtgctacggcatagcactgaacataaagcacacacgggcgcatcagggtctagctcgagtccattacttgcaaaaataggaaaaaggttgcatatgaggagatgacgaagctcgtgcagatagctagcaacagcgcatcggcgtatgaaaaacggtcagaatatggtgagcgcgacgctgcaaggaacgacctgaacacagcgacgcttcttgatcctacaaggacatatccttacagatacagagcagctgttttgatggacgagggcaaggaagaggaggcgatcgcggagctgtcaggagccatagctttcaagccggacgtccagctgctccacctccgcgcggccttcttcgactccatgggcgacaccgatagcgccctgcgggactgcgaggccgcgctctgcctagacccgacccacggcgacacgctggagctgta

SEQ ID NO: 20552 - DNA, 522 bp, Sorghum bicolor
  Clone ID: 10421191
tggaatcaaactgtaaaaaagaaaatacagtgattgagctcttgtttgtatcagagaagcaatatagctgactagctcatccattctcttactgccatgatctactgctaggcatcatgttggatttggatttttggcagaattttgtctcatgtttgatggaagtagaccagggactaaattttgcatctggacaacaatgccgccatatttttgattggggtcagctaaatcattctgtgaatgaaggtgcatcatctgcagctgactctggaagtaatatattgaccaaactgagcaacaacattcttattgttgatattgctaattggctattgctatcgtgcctcaattctactcgggttaccattcaacaaatcattctgccagagttctgccaatcgtgtattgccatctccattgttgctaccatgcgatggagccagatggcatcttgactccttttttaacattcttttgttcattgtaccataagcgaatgcatatagttagagttgtaaa

SEQ ID NO: 20553 - DNA, 648 bp, Sorghum bicolor
  Clone ID: 10421247
ctgcaagtttcactcagtttgttgtagctacagatggggatgaagaatcactcgatctccttagacaaaacatctcctcgaatctggagcctaattctctgagcagaattaagattaggaagttattttggggcaacaaagatgatacgcaggcagtccgagagctttctggtaatggtgcaggttttgattgcataataggcaccgacgtgacctacaatcccgatgctatacaccctctcttcgtgactgcgagggagctgatttctgacagagctaacaaggattcaacccctgctcttattctttgctacattcagcgacgagttgatgaggactccatcctttctaatgcaacgtcccagggtttcaggcttgtggacaaatggataaatggacttcatgagagtaacggtatcatcagttcttggttctctggtaatgatgtctgcagtgctttccggaatgcagtactttcagtattgtacttcgagctgtgaaaattatgcctgcttgccaggatctcattgttactgtataacctgaagaatttttgtagcagctgtatcaagcaatgggcaaaacgactagaacattagaagaatttttgtagcagctgtatcaagcaatgggcaaaacgactagaac

SEQ ID NO: 20554 - DNA, 578 bp, Sorghum bicolor
  Clone ID: 10421283
gtacgacgagacgcacgtgtcgacgcgagtcatgggcacgcagggctacgcggcgccggagtacatcatgacgggccacctgacggcgaagagcgacgtgtacggcttcggcgtggtgctgctggagctgctgtcgggccgcaaggcggtggacaagacccggccggcgagggagcagagccttgtggagtgggcgcgcccgtacctgacggacgcgcgccgcatggaccgcgtcgtcatggaccccaacctcgccggccagtactccgcccgcgccgcgcacagggccgccgccgtcgcgcaccagtgcgtcgcgctcaacccaaagtcacggccacacatgtccgccgtcgtcgacgcgctcgagccgctcctcgcgctcgacgactgcggcatcgtcgggccattcgtctacgtcgcgccgccggagacggtcaccaaaggggacgaagcggcggtgggtaataagagagggtccggcagacgaggaggccggaggaggtcgtcaggagaaggcggtgcggcggccgtcgtgcggccggaggagtgatccgtccgtccaaccgtcgtcgtccgtg

SEQ ID NO: 20555 - DNA, 617 bp, Sorghum bicolor
  Clone ID: 10421285
ttcactcagtggtttggaaaggacattatcacaacttgatatggcaaatgagcatttgcaaagtattttcccttcatttaaagagcttcctggttctggcaatgcctttgaaagactactcgctttagaactcgagctcgcagaagctctccaagcaaagaagaaaacagacatccttttccagagttcattcttgaggcagcacaatgatgaagcagcaatcttgcaaagcttcagggacatcaatgaactgatacaagatactatcgagttgaagaggaggcagatggcagtagaaaatgagctaaaagagatgcagggcaggtattcagagctcagtgtgcagtttgccgaggtggagggtgaacgacagaagctcgaaatgaatctgaagaaccgaacaccatggagatcgtagggaaatcaccttatgagaaaactaatggggaaaaaagtgtcagccagttgcaggctttgtaaacaatcttgtgcgacggcaatggaatacattttgtaatgtaaatatcagtagaatctcaacatctctgtatcaaattgtagagttgtaagtgatatgcataaatgttacaacaccttgtacaagcgcctccagatca

SEQ ID NO: 20556 - DNA, 376 bp, Sorghum bicolor
  Clone ID: 10421289
tgaccgtggcggccgccgtggccgggtgcgccgtcatcgcggcgcccgacccgccgcggggccgctgctacaccgtccacatgtccgccaccgtcgtggtgtccatcctgcagggcgccgccgccgtgctcgccttctcccgcaccgcggagttcctctccgacgggctcaagtcgtacgtccgcgaggaggacggcgccgtcatcctccgcatggtcggcggcctcggcgtcgccatcttctgcctcgagtgggtcgcgctcgcgctcgccttcgtgctcaggtactacgtctacgtcgacagggagtgcggcggcaaccccatgcgccgcagcgccaaggtcggcggcgaggacggcagcgccggcacatggcc

SEQ ID NO: 20557 - DNA, 680 bp, Sorghum bicolor
  Clone ID: 10421439
ggaccgcgccaacgccgcgcagcggaggctctccgcggggtgccgcgagggcacgccgctggaccgtacccgcaccgccgtcaccgcggggctccggaagaagctcaaggacctcatgctcgacttccaggcgctgcggcagcggatgatgtccgagtacaaggagaccgtggagcggcgctactacacgctcactggggaggtccccgaggaggaggtgatcgagcgcatcatctccgacggccgcggcgaggagctcctgggcgccgccgtcgcggagcacggcaagggcgccgtgctcgccgcggtgcacgagatccaggaccgccacgacgcggcgcgcgaggtggagcgcagcctcctggagctccaccaggtgttcctcgacatggccgtcatggtggagatgcagggggagaagctcgacgacatcgagagccacgtcgccaacgcctcccactacgtgcagagcggcaacaaggagctgggcaaggccaaggagtaccagcggagcagccgcaagtgtctctgcatcggcatcatcatcctgctgctcctcgtcctgctcgtcatcgtgcccatcgccaccagcctcaggaggtcttgatcgagttgtgattggatgaacaacgaccggggttgtgaatttgtgaaaaacaaaaatgaggggttacgaattc

SEQ ID NO: 20558 - DNA, 539 bp, Sorghum bicolor
  Clone ID: 10421634
tcaacgccgcgctctacagccgcctcgcagagcctgggtctgccatgggcaggtaatcaaggagagttcagctcgcctgtggctgccggatagggacgatactgatactgctattcaccaccggacttttcatcatcgccaccatggttacaacacgatagccagagagattcaggaggagggagacgacgctgatgctggtgttgttgttgttgttgttgtaaactttagtaggaaggatggatgatgatagcttctgcagttcttctgctgttcatcatcttgttgtgtttttgctagtagcgtgttaattagcaggattaagcaaccaaccaccacaaagcgtccacccgccgttgttgttaactaagtacctgttgttatgagctgtgatgatggatcgactgatgttagcggttggtcagttgaatccaaaactgtatataggatggatcaaacgtcgtcgcactgggtggaggtggacgatgatgccctgatcctgatgatgtatgtattttacacgcaggatttcgcttgca

SEQ ID NO: 20559 - DNA, 584 bp, Sorghum bicolor
  Clone ID: 10421690
cgacgtacgagaacttccggtaccggtacgagcgcaaggccaaccccttcaaccgcggcgccgccggcaacatcgccgagatcttcttctcgccggtcccgccgtccaggaacgatttccgggccaaggtgtcgccggcggacccggacgccgccgcgctctactacctcggcccgctggcgtccgagtcgcggatcagcttctacaccagggccagcctcagcttcgacatggcaaaggcaagcttcgacctcaactactccgccaagcgcaccagcgtcgcgtcctccgacttcggcgacatcgtctacggcggccacggcggggcgctcgaccgggtctcgacgacgcagtaccagcagccgcggcactccatcttcggcggggccggcagggagagcaagaaggcggaggacgaagcggacgccgtcacggcggagctcggggccaccatgcacaagcactacggcgccgccgccggccggtcgcgcgtcagggagttcgaggtggtgtgatcgatcgaggtgtacgtatcggcgcgcaggggggatcgttgtgatcgagaaaccgtgttcgtctcagga

SEQ ID NO: 20560 - DNA, 531 bp, Sorghum bicolor
  Clone ID: 10421840
gcacgaggccccgtcttctcgcggtagccggccgacgactcggggtgccggcgcggcggcgatgtcggcggcggcgccagcgccagcgcaggctccaaggaagtgggagggactagtggacgaggcgctcgagagggaggtgctgggagcgtgcctggaccaggcccccgagcgccgccgcatccgcgaggctttcaagaacgtgcagctcagcatcgaccattgcctcttcaagggacaatatagtggcatcggaacaaaggagtcatatgagcgtaactctaggggggtggagattttctcaaaatgctggtttccagagaatcatcgcatgagagcaattgtttgtctttgccatggttacggagacacatgtacctttttccttgatggagttgctaggaagattgcttcagctggatatggagtatttgcactggactaccctggcttcggtctttcagaaggacttcatggatatattccaagttttgatactcttgttgacgatgtagctgaacacttttctaa

SEQ ID NO: 20561 - DNA, 585 bp, Sorghum bicolor
  Clone ID: 10421861
gcacgaggctgcattaccattattttctggtagtggagaggaaaatcgagaaaacaaaattaagagtgggcctgcaggttcccctaccatttccaggagagagaatatacagcaggaagttattaatgttttggaaagaaaacagtcatcagaaggaaccgatgatgaatttaataacgcgatggaagaagttactcgccttgatattgatcagataagcccgttaagaatggtgcttattgcgtctgttgcttttcatgatcaatctgtaaaacctggttcacctctgcttgtcagtgtgtcactcttatctcatcttccttctccagttgtggttgatcagctggaggttcagttcaatcaatctgactgtaactttgtgatacatagtgcacaggaagattctcctcctttagattcaaatttgcacgaccaaattgttcaagatacttcttctcttacactcttcaccaacagatggatgcggttgacacatgagttaaaatcagagtggaaagctagaatgtttgtctgtgaaggcgacaataaacaaacaccttgtgatttgctgccatgctgaaagtc

SEQ ID NO: 20562 - DNA, 603 bp, Sorghum bicolor
  Clone ID: 10421949
gcacgagggagatcctcagcttcggcgccgacagcaacgcccggaggaacccgtcgccggctcctcccgccgccaccgccagcctcaccaccgctcccgggagcctcttctcgcagcacacggcgaccatgacacaggccgccgcggcgaacgacgccaagaacaacaataagcgttcaatggaggccacctcccgggcgagcaacaccaaccaccacccggcggcgacggcgaacgagggcatgctgtccttctcgtcggcacccactacgcggccgtcgacgggcacgggcgcgccggccaagtccgagtccgaccactcggacctggatgcgtccgtgcgcgaggtggagagcagccgcgtcgtggcgccgccaccggaggcggagaagcggccgcgaaagcgcgggcggaagccggcgaacgggcgcgaggagccgctgaaccacgtggaggcggagcggcagcggcgagagaagctgaaccagcgcttctacgcgctgcgcgccgtggtgcccaacgtgtccaagatggacaaggcgtcgttgctcggcgacgccatctcctacatcaacgagctccgcggcaagctgacgtcgctgg

SEQ ID NO: 20563 - DNA, 514 bp, Sorghum bicolor
  Clone ID: 10421989
gcacgagggcgtcctccggatcccgacgacgcggcgacgtcggcggacggcagctcgtcgttcgcgtccccggcgacgggcgcgtcgtggtcgcttcccccgacgcgcgacgtgtacgtgaacggcgtggtggtgaaggtcaagtactgccacacgtgcatgctgtaccggccgccgcgctgctcgcactgctccgtctgcaacaactgcgtggagcggttcgaccaccactgcccctgggtggggcagtgcatcggccgccggaactaccgcttcttcttcatgttcatctcctccaccaccttcctgtgcctctacgtcttcgccttctgctgggtgaacctggcgctcatctcccggcggtccggcgtgagcttcggcgaggccgtggcggagtcgccggtgtccggctgcctcatcgtctacaccttcgtcacggcgtggttcgtcggcgggctcacggcgttccactcctacctggtgtgcaccaaccagacgacgtacgagaacttcc

SEQ ID NO: 20564 - DNA, 326 bp, Sorghum bicolor
  Clone ID: 10422006
gcacgagggcacagcgccggcgtcgtgcccgcgccgccaattccggaccacaccccttcgtcgcctcgtcgccacgacgcggcggcggcggccacctatcttcagcagctggtgcccacgtcgcacaaggcggtggaggccttgacgtggacgggaggcgagggcagcgggtccacgtcgtcgtcgcggtggcccaaggaggaagtggaggcgctgatccagatgcggaacgagaaggacgagcagtaccatgacgcggggggcaaaggcccgctttgggaggacatcggcgccgggatgcgcaggatcgggtgcaaccggagcgc

SEQ ID NO: 20565 - DNA, 570 bp, Sorghum bicolor
  Clone ID: 10422012
agcacgagggcagagtcgattaattagttaggtagtcatggcggcacctttcccgtcttcttgttctcgtgcaagaatggcggtggtggtggcgctgcttctagtgacaacggcggcagctccggcggccgtggcgttgctgaaggacgacatcgagttcatgtggggcccggaccatagcttcttctccgatgacggcaacaccctcgcgctgtgcctcgagaagacccacggctccggcttccgctccaagggcgcctacctctacgcccgctacgacatcgacgtcaagctcgtcgccaacaactccgccggcaccgtcaccacggtctacctgacgacggatgacgtgcgtccggggtaccatgacgaggtggacatggagttcctgggcaacgtcaccggcgagccgtacacgctgcacacaaacatcttcgtggacagcgtcggcaaccgcgagcagcagttccggctatggttcgaccccaccaaggacttccacacttactccgtccaatggacacccaagaacatcatattcctcatcgacggcacgcccatccgcgtgta

SEQ ID NO: 20566 - DNA, 526 bp, Sorghum bicolor
  Clone ID: 11064516
ggggtccgtgcacaacatctgccaggtctacgagcgagcgagcgggcacgtccagctcctgcagaagagcgtgcagatcccgctgctgctggggagcaccctcttcctcgtcgccggcgtcgtcaaccggcacgaccgccgcagccgccactccgccttcgtgttactggggaggagctgggtgtggttctgcgtgttcgggagcctcttgttcctggccggcggcgtgctgaacctgctgaaggtgttcaagacgcagcagatgggcgggaggggactggagaagctgcgcggcggcgcgcaggagcggctggcactggagagggagggcaaggtgcccctcatcctggagcatggccacggcggcggcggcggcggcggacggactaggcctggccctgcggcaggggcgatgacgccgccgcccgggtcctacaaggacgcgctcgtcagcagcgccagctaggagaggaacagaacagcaatggcaggccgccttgtgtagatgctcaggatttcacgttga

SEQ ID NO: 20567 - DNA, 200 bp, Sorghum bicolor
  Clone ID: 11064528
agggggaggaacttcgcaagcacattggcgcaacttgttacatcgagtgcagctcaaaaactcagcagaatgtgaaagctgtgtttgatgctgccatcaaggtagtaatccggcctccgaccaagcagcgagaaaggaagaaaaagaaagcacggcgaggatgctcaatgttttgcagccgtatcatgcacacaaggaaa

SEQ ID NO: 20568 - DNA, 567 bp, Sorghum bicolor
  Clone ID: 11064534
caccttctggcgcaccttaccagcagccgccagggccagatgcgtaccaacaacatcatcaccgccctcaatctacctacgaccacccgcaagaacttggaacttcagtctacgactcccccgttgaccgtcccgccggacaacaacttccgttcccaacaggtcaaccacttccaccagccctccaacgattccagcagcagcagcagcagcacaaccaacagcaacagaaccagcaagaatattcaccctccgcctactcccacgacgatgctgccagcgctccgtacccggtctctcaagcccccccgacgcatcaccctcccccagttcctaccggggcttcaaagccgccatatacctctttgacccctggagtccccaatggcggagaataccaggcgtataatccagcggcatcgaacccttccttgttttatcagtaaatttttgtctttttgaggttaggcagggtataactgatgtgtcgttggatggggtgaatatggcggttgtgttgtattgtttattgtgactgttatgattccagcatagctcccactctta

SEQ ID NO: 20569 - DNA, 467 bp, Sorghum bicolor
  Clone ID: 11064536
tccatgcatgtgtgggctttattttgccttcgctagcaagattgagaacaatgtacctaccaaatgagctgcgtgggggcatgatgagcttttcactgtcactggcaaatgccgctatcttcattttcctgttacagggcgcccaccatcgacgctttgcaaattcaaccatcctgtttcttgcgtcctatggcctgttaggagctgggggttgcattcatatgttgaggaggtggagaaagcacactaggcagaatgcccgcagtttgtaggagcttgaggcacctaaggttatacactacaggtcagacttgagagagattttctagtatctcacattttctttgtcgactcctttcatctggaaataggaaagtcatggtaacaccattggtcactggtgacttgtgcagcatattggagttaggtgtaggatatgtttttttgttcgaagaaattgtagaaat

SEQ ID NO: 20570 - DNA, 551 bp, Sorghum bicolor
  Clone ID: 11064552
aagtcggggctgatgaagtcgaacgactacctgacagctgcgctacagtacggccaagaactgcaagccgagtttggcggcgataatcggcctgcaaccaaggagaagctccgcgagatgtttgcgatcatggcatacgttgacccgcgagaaagcattgtgggcggtctgctcgataagcgagggcgtgtgggtatcgcggagggtgtcaatggggccatattggtatcattaggtaagccctcatccgccgctctcgaaaagctctgcgcccagacagaagctttcctcgacgctgtggcagccaaggctggtggcaaggcgggtatggtcaatgtgcgggaggatttcctcaggccccagtaaaggcatggacatggcgggctgcactcagggcgtcccaaggcgcgataggcttttgacttatggcgttacatatctctcttcgaaggattcaggagttctgatctgttgttttggggcactccatagatttctcgtctcacttactggcttatcggcaacgcggcgttctcttgtacatattcgtt

SEQ ID NO: 20571 - DNA, 536 bp, Sorghum bicolor
  unsure (1)..(536): unsure at all n locations
  Clone ID: 11064562
tgaagctttgcttgcagagcatggcanaggcattgtaggtgcggatattgaggaatcagattatagtacttcgcatgaaacacttgttaagatcaagggcatggacgccttgaggatattcaaatcaactaccaaaagaagagctgctctctacatgatgcatgacgagttcataggatggatcgaccactacatcaaattaatatgaagtagagatgtatgtcagttaccttcaaccctggtgccatttgcagtggaagaattgctgtgttgtattctttctcctgtgctatccatggtgccgagtggtgtagccattgccgtcgagagaaactgtgccaccgataggaactgaatggagagagcgacgctggttgttgagatcctataaattaggaagtggaactgaaatggagagagggacgctgggttgttgagatcctataaattaggataagatggccacggagtggaactaaatggagagagggacttgggttgtgacaggccggcccaacaacgagccagctatagac

SEQ ID NO: 20572 - DNA, 571 bp, Sorghum bicolor
  unsure (1)..(571): unsure at all n locations
  Clone ID: 11064571
atacgtagaaacagcattgccagacagggtgactagtgtggtggacagacacttggtacaagaggcagaagatggtgaagggattgcagatatgaaaatntcctgcatcatttcaattctacgtatcggggttcaatgttcagaggaggcaccggcagaccgcatgcaaatcagcgatgctctgaaagagttacagggaatcagagacaagcttgaaaacatctatgcattgaaggagcgtaattccaccgacatattctgaagtttctccattgcatgctaccacatgcctcctattagctaataacgatagagacaatgcgagactgcatccgctatgtcagtgggcctagctattggggaaacaaggcaaccaaactccaaacagacctgaggtgttggaggccggtgtctctgcaatccttgctagtactctatcccgctagtaggatggggtttcacagaaggattgatcttctctcacataagagcatactacattgtaactgaactcccaattactgtaatgtactatgtatactagcactaagaacatggatccaaggtcttg

SEQ ID NO: 20573 - DNA, 428 bp, Sorghum bicolor
  Clone ID: 11064579
ggcaacgccacctacgagaggctgccgctggagcaggacgccgaggagggcgccgtgctctccgggtcgtccgagggcggcgccaccgcgcagcagctggagcagcagcagagcagcgggggccccgtcgtgccgccgtcgtccatgtacgccgtcccgcagacgccgccgcacgacatgttcggccagtgggggcacgcggctgtgacgcggccaccgccgacgtcgttctagctagcgctagctgcacctgcaccggcctgccgccgtatctctctacctcttgctagttagagatttccacttcttcactaggtattagctactagtactctagtcgttgttacattagctcgactacccacgctgttaattaatgtgccatggcatgcatgtgtatcttttcccatttcttctagctatttgga

SEQ ID NO: 20574 - DNA, 557 bp, Sorghum bicolor
  Clone ID: 11064603
gaaactacgcaccagcccgtcgatctcttgtcataagcaccagcggtcaatctcgaagaatgatgccgcgccaacagatccaacaatacatcaacgaagaagaagaatacgccagcgacgcttgcgacgaggaagatgctgctttcgacaacgaagagtttgaaatagtaggtgcctcacgacaacgcggacacgcaccaaacgcccgagtttcgcggcggagctacacacgacgacccgaaatcaacaaattccgcatcaaggttcacgcactagaagacaaacggtatatcatggtcggaccgacaatccagattggggagttcgagaagcgaattcgcgataagtttgggttccagtcgccgttgaagctaaagatgcaggatgatggggatatggtttcgatggtggatcaggaagatatggatttgcttttgatgtcggcgaaggagtttgctcgacgggagggaagtgagattgggaagacggagatctgggtggaagtgttatctatgttttaattttggatggttccttttctacgtatataccccttg

SEQ ID NO: 20575 - DNA, 515 bp, Sorghum bicolor
  Clone ID: 11064629
tgcagaaaataaggaccagcctggtgtatctctgcccagctgagcacatacctccaaaaattgaggtggacctaacaaatcttgatgtcggagatagggtattaatgcatgacattccggtccatccatcgctcaagttgctgagtaaaaacgagaccatgcccatctgcaagatcttggcctcaaagccaattgagccagtcgagtagccagcactgcaaatatttcagagttgataacattgtacctttgggtggtactgccctccagcatctccatctcttggcttgtttttttgttatccgttccctaggtttcaatatgatagtgtattcagacaagctacgagcttcaagtaaagatatatgaaggaacaaaatgaagaacaatcactggagaaaccttgtctgtaccaatcactatagaataacatcctttctcttttgagtgttcgggttcagggacacatgacatgtaagaagacattgtgcactatccttttgctgtgtggcctg

SEQ ID NO: 20576 - DNA, 579 bp, Sorghum bicolor
  Clone ID: 11064631
attcagcttctcaaggcctttaatcatattaaatgcagaaattgccagtctcgtatagcaaaacgtagtgacatggtggtgatgtctactgatggggttcttggtgcttatgtcaaccctcatggttgtgtccatgagacgattacagtcagcaatgcaactgggctagcactcattggcaatccttctacagttcacagctggtttcctggatactcatggacgattgcagcatgcatggcctgcgagtcccacataggctggcgattcaaagccaccaagaagaatctgcgacccaggtcattttgggggatccgcagctcacaaattgcagatgacacagtagatcagagcgactgattctccaaacatccatccatataaggccatagtagcagtgaactactaagccatgtatgacctgttgttcccaatccatctcttcctgttatctcttggcatagtagtgacagtaaagttccttgtaaaataatcactttctcaggggtgttgtactgttgtagtgccctgcactgaagggttttactgaatcctttcttttgtgtctaaataagatat

SEQ ID NO: 20577 - DNA, 485 bp, Sorghum bicolor
  Clone ID: 11064634
ctacagctcgagctctgatatgtcgtcacgccattccagggatagagacagagacaggcatgacagcaggcactaccaccaccgcagatgagtcaagcctgcagctgatttgtatcatatccttttgctgaagaatcctatacttgacgccttcgatctgacatagaagcagtcctgttatggtttctgaagttttgaaatgtccatcccttccaatatatttttgcagcactgctcctcaatccatggtaggcagtgaccttatctcatctggtcctcgagtccttgactgagctgtatctgtgttgtatgactgcctttctctcatctgcaactcctgctcatttcttgacagttgtggcatatactgtagaatgtaaatctcaatcctgttgtggacaaaagaaaaatggattcatgcatgttcgctaaaagcatgttgcgtcggtaaagaactgatgattcgagctacatggtcactatca

SEQ ID NO: 20578 - DNA, 495 bp, Sorghum bicolor
  Clone ID: 11064645
cagcactgcttcggctactgctactgctacttctgccgcggcttcctctgcctcatccactcaggcttccactacccctgcttcccaagccaaggcccaggtctctagctctacccctagcgcttcgtccgttaccacttctggcagcttgtccgactacttcagctccctgagcgccgaggaattcctcaacgttattagcgagactctgtcttggttggtcactgacaagatccacgcccgtgacatctcgaccgcataaatgaaagacactgaaaggggttcaaaataagtgacaatttggaggtcacgcatccagcatctagactggcggactttcttgtggatcaggaatcctgtctttctttagtttcttttcattctcgatcatgtgtgtatctatacaaatttgcttttgaggcttaattcgtgtctttgtagggctttttcctggatgaaaagagaaagtatacaatcattatttgtagctggaat

SEQ ID NO: 20579 - DNA, 608 bp, Sorghum bicolor
  Clone ID: 11064670
gacactttttgttgtgatggcaacacttgtcccctacttcagctatgccgcgatccagatccgttttttcccaatgttccacaacaagattcagtggaaacggtacttggggaaggctgaagatccagaagtggcaaggcagttgtcatcacgacaccggacgtcgtcgcagcagaggatggttggtatctctgctcgccgtgatggcaaggctatgcaaataacaaaggagacagagctagaagttcaggagtagcattgtcagtagattttgtgttttgtacagcttataggatattgtctccggcaagacgacggctgaactgattggaacttgggatgttcctggattgctgcttctatgatgcctgtcatgggagttgttccagttcagatgatagagcaagaccacagattgcttagataggtcacaaggaggcaaagtgaatacctgctgtaaagttcaattttagtagtccaaggctttgtggtttttcttttcctgcttctcttacacatgtagatgcttgtaaccagattggtagtgttttattcctttttacaccccccttgcctgccgtctctcaagtgtattttaaacaataatg

SEQ ID NO: 20580 - DNA, 646 bp, Sorghum bicolor
  unsure (1)..(646): unsure at all n locations
  Clone ID: 11064680
tgatgatggtagatggttcatatggaagaagagaacaggaaggcttattaaaatgcttgcaggggatggagctgtcgtganctgcatacagtctcatcccttcgattgtgctgttgcaacaagcggaatcgataacacgataaagctatggacacctgatgcaaatgctacatctatggttgctggaccagaacttgatgtattaagtgccatagagaataatcagcggaagttatgtcggaaccgtcaaattgtactgccttttgaatttttggaacgattccggatgcatgagttttctgaaggtttcgagtgtgcccagagctgatttactatcgctggagttgctgagcttttccaggaaaaatgttttagttggaagaatgatatcatccaagctacaagcagcctatgtttgaattagtgaaatcgcgaggccttgttgcgattatagagtgtagacacacctggatagacaagcaggtgggccggtgctgaaactattacttgagatgtcaataaatactggaattatgttgtggtttggggtggtataatgattcatacgcgtgtgcaaagctgtgggattcattcccttgtacagattgtagataggtgacattttgcaataagtaaaataacatat

SEQ ID NO: 20581 - DNA, 656 bp, Sorghum bicolor
  Clone ID: 11064681
gctactcagatccactctcacttctgctactctgagttccaggacttcttccacgccatcgccgctcttgatgctgatgtcctctccatcgagaacagcaagtctgatgccaagctcctccgtgtcttcgttgactctgagtacccccgtcacatcggacctggtgtctacgacatccactctcctcgtgttcccagcgagcaggagatcaaggatcgcattgaggagatgcttcagttcctcaagcctgagcagctctggatcgaccctgactgtggtcttaagacccgtcagtggaaggagaccaaggaggcgctcgccaacatggttaacgccgccaagtacttccgtaacaagtacgccaaataaatgtcaacctatgctgtgtgcttaagggttgatggggatgggggcgtctgtggattgtgttaatagtgttttttgtggagtctgttcttgagaacagctacgatttcaacatcggcgtttgggactggcctaaaaaaggaccagatatatttgtggtaatcccaaaagttaacctgcggattaggataggaactgggtacggatgatttggcgagcattcaacatttgcatataccctcaccaattgggagccagatgaaggtcttaaaatcaacaaatgaacctat

SEQ ID NO: 20582 - DNA, 445 bp, Sorghum bicolor
  Clone ID: 11064688
gcacgaggatatgtttgctggtataggtccatttgcaatcccagctgctcagaaaggatgtgttgtgtatgcaaatgacttgaatccagatagcgttcattacctaagaactaatgcaaagattaacaaggttgatgactatatattcgcctacaacatggatgctagagtgttcatgcaaaatttgatgactgtgcctggtttggaaactggatcagactgtcaagttgccgctgatgaatcctatcctaaagaaggggtccctgctaatgaaaattcatcttcaaatggaaatcataatgatgttcgtgagggcagtcaaaatggtgctaatgaatcttctgtggcgagcactactgccaaaaagcgacaacaaacttcagaagaatgtgaatctgattgccaagatggagatgctagtcaaacaaaaagacgaaacaacagg

SEQ ID NO: 20583 - DNA, 496 bp, Sorghum bicolor
  Clone ID: 11064698
gcacgagggttgttgctccgacggccgctgcggcgggcggaagcaccctcgggcgccagccgcctatctgtcccctttcccgcggctggcgtggaaagaatccccgagaaagagtcgaggagattgtacggcggaggaagagatggtctgggcgctgacccccgtcgacacagcgcgcgggacgctgaagcgttacatcttcgccgccgggacgtacaaggtcggccgcaaagattgtgatgtcattgttcaaactgacacatctatatcccgagtccatgcggagattgcaattgaaaagatggttgcctgggatccgcattctggtgcacctgccagtccatcatttgttcgtgtaatcgaccgatcaaagtatggcacatttgtcaacaaagtacatggaacccagggcagtcgtctgcataaagatgaaaatatgatgcttactgatggggatgctgtgacttttggaactggtaatgcgaccttcaggtta

SEQ ID NO: 20584 - DNA, 450 bp, Sorghum bicolor
  Clone ID: 11064700
gcacgagggctgctggtgcttatacctatgacaccctacaccagccggatgatggcggtgacacgagcaagagcaaagatgagataatggatgatctcgagagacatgcttgccccagtgcgggagcttgtggtggtatgtttacggcaaacactatggccacagccatagagtcgatgggtctgtcgcttcccgggtcgtcttctactccggcaacatctccgtctaagatgcgcgagtgcgtcaaggttgcggatgctattaaggcgtgtttggaaaagaatattaaacctcgggatttgttgaccaagcggtcatttgagaacgctttggtgataactatggctctcgggggtagtactaatggtgtgctgcattttctcgccatggctcgcactgcaggagttgatctgactctggatgacattcaacgggtcagcgacaagatcc

SEQ ID NO: 20585 - DNA, 518 bp, Sorghum bicolor
  Clone ID: 11064707
gcacgaggctgaggagtccaagaacccacctgagccaccggcggtgcgtgattctgcaggtggtcgccgcatccctggtttcccagaaggcttccagccaaagtccaactccagcgttacaaggcgctctcttgtgactggcccatccaacgtccgccccgccaagcgagcaatcgttaagcgtcaagcatctaacgatactgcaaacggtgctaagcaccttggtcttcccggccgtgatctgatcaaccctaagtaccagatccacaacgaagccggttcgatcagcaacaggacactggccacggacattcagaactacgatggttcctaccactatgatactcacaacttctggggttcaatgatgagcattgcctctcatgcgtccatgcaaatgcgccgtcctggaaggcgtcctttcatcatcaccaggtcaactttccccggccttggctcttacctaggaaaatggcttggcgacaacgttttcgagtgggctcaatatcgcttctcga

SEQ ID NO: 20586 - DNA, 307 bp, Sorghum bicolor
  Clone ID: 11064710
gcacgaggctcctccggcaccaagcaatccagttgcctttcttgcttcgcttgcttgcaagaaacagccactctcgcgtccaaaaagaagtctttctctgaaaaaggagaaggatcatcatcgtcgtcgtcgtcgtcgtcgtcgtcccccagggactccatcatcgtcggttcctgtccccttccgacttcttctgatcttatctctctttccttctctctgtgtgagcgggccggaggaggaggaggaggaggaggagatggacatgaacaacggctggctcggcttctccttgtctccttccgca

SEQ ID NO: 20587 - DNA, 448 bp, Sorghum bicolor
  Clone ID: 11064728
gcacgaggtaaaaacaggaggaacactgaacagacatatatagtaacaaaaaacctccctcctgcagtgtcatcgagtgttagctagatttagcccggccggagtgagcatcatatcgatcgatcatgtggaggctcaaagtgtcggagcgcagcagcccatggcttgggtcagtgaacaacctcctcgggaggcaagagtgggtgttggatcccgacgacctcggcacgccggaggagcgcgcccaggttgacagggcacgccgggagttcgccgaccaccgattcgaacgcaagcattctagtgacctcctcatgcggatccagtacgctaaagaaaaccctcataatcatctgggcgaccttcccccggctgtgaagcttcaagagaatgacgacgacattattacggaggaagccgtgtggacctctgtgaagcgagcagtaaa

SEQ ID NO: 20588 - DNA, 488 bp, Sorghum bicolor
  Clone ID: 11064729
gcacgagggtttgatagtatcctggtgatacatccattccttccactatcttctacagaacatcccaatcaacgctcctcagcaaaacctttcttcaaaaccagcaaatcaaaccaaatggctttcctccagaccgccgccctcctgggctcccttgccgcctcggcctacgctcacggccgtgtcaccagcatctccgttgatggcgagtcttacgacggcttcctcaacgactacatctacatgcccagcccgcctgacatcgtcgcctggagcgccgacaacggtgacaacggtttcgttgatggcagcagctacacctccggcgacatcatctgccaccgcgaggccaaggccggcaagatcgccgccactgtcgccgctggcagcaagatcgatattcagtggggtcctgatgcctggcctgagtctcaccacggtcccgtcattgactacctcgccaagtgcgctggtgatgactgcaccag

SEQ ID NO: 20589 - DNA, 176 bp, Sorghum bicolor
  unsure (1)..(176): unsure at all n locations
  Clone ID: 11064731
gcacgaggcccagccctgccggctgccgcagccgctgccctcgcttcggcgctttctccagtgagccgcacccgcactgccgctgccgctaattaaccacaagcggccgtcgccttccccctccccctcctcaaaaaaaggcggagaggtggaggtggtggtggtggtggtggtcn

SEQ ID NO: 20590 - DNA, 638 bp, Sorghum bicolor
  unsure (1)..(638): unsure at all n locations
  Clone ID: 11064745
ctaactcaagaatgtaaacctgccgagggcgctggtgattctggaagtgataaattatcttactcactaagtaatattattgatctcaaggacaaactctctcattgcttatcatcacgtttgctccgtagatggtgcatgtttgagtggttctatagtgcaattgattacccgtggtttgcaaagagtgaatttattgagtatttaaaccatgtcaagctaggtcatgttccaagactgactcgtgtcgagtggggtgtcatacgaagttctcttggaaagccccgtcgattgtcgaagcagtttttgcatgaggagagagagaagcttgctcagtatcgtgattcagtaagacagcattatactgaacttcgatctggcgttagagaaggtctaccaacagatcttgcacgacctctagcagttgggcagcgtgttatagcctgccatcctagaacaagggaacttcatgatgggaatgttctgactgttgatcataatcagtgccgggttcagtttgatcgacctgaactgggtgttgagcttgtgaaggatattgactgcatgcccctacatnctctggaaaattttcctgaatctctcaaacagcaaagcatcttcaatggatactacagcca

SEQ ID NO: 20591 - DNA, 548 bp, Sorghum bicolor
  Clone ID: 11064754
gcacgaggcttcatcaccaccagcgcggctgctgcgacgaggtccgatcgatacatcgtcaatggcgtccaaggctctcttcctgctcgccatcgtcctagcggcggccgccgtgctcaccaccgcggcgggccaaacttatgaaaacaacgagaagatggcatacaacgacgccggcgtgaaggacgacaggcacggcggcggcggcgtatcagctggtgggtacgcctgcgagtacggctgctgccaccacgtattccatggaggctgccagaagtgctgcccgccgccgcccggcgctgctggccgaccggaggaggtgaagaactagaccaggccggcggcccggccgctgccaattaaagcctctctcaggcgctgcgctagctagctagtgtagcgaggatctcttgtgtcaaataagagtactcgtcaaataattgtacggctgtagctaggtatcatcagaacgtgcgagacgtcgacttgcttttgtacgtagacgtttgcatgcacccttatgcgccaacacatgatgcatgccgtag

SEQ ID NO: 20592 - DNA, 487 bp, Sorghum bicolor
  Clone ID: 11064758
gcacgaggggaaatcgaaacgtgggtgctggccctggaatactacgacaaccagcaatatgaggaggctatccaagtgtttgatggtattgcggatacctctaaaattctcttcaactgcggtgttatctgcgctacgttgggagaacatgaacgagcggtcgagtgctatcaacgcgctgtcggcttagaccagtacctcgccatcgcctatttccaggaaggcgtctcgaatttcctgctgggcgatttcgaagaggcgttggctaatttcaacgatactttgctctaccttcgaggtaacacgtctattgactacgagcagcttggcctcaagtttcgtctattctcttgcgaggtgctcttcaatcggggtctatgctacatctacctccagcagatgggcctgggtctccaagatcttgagtttgcctcgaaagagaaagtcacacaggaccacgatgtgatcaacgatgcaatccgcgaaa

SEQ ID NO: 20593 - DNA, 637 bp, Sorghum bicolor
  Clone ID: 11064766
gcacgagggttagcagtagctggtggacgcttgtcggtattatcttttctccagtgtctgttgggcagaagcaaaaaggcccgacagaaaggggaagaagagcagatagacaggaagacagagatagcttcagatatacagctaaatcaggtcaatccctactaataatactaatctatcctcgtctagtatttgttctctcacgaaccatgggtttgtgccattcccgcccgctccaccggcgagcatcagacaacgccgtcttcctttcttcctccaacctctcctctaccacccccaacttcacctcataattttgctttgttcgtcgcattagattttattttttactgttttagagtgcaacatctctgcgccttgcattccagcctcttctacttgccttgaggacacttgtctcggctcacggcccccattgcaatcctgccacgaccagaccacgtccaattagccttagcattgtctgacagacaagccacagatagtcgagacactgtcgcgcggtggagtcatacccgtcattgtcgcagacgctacgatttcacgcctctcactacgtatcctccccatacgccgcactctgtacatcaccccggatcctccgtcaccgtttcat

SEQ ID NO: 20594 - DNA, 522 bp, Sorghum bicolor
  Clone ID: 11064783
gcacgaggcagaacctgaggaagtgagaatggcgcagtttctccgcggcaaggccaccgccgccgccgccgccaccgccgccagggaggcggcgccgtggcggcggacggcctcggcgtcgtaccaccacacgatccaggctgtaccgcgggagacggccggcccgcgcgccgcggcgcgcgagcgccgccacggccgcgtcccggcggtcctgctcacgctcgcgggcgccgcgcccgggaacggaatcgcccaccggcagctcctcaccgccgacaggaggcagctcgcggagatgctcaagcagtcgccctacttcctctccacccccgtccgcctccaggtccgcgccggcgagcgatccaacgccatcgtccacgccggtaccgtcctccccatcaaggtgcatagagatgaaacttctgggaatatattgaacttagtaatggtgaaggcagatgaaggaacaatgctgaaggtggatttacctgtagagttcaagggggaggatacttgccctgg

SEQ ID NO: 20595 - DNA, 453 bp, Sorghum bicolor
  Clone ID: 11064788
gcacgaggggcgcgtgacctaagagcgccgccgcccgagcatcctcctgcctccgtcgacacccgccggcggccagcgcccgccgcctcgttctccccaccccggccgccccgccccgccggccgccaccatcctccaccgaacaagcctcgacgccggcgcgagcgagctacggggacggcactggccgcacgcacggggcgagcctcacgactggacgaacgccgccggccctccgcccggtcttcttcggcccctgcgacgagcaccccacaagattcggtccggaatgttcaatgcatagtgtatttgccccgcaaagaaatggcatcagacgagttcatcagccttgagtcaccttgcgaggctgatgcgcaagatgaagggggagacgttcaggtagctcctgatgtgaatggggcggagcctctcgcatctgaactccaaccagaa

SEQ ID NO: 20596 - DNA, 499 bp, Sorghum bicolor
  Clone ID: 11064795
gcacgaggccttttcgttctctttatttctccggcttcattgactgaagtccttcgtttcttaccgtcattcttttttttcgtccggtctacacgctgtgcgttgatcaccaaaaccaaacccattcacaagaatgtctgtcaccaagatcgctggtcttcttctcggctcggccgctatggtcgctggccacggttatgtctccggtgccgttgtggatggccaatactacggaggatacatcgtcacctcctacgcttacaccgacagccccccggagaccattggatggtcgaccgaagccactgacctgggcttcgtctctcccagctccttctctgacccggatatcatctgtcacaagagtgcgcagcccggtgccatctctgcttcggtgacagctggtaaggatgttgagctgcagtggaccgaatggccggagagtcaccatggccctgtcatcacctatctggccaactgcaacggtgactgctccaag

SEQ ID NO: 20597 - DNA, 473 bp, Sorghum bicolor
  Clone ID: 11064798
gcacgagggtcagtcacaaaagcatattatgcgttttgtgcaagtatggaatctgagcagaaggaaagttctaaagaccagattttgtcaaaaaaatctgttggtagccccggcaaaaagcaggtctctagctctccaggctgtactttaacagaggatatccttagcaaattaaaaagagttgttgtaaacaaacgaacaaccaaagtagcgattcaaaggctcaaacagaaaaggttcaaaaaggaaaagaagaagaatgcaaattcaagaagactgcatttaggcaatgaaagaaaaaaacgaggtggttgtgctctacttgttcgtggatcgaacaaggagtctggcagcggcactgatggttttgttccatatgaatggaaacgtacgatcttctcctggctgattgatctggatgttctatcagtcaacactaagctgaaatgtatggatgaaagcaactcaaaggt

SEQ ID NO: 20598 - DNA, 482 bp, Sorghum bicolor
  Clone ID: 11064808
gcacgaggcgacactttcacattactagatccattaactctcacaccgagagtttggtatctagcccccaacacaacctacgaacaccgcggcgggatcttcatccgcccttcacgaactccagctcacagcgcagagcgtgtgagctcctaccaacaccgcaatcatggccgacaagggacttgaggacatcgaggctgctcagatcgagtccaactacgatgagaccaccgactctttcgacgctatggacctgaagcctgagcttctccgtggtgtctacgcctacggtttcgagcgcccgtctgctatccagcagcgcgccatcatgcccgtcatcaagggcaacgatgttatcgcccaggctcagtccggtaccggcaagaccgccaccttctccatctctgtcctccagaagatcgaccccaacgtcaaggcttgccaggccctcatcctcgctcccacccgtgagcttgcccagc

SEQ ID NO: 20599 - DNA, 511 bp, Sorghum bicolor
  Clone ID: 11064821
ggttggcatcagtggtgctgaaggaatgcaggctgtcatggctagtgatgttgctgttgcgcaattccgcttcttggaacggctacttctggtgcatggacattggtgttaccggcgtatttcagtgatgatatgctatttcttctacaagaatgttacttttggtgtcactatctttctgtatgaagcatttgcatctttctccgggaagccagcttataatgattggttcttgtcactctataatgttttcttcacctcccttcctgtcattgctttgggggtatttgaccaggatgtgtctgccaggctgtgcatacagtatccacagctataccaagaaggagtgcagaatatattattcagttggcgtcggatacttggctggatgcttaatggtgttatgaatgctgtgttaatctttttcttctgcatcacttcctttgaggaccaggcgttccgtcaggatggtcaagttgcgggcttggatgctctaggtgtcgtcatgtac

SEQ ID NO: 20600 - DNA, 520 bp, Sorghum bicolor
  Clone ID: 11064831
gcacgaggccgaagggcgcagagtgtccagaagcatccccccactcggcccgcggcgatcgcgcggaaactggctgctggcgacgcgggagagggagaggcggcgagggttagctggagatggacgaggcggagaagctgaggtggcccttctcggacggcagcgtcaccgatctcctggacgctcgcagcctccacggctcccccgacattaagaaaaaagtacagttccattcttctctagtgcaaaagcttgctttggaaaaggagatggagggtcatgcaggttgtgtgaatgctatcgcgtggaactcaagtggttcgcttcttgtatcaggatcagatgacactagaattaacatctggaattataataaccgagagctggtgcatgatattgacactggccattctgcaaatatcttttgcacaaagtttgtcccagaaacatgtgacgaagtagtagtctctggagcaggagatgcagaggttcgtgttttcaatatgtctcgattaagtgg

SEQ ID NO: 20601 - DNA, 480 bp, Sorghum bicolor
  unsure (1)..(480): unsure at all n locations
  Clone ID: 11064832
gcacgaggggcgagtgcaccaaccttcagatgctcgccctcaacgctcaactccttcaccggcggcgtgcccagggagctcgcggcgctgccgtcgctcttaaagctctacatttaccggaaccagctcgacggcaccatcccgcctgagctgggaaacctgcagagtgtcctggagattgacctctcggagaacaagctcaccggcgtcatccctgccgagctcggccggatatccacgctccggctactctatctcttcgagaaccgtctgcaaggtaccatcccaccggagctcggncagctaagcagcataagaaagatcgacctgtctatcaacaacctcaccggcacaatcccgatggtctttcagaacctgagtggcttggagtacttggaactctttgacaaccaactncagggcgccatccctccattgttgggagccaacagcaacctttcagtgctcgacttgtcagac

SEQ ID NO: 20602 - DNA, 558 bp, Sorghum bicolor
  unsure (1)..(558): unsure at all n locations
  Clone ID: 11064833
gcacgaggattgctctcattgccaaggccgtcaccgagggccctgcctccgtccgtgagcagcttgaggctaacgccaagtccatcaaggctcgcgccgactctcctcgcaccaacgaccctcaggtcaaggagcgccagtccaaggtcacccagaaggactacgagcgaaagagcgagttcactgttcgtatcagccagcagcagaagaagctgaaccttcccctcttccctaccaccaccatcggatctttcccccagaccaaggagatccgagttcagcgaaataagttcaccaagggtgagatcaccgctgaggagtatgaccgcttcattgagaaggagatcgaggagaacgtcaagatccaagaggagcttgacctcgatgtcttcgtccacggtgagcctgagcgtaacgacatggttcagttcttcggtgagcgatttcagggttacgctttcaccacacacgcctgngtccagtcttacggttcccgatgcgtccgacctcctatcattgtcggtgacatctcgcgacccaaccccatgactgtcaagg

SEQ ID NO: 20603 - DNA, 591 bp, Sorghum bicolor
  Clone ID: 11064840
agcaattatgccacggagcttgagaatggagcattggatataagtgaaagtgtactgggagtgtctgtcagcttatcgcccctgcacaagtcaatcaaagagttcagaaaggcagttctgaaagtggattctgaattgaaggctctacagacatggaaattttgggccccatggaaaaacagtcccttgaaggtcagagacatcaatgaccggctgatgatgaccgaacgggcattcactgaccgggaaggactatctggacggccatggtacaagcacctgatatacgcaccttcactgcacaacgactacggggctcaagtgtatccaggtgttgatgacgccattcagaaggcgaagaaaacaaatacttctgaatcctggcaatctgtacagcatgagatttacagggtctctcgagtcataaatcaggcagcgctagttttaagtggagatctaacttgagtatttcttacagtagccccgttttctggttgtacatggccctggccgttgactataacttcttgaaaacagtagctggactgatacagtattgcggtggatgtgatatggaaaacaaatgtaatt

SEQ ID NO: 20604 - DNA, 524 bp, Sorghum bicolor
  Clone ID: 11064847
cgaacaatggcgacgacgccgtccccggcgccacgtgcggcgagaacaaactcctgatgacggcgaagcggcacagcagcaaggaggagctgatgaagcacatgcgccggtgcagcgggcagctcagcccgtcgcttttcgtttgggaggggtgcatcgcgacctcctcctgaacgccgcgccgcactctccgggcgggtccacgcggccgccatcgccgatcagttccattccatgcatgctttcaacgagtgctatctgtttgtttgcagcagccgctgctggtgtaacgtcgtcgtccgtaacgtaatgctgtcgttgttactagtaagtgatgatcgtcacgtgattggtttagccgtgtatgtgtgtgagatcaggtgaggagggacagagaggtagcccaattggtttggcatgtcaccttgcatgccctgcttgttgtatctactactactactagtgccatttgcatttgcatgctgctgctactactagtgaccgttgtttataataatagtaac

SEQ ID NO: 20605 - DNA, 567 bp, Sorghum bicolor
  Clone ID: 11064860
cagtcccagtctctcaatatccacatgaaggagcccaccatgggtaagatcaccagtatgcactttgctggctggaagatgggattgaagactggcatgtactacctgcgtacgatggccgcgtccgctccgattcagttcaccgtcgaccaggaacagctccaggttgctgataccaacgttgctcgtgaaaccagtgcatataagaagcgcgttggtggcgggacatccagtgcttcctcggccgttcctcgcgaggagaacggacacgctgagcaagaagctcctcgtgcgactgctgaggccccggccgcccccaacggcggtgaggcagagcagggcgagcaagagaacggcgagcaagagagcggggacattttctcgcagcaggtgctccagtgcagcattgagaacaaggatgcgtgcataatgtgccagggttagatgtctttttcttgtgtcagatttgattttggttttataggcgcttaaggcgtcatgttatatcggactggatgtcatatgtttgttgatgcgttattcttatgggcttatgtttatgatttt

SEQ ID NO: 20606 - DNA, 607 bp, Sorghum bicolor
  Clone ID: 11064861
cctatcgttctgaaaggaatccaaacacacgaagacgcttatctagcctcgctccacgctccagccgtcaaagccatcatcttatcgaaccatggtggtagggcactggatacagctccacctgctgtacacacgttacttgagatacgcaaatactgtcccgaggtgtttgatcgtattgaagtttgggtcgatggaggaatcaagcgggggacggatgttgtcaaggccttgtgtttgggtgcaaggggtgtgggtgtaggtagggcggcgttgtttggactgggggccggagggaaggaaggagttgcgcgggtgcttgagattctcaaagcggagactgagacgtgtatgcgtctacttggtgtggaaaaggtcgagcagttgggtatgcattgcatcaacacacgtgcggttgagcgcgacatctgggatggaccgggtctggaaagggctgtcgtcaaggcgaagttgtaagaacgcatttggggatagcctgggaaagggaaagagaaagcgagaccgagaccgagagaagaggatccaaaacacaggtactcacgttggagccgatgagacctattttcttatggtatcacggctggta

SEQ ID NO: 20607 - DNA, 612 bp, Sorghum bicolor
  Clone ID: 11064866
tggacacggactagagtcattgagcttcagaagttgtttccagtcgatgccggctccatcatatggcttccttggctttgtgcatggtgttgatgtctttttcgtgggaatgaatgatggtgtgctattcagttttgatctaaagtctggtcgggtgcggaaggtatacaagggggaatgtgatgaagatggcttgcttggtcgtgttccctgtgttgttccctacacgagcttctgcactccagcactgagattagtcgctacagaagaggaaccagaagctattgctgcaagtccatgaaatacaaaactcaaacctgatgaagcaaggccttcaaaatcaagatgaaagtgtgctataagtggggcttaacactttggttccagtgggtatgaatatcgaagaaaatatcgaaactaccttttccatttgtgtgaaggtagttaactcctggaattaattgctttttattttgcacaagtttttgatacagtgatcgagtggatcgctggcgtgccctcttctgcagggataacaagtgtaacctctttcttttgaagccacgtccatgtataacatctacgaggttactgggagcaatactttaattt

SEQ ID NO: 20608 - DNA, 678 bp, Sorghum bicolor
  Clone ID: 11064873
atcacggattgtgtttgctcctagtggcgatgcatatcatcccaaaaacagaaaagtcaaactcagtgtaactgtgaaggaactgggactttcacgacatgctttccgtcggttgcgtgatgttgttggaaagaggtataattctgggaaagatgagctcacaataatcagtgaaaggtttgaacatcgggaagagaacagaaaagactgcttgaggacactgtatactctaataatagatgcaataaaagctgacaaacttgttgaggatgccaggaatgcttatgttaaaggaagacttaaggctaatcctcaatttatggaacgattgaagaggaagacagagaaattgatggcagctgcataaggggtattcttagtcatactatatgttgatcatctagaataacaatgtcaacatacatctgcactctatgcctttttggagaccttttgctgtttcctaaattgaagatcgaagatgcttactttcctcagtttgctcagagtagcaactactactcacatggtattttggtattaataagccgctgttcatcgcatggtaccttttgtgtacgtcgaattctcatgaagtcacggattcatgtaggcaggactggtatcaaatcttaaccttctggtctgtacaatcgattcatttaaagggtaatttct

SEQ ID NO: 20609 - DNA, 597 bp, Sorghum bicolor
  Clone ID: 11064889
ggcaattccgagccaacatatactggaatgtatggcaatcctgatgcaacatatactgcacaggcttatcctgatgcttatagcactaatcaggctcatatgcacaccggcgccaattctcattacatgagtcaacctgtttcctatggacaatacgagggccagcacaccaatgttcaaagatgactgtcaacacaagatagcttacttgcctgccatctcattgtaaaaggatagtcaaagaatccaccagattaagcatgttagagaaatccgttgcattgaagtgctggaagccctcatgttaatgttttttctttcctggctaatttgttccagaatgggtcgaacttggagcaaaaatctttctcccttctccatgtactagcctgatgattcgtcagttctgcaaattgatggtgttattcagggactgtgatgcctctagccatttgtgtacatataaggccttgtttagttacatttttttttttgcaaaatgaacactgtagcgctttcatttgtgtttgataaatattatccaattatcgactaattaggcttaaaagatttgtctcgcaaattatagacaaactg

SEQ ID NO: 20610 - DNA, 576 bp, Sorghum bicolor
  Clone ID: 11064910
ttgctctcggtgacaacgttgctgagctcgagaacaccggtgtcatcctggacactggtacctctctgattgctctgcccagcaccatggctgagcttctgaacaaggagattggcgccaccaagagctggaacggccagtacaccgtggactgcgctaagcgtgactctctgcccgacctcaccttcactctggctggtcaccccttcaagatcagcgcttatgactacgtcttggaggtccagggctcctgcatcagcagcttcatgggtatggacttccccgagcccgttggccccctggccatcctcggtgactctttcctgcgccgctggtacagtgtctacgacgttggcaacaacgccgtcggcttggccaaggccaaataatcgctctaatgcctgatggcccggtgagctgtggataccaagaaaccaggtaatcgtcaagagattgcttcgtatatagatgcgtcttacctgggtgaatgtttcgctccatgcaccccatttttgccaatcgcttcaattgtgtttctgtatctgctagcaccgcctgttgtgacgtcctctcata

SEQ ID NO: 20611 - DNA, 656 bp, Sorghum bicolor
  Clone ID: 11064914
ctcagcacgctgtcgctggggttcttcgtcagctccgcgctcgtcgccgccgtgcacaaggtcaccggcgaccgccacccatggatcgccgacgacctcaacaagggcaggctcgacaacttctactggctgctcgccgtcatctgcctcgccaacctcttggtctacctcgtcgccgccaggtggtacaagtacaaggccggacgacccggcgccgacggcagcgtcaacggcgtcgagatggccgacgagcccatgctccactgatggatgatcgacgaggcacgcgacgacgtacgtaccacctataccaaaagcatgcatatccgtccgatcgtcgatcaaatccaacggctctgattgattgctcagcgtgttgtaccatcgtatcatgtgttactcagtcagtatacgagtgtgtgtatcttctctatcaaagcgtatagcacgcgccgatatgatttagcggcgcgtgcctacgcgtgtagtataaaaattaataacttggttcttagagtggaggggggagggaggggcggaaatgtaaaaccgcacaaggatggtggggccagggtgtccgtgacatagtgttactgcattttgtatatcgtcgtggtgggaagaaaaatcctccactgcaatctttaaatcatgca

SEQ ID NO: 20612 - DNA, 440 bp, Sorghum bicolor
  Clone ID: 11064928
ggggcgaattccccgtggcgagaacttggtgatcatcgtccgacacgaaggacccaagggcgggccgggaatgccggaacagctcaaagccagtgcggccctcatgggggctaaactcacgaacgtggccctgatcacagatggccggtactcaggagccagtcacgggtttatcgtcgggcacattgtccccgaggcagcggccggtggaccgattgccattgttcgtgacggggatgtggtcactatcgatgcagaaacgaacgagctcaaaatggatgtatcagaggaagagatccagcaacgattgcgcgaatggaagcccccagcaccgcatgttactcgtggtgtgctggccaagtacgcgcggttggttggggatgcgtctcacggggcgatgacggatttgttttgagactagcgactgctaagcgtggttt

SEQ ID NO: 20613 - DNA, 579 bp, Sorghum bicolor
  Clone ID: 11064935
actggaccggtgagcgtgtggaagggaagggcgagtacgtcaacttgacggatatcggctttgacacgattcctctgcacgtcaagggtggatccatcctgcccctccgcgctgagtcggccaacaccaccaccgagctcaggaagcagaacttcgtcctctggatcgcgcccaatgccactaaccaggcctcaggaactctctaccttgacgacggagattccctggagcagccagccacctccatgatcaacttctccttcaacaacggtgccttcagcatgagcggtgactttggttacaagaccgactgcgtcatccagaacatcactatccttggtactggtcagagcgtccagggacccgtctctcttaccaagaactgggagcacaactttggctcgagcttgcccgaggtctccaccagtgcggcatcaggacgtcgtggagtcactgcggcatggggtgcggttgttggcttcgccagtttgtttcttagcttgtagatgactgagatagtgatgagtaatgcggaaatatgagcatgaaggagcagtaggtagatacctcactacataa

SEQ ID NO: 20614 - DNA, 514 bp, Sorghum bicolor
  unsure (1)..(514): unsure at all n locations
  Clone ID: 11064955
tcncaggccgcggccaccagcacncaggcatcccagagcacacagaccgccgcctccaacggcaacagcaacaactccggctccaacacccagtccgccgcctcggccgtcacctccgccccctccgtcaccaagatctccgactccgtcccctccgccgccctgacctccaccatcgacggcgccgtccccaccgccaccggctccgagtccgacgacgactaccccagcaagcccctccccgagggcttcacgctcgccgacctcctcgagtgggtcgactacttgatctccaaggctttcaaggccgagggcgtccacgctcgtgaccttgagcgccgttaaatctttctcattcagagtaggttctgagtggtggcgattggaaaagagatacgagggagatgcatgagatgagacgcgattcgagactttttcgatgattttggtctgttgaggatgaggtttttgccttctattttttggtctttttgcaatgcaagatgacgctttg

SEQ ID NO: 20615 - DNA, 447 bp, Sorghum bicolor
  Clone ID: 11064982
gaaaaaaaaaagtaagagctctcgatctacggatccccttcccggcttcccgttcccctcctcgtccaaaaccctaggccagcttagcggcggagcccgcgcgcccccgcccccgggaccatggccgaagaccacttctcctccgcgccgtccgcgccgtcggcggcggcgacagctgcggccgcggccgccgcggcggtcgggtcctcggtgatcccgatcgtaaacaagctgcaggacatcttcgcgcagctggggagcagctccacgatcgacttgccgcaggtggccgtggtcgggagccagagcagcggcaagtccagcgtcctcgaggcgctcgtcggccgagacttcctcccgcggggctcagacatctgcacgcgccgccccctcgtactccagctcgtgcaccagccgcgccggcccgccgacgccgaggccgatgag

SEQ ID NO: 20616 - DNA, 490 bp, Sorghum bicolor
  Clone ID: 11064985
gcacgaggtgaggctccgcccgctcccgctcctcatcgccgcggcgttcgcggcctcctaccgcctcctcttccacctcgcgcccgcgccgtcctactaccagtccctcctcctctccctcggctccaacgacaccgccgccgcccacttgcacgcgctcaccatccgcccccacctagcgggcacgggcgccaacgcgctcgccgccgcgcacgtcgcctccgcgctctcctcccactccttccccacccgcctcaccagctactccgtgctcctctcctaccccgcgcaccgctcgctctcgctctccgcgccggatcgcgacacggtgctcttcgctttgaagcaggaaacctacgcaggcgacccctacgacgcggtctccgacgaggccgtccccaccttcctcgcctacgcggcctccggctcggtcaccgccgaggccgtctacgccaactacggccgcgcggaggactacgcttacctcgcc

SEQ ID NO: 20617 - DNA, 443 bp, Sorghum bicolor
  Clone ID: 11064995
gcacgaggggaagaacagttgaagtcaaaaggactgtcccaaaagaggaaatgtcgtcgaaagatggacctaagacaaaaaagatctttgtgggtggtatcccatcatctcttaccgaagataaattaaaggagcacttctcatcatatgggaaggtggttgagcatcagattatgcttgaccatagcactggacgctcgcgtggctttggatttgtcacatttgaaagtgaggatgctgttgaaagggttatgtcagaggggagaatgcatgatcttggagggaaacaggttgaaattaagaaagctgaaccaaagaaacctggcgggggtgattcaagctcaaacggaagacacagtcgtggtggtggtcaccgtgattcataccgtggtagtggtggtggcagtggtgtttctgggaacagcagtggtggtggctatgga

SEQ ID NO: 20618 - DNA, 458 bp, Sorghum bicolor
  Clone ID: 11065003
gcacgaggctggtctctggtttggacaaccaccaagccagggaggagcagcgctaggcagccagccaaggacaccggagcacgcacgggcgccccagccagcgagaacctcttctcttcttccgcgtcccaaccaacagcgagggcggcagcatatggtggagaaggcgaggaccatgaccatggcgcgcaagctagagatcccgcagtggaagcccgacggcctgctgccgtcgccgacgagcccgctggaccgcgcgtcgccccgcgggtggcgccaccgcgacgccgtcgggggcgtcgggctcgggatcctcgcggcgctggaggccgaggagggcccgcgcgcgcagcccgccgccgcgctggcggtgccgagggtgtccatcccgcgtcgcgcggcgcggctggaggtgtcggagctcgggtgcagcgggcggtgcgccaccagcctgtgcg

SEQ ID NO: 20619 - DNA, 425 bp, Sorghum bicolor
  Clone ID: 11065005
gcacgagggcaaccggaagagcaaccagaagaacctgggaaccatccgcagctccaacctctgcactgagatcgttgagtacagtgctcccgatgaggttgctgtttgcaacttggcttcgcttgcccttcctactttcgtcgacgctgctcgtggcgaatacgactttggcaagcttcacgaagtcgtacaggttctggttcgcaacctgaaccggatcatcgacatcaactactaccccgttcccgaggccaagaagagcaacatgcgccaccgccctattgctctcggtgtcaacggtcttgctgacgctttccttgctctgcgtctgcctttcgactcggccgaggccaagcagctgaacattcaaatcttcgagaccatttaccacggtgctttgaccgcctcttccgacttagctaagg

SEQ ID NO: 20620 - DNA, 518 bp, Sorghum bicolor
  Clone ID: 11065006
cgccatcctcacgccgagggttgcgccatcgccgtcctcgtcgaggtccgcgccgtcgccgtccttgttgtcgagggtcacacgccttcgatgtcctggtcacaccttatctcctcgatcgagcggccgtgcacttggcccaggaggccgggattgcggccacgacgacaccaccatagcgcgcctcctgcttgtggcgacagcgtggtggtccaggaccgggatgcgccgacatgacgaccattgtgttgtacgcctactggataccagagagcagaacattttgtgaaagtttacaacacaatggtaatctcaaaaaaaaaaaggtaatctacaaaatttgcatgattttgatgttttggatacagccagtcgtttctgcagcaagttgtcgagctctgcacgggtagaaggcgcgcgcaggacgtggtcgaggttgaaacgctgtaggctggcagcgtccatgacaccgagacgcttgacgagggagcccacagcgaagggacggcgacagggtg

SEQ ID NO: 20621 - DNA, 448 bp, Sorghum bicolor
  Clone ID: 11065007
gcacgaggcgccatctttgtagagctttattttgcattcccagcttttgatttcgtgttttcttcccgcattgtacaagtaattgaacgcacggcatcatggcgaaggttttcgattatgccgaggtcgcacagcacaacacagcagagagctgctgggtgattctctacggcaatgtttacgatgtcacgcgcttcattcctgagcaccccggcggctcaaaagtcatcctccaacttgccggcaccgacgcaaccgaagaatacgatcccatccacccacccggcattctcgaagagaatctcgaagcctcggataagctcggcaccataaacccagacacgctcccgaaagaggagaagacaccagaggagactggcgaggcgcaagacgaaggacccgtagatctggacagcttactgaacctcgatgaaatagaagaggtggc

SEQ ID NO: 20622 - DNA, 477 bp, Sorghum bicolor
  Clone ID: 11065013
gcacgaggaattttcctgccccatttgctacaggtacaggaagtggggctcaaacaaaacgagcacttggaccttcactagtctactctaaacgcgccaattcgcaccaggcagcgccgctcctctccccggatctgtagcagtatggagctgccggccgacgtcgtcgaagagatcctcctccgcctcccaccggccgatcccgtgagcctcgtccgcgccgcgctcgtctgcaagccctggtgccgcatcgtctgtgcccgcagcttccgccgccggttcaaggagttacaccgcacagcaccactgctcggcttcctctgcaaccccttgttcgcccggttcgtccccacctcctctttccgccgccggtccgcgactgcgtcgtcctcgacgcccgccacggcctcgtcgtcctccacttcgtcctgggtgacgacgaggtggacgccctcgtcatctgggaccagacaacgg

SEQ ID NO: 20623 - DNA, 508 bp, Sorghum bicolor
  Clone ID: 11065019
gcacgaggctttccgcagattccttgacctttctctatttttcattcacaatcatgaaacatgcttcccgcgcacgtctctgttttccctttcgctcgtcgatcctctgttctgttcgtagacggtagtagcgcgtggcttttgaccaatggatgcaagcatttttttcctctggtgactttcagttcaattgaaataagaattcatctacgtttctttctttctttctttcttgttgatcaatcaagcgtattgatctcttatagcagcaggttactctgctttcgaattggtttcattcaggaggcggagccggtccattgaattcgaccggggcaggcaggagattcggttcggttcgggcaccttcttcttcaacaagcaaagggatcaggcgataccaaatgtggcgtacctgtgggatgtgctaggatccggattcctctcctccagatttctctgatccacctggagaatacgggaccatctcgttggtggcggcaggcag

SEQ ID NO: 20624 - DNA, 456 bp, Sorghum bicolor
  Clone ID: 11065024
gcacgaggaactgctgcaggctgacggctgcacctacccccagcggccttgccgggaaggaagcggcagtggagccggccggcagctgcagctgcagctaccccgaagccccgcgcccccgccaccgccatggcaatccacctccgcgcccacgccttcgcggccaacccgctgcgtggcgtctccgccgccaccaccgccgtctccccctccgcggccgccgaggttctccgctcccttctcgaccccagctccgccgccgccgccaatccccagccgtacctctccaagatcctccctttccgccggggccgcccgcttgcgcgctccacggaccctcctcccgcgtccgcccccgccgcggcgccggcctggtgccttgcgtggctcccgccgtcccgcgtccccgggctcgccccggacgccttcgtcttcctgggcgcgcatgtcgagggg

SEQ ID NO: 20625 - DNA, 482 bp, Sorghum bicolor
  Clone ID: 11065025
gcacgaggcaccagagttcattagcgctcaggccccagctacacctggtttaatggaagagacagttccttccagagtccatgaaagtcctgttttgagcccacagagaaaagcatcaccatctaccaatgatgaaactgcaaaggctgacactcctgctccagcctcagattttctccattcagctacaggaaatgccagtgatattgtgggtgctgagatgacagaacttgaatcggcgaagcctgtgcaagttgagtcttctgttgtacatgcattggtgcaacagcacacaggtgagggtttaccaacccagggtcaagcatcacacttggaagccactgctgatatgttggttggttctgatggtatagctgcactctgttgaaacggtaactgtcaatgcaaccattgaagatgtacctttggctgtaaatgattcagagcattgtgtcgatggttctactgaaccatctgcggtg

SEQ ID NO: 20626 - DNA, 565 bp, Sorghum bicolor
  Clone ID: 11065032
gcacgagggccaacagcatggtcatctttcatgtttgacttccacatcctccttttcctgttcccagctggcctttatttctgtttcaaacgcctgtcagatgccactatattcattgttatgtatggcctcacgagtatgtactttgctggtgtgatggtccggttaattcttgtggcagcaccagccgtttgtcttattagtgctattgctgcatctgctacaataaagaatctgaccactttgatccgggcaaagagcagaagtccacagactacttctggaaaaacaactggctcaaaggcagctgcaaagggtgcagttgatcaaagtttaccattccaacacaatgcagctattgctcttcttctgggtgccttttacttgctaagtaggtatgccatacactgcacttgggtgacatctgaggcttattcttctccatctatagttttggccgcaaggggtcataatggtggaagagtcatctttgatgattatcgtgaggcatactattggcttcgtcagaacactcctcctgatgctaagattatgtcttggtggg

SEQ ID NO: 20627 - DNA, 433 bp, Sorghum bicolor
  unsure (1)..(433): unsure at all n locations
  Clone ID: 11065037
caatcccctcccaatccccagcgcggcgacgccagccgcctctgccgcctgcgatggccgcacggcgcgggccccacgtcatcaagcttcacgatcccaatccgcccctcctcggccgggcgccaggtcccgcggcggccgccgtctccgcgccctcgcgagacgagggcatcctcgcgcagcacccgcgcgccgccccttcgagcgcctccgccgcgcaccccgcctttgcactcatcgaggagcgcctcgtcgcccgggaccaggacatccaggagctcctcgtcgacaaccagcggttcgccgccacccacgtcgctctccagcagcagctcatcgcggcgcagcacgagctccgggctgtctccgtcgccgccaccagggcgcgcgccgagcgggagggagaggtgcgcgccctcgccgaccangcggc

SEQ ID NO: 20628 - DNA, 465 bp, Sorghum bicolor
  Clone ID: 11065046
gcacgaggccctcttttagcaaggcttgcagatccaactggagttgcagtgccaagaggcctcaggaagttgaaagccctgcacacactgggtatggtgaacatcgcacaagagaaaaccgtcctacaagacattagaaggctcacccggttacacaagcttgcagtgacaggcatcaacaagaaaaattgccaagagttttgtttgtgccttgcccatctcagctctttggaatcactctcagtgcgctcatgggagaaggaaggtctccgtggctgcttggatagtctgtctatgcctccgaaagacctccagagcctgaagctgtttggcactctgggcaaactgccagaatgggtcacgggtctccagaatcttgtgaagctgaagctggaacgcactaagctaacagagctggatgtaaccatgcaagtccttggcaagctaccaaacctggccatcctt

SEQ ID NO: 20629 - DNA, 511 bp, Sorghum bicolor
  Clone ID: 11065059
gcacgaggacacattatgaagtctttcaccctcctgacagcctcggcgctgttgggcagtgctgccgctgaggtgcacaagctcaagctcaacaaggtccctctgtccgagcaactgaacacacacaacatcgatgctcacatgcacaacctgggtcagaagtacatgggaattcgccccgagaagcaccaggatctcctccatgacacttccatcaaccctgccagtggtcatgacgtgctggtggacaacttcctgaacgcccaatacttctccgagatccagctcggtacccctcctcagaccttcaaggttgtcctggacaccggtagctccaacctgtgggtcccatcccagtcgtgcagctccattgcctgcttccttcactccaaatatgactcgtcttcctcgagcacatacgagaagaacggcactgagttcgagatccgctacggatccggcagcctgagcggcttcgtgtcccaggacactctccagattggtgacatca

SEQ ID NO: 20630 - DNA, 426 bp, Sorghum bicolor
  Clone ID: 11065060
gcacgaggattccaagtggtattgggatatacaggactcatgtcactatttcttaggttgataaatccagttgtcgtctcaccaacagttgcagctgttgggctttcatttttcagttatggttttgctaaaatagggacatgtatagagatgggaattttgcagttgttgatggtggttatttttgcactttatctccggaaaataaagttatttgggtacagagtatttcttatttatgcggttcctcttggattaggaatcacatgggctgttgcttttgttctcaccgcaactggagtttatagctacaaaggttgtgatgcaaatattcctgcctcaaacaatgtatcagccttttgtcggaagcatgtattgaggatgaaatcttgccgtgtagacacttcacatgccttaagatcttca

SEQ ID NO: 20631 - DNA, 587 bp, Sorghum bicolor
  Clone ID: 11065062
gcacgaggctcctcgcttcctccccgccgggtcgcggtcggctccgccttttaaccggcttgtcctggagcggggcgagcggcgaaccgcacgggcgctctaaccgcggggcgccggaacacgaaccggaaccctagtggtggtggcgcgccccatgggaatcgatctcaacatggtgggcggcgagggccacgatcgccgcccgccgccgccggtgagccgggagctgtggcacgcgtgcgcggggcccgtggtcgcgctaccgcggcgggggagcctggtcgtgtacctgccgcagggccacctagccgcggcgggcggcggggacgtcgctgcggacctgccgccgcacgtggtgtgccgcgtcgcggatgtcgagctatgcgcggatgcggcgacggacgaggtgtacgcgcggctggcgctggttgcggaaggcgaggcatttgggagaaatctgcacggcggcggagctgaaggggacgatgacatggaggatttggatgctgaaaggaagtcccggatgttgcacatgttctgcaaaacgcttacagcctctgacacaagcacgcatggagggttctctg

SEQ ID NO: 20632 - DNA, 546 bp, Sorghum bicolor
  Clone ID: 11065065
gcacgaggctcctttgtttgttatcttatcgataaggcatcacagctgatcctgagtcctgaccacaatgctttgtttaagtctcttcagagtttcagacttcagagtcgtcgtcaatgacgatgatgctatgtgctaaccggtctatctggggaaggaaggatgctttgcttacacctgcatcattccatcatttgcatattagcatgaacaggtgtttggttcttgtccctgattgggcctcaacagtccaccatgtgggggaagattgggaaagattattgccacacctgacgcactgaatctcttgtgtttatttaaattaaacccccggcgtgggtctcattccatagcatgactctggcaggcaggcaggcaggcagcaggcttctgcagatgacctgtttaaatgataagctctgacgactcattaggtgtcgacaattctctccggagtgattagtattgagatggcgattgcatcttctatctataataagaaatacagatgcccctgcatgcttgacggatcgtaagcatgcatgt

SEQ ID NO: 20633 - DNA, 581 bp, Sorghum bicolor
  Clone ID: 11065067
gcacgaggctatatagacatcgataagataaacacagctgcctggccagctttggtcgctgacttaggtgctggagaccagagcattacagctctttccttcggtttcacaagacttttccaaccgaacaaacctgtgacgaagggacaagctgccctagcaatttcaactggtgattctggtgaagtggttctggaggaggttgctcgtattgaggcagagaaaatagctgaagcagctgtaaatgcacatggtgccttggttgctcaggttgagaaagatcttaatgcaaggtttgaaagggagcttaaggaggaaagagaaaaggtagagacccttgaaaaactagctgaagaagctaggatggagctggataggttgagggaagaaagagaggaagagaagaacattctgctcaggggcagagctgctgttgaatctgaaatggaagttctgttgaagttgaggagtgaagtagaggaacagctgcagaatgtactgagcaagaaggtggaggtctcctttgagaagagtaggattgaaaaactccaaaaggaaattgagaatgataacttggctgt

SEQ ID NO: 20634 - DNA, 538 bp, Sorghum bicolor
  Clone ID: 11065075
gcacgaggccgcagtgcgtgcgcgctgcaacacatcgctcaccaccacctgctcctccagcggcggctccccgggcgaacccgaatccccaaacaccatggcgggtggcaagatccagaagaagcgccacggcgcggcgggaggcgccggcggagggggcgcccggctgcagggcggtatcccgttcgagaagtccaaggggcagcacatcctgaagaacccggcgctggtggactccatcgtcgccaaggccgggctcaagcccaccgacaccgtcctcgagatcgggccgggtacaggaaacctcaccaagcgcctcctcgaggccggtgtcaaggccgtcgtcgccgtcgagctcgacccgcgtatggtgctcgaactcaaccggcggttccaggggcacccgctctcctcgcgccttaaggttatccaaggagatgtcctcaaatgtgatctcccatacttcgatatttgtgtggcgaacatcccgtaccagatctcatctccccttactttcaagcttctgtcacaccgtcca

SEQ ID NO: 20635 - DNA, 430 bp, Sorghum bicolor
  Clone ID: 11065080
gcacgaggccattatccgtcggtgatagcgcgccccagaaggtttctgagtggtaggaataagaaaaatcccgagaagtgcattctcggcataaatagccgcggagagcaaagccggctatagtttcgtctcgtcgtcccgaccatttgctggctaggtagctcagagactactgcctcctgattatctcgccgcgcgtcgtgttcatttacggctacgaaaatagtagggctggcaaatcggtggccggccggcagtgcggcggccgaggagatggggagcctcgacggccactcgctgcagcagggccatcaccacggctacgcccactcccacgtcggcgcgggccccgacagcagcggcaacaacaacaacgacgaggacgacgcgtcgcccccgcctgccggcgccgcggcggggggaggcggga

SEQ ID NO: 20636 - DNA, 539 bp, Sorghum bicolor
  Clone ID: 11065087
gcacgaggcaaacacaaaccaatagtgaccctagcagccaagctccactggcagcaatggcgctactccgagagtcgattttgcttgcctttgtcttccttacatgttcagttgcttctctgccacccacagccacaagcaataccactgattacctcgcactcatgctgttcaaatcacttgtgaagggtgacccaatgagagccctggaatcatggggcaaccgatccattccaatgtgccagtggcacggtgtggcctgtggctcaaggggacaccgccgtgggcatgtggtcgcattggacctgaccgggctcaaccttctcggcaccatcagccctgccttggccaacatcacgtacttgaggcagctcaaccttccacaaaatcgcttctatggcatcctgccaccagagctcggtaatatccatgaccttgagactctagaccttagctataactccattgaaggtcagattcccccatcactctccaactgtagccgctttgtagaaatcttgctcgacagtaacaaactg

SEQ ID NO: 20637 - DNA, 424 bp, Sorghum bicolor
  Clone ID: 11065102
gcacgaggataatggtacatttccgccttggacgttatggaaagggtcacttgggcttgagttcctgagtcacaagtattcagaacatgcagatcagcatacactctatcctccctggattgtaggatctgatgaggagaactatccattgaccagacaagtgcagagagatatatggactcatcagcaccctcgaaactgcagcgatccaggcttacggtttctggttgcagactgggagaggctgcctggattcggtattggcgcgcagatcgctggaatgtcaggacttcttgctattgccatgaaagagaagaggatactggttacaaaccactacaaccgtgctgatcacgatggttgcaaaggtgcctcaagatctagttggtcttgctacttttttcctgagacatctccggactgc

SEQ ID NO: 20638 - DNA, 579 bp, Sorghum bicolor
  Clone ID: 11065109
gcacgaggcaagggatacgggcccaagttcgagacacaggatgtcattggctgcggcatcaacttcaggacagggcatgccttcttcacgaagaatggcgtacatcttgggactgcatttactggcctcaaaaacatagagctttacccttctatcggcatcaaaaagtctggcgaacatctccgagcaaactttggtcgcaatcgctttgtgttcgacatcgacggcatgatggctgaagaacgaaggcatgttcgtaaccagctcaaccaggcggatgtcactcaactacacccaccggacgacgagaacgcactcatccagaaacttgtcgggcagtaccttgcgcatgaaggctatgtcgagacctcgaaagctttcgctgcagatgtacggaatcgcgccacaccgctcgcgacctcaagctcagattcgccatcaccaggaggagaagacgatttgcacaccatgaatcgtcaaaagattcgacgagcgatattagatggcgacatcgataaagcattgaagtacacacacaccttctaccctctggtcctgcaagacaagcgcaacgaagac

SEQ ID NO: 20639 - DNA, 444 bp, Sorghum bicolor
  Clone ID: 11065110
gcacgagggtgaggctagccatggtgaagctggcgacggcgcgcgagtgccgcacatacagcctgggcgccggcgcggggtccggcacggcgtcgcgcaaccggtgggagtacatcaacgccggggtgtacatcttggcggcggtgctcctggtcgccgggttcctggcgcagctcccgccgtgggggcgcgggtggtccggcaggccggggctcgtggtgaccgcgatcgggctcgccggcgtgctggccgtcaacgcgcacgacctcctggcgcacgtcgccggcgtcgattaccggctcgggacggtggctggcctcgacgcgcagctcgcgctcgtcgagctcgccgtccccgccgtgcagatcgtcggcacactgctcatgctcgtcgctgtcatcttctttgagattcagatggagagaggggaccggcacagtctag

SEQ ID NO: 20640 - DNA, 598 bp, Sorghum bicolor
  Clone ID: 11065120
gcacgaggctctgctgtattgactactcgatcctgggcacaacaacacctcgtcatagcctgctgactcatccccgcagcgaaccatcgtcacctggttgaatatcatccagccagtcattcattctgccattcactcctgctttctcaaccaccccccgaagtgtcgacactagttacctgtttgtatttcttttcattcgaagacgaacggcttgggcatattacggcgatatacggagcgactgcctagctatcaacgctttgactgctgcgaggccggccgggcacctaactacttgtctacctacctacctccccgcaccgcaccgcaccgcaccgcaccgcatcgtactgcaaaagcactcacgcattccctttacgaagtacgtacatatacacacggacgaatatacggagaacgtatcatacacaccaggcacgaacttgaagcgaagcgaatcgaacccgaacctgctagagccgcaactgatcacgacacctatccagcgttcccccaccacccgaccaacaaataaccgaaaaagaggaatcgagtctagaataggaaacaatcattagcgatgtttcgcgcgcag

SEQ ID NO: 20641 - DNA, 333 bp, Sorghum bicolor
  Clone ID: 11065122
tcccatttcctcctcttcccttccccgtcgatctcgtcggcgacggcgacaccactacctcgccgtccggtcccaccccgcgcctccaactcctgcgacccagccgcggatcccgaggagacgaaccgagtccggcgatgggggtggtgatcgagcgggaggagtgggcgctcacccccctcgcctacccgctcctctccgccgccgccctcgccgcggtgctcctcctcccttacttctccgcgaggactgcggcgcacgccaccgggtcctcttcccccttcgacgtgggcaccgtacccttcctccggttccggcgcgccttcctcatcc

SEQ ID NO: 20642 - DNA, 496 bp, Sorghum bicolor
  Clone ID: 11065123
gcacgagggtcatatgaagggtctagcgaactgcatgcgctggccttgaagtcattggttgacctttcttctcgtgagccgaagttggtgtcattgcggtatgcagaacgcataaattggctaagaactcttttgggtcatgttgattctgatgctcgtgaagctgcgtcacgcctgcttggtattgcttcttcagctctttcaacctcttctgcactaagtcttctgtctgagctcacttcaacactgagtcaaaatcgtccatcaagatttgaaaattaccatggagttctgtgtgcgatcgggtacctaacagctggtgctttgaagcagtcttatatttctgaggatatggtaaaaaatgtagttgatattcttgtaaaagtagttatctctgaaggttcgacattagcatctgttgcaatggaatctcttggtcacattggtctgcgttgtgcattgccttccatcaaccaaaactcttctacaggtacac

SEQ ID NO: 20643 - DNA, 490 bp, Sorghum bicolor
  Clone ID: 11065126
gcacgaggccagctcgaccccttccagtccgaggccatacgctgcgtcgacaatggcgaatccgtcatggtttcagctcatacgtctgccggaaagacagtggttgcgttgtatgcaatagcaatgtctttgcgcaaccaacagcgggtcatctacacgtctccaatcaaggcactgagcaaccaaaagtacagggagttcaaagaagagttctctgatgttggtctcatgacaggggatgtcacgattgagcctaatgcctcttgtctggtcatgactacagaaatttggcggagcatgcaatacaagggatctgaggtcatgagggaagttgcttggattatttttgatgaggtgcattacatgcgggatagagagagaggagtggtctgggaggagagtatagtgatggctcccaagaactcacgctttgtcttcctctcagcaactgtacctaatgccaaggagtttgctgattgggtagctaagg

SEQ ID NO: 20644 - DNA, 528 bp, Sorghum bicolor
  Clone ID: 11065128
gcacgaggagaaggcgtaggaagcgtgacaggaaatcaaaacataagtcaaaaaggataataaagggtgatagtgaagctgaaagcacgagcgatagcagctctgaagatgatagaagcaagagacaccgccgtgggcggaagtccaaggcatcatctcaagtttctgaggaaaatcttgctgcagtggctgctttgaaggatgccatatcacctcaacaaaagagtggaataccaaggagtccagcacaagatgtctctaccctgcaaaacggggaaatccatacaaatggtgttaatgaatcaaaaattgaaaggagtgcagctgtcatgcctgttctaactggcaatcgaagcaaatctaggagccagagcatgagtgctaatcactcaatgagcaagagtatgagtatcagtccaagaagaagcccaatgaaaaggtcaattaccagcccaaagaggtcagttagcaggagccctgttcaccacaatcgcattgtccgtactcctaaaagaagtgagagcagga

SEQ ID NO: 20645 - DNA, 480 bp, Sorghum bicolor
  Clone ID: 11065141
gcacgaggacagagtcgtgcggccgccaccctaaactgcgactccagcagcgatgcgcgcccgccgcccttcacgcagcccgagagaagcccgaccacccccctccgtgctgcccatggagcgtcgtacgatgactgcagttcgcggcgatgcgtccaatccagtccggcttccgcgagtccgcctcgccatccgcatcttggtcatcccgtcctcgatccaaacaccctgccctgactaccgcagttcgcctgacttcccgcatcttgcccagccgctatgagtccgcatcgtgctcccccaatcagcagttgcgggctcgatccgcaacacatctcggtgtatgccgcagctcagcacctacctcagcatctaccacctcactaatgcagtccaagtccccccctagggtgcttggaggaagggaggtggtctgagacctttttgagattgcctggtttgaacatcgtacaacttgtg

SEQ ID NO: 20646 - DNA, 490 bp, Sorghum bicolor
  Clone ID: 11065145
gcacgaggcattatctctccgttgtccgctgggacagcctcctcctgctcagacaccgaatggcagcatcaaatgcaaggtctggacgaactgtactacgccacaaatattgagtcgggaggtgatgagtcgacaaccccggccgaaaagaagaaatatctcagtctcactattcccccacactcagtacaggggccacacaagagctctccagttccaccaacgccttcgccaaagattccggtgtcgccagcagctttgtcaaagcttgtacgttcggtccccgccgtgcatgctcctccttcgctcgacggaagcgtgtcgtctgatcaagtgtcgagtaccagcgctccagccacccccgacctgcaatctgttgccgacaacgattggaacaccgaggaagtgcgcgtacacttggatttgaacctggagggcagtcagaatccagataccgctgatccaaacaccagctcagatgttcatggaa

SEQ ID NO: 20647 - DNA, 433 bp, Sorghum bicolor
  Clone ID: 11266114
cttaaagacagctctgcaaaagatggctgccataccatcaagaaaaatactggcagtcgaggtcctatggactccacaaaatgagaatgacacgttgtcagagcgagaactccttgaagattacccactcttaaggcctctgtagaaagataaagttacagattgcccctgcaaagaaagaacaggctgtagattcagttttggcggttttattattaactatagcgcagatcttgcgtttgtataagaagtatataacttgtaattgacgtcactgttagccttcatttcagaacatgtagcgcactgcagtgcaaatctgcaattgtatgtggatagtcttgttcactgttctggacacaataacacaaatttgtaaatagattgttctgaaagaacactagagtctgcacttttgtgtgtacccgttctg

SEQ ID NO: 20648 - DNA, 528 bp, Sorghum bicolor
  Clone ID: 11266136
atcactgactccccgcagcctcctcctgagaggatcaccttcactctcccagtaatcaactcagcatccaacatagcaatagtgtccaccggtgatgacaaagcaaatgctgttcacttagcagtttctgacacgactgaaggtcttgatgctcctacatcactgcctgctagaatggtccagccaacggacgggaagctggtgtggtttctggacaaggaggcggcatcatcccttgagtccatgaccgacgacgatgcttccttcgaccgtcatgagtactaactctgaggatctgaggtcgtcttgaagtgaatgaacggaggtgtgtaagtaggtggtggcatatgatggaagacgtgctgtttgctccccttttagctcgatgtatgcattgatttgtctgagggtttagttccgggaaatctgaaattgctcttggtccttttgctatgagaggtgattgaaagcgaggaaatgggtatgcgatgttgagtcatcgaagaacatcagattttaactcgtgtc

SEQ ID NO: 20649 - DNA, 389 bp, Sorghum bicolor
  Clone ID: 11266181
tccctatgccagcctcagacattggaaaacattttggtatgctgctagaaagcatggatgggcctgatatttcgttcacaattgacaatgagacattccatgcacaccgagcagtgcttgctgcccgttcacccgtcttcaaatctgagctcctcggttccatggctgagtctactatgccaaacatcaccctctgtgacattgctccagccacattcagagtcatgcttcggtttatgtacacagatgccttgcctagagatgatgagctcggggactctcccttagagatgatgcgacatctactagctgcggctgaccgcattttccttccattattgatgagcttcgagagaggatgggactataacctggtggggcatactggc

SEQ ID NO: 20650 - DNA, 630 bp, Sorghum bicolor
  Clone ID: 11266196
gccaccttcacgccgggcaagcactgactttggtcgaccagtgtttactgcagcagcattctacttatgtgcgaagaggcacaagctcaaggttgacaaactaaagctgatagatctatgtggcacatccagctccgagtttacaacggtttcaacatcaatgacagatctctgctttgatgtttttgggatagccaaggagaagaaggatccaaagtccatcaaagggaacagagaattgctggatgttttgccaagcaaaaggaaacatgaagatgacagtgattcatctggatctgatgaatcgtcagacgacgatcaagatgaactagatttaccaactcacaagaggcgcaagaagatggagaaagaagcatacaatgattggaagtcatctgttctctcctcgaacaagaaaaccaaaacagaccctgccaagcctaggaggcaagctcaacttaactttaagaagccggcagaagtaccttctgcagccaactagataaacctgagccctattcgcaacaaatggaattgctgggactgaaaatggtctatgctttatcctgatcgatgttgcttatgaaccgcaaaaaagggggaaaaatcagacgcctttgttccttgttt

SEQ ID NO: 20651 - DNA, 538 bp, Sorghum bicolor
  Clone ID: 11266216
tcagaattccactagaaatattcaagacagggaagacaggttggggtgtaagatccctcagttctatatcatcaggcagtttcatatgcgagtatactggtgagctattgaaagatgaagaagctgaaaagagacagaatgacgagtatctatttgatattggtaataactaccatgatgaagaactttgggaggggctgaagtcggtggttggtgtaggatcttctacctcgtcctctgagacaatggaaggcttcacaatagatgcagctgagtgcggcaatgtgggaagatttatcaaccatagttgttcaccaaacctttatgctcaaaatgttctctgggaccatgatgacatgaggatgccgcatgttatgctttttgctgttgagaatatcccgccgctacaggagctgacctaccattataattatagtgtaggggaggtctatgacaagaatcacgaggagaaggtcaaacattgctactgtggcgcctcggattgctgggcaggctctactaaaacattattgactgt

SEQ ID NO: 20652 - DNA, 537 bp, Sorghum bicolor
  Clone ID: 11266227
cacatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccggtgccggtgccagtgctggcgcagacttcgccggctggtgcccgctcctctcgccgacggccttggactggcagttcgaggagctgttcaccaatgcaatggagccctttcaatgggacctctatacggccaattagatgggggtatctgcagacaaaacatatatgtgcagcacgtactgtagcttgttttaccgatttccggtattagtattagcttcagagtagactagagtgtagtattcttctgctactatga

SEQ ID NO: 20653 - DNA, 111 bp, Sorghum bicolor
  Clone ID: 11266264
ctcatcatcagagtgcatcggaccgccaggcaaggaagccaggtacacggcggtggtgcgccagagtacctgggaggggaactctatctttggtcctttaagccagctaat

SEQ ID NO: 20654 - DNA, 194 bp, Sorghum bicolor
  Clone ID: 11266299
catcagatcaggaaaaccagataatttgtgggcataaaaaaaagcagtcaaatagtttaaatagtttcggtcagctttgtacatatggatttctatttattaatccctattatgcggcccatagatgtcgctgataaacggaaaaagatccttaattttttgttggaaatccgttgtgtaggcattttcgggcc

SEQ ID NO: 20655 - DNA, 303 bp, Sorghum bicolor
  Clone ID: 11266402
ttatgagactgagattttggtggtcaacctcgtactgctgcgaggaaggaaggaagaacgtgacagaataacgtgaggctcaagtgtacagcagctgcagctgaagctggaacttactactccatatatattgctactactactactagtaccccaggatgtgtacagggccctttggtttggcctgctagcattttattgtcggactttgcttctttaaatccacctttttttttattttcctatatataggtcgtttgactatgtaagcacaagtgtatttgcgtcaaacttatcagtagc

SEQ ID NO: 20656 - DNA, 119 bp, Sorghum bicolor
  Clone ID: 11266418
gcacgaggaacctccctccatccccgcagcatctccacgccgtcacacctcgtcgcgtcgtcaccggcgagaagatggtcgggccgggcctctacgccgagatcggcaagaatacctag

SEQ ID NO: 20657 - DNA, 267 bp, Sorghum bicolor
  Clone ID: 11266460
ctcgaggacgtggactacctggaggccccgctgatgatccccaaggacgacctcctcccgcccacccccgccgcaggcgacgaggaggacgagcgcgcgctcgtcctgctcgttcatgtcacctccttcgcgtgcggcggattcgtcgtcggcttccgcttcagccacgccgtcgccgacggcccgggcgccgcgcagttcatgaacgcggtcggggagctggcacgcggcgccgaaaacgcgttgtcggtggtgccgccttccacg

SEQ ID NO: 20658 - DNA, 270 bp, Sorghum bicolor
  Clone ID: 11266520
gtggactggcatctggttggttttaggatgctaaaatgtaatttttcgcagagggcgacatgtagccttgcagcagttttgatttcgatctgctgttagatgtatccatccatccatgcctgcctgtgggttgcttgagctggagacctgcggtgcgtgtcggcacctgacaggaggtgacacctcgtgacaggtaaataaaccctttgccgccgaaaaaaaaaaaaaaaaaaaaaaaaaaaaaaaaagaaaacaaaaaaaaaaaaaaac

SEQ ID NO: 20659 - DNA, 443 bp, Sorghum bicolor
  Clone ID: 11266564
gaactttgctacatttattgagctcataaagattttggaagaatcacagatggaacatcaaaagcaactcttccagcttcagaagaagtttgaggcctttgttgctgatgaagaaaagtacttgatggagaaggtcacagggttatttgcagaatcgaatgctagaaagaaaaatatggttcaagatgatatatgcagcctcaataggactgcttctgagcgttcaaacaatttacaaactgaaactaccaagcttcatgattttacatcttctatgaaagagcaatgggaagcctacatgaagagaactgaagaggcattccaacaaaatgtatcatctattgaacagaaacgatgcttcttggtagggaatttgcagcagtgcaagggaagggtagaatcatgttcagaacaatggattacggcacaaaatttggtgttgg

SEQ ID NO: 20660 - DNA, 183 bp, Sorghum bicolor
  Clone ID: 11266576
gcacgagggcagctcgcaccctcaccggaaggcggcttcaggcgcacacagtcacgcaaacccccctcttcatcaacctccgaatcgagcccagcgcgcgtccccgaatcgagagaacatgagccgcgctcacgacggccacaagtccttctttccagtggggaatcccttcaggatgatttt

SEQ ID NO: 20661 - DNA, 468 bp, Sorghum bicolor
  Clone ID: 11266592
gggagatgggattggaattggaataaaaaaaaaggaagagagcaggagaagcgcgcgcacaacacaatccgcaggccgcagcagaggagtgagtgcagaggagacattcagatcaaacccaaggagaatattggtgaaacaataacttgacatagagttctagaccaaagaagcaatggaaagggaatcgtctaccacatatgagccaaaaaggaactgtgaaataagggtttttgagagttcagatgaaatttcaacagatcttgctgagtatatctcgcaaatttcagaaatttctgtcaaagaaaggggatactttgccatcgccttatctggtggtcccctagtcagttttttggggaaactttgtgaagcaccatacaacaagaccctggactggtccaaatggtacatcttctggtctgatgaacgtgccgttgcaaaaaaccatgcagagagtaactataa

SEQ ID NO: 20662 - DNA, 364 bp, Sorghum bicolor
  unsure (1)..(364): unsure at all n locations
  Clone ID: 11408855
gnncaaggcattgacaaggcagtctactgtgatccgttctccatttgcgggcacatgtggcggatagtctgctacccaagaggggatattgggtctgacagtggtgaatacctcacactctatctggagctgctgagcacatncacaattggtaaggccatctgcgacatccttttattgaacaagaacggtaagccatgttctaggattgcatcatcaagggtttgtgttcctctgcctcatagcaggaatgctgctgaatgggtctttatcactagtatgtatatttcatttaataatctagaggaaaatttcctgacagagggacatatcacttgggtatgctccatcatggttacccgtg

SEQ ID NO: 20663 - DNA, 317 bp, Sorghum bicolor
  unsure (1)..(317): unsure at all n locations
  Clone ID: 11408858
nncacgaggcttcaccatggaaagaaagtcagagatgatagtaaaacgttaattcaggctgggattggccaggatgatatgctggacaacctaggcttttcacttgaacccaactgtacacaaaacccacaagtcnnnnnnnctgaagatatcagtttccttgaaaccattgatactaccgaaccccttgcaaggattgcacctgctgactcatgttctaagcatggtgaagtggatgtatcacaggagcttgcattgaccccattagcaatgaactaccagggcagtgatcatgattctgtgcactcccctcgggg

SEQ ID NO: 20664 - DNA, 321 bp, Sorghum bicolor
  unsure (1)..(321): unsure at all n locations
  Clone ID: 11408859
ngcacgaggagagagcagcccaaaaagaagattaggatgggaatgcctgcgacccaatggattagtgtttacaatgccaggcggcctatgaaacagaggtatcactacaatgttgcagacagcaggttagctcagcannnnnnnnagggaaatgaagatggcttgtttataagctctgtcgcctcttgttcaaatctgtgggctttgataatggatgctggcactggatttacttctcaagtatatgaactttctccatattttcttcacaaggaatggataatggagcaatgggagaagaacttctatattactgcccta

SEQ ID NO: 20665 - DNA, 396 bp, Sorghum bicolor
  unsure (1)..(396): unsure at all n locations
  Clone ID: 11408887
gccnangatcttgccttgaagaattgcatcaaaaccaaatccccagttcgtgtgattcatgggttcaaaggccaaagtagaagtgaaggtggtcattctaaaggcaagcaaactacaacatttacatatgatgggttgtatgannnnnnngaatgttggcaagaaggcccaaaaggtgagatggtcttcaagtacaagttacagaggattgcagggcaacctgaattagccctacatgcagttaaggcaacaaggaagtccaaagttcgtgaaggtctttgtttgcctgatatatctcaaggaaccgagaggatacccatatgtgtcatcaacacaattgatgacatgaagccagcaccatttaaatacatcaccaaagtcatatatccagctttg

SEQ ID NO: 20666 - DNA, 104 bp, Sorghum bicolor
  Clone ID: 11590084
aattctgacagacctgaataagctgatattgtgcttgatttcagatggacgcctttccagtataggttagatggggccatgcttagttccaatagagcttgtta

SEQ ID NO: 20667 - DNA, 112 bp, Sorghum bicolor
  Clone ID: 11590092
taaacagcacaaaagaaatgtgcaacaacagtcctgaagaagtaagttccacaataatgcaattcatatggcaccgctgccattacctacagaatgatacctccaccagtcc

SEQ ID NO: 20668 - DNA, 126 bp, Sorghum bicolor
  Clone ID: 11590098
taaacttgcataggcagccttacagagtatgtcatacaagatcccggttgttcctcccatgactcgtcttactgtggcaccaatctcatttactgtttcagcgacatcattcattgggtagctgag

SEQ ID NO: 20669 - DNA, 137 bp, Sorghum bicolor
  Clone ID: 11590102
caatcaaaatctaatctgcttccttaggttatttagttatgtattgtgctggtgaatgatccagaggtgagcctggaagaagacaacttgtgttgatgaacaggtaaatgccatcaatgggttagtcccaccgaatt

SEQ ID NO: 20670 - DNA, 101 bp, Sorghum bicolor
  Clone ID: 11590106
tatgatgcccacggagaagggcgtcctgaccgtcagaggcaacgtctatactgcgtacacctgcgaagaagaaagtttcaagatcaccgaggaaattgacc

SEQ ID NO: 20671 - DNA, 118 bp, Sorghum bicolor
  Clone ID: 11590112
tccaaggccaagctccatttgtcttggacccaatcggtcagaagttacttgccctggcaatgtgcaaacagaaagtgcaactcccatcgtaccaacagcctcagatgcatgttttgct

SEQ ID NO: 20672 - DNA, 134 bp, Sorghum bicolor
  Clone ID: 11590119
ttaatcgacacagttggagacactactttaagactccattcttaaagcaagcccaccgaccggtctcaagtataaacatcattaaccataaaagtatttcacaacaacccttcaaactttctcatttgaaaacc

SEQ ID NO: 20673 - DNA, 136 bp, Sorghum bicolor
  unsure (1)..(136): unsure at all n locations
  Clone ID: 11590120
aattcagttcagagttgtagaatgggataatnctgacttcctgtgctattctagattgagataatctatttgtcgagtggctttgaaagtagggaagtcgatgatatttcagtggacaccagtagttcaagcatta

SEQ ID NO: 20674 - DNA, 146 bp, Sorghum bicolor
  Clone ID: 11590136
cccaagtcatcatgaagagtgttgacaagatcagttgatatcccactcaaagcatcttgtgtcctctaggcattgaactcgcaacatctccaattttcttatttcatttttccagcagctctgtgggtatgataattgtgggcata

SEQ ID NO: 20675 - DNA, 113 bp, Sorghum bicolor
  Clone ID: 11590139
ggtagttggacctggagtgctgtgacatctgaacatgtacagctacgtattcgagcagcaagaggaatacgtgagttaagagacaagagcatgtagatacagcatcttacacg

SEQ ID NO: 20676 - DNA, 117 bp, Sorghum bicolor
  Clone ID: 11590181
cgcctgtgcagaactgcagatgggttactgctatttgtctctttacgagttgattgtcaatatgtgtttgcacttacttctgcactacctacttataaaaatgctcaatctctgcta

SEQ ID NO: 20677 - DNA, 109 bp, Sorghum bicolor
  Clone ID: 11590195
taaagatctctctagcttctgcgtgcaatccagatttacaaagacagtctatgagcatactgtaagtaacaacatttggccgttgcccatctctagacatttctttgag

SEQ ID NO: 20678 - DNA, 190 bp, Sorghum bicolor
  Clone ID: 11590202
cttgtgcagaagtgggtgcatactgccatcaaagagcaacttgctactacttgcatacttcctgggtcaaggaatggcgcttttttggctatcttgtgcagaagtggctgcatactgtcatggatagcagctagctacctgtagttatgttggaaaatagatagcacctagctgtcagttagcacttcta

SEQ ID NO: 20679 - DNA, 109 bp, Sorghum bicolor
  Clone ID: 11590204
aattcctgcaggagaacacaatatgcacatttcggtgatactgtaacatttaatacgacgtataggactaacctgtatggcttacctttcatcttgtttgttggtgtta

SEQ ID NO: 20680 - DNA, 169 bp, Sorghum bicolor
  unsure (1)..(169): unsure at all n locations
  Clone ID: 11590207
tgaaagatgagaggatntnataatcncatcaaaacacaccganacaaactggttataacctcccctcccgcactcactgccctctgggccccccacaaagacaagcgtttcagtcacacctataaagcagcaggaaaaactagtagattataaggatagatacagggtc

SEQ ID NO: 20681 - DNA, 143 bp, Sorghum bicolor
  Clone ID: 11590211
taaaaccactgcaagtagtttatcgttttttacgaccattcctctctgctgttgtacctgtcgactgttgtgcaatcccttccaaaaataaaaataaaaatcagctgctatgcatgtcatctccatgaccaagcactgctagt

SEQ ID NO: 20682 - DNA, 150 bp, Sorghum bicolor
  Clone ID: 11590214
ctttctccaaccatgccaccatcattgtcaccaatcgggagcatcagacacccttgttttccatgttttaggtgttattatccctctcctgctgatggttcgatgctaaaacctccttgcattgttagagaccccaggctacctccatta

SEQ ID NO: 20683 - DNA, 107 bp, Sorghum bicolor
  Clone ID: 11590217
taattgacaacgactacggagtactcctactgtacttctgtacaaaaacttgcgcatggcttggatcaatgacaccagtcgtttgtgcttggcacagcagtgcaatt

SEQ ID NO: 20684 - DNA, 104 bp, Sorghum bicolor
  Clone ID: 11590230
ggtacctcctctaccaacgatgtactctggtgcatttaggggactcgtcaaaagcatgctgcgcaaaagtccagatcatagaccaagtgctgcagaactgctta

SEQ ID NO: 20685 - DNA, 144 bp, Sorghum bicolor
  Clone ID: 11590238
taaaaaaaacttccttttattcttcaccatttcaacaacacagttggaagtcaagcgtaccatatgacctggctcccaaaaagaaatacatcgaattatttttagtcgattctcacttttcagtatctcacggctcaaaacatc

SEQ ID NO: 20686 - DNA, 126 bp, Sorghum bicolor
  Clone ID: 11590240
taacaattggagtcagatggttgtgtccaggtaacccaaacttcccaagcttagcacggacagtctctgctttgctcattccctcctgatctgggtgaagcctcaacaaatattgaactggatttt

SEQ ID NO: 20687 - DNA, 124 bp, Sorghum bicolor
  Clone ID: 11590249
aattccacctgcgacattgtaaacttttttgaaaccctgtgactgcaaccatttagccacctgcattgagcgcatgccatgatggcacagaacataagtgtccttttgaggattagcccactcg

SEQ ID NO: 20688 - DNA, 170 bp, Sorghum bicolor
  unsure (1)..(170): unsure at all n locations
  Clone ID: 11590254
catcacttgactcgcaagaaatgctgaaatggggtgtcagtggcttactgcacaacacacaggtcaaagcattctgtattttttcttggctttggcttgntatgacctatgaatcatttttccagaacaaaatgacttttgagaatttcttccatgccattcaaacgtta

SEQ ID NO: 20689 - DNA, 125 bp, Sorghum bicolor
  unsure (1)..(125): unsure at all n locations
  Clone ID: 11590264
accncctganccntactaactatntggnctnnntggntaccgcancccnncctngaggncgacggcatcgatnagcntgatatgcgaattgcccccatggctgtcctatcgtagactccggncag

SEQ ID NO: 20690 - DNA, 110 bp, Sorghum bicolor
  Clone ID: 11590268
taagatacaaagctattgcaggtttagtcttgcacttacaggcctctggttatagtccagtttctttcaaactccttgacaaccatatggctgtctctcttggagatgcc

SEQ ID NO: 20691 - DNA, 198 bp, Sorghum bicolor
  Clone ID: 11590272
cagtggttcattcgtgtattggcctgttctgaagaagctatatgtacatgctatcatcatttagaatagtatggatatggagatcgtcacgtactgatcatgcaagcaggaaggatattcaattgacaactgaagaactgatcattagccaatgaattgaaggagtatttcttttgaacaaacaccatgaagaaatta

SEQ ID NO: 20692 - DNA, 130 bp, Sorghum bicolor
  Clone ID: 11590283
aattcagtgtgtagttatgtacagtgacagcgactcagcgagtagtgctgatggttatatatgtttccgtcagtggtggtgtactaactctgtttctgtaatttcgtgcggtggcaactttgttgtgtta

SEQ ID NO: 20693 - DNA, 166 bp, Sorghum bicolor
  Clone ID: 11590296
gtgctgtgtccatgacgtgctgggtggatttggacccaggaacagataatggtcaatcaagagaccgttgcagtgtagactgatccaccggttcaaccgccccagctgctccggatgacgatcttaccagagcatgaatccaaatggaagaatcagttcccggtta

SEQ ID NO: 20694 - DNA, 145 bp, Sorghum bicolor
  Clone ID: 11590321
taagtttagatgacattacagaaacgtacataatgctaaactagcaacagttcttggaggctgtaaattgctgtgccgttacatctcagtacgaaaccaggcctttgtttccatcagggctgctagaccttgagctgctgctgcg

SEQ ID NO: 20695 - DNA, 108 bp, Sorghum bicolor
  Clone ID: 11590323
gctagagctgtcaagagaaaactagaagcaagtaggattccacctaatgatttagatagaagaacaggcaaggaacggaaagtagctgcatatgaatttcgtcagtta

SEQ ID NO: 20696 - DNA, 107 bp, Sorghum bicolor
  Clone ID: 11590329
cgcaaattattcagagtacagtaccagtgataaccaacaatcagttggaatcggcaatagtttccctgatgatgttatgtctgcatgtcaatctgggcaggagatta

SEQ ID NO: 20697 - DNA, 105 bp, Sorghum bicolor
  Clone ID: 11590335
taaacatgttttctgcactctcatttctttgggtactagtctgcttggacagaacttttctttcaagtaggggttggcccatttgtgtctagagtcataaatctg

SEQ ID NO: 20698 - DNA, 104 bp, Sorghum bicolor
  unsure (1)..(104): unsure at all n locations
  Clone ID: 11590347
gaagangcgtggttcgtcaatagtgaagaccaggagctgaggaccgacagtcgaagcagaagttggagatcagaagaaggaagtcaaagatttctgagcagtta

SEQ ID NO: 20699 - DNA, 112 bp, Sorghum bicolor
  unsure (1)..(112): unsure at all n locations
  Clone ID: 11590353
aattccaggaaantataaaactgtgagtgtcatttcagaattgatggacttccattggcacggaactcaagctgcagatgaccaaaaggggtaaatagagaatggagtgtta

SEQ ID NO: 20700 - DNA, 107 bp, Sorghum bicolor
  unsure (1)..(107): unsure at all n locations
  Clone ID: 11590354
taatatcatgatcactggcatattcatactgntcttgaagacttggatcttcctgaggaacaaactgagcctttatgttagctttccaaagctctgcgacaagttcc

SEQ ID NO: 20701 - DNA, 123 bp, Sorghum bicolor
  unsure (1)..(123): unsure at all n locations
  Clone ID: 11590364
taaaagattcgtcctctgggccatcagaaccaccaccaccacgtncataacggnttttgnttcctccatttcaccagagcctagtcctccaatcttaaccatttgntncatcannacgtcttg

SEQ ID NO: 20702 - DNA, 133 bp, Sorghum bicolor
  Clone ID: 11590367
cacggtgcttggtgccctacgcggtcagccgcagctccaccctgtgtaacctgtacatgtacttgtcaatgaacatgaatggaactcgttggctccggttctcattttctaaaaaaaaaaaaaaaaaaaatta

SEQ ID NO: 20703 - DNA, 122 bp, Sorghum bicolor
  Clone ID: 11590378
taacagctctggataactccccagacttgcagagaccatatataagagaattgtaggttactatatttggagtgagaccgacactcaacattgtatccctcagatcaaaagctacatcaaca

SEQ ID NO: 20704 - DNA, 124 bp, Sorghum bicolor
  unsure (1)..(124): unsure at all n locations
  Clone ID: 11590379
taactgccgttagacttcaaaatggacggaatggcacaccggttatagcccgaagatgaagtttgggtataacggngctaaacaactttttagtggctntcctantntngggtcnatnctttcc

SEQ ID NO: 20705 - DNA, 131 bp, Sorghum bicolor
  Clone ID: 11590383
ctcgttccttcactgaatactgaactagcgtttacacagtcataagtggtattagctgtctaaccagaccagatatattcaattccagctacattctgttcggtggccaaattcactgtggtattctgtta

SEQ ID NO: 20706 - DNA, 150 bp, Sorghum bicolor
  Clone ID: 11590412
taaacatgatttactaagtgtgggccctaatgcatcctgcagaataattgcacaaacacagttgctctttgcatacaaaaccttgtatccgactatcctctcaaaatgccacgtctcgtacaaaaaaaaccgcgcgtgctccggagctgt

SEQ ID NO: 20707 - DNA, 141 bp, Sorghum bicolor
  unsure (1)..(141): unsure at all n locations
  Clone ID: 11590421
taaccttctcatcctcaacagctaattcaacaccacgttctagccctctatcaagtagatcgtcatcgtccattgcatttacctttgttgaaacacgaccttccgatttgctttgcttctccaaagctgcttttaccnttn

SEQ ID NO: 20708 - DNA, 132 bp, Sorghum bicolor
  unsure (1)..(132): unsure at all n locations
  Clone ID: 11590423
gtnagngtttgtctttttgctgtcagttagataattttcgggtttaggaaaacatggttttcagcttttgttcacttatgttcctgttgatcatgcagttatcatcgctttgggctagtggatatgcctcta

SEQ ID NO: 20709 - DNA, 115 bp, Sorghum bicolor
  Clone ID: 11590424
tactaaagaagcaaaacagggggtccgttgttctaatatcgctggcccgtctcccccttcgcatcggcaaacatggcatatagagaatgaataccagaagcgtgagcatgtttca

SEQ ID NO: 20710 - DNA, 175 bp, Sorghum bicolor
  unsure (1)..(175): unsure at all n locations
  Clone ID: 11590476
taatccgatcgaaggactgcaacaatagaagttctttctctttcggcatatctggaggtttgctcatgaggtgatcgcacagtgactcgagcttcttgagacgctgtaagcaagcactcatgtcctcttctcttacnnnttgtggtttnggttgctctgatgcagcataaggatg

SEQ ID NO: 20711 - DNA, 104 bp, Sorghum bicolor
  Clone ID: 11590487
taagatcatgacaagatcgacgaggagcggcggcaatgcaagggagaagatgaatcgtccaccccgtggatcggatcagaagaccaagaaccgcttcttcgcct

SEQ ID NO: 20712 - DNA, 107 bp, Sorghum bicolor
  unsure (1)..(107): unsure at all n locations
  Clone ID: 11590493
cccgggtccgttgccatcagagcagtgttttggctgactctgtaactcattcggttgatgtttgttacccgagtgtacgctgctatatgctactccgnatctggtta

SEQ ID NO: 20713 - DNA, 111 bp, Sorghum bicolor
  unsure (1)..(111): unsure at all n locations
  Clone ID: 11590501
taattcggcaactgttttttctgctagcggagtgtcctgtggttgcncagaaatgttgtcttcagatggaggaggtcgctctatgtacatgggttcgtccttgaatctttt

SEQ ID NO: 20714 - DNA, 125 bp, Sorghum bicolor
  Clone ID: 11590515
taccagatacctaggcaaagcatttgttccataacattttgggcacctatatccaccagcagcttgtggatccatctttttcttgcatggtttgcaggacatataccaccagctaatattgtctg

SEQ ID NO: 20715 - DNA, 113 bp, Sorghum bicolor
  Clone ID: 11590520
taaccttcggctctccgccggggaaggtacaagacccctcacaatcaccgggagatggccacgaacaatcaccaactcgtgccaatgctcctcagcttattcaggtctgtcag

SEQ ID NO: 20716 - DNA, 140 bp, Sorghum bicolor
  Clone ID: 11590536
taacaagggttggtcaggccagcagaagggctgatagcggcactactcaggaacatctgaagatcactttatgacataaccagagcgctgaaggcaccataatgccccttgtgcggcgttctctcgtgcagctttcttcc

SEQ ID NO: 20717 - DNA, 163 bp, Sorghum bicolor
  Clone ID: 11590537
taattgttggaagccgactgctgacgttgcttatctttgtagtgatgccaccggatgttgaccgttgagtcatgagagaacctagtgttgcttgagcttgtgatatcacgttatccatctgtccagtactcctgccaattgcagcttgttccctgagaagggg

SEQ ID NO: 20718 - DNA, 152 bp, Sorghum bicolor
  unsure (1)..(152): unsure at all n locations
  Clone ID: 11590574
aattcgagtaggactaaagtactcaaactagattgttgttgtgcaatattgtagatcactttggcttcttggcggatagtttgtgagctcaagctgtggggcatacttatccgtaactggccgtgaagcctgtagctgtaggtcaatttnnc

SEQ ID NO: 20719 - DNA, 120 bp, Sorghum bicolor
  Clone ID: 11590577
taaaacagcagaatccagaggtttgtcaggagccactccatctacacaaacccagggatgacatagagcttcatgtgcagtcaatctctttctgggatcacggtttagcatcttcctgac

SEQ ID NO: 20720 - DNA, 111 bp, Sorghum bicolor
  Clone ID: 11590578
gacgaaattgcaggattgagagaaatgttcaaaatgctggacactgacaatagtgggcagatcacgttagaggaactaaaaagtggtttgaagagaattggtgctaactta

SEQ ID NO: 20721 - DNA, 120 bp, Sorghum bicolor
  Clone ID: 11590583
tagccaaggcagtgtggttcacaggtatgtctgcagctgtttcttctgcagagtccacggtaggcaatggcggagaagaaactacagtagaggcatgttcatggtccccttcttgctgtg

SEQ ID NO: 20722 - DNA, 177 bp, Sorghum bicolor
  Clone ID: 11590586
cgaacgctgatccgatcatcacctagctggctatactagtacactactgtcttcagattcaggtgatggatgtctgctttccttacttattggccgttctagctgaaatgctttatactactgatgcctgatgcttgagaacatgtgtggtctgacagacctgaataagctgaggcc

SEQ ID NO: 20723 - DNA, 110 bp, Sorghum bicolor
  Clone ID: 11590636
tatcacctataaacatcttctcaaaagaaagtagcctgtcccgatcttctgccgagtcagtgaaggaatgtgtaaccccaccagggaatctgtgcaaatttcgtgtcatg

SEQ ID NO: 20724 - DNA, 493 bp, Sorghum bicolor
  Clone ID: 11921784
gaacctagagttgtgcccactcctcaggtaactgaggcacgctttgatctggaggatagggccaaggagcaagtcattgagagcttcgacatcttcaagcagattgagcgcagcatctagaggccgatcgatggagcggtagcccagaggatcgagtaccatcagccatatatataatctatgccgtatcaccgtacgcaagcatgcatctatccccggtcattctgtacttttaccccgtgttattactgttgctattattcttgttgttggttggattgtacgcaccctttaattatgaaccgctaccctatataatatttgccatcttattgttattgttccttatatatggtccttcttagatcacatgtgtagcaggttctaagatattaaatttcttgttttctatattgcatgatctctccactaaaaacagggggacatttcttatggtgataaacatattattaatatatctactagtttttgg

SEQ ID NO: 20725 - DNA, 441 bp, Sorghum bicolor
  Clone ID: 11921803
tggtgcggcacaagggctccgccttcatcccctgcggccacaccttatgccgcctctgctcccgcgagctctgggtcagccgcggcaactgcccgctttgcaacggcttcatccaggagatcctcgacatcttctgacggatcgagctcgccgccttcattgtttatttatcttctaataggcccttgtacgtacgtccatggaatcatcgccgtcgatcaccatcgtcttgctctgcttcctatcctagacgaggatgtgagtggccgatgcgccactccggaatctgtgaaactgaaactcgtagatgaattcgatttcgagctggccaacaccaaactcttacttggtgtttgctatactgcatacattttttttttttgtgatgtcattgattgttcaagtatgttgttacagtaagttgcaataaaatggtatagt

SEQ ID NO: 20726 - DNA, 569 bp, Sorghum bicolor
  Clone ID: 11921815
gcctttttagtgctgatgacatcccaaagcccatcactagcaataacggcaaaagctgtgcatgctttggtgatacgaacagcttggctcacatacggttctgagctgaagcgtgagtcttgctccttaagaaacttatctccaaacatcctagcaagatttagtccattaagacgaacttccccatctttcaggggctgcccagttcttgctatcctagctctttcagttgcactagctactcgatgatcttcagtcatatcaattgtccttccattgacactcattacacaagcagaatcaccaagattagcacactgggcaaaacaatctttattctgatcaaaccaaataagaagagctgtgcctgtacatccctcgtactgatgatcgattgcgtcttctgtcaaagtaaaagcatatctaagaacatcagaagcatcagcacatgattgcactcgttcttttgtttcaggatgagacaaaatgtatcccagattttctggaagaatcttgctgacagctttggcagctccatccccaccagtccatcaaaaaggggggcccgg

SEQ ID NO: 20727 - DNA, 581 bp, Sorghum bicolor
  unsure (1)..(581): unsure at all n locations
  Clone ID: 11921838
gttnaagggcgaagcttgaagccaatttcttcactttccgtctagggctttgcttggcattgggcttcgatatagctggtgctttcctggtcttggattaaacctcagctctcctaattccgtctataggtggttcaatcttataagtttagcttaggtacatcgattcaatcctgccccaggcgtaccgtacctgagacaaccctttcctcacccgagaattgcatttccgcttcagcttccttacatccaactttttctggatctaggcaaggatcctttctcctcagcctatagaaagaaaagaatctcagttcattagattatgcttccttgcccgtgtggaacatgtgtgagcattatgtttttccaacaagtgatccgactggaagaagtgttatatgaggacttcgagatcaaatagagaatctgtctctccattcctcgtgagccacttatttctccgaaatctgagatcagagtgattttcctcctttttcccaaatagtcgacggtcttacaccattgggatacttcggataaactggagtacatatatagagaccggtgctaaaaccttt

SEQ ID NO: 20728 - DNA, 297 bp, Sorghum bicolor
  Clone ID: 11921839
agatgtttgggttttgccagcaattgcaagaaggaagtcggctaaatgcagaggagtagcctacttttgtagggtgctgggatgtgcaatattcagagcttgcacttggcacctgctcctatgtattaattaacgtgtttaagagttggtgaagggacagctatgtactgatccagtttctgattgtaaatttataataacaataacttccatgggaattagtaggacaaatgagtgagtttcacatcattccaaattgactttactgaagattgagtttcgtttatatataaatga

SEQ ID NO: 20729 - DNA, 221 bp, Sorghum bicolor
  Clone ID: 11921842
gttggtttcaagggacgaaggcttgatatcccaagcagtgttgatccaaaagtggcgccagtaattgagtcctgttgggccagagacccctggagacgccccttttttgccagtatcagggaatccttgaaccctttcatcaagacattcccccccaatcaattattggaggaaaattagttccacttcgcaaaaatttcaacatccagtagacacgagtt

SEQ ID NO: 20730 - DNA, 326 bp, Sorghum bicolor
  Clone ID: 11921850
cggcagcggcgcgcccgcaagggtcaagtccacggcggtcgacaaggacccgctcgctgtctacgtcatcaacgccgtggtggagcccgtggagctgttcaagcccgcgccgtcgccgacgccggcccccgcgcccgcgcccgccgccgcggcggacgcgcccaaggccgggaagaagggcgccgcgcgccacgcgccgcccgccgtggccgacgcgcccgggcccaacgcggacgacaacgcggctcctgtggaccagaaggacgccaacaagaagagcgcggccgccggcgcgccgtgcgaccggtggtggctcgccaccgtgc

SEQ ID NO: 20731 - DNA, 346 bp, Sorghum bicolor
  Clone ID: 11921855
tgatctacttactgtgggcaggtggcaagctgtgtctctgcaggtctttgacgctttgaccaatgacttcatgaagccagcgatcaacgaggttgatgagttgctgtcatatggtgtcaacgtgacagtgtaccaggtccagcttgatgtgatctgctcaacgcttggcacagaagcatgggtgaagaggctcaaatgggagggtctgcataacttcttgagcctgccaaggaagcctttgcattactgtcatccttactatctcaccaatggcttcgtccgatcatacaagaatctgcacttctattggatcctcggagctggacactcggttcctgtggacaag

SEQ ID NO: 20732 - DNA, 526 bp, Sorghum bicolor
  Clone ID: 11921867
gacgaggacaagcgccgcgtgcccacggggcccaaccatgctgcacaaccgatgagcgccatagcaccgcaccgcgcctgcctgcctaggcgccatagctagctagctactacctttatgatcgaggtgcggtcattactgcggcgactgcgctgcgtcgcttggccgccggcactccggccggtggtgcgtccgttgttgccatcaccggcgggggcgcgcgcgctggtcaggtctcgctctcgctcgcgcgcccgtgcatggcgaggtggaggagaagaatgcgaaggagaagagaggagcgtgttagtaatttttttactactattcccttctgcttccctttcttctctttttcccctgctagtatttttcccccccttcttctctcgtctgttctcgtggctgtttttttaccctcttgtattgattggcttgccaagcgaacagcaaggctattctgttgattgaaagagatagatatatgagtatagtgtttcttgtttgaatttcaatttgcttgtat

SEQ ID NO: 20733 - DNA, 589 bp, Sorghum bicolor
  Clone ID: 11921875
aggttgtagttggcagtttcattgctgaaggtaaaaagccaaaagaagagcaaccgaaacgcgagccaacatcggtgccaccacacacagctggctttggggcggcctcgactgccagccccccatcggatggtacatcaagcgagcactctgatgatccagggagccccatgggaccaaacggcagcacattcactaacgcggggcttcctctgcactccacatttgctccagctggttggtcactatcagggaaccaaagccgctatgatccagatctaaagatgatgaccgactgatgggtgccgtttcgcagcttccttgttagcagttgacctagttgagtaggctcaggacttcctgcaccggctccagtggcgcggcatctgacaataattgaggaatcctgagagtgataaagccttcaggaatgagtagatcacgagtaataagtagtaccagtgcatgcctttgccttgttatgttgtagttagtaaaagtttgtatttgtgtggtttcactgtcaggagtctatgcagcattccttctggtttctacctgatcagcgtaggcaacgattctcttatca

SEQ ID NO: 20734 - DNA, 469 bp, Sorghum bicolor
  Clone ID: 11921896
gcttcagctgtgaggtccagagcttgacgccgctggtgacctgcatcctgcgaaggctcggcggcgacatcgacccagaccgactaccgcaaatcctgtacgaagacgaggaccaggacaaagtggtgctggcgtcggacgacgacctcatagcggcggtggaccacgccaggctcgccggatggaagggtctgaagctgttcctggactactccggcaccaccggccgtaggaaagcggtggcctcctccagcggcggcgccatggccgtgggcatgtcgagccgggacgcgtgggcggccgcctacagcggggtcgctgccggggctgcgcttgtcactgggatcggtgtcatggcgtatctgcgaagatccgcctagctagctagcagaaccaccaagggattgttcctagctgtcttggggtcacttaaggcagtacatatatggattaaccaaaccagtgtctc

SEQ ID NO: 20735 - DNA, 481 bp, Sorghum bicolor
  Clone ID: 11921947
catctcctcgctctgactgtatgcatgagcagcatctggcctatactctcaggtgtggcagtaggagctgggtggcaagtgcctgtggcattcataaacgtcggttgctactacctagtgggcattccaatgggtatcctgtttggcttcaagctaaaacatggcacaatgggaatatggataggcatgttgacaggcacgtttctccaaatgtctatacttctcgccattatcttcacaacaaagtgggataaacaggcggcgctggcagaagtgagaatggcggagtggggaggaaagaacgagaacctgccactgatggaaacaacacatacggctgataatcatatggctcctgcacaagagaaaatcttggcgcatgacagccagaagaacgtagaattagtgcgcacagattgatcacggaacatatatattggtttcagttctagaaaatatttcattatttactataggatga

SEQ ID NO: 20736 - DNA, 455 bp, Sorghum bicolor
  Clone ID: 11921962
gcgtcgccggagaacgcggccatctacaaccagaacctcatcaaccacgtcggccggggaacgccgcgccacccgggcgccatcgagacgatcctcttctccatgttcaacgagaacctcaaggagaacggcgtggagcagaactgggggctcttctaccccaacatgcagcgcgtctaccccatcagcttcaactgacgaagctagctcgatggatcgacatccacacgtacactctacccaccgtatcgtatatccgtacgtacgtcaataagtatgtatccgtatgcgtcccagcaggtgattatgtattgtatgtacacctacaaagggattgctagctttcgcgaccactgggagtgtcgaatgctactctcagatgagtatgccatgcatagaggccggattctttgcgtcgagaagtccacgcatggtcatcagcgacgtgtaagtgg

SEQ ID NO: 20737 - DNA, 598 bp, Sorghum bicolor
  Clone ID: 11921967
ctggttctacgcgcacgtctccgtgcagggggtcgggttcgtgctcggcgccgtcggtgtcgccgcagggttcaagctccgcgacgacgtgcccggcgccgacagccaccaggcgctcggcgtcgccgtcctcgtcttcggctgcctccaggtgctggcgttcctggcgcggccggacaaggggtccaaggtgaggcggtactggaactggtaccaccactacgtcggccgcgccgcggtggcctgcgccgttgccaacgtcttcatcgggctgtccatcgcgcacgaggccaccgcgctcagcgcgttctacggcgtcttcctcgcggtcggcgtcctcgcctcggttgttcttgaggtcaggctctggaggaccgccagatccagccattgattgatgattgttgaattcggcggcgcgcgcgtctgtctgggtgcgtgaggcgccgattcacgtacatcgtatagtaccattctctgtgctacatatataccgtaaaccgtactgagctacatagtgtctttaggtgtttgtatgagcgtagatgatttgtcttcgttgagagatatttattcaggtcgtttctccgttatttaa

SEQ ID NO: 20738 - DNA, 648 bp, Sorghum bicolor
  unsure (1)..(648): unsure at all n locations
  Clone ID: 11921968
cgccagcatcatgacgctgctgtcggcagcgtccccggcgcggagcctcgtcatctgccccgaccgcngcagcaacatcgcgcggttcatcaacggcatcaacaaccacacgccggaggggaggaagaagcagaacctcaagtgcgtgcggttcgacgtcggcggcgagtgccgcgtgctgctggtggccaacagggacatctccaagggggagaggctctactacgactacaatggctcggagcacgagtacccaacgcaccatttcgtgtgacggttgtgaccacagcaccaagagcggcaaggcgaggcgatcggagtctgccattgcagctccagctctgatctcactaccaaaattggaccttcgaactggccattggggaaagggattgtaatgtcagaggtttcctgttgtacaacattctagatggcttttggatgaaccagcatcatcagtgttttgggccagtttgaattagctaaggctagttaatagttgaagctataagtcagcctaaattagctaaggttagctggctagttggctaacaactgagtagttgttattcccttgtttagatggattagagctaaaattagctctatgcatccaatcaggccttataaagcaaggcaaaggccaac

SEQ ID NO: 20739 - DNA, 608 bp, Sorghum bicolor
  Clone ID: 11921981
tgccacctttgccaacttcggctccgggtaccggcagcggccagcagcgcggtggtcaacttcggcttcgagcggcggcacgagcttgtggccgtgcgtatgttgcggcctgcaggtgcggcacacaggtgcatgctgcgcgtgcgcggccatcaggtgttgtgcccctacaggctcatgagcaggcagctacaggacgccttccttaagatcaggctgacacctcatcagcgaaggataggaggtgtgaggccatcaagcatcaaaatgaacatatgcagcaaccatgtgtagcagctaacacaaggaagtcgaatgcaataggagtaccatgtgcagtagttaacataagaaggtttaatgtagcaatatgcgtatctataggagtggtgcatatagtatatatctatgttaactagtaagagcaacatctggtagtaagatgtgtagtaagaacattagtcatttacatgtctaagttagtatcagatctgctaatgcagtaggaactgcaatactatataattgcttatgcaaaagagctagattgcttatgtaaaatgactgaattgcttatgcaaaagtaattaattactcataagttagga

SEQ ID NO: 20740 - DNA, 530 bp, Sorghum bicolor
  Clone ID: 11921983
cttccttcaccttgacagtaaactggtgcatggtcccggccaccacctgatacctcaccttcaccgacctcacaaactttagtatcgcgttctgcacatatattatacatgtgatgcatcatcagtggtggctccaatgatctcaacttgaaggtgtgaaggtggtggtttatgcagagggacatgtcttacggtcttgccgttgtgctctgcgtttgtgaagcacacgagcttgatggcctcgaggcttttctcgcaccctgggagtgtgtcctggacgtcgtccaccatccccacaggccattcgtcttggccatggctgctggagttgagcagctgtgcagtgggagaaagaggaagctgcagtgagacgagacagatgacagcggcgtctcctgcttttagtagtagagcagcaacaaatattgttccatgaagccagatcagcataagtctggagtggaggacggccaggttttaacttctaagtagatgtgtaatttattgcatgtttattcaattcaatttca

SEQ ID NO: 20741 - DNA, 658 bp, Sorghum bicolor
  Clone ID: 11921985
agcacaatcttcagataaccagtgcctggcattgatgacggagctgagggagatgcaggagagagtggagaaccggcggaggtacgaggaatcaggcagggctttcatgctggccggcctgagctcacactcatggcagagagcaactgcacgtggggactcaacagagatcactaccactattcatacctatcagacgccaaccatggttgacatgctgcagcgctctcagattctcgtggcacccactgctgacatgctgaaccgctccccaactgtggcgccttcacagaggtctccacataggttcagccggtcatccaggtccaggacaacaaaatccttctctgagcaactcctgtgatgcatcctgatcatgacgcaggtctagctataactgtcaaaatattaggtgaatgtaatctgttcatttttttagtttattcctacagctgatacttccattttcagtattctatagcagacatgggcctagaagtcctggggtataaattggtttggtgtacatggttggaatttagaaaggatttgttctgtaaataaacttgtcccttgaattctggtcaataagcacaagctagctttgggggtgaaatcatttgggtatatttcttttgggcccatataaaacagtctg

SEQ ID NO: 20742 - DNA, 661 bp, Sorghum bicolor
  Clone ID: 11921991
gccgcttctcacttgttgcagctgccgcggtgtgcgtcctccgtctagctctgctgcaggcgcctgcgctgtggtgggcttcttgctgctgctgcgtgcgccctctgtccagctccgccacaagtgttctcttcctccctgtcaaactccactgctgctagtagtgctcgttgatggatgatgacaactaaacagtacgtatgaggtttcccatgtgcagatgagcaagcttggggagcagcacaatattcagtactgggaataactgtaggggttacttcagtatcgccaggaacaaaaaagggctactgcaggtagaaaaacctattttcttctggattaagggctactgttttgttctcagtattgcagtggcctacagcagctggtgcatccgtgagtgctactggacctgctggctaggagaataatttcgccatgtccaggggcactgataaaatcctctgaagtctgaactgaagcccccccaagatcttggttcgtggtggcttggctgcatggaccgagctgcaaccgcaccagaactgtgacagcaactcagtggctacgtagacacaagcaaggggactatcagcaatatttgctaggaattgctgataaagcagtttagtgaaccatatgtaatttaatgtgatgtgat

SEQ ID NO: 20743 - DNA, 526 bp, Sorghum bicolor
  Clone ID: 11922002
gcaccgccgacgtcgacaacagcgggaagacagacgcggagacagccccgcggccgcagctggcgccgacggcgccggtgctggtggcggtgccagtgccggtgacggagaagatgggcgggtacgacgtggcgtaccccgaccgcggcacggtgatctcgcgctacaaggagaagcggaagaacaggaggttcgacaagcagatccggtacgagtcgcgcaaggcgcgcgccgacggccgaatgcggatcaaggggaggttcgccaagtccggcggcgaggtctgagacgcgcgcacgcatgcggcgctcactctcgatcggtcgtacgtcgtcgacggcaacaacgaacgcctagtgaccggccggagcaggggaccgcgacacagcgcggcatgtgtttctcgttggttgtttggttggtgtcgccggtcacgagcacgcactgtgcttccgtgcagctgaaataaataaataaataaataataaatcaactactcgtgctgcactactgtactgtactgtac

SEQ ID NO: 20744 - DNA, 210 bp, Sorghum bicolor
  Clone ID: 11922005
aagctcaagagattgggtactgtgcaggacatggctgcggctgccgcattcctggcatctgacgatgcatcatacattacggctgaaacaattgttgttgctggagggacacagtctaggctgtaaatctggttgaagtattgacttggctgctaataatgtgtattggtgccgattgccgttaggccaaggcacttagatggtatagca

SEQ ID NO: 20745 - DNA, 709 bp, Sorghum bicolor
  Clone ID: 11922007
tcatggcgaagggaaaggaggagcttcccaacgcgaaatgcaaggaggaggaagctgacgcctctgtcgatgccgctaatggcgacggtgacgctgacagtgcgccgacgaacgcgccaaagaccgggttggggctgaagctggacgccgacgaggtgctcaaggcgtggtccgacaaagggtccatgtttgccgagggcagcgggccggagtcgccgacgtcggccgccgaagtgcgggctaagcttgcagacatcgacctgtttccagagaatggagctggtggtggcatcagggaagccagtgtgctgcggtacaaggagaagaggcgcacccggctcttctccaagaagatccggtaccaagtgcgcaaggtgaatgccgactgccggcctcggatgaagggaaggtttgttaggagcccatctcttcttcagcaagccctggaggaagagagctagctagacagacagtgatctttgctggccttttctcttttttttttatcagaacctttttggccttttagttcatcattagctaagagatgcgagtgagaaatttaccccgttttgtttttcatcggagtttttgctctggagaggagaggagaggataggatgccatagatcggattgtcatgtcatggtggtcaaatagtttgtctcaggtttacaatgtcaggtaaaggaaggaaataaagagatgt

SEQ ID NO: 20746 - DNA, 575 bp, Sorghum bicolor
  Clone ID: 11922009
gacacctccagcagcggcagtggcagcggcagcgtggggctgctggagtcgatgctgatcggcgacgaacacctgatgctccggcctaacccgagcatggtcaaggtcccctccatgcccgcgctctcctaccgcgagccggccggatccaggctgctgcccgcccacggcgttggcagcgacggcgacgtcacctcgcacgcgcacgcgctctgccctccgggagaggacatccaccatggcgcgacatgggacttcaccttcgaggccgtgaagccggcgaagaggaggacggcgagcgaggtggggatctccgacatgttcgccatcgccccggcgggggattggttcggcacctgcggcgggtcgacggggccgtcgtcggccgtcaccgacgacgagttcaacctggagatgcagcagttcatgtcattgctaccactgtccatcgacgagcacggctgcaacgcataaatgcggccgggtaaaaaaaatggaaatcggaaactgtgtagagagcgtgtgtttatttgcttccgcgacgagaacagtgtacgcattgtttttgtaatgag

SEQ ID NO: 20747 - DNA, 449 bp, Sorghum bicolor
  Clone ID: 11922092
ctggccgccgccgcccgtccaccgtcctccgccgcgccgccgccaagcctgggccgtctgcgagggcttcagatggccctctgatcctcgtcttcttcacctcgatctccaccatgaaggtcaataccaaggtcaagctggagcccccaaagcaggccatggcgccgtcgcggtccctgccgcagagcgccagcgagctcgccgacccgccgtcgccgttcagctccaacccggcgcaccagccggtgaccgtgcccaacacgcccgggctgtcgtcgtgctcgtcgttcggccgcatgctgtcgtccccgcccaacgacaagcagcagcagcagcagcagggcaagcccaagccgactgcggcggcggccgccgccgcgtactacgcgtcgctgtggtcgcccatgcgcctcatgcagcgcgccgcccgcgcgttccgacgcagcagg

SEQ ID NO: 20748 - DNA, 465 bp, Sorghum bicolor
  Clone ID: 11922114
gcacgaggaggaggtggtgccgaggatgagctgcaacgggtgccgcgtgctgcgtaaggggtgcagcgacgcgtgcgtgctgcggccgtgcctgcaggggatcgacggcgccgaggcgcagggccacgccaccgtcttcgtcgccaagttcttcggccgcgccggcctcatgtctttcctcaccgccgtccccgagacacagcgcccagcggtgttccagtcgttgctgtacgaggcggccgggaggacgatcaacccggtgagcggcgccgtgggcctgctcggcgtggggagctggcagacgtgccaggcagcggtggagacggtgctgcggggcggcgccatcggcccgcttcccgagttcgacgtgggccgcgacacgttcgctctggcggcgaggcgggccgtggggtgctcgacgttctcgacggcgaagcgtgcgccgacgacgacgaggacgaacgt

SEQ ID NO: 20749 - DNA, 486 bp, Sorghum bicolor
  Clone ID: 11922135
gcacgaggatccctccctatatggatacctcagatgtgtgcctacaaaataaccagggaatagactgatcgagacgaggtgactcacaaacacagacgaatatgcttccgcactagtagcaaaagcagtcgttgtagtttcgccagcaccacccacctgtgatggcacggagaaagaagcatgacccgggaagatgaactgacttctggattagcgggactggggaagcggacgtagaaagccttttctcccggtaggtcggtcagtatgtccttccctaccctaccagcatgaaatgacagatggtggagccacacattggccgatgtcttgagcagcaaataatggtttattgggcagcgaggcgagggtctttcctttagaatttaggcattattttgccccttgcttccgaaaaaatagtcaagaaacacttttttcgagtctcctctcatctctttccttttatgatgtgttagtgtgtgt

SEQ ID NO: 20750 - DNA, 102 bp, Sorghum bicolor
  Clone ID: 11922138
ccaaggacaagctggaggtggctgacgacaacaacaaggtggtgtcgtacaccgtggtggacggcaagctggttgacttctacaagaactttaagatcacgc

SEQ ID NO: 20751 - DNA, 553 bp, Sorghum bicolor
  Clone ID: 11922157
ttgggagatgcagttagatgcaaaatgctatctccaaagtggtcaaagggttactaccgggaaggacaagctctgatacttcttaaggagtatgaaaaagcttgtgacacactctctgaaggcttagagctgaaccctatgtgtgatgagctcgataaattatattgggaggcaatggatctgaagaatagcagcactggagcagcttagaaaaagcctgcaagaaaattggatcgccgtttccctttttggttgatgttcttgggaatacgaagaaacactcatcagtagtctttagttttgctggttgtactgtattcagcacatcagcatttgcctgtactttgaattggtggcgctctgcttggagtcctttctgaggttgggagaagcgtgtgatacctggagaatagcttagcttagatcgaggtactggactactggtttcaagtaacttttacatgttaccagagtggcatacgcacactgttttggccattttgcgtgcttgaagcacgacacgaccacagctgtgaagcgtttttatgggctg

SEQ ID NO: 20752 - DNA, 482 bp, Sorghum bicolor
  Clone ID: 11922159
ctcttcaatcatatcagaaaatatagacatcatgcatctttgaaaagaagctggtgcattacataacccgaaagacattctacgataagcataagttccataagggcatgtaaaagtggttttgctttgatcatcgggatggatcgggatttgatgataccctgaatatccatctaaaaaacaaaagaacgaatggtttgctaaccgctctagcatctcatctataaaaggtaaaggaaagtgatcctttctcgtggctttatttagttttctgtagtctatgcacatccgccatcctgtgatggtgcgttgcggaattagctcattcttttcattcataataactgtcatgcctccctttttgggcacaacttgtactgggctcacccactcactgtgcggcacaggatatataatccctgcatgcagcaactttataacttcctttttaactacctctctcatagtgttgttaagtctac

SEQ ID NO: 20753 - DNA, 542 bp, Sorghum bicolor
  Clone ID: 11922172
tgcgccgcggtgtccgagattgccccggccgcctcagccgcctacggcgtcctcctcctgggcggcggcgccttcgcatatgcgaggtcggggagtaaaggctccatctacggaggactggctggagctgcgctcatgggcgctgcctattatctgatgcagtcgcctgagacgatggcagcaggtgatgctgttggatttggatctgcctttttatttgcctgcgtgtttggtatcaggttgtacaatagccggaaactggtgccatctggccttcttctagccctttctcttggtgccttgggtgtcttttactctgcttacttgcaagacaaggtgtaaaccaatttgatttagtagttgaagaatatgtatcatctgaagcttccttgaaggcttactctgttgggttgtagatgtagaactttgcatcagctgttggtgcaccttcctttcgttgtagttgtaacaaagagcatctagtgttctgtattggttgccaacgataagtttcttcaagcttttcagtggccattggtttt

SEQ ID NO: 20754 - DNA, 596 bp, Sorghum bicolor
  unsure (1)..(596): unsure at all n locations
  Clone ID: 11922190
tccacaccctgatcttgccgtcctggtggcccgtgaagatgcgctcgccggagatgacgatggccttcacgaggccgctggaggacttgaacccaccggagtccttctgcttgcgccagacgcggatgttcttgctgtcggagccggtgtagagcgtgtcgcccttggcggcgagcgagtagatgtggccttcctccctcaccagcgagctgatgaggctcgtcccgggcgccatcgtgggagcggctcctccgagcccggcggcggacgcctcgctgtggtgcgaccagggggacgccatggtctggttccagggggacatgttgtacggcgagcactcgccgctgaagctggacgggtagtcggagtagtacccggggctcgcgccgccggtggcagaggagctgctgttccggttcgacgactcatcgtccgtcccacccgagtactggaggttcgggtcggactgtggagcaggaagtgggagattggacgggtgcgagcgggcgacgccaccgccggcgccctcgccgtcgctgtctttcatctgtctcctgccggaggcggccgtggtggatcggaggggggggncccgg

SEQ ID NO: 20755 - DNA, 231 bp, Sorghum bicolor
  Clone ID: 11922213
gcacgaggatccccagccgcaccggatccaacctcgcgctcttcgacctcgccccctcgccatccgccgcatcctcctcccacgaaggcgggcccgcggtctcgtctggatctgcgaccgccgcgtcgccctactgcgcgctcctccgcgccgcgctcttcgggcccgacacgcccgaccgggtcgcgtcctcggccaccgcgtgctcgtcgtcctcctccccggggccct

SEQ ID NO: 20756 - DNA, 307 bp, Sorghum bicolor
  unsure (1)..(307): unsure at all n locations
  Clone ID: 11922233
gcacgaggcaatagttaccccaccaaggatacgagatttaggcagagcgacaatgaaatttcccctttgcacgaagcgctaaggggtaaaacaaccatgccaactctttctagcagtgaacctaatgaccatgctcactccttcaagagctactacaataatagtgaagcaataccacaccaactccactcagtttctactcccataccaccaactagcatcattgcatnnnnnnnnctggagcaaagcttgaagaaagagcaagagcttatgcgcatgtttctgacaactcctgtaagtgaggatg

SEQ ID NO: 20757 - DNA, 271 bp, Sorghum bicolor
  unsure (1)..(271): unsure at all n locations
  Clone ID: 11922237
gcacgagggctcggtggattccacgaatccgagcacgaactcgacaggggagttctcatggaaaaggctgcaggggattaaggaagaggctgaaagggcggtggagataataagactataagagcgagctgggccccttcccttgatgatgccgtcaagaaaccgcgtggaggggagcgcgatgagatgagggatgctggccgcggtgatggactacttganctcctgctggggcccacgatcgcgtgccgggcaccggggcaagggctcc

SEQ ID NO: 20758 - DNA, 443 bp, Sorghum bicolor
  Clone ID: 11922262
gcacgaggcttctgcctctcacaaagatcaatggggatccgttcccccactggcctcctctgtctcatgttactcatccagcttggtcttggacttggagaggctgctacagtctcgaacggcaccactgacggcaaggagcgttggggatacgtagaaattcgtccgaaggcgaacctcttctggtggttctaccagagctcgcagcgggtgtcgacgccagaacatccatggccaaccatcttgtggctgcaaggtggcccgggagaatcgggcatcgggagcggcaacttccaagggatcggaccacttgatgtagacctcaagccacgcaacccgacgtggctgcagaaagctgacctcatatttgtggacaacccggtgggcgttgggtacagctacgtggaggacgagagtgcgttagtaaagaccgacttggaggc

SEQ ID NO: 20759 - DNA, 463 bp, Sorghum bicolor
  Clone ID: 11922273
cgagaacctcacagctaccctgcagctccgatcttttaccccgctttgactccactctaccgcactccagcccagcacagccccctgttgtctcccactgcaagaatccggccggccggctaccacctccagtccccctcctcctgctcctcccaacgcctctgctagtgctatagctagctcgatccacacgtcaccgccgtgcccacgcgcctcagcttgttcgttaagcttgccggccgcccggcgcccggcgtcctcattcatcgggcgtcacacaccgggcaccgtccgctgctgcgagctcgcgcgctgggcctggcggcgcgtcggcgcgtgcccgaagcatgaggaggcggtggtcccgcgccacggtgctcgcgtgcttactgctcctcgcggccgccgcgtgcgtcgccgagtcgcgcgcggtgcccgccgacgggaccgggaccggaaacgc

SEQ ID NO: 20760 - DNA, 475 bp, Sorghum bicolor
  Clone ID: 11922283
tttgtaacactagtgacatcaataactatgtactctggatccgaccctgcaattgaccagagaggccttgcaactatcagcaatctcttttgagttgcattgtgctctaataaaatttctagaaagttaactaccatatactagcattcatctgcttaacttgcatatttccattatttttctcttggctattacatgtttacatttgtctgcattcttgcttttttatatataaaggtataccctgctttttaggaaagcacatatatggtagctgttgcctgctttctttgtcaacttggttttagacgatatcataaaatggctatttgtttaaagttttcatctcatctaggcaggatcaaacagggaacttaggaccgcatattcattggtgcctctgagcgcaaactgaaagagcatgtcacaatattttcatcttaatgtagtaacaatcatatggaatcatccattg

SEQ ID NO: 20761 - DNA, 432 bp, Sorghum bicolor
  Clone ID: 11922295
gcacgaggctctctccagcagcaccacagcactcccctcgcattgttcttgatcccatccttccatccagtactacgattctcgctccctctccaagatcaatcaaaggtcggagaagaaggaattcagggttagggagccagccatggggtgcttttcatgctgctgcgtggccgatgacgacgacattggcaggaggaagaagcatgacgatgcctacgttcctatccctgctcaagttgataactttggacctagccggcccccagccccaatccctgtcatccccacaggcagagatcagccaattgcagtaccgcccattcatctggaagagttgaaggaaattacaaagaacttcagcagtgatgccctcattggtgagggctcgtatgccagagtctatttcggtgtgctgaaagatgggacgaa

SEQ ID NO: 20762 - DNA, 471 bp, Sorghum bicolor
  Clone ID: 11922299
gcacgagggaactggagactaggataaggaatcagctccggaggccccagttgccaccttctttgtacgacacagcctgggtttctatggtgccaatgcggggctctcatcatactccctgcttcccacagtgtgttgagtggatactgcagaaccagcaggatgatggatcttggggtgtcagccaatctggctcagaagtcaacaaggatgttctcctgtccacgttggcatgtgttcttgcgttgaagagatggaatgttggcagagagaacatgtggagaggactgcatttcattgggcggaacttctatgttgctatggacgagcaggtcgctgctcctgtaggtttcaacatcacttttcctggtttacttagcctcgccattgatatgggtttagaaattcctataagacaaactgatgtctgtgggattcttcacctccgtgagatggaattgaaaagacagg

SEQ ID NO: 20763 - DNA, 440 bp, Sorghum bicolor
  Clone ID: 11922307
gcacgaggcgcgatcattggccccgtccgtccgccccaagcaatggtcggcggcatgtcaccgccgcggcggacgctgtcgatggggagcggcggcgccatggggcgccgcgtggctgccgccgctgccgctgccgccgtgatgagcgacagccccaagcccgtgctgtcccgatcgatgaccatgggcggcgagcgcacggtgaagaggctgcggctgtcccgggcgctgacggtcccggagagcaccaccgtgctggaggtgtgccgccggatggccgcgcgcagggccgacgccgcactgctcacggactccaacgcgctgctctgcggcatcctcaccgacaaggatatcgctacgagggtgatcgcgcgcgagctcaagatcgacgagacgccggtgtggaaggtgatgacgaggcaccccatcttcgtcatctc

SEQ ID NO: 20764 - DNA, 494 bp, Sorghum bicolor
  unsure (1)..(494): unsure at all n locations
  Clone ID: 11922335
gcacgaggcccatttgcagagactcttggcagtaagtataggaaaacatggcttcggcttgtccatcgtactttggagcttgcaggtcctgcgtttatcaaatggggccaatgggctgcaacacgccctgatctgtttccaagtgacctttgtactgaattgtcaaagctgcacacaaaagcaccagctcacagctttaagtataccaagaaaactgttgagaaagcttttggtcgtaagctatcagacatttttgagaattttgaagagaaccctgttgcatctggaagtgttgctcaagtgcatcgggctgttttacgattccggtatcctaatcagcagacaaagcgtgtaacagttgcagtaaaagtaagacatcctggtgtaggagactcgataagaagggatttcaatatcatcaatgccgtagcaaaaatttctagatacatccccacgctgaattggttgcgcttanatgaaagtgtacaacagtt

SEQ ID NO: 20765 - DNA, 457 bp, Sorghum bicolor
  Clone ID: 11922342
cgggtacgacgagaaggcggcggcggccgggaacggagggtggtggcctgcctccgcctgggaggatccccaggtgctccgcttggaggacgtgatcgttcccaccacctcttgccatggcctccagccgctcctcacgccgccgtccccagagaaccggagctccggcggtgagatggccgacgaggttgtccggcagctgggggagctcgccaagttggaggcgactgtggcggcggcttacgcggagatggagccggctgacggcgagcagctgcctccgtgggcgtcgccggagcttgccattggacacgccgacttcggggctctcgacgctggcgccgcctggcatgatgcagcaaccatcgcagcagtgccttccactgaggagcaggaagcgtggatcgcggccggctgcgacgtcgacgcggcgggccggacggacgaggaggcgcgc

SEQ ID NO: 20766 - DNA, 138 bp, Sorghum bicolor
  Clone ID: 11922346
gcacgagggcgatggatgtcaagtgccggcgtctggaggggaaggtggccgtcgtgacggcgtccacgcaggggatcggcctcgccatcgccgagcgcctcggcctggagggcgccgccgtcgtcatctcctcccgca

SEQ ID NO: 20767 - DNA, 496 bp, Sorghum bicolor
  Clone ID: 11922348
gcacgaggctcccccaaccatctccaattccccatactcctctctgtctctctctctctctctctctcaacaatctctctctctctctcatcctccaaaggatccaagaagtaccattgctgctctccccattcgtcctcaatcccaacacagcttctcaactcagctcagggaattcccctgcttttttttttaattcttgtgctcttggctgcttcttcactctgcttctcctcctcttcttgccacagaggaggagtgcatgtgcagcagctgcaaagacatttactttttttttcacctcatcttcttccaaggtgttgttggtgccccttgggttcttgaattttttgggggagcttgatcgattaggttcagccatttcttgccccagtgttcttggattcatggttgtggaattaatccaagaatagctggagctgctcattttcccttccgacaagacgaggacgaagacgaaggcgatcgtttgaga

SEQ ID NO: 20768 - DNA, 560 bp, Sorghum bicolor
  Clone ID: 11922382
tggaattcatgaagcaaaaacagattcaattgaaccaaaaggcttattttgagataatatcttcatgcaccatgctacgggactggaaaacagcaagtcaaataatcgaacatttggattcctctctctcatcgatttcttttggcacactaaaccatattttaaattttcttggaaaatgtggcaggacagagagcatgatgaagctgttctataagatggtgactgcatgctctactgtgggcctttctacttatacgattctgttgagaaatctcttagttgtggggaaatggagaaagtatgttgaggttttgcagtggatggaagatgctggaatctgtccaacactctatatgtatcaaaatgtgcttccatatatctggagagacaacagcatggactatgttactctcatgcaagaaaaaataaatgcattgagagagaaggtaacatgagcttcagatatgcatttgcttgcttggtatcaagtactcgaagtccataaccgagtactggacagcttcagagagaagtagcttcagaatgacactagcaac

SEQ ID NO: 20769 - DNA, 379 bp, Sorghum bicolor
  Clone ID: 11922407
gcacgagggggacgactccagcgcaagcgacgtgcagtgcagcgtagtatttaccatggctctaaaccaacatttggcgtctataaatgcaggtcccccgggaccgggccgggagcgaccattgaggccggccggggactacggcgggtgagagagtgcgacccaccagcagcgagaagttactctcctagctgtctctgccgtgtagtgccgatgggtgccggagccagggacgaggaggctgctgctgccggtgccggtgcccaccatgggagcttggccatggagaagccgcagcatggcgcggcggagtacgcgcaggacgggtccgtggacctgcgcggcaaccccgtgctccgctcccagcgcggcggctgga

SEQ ID NO: 20770 - DNA, 417 bp, Sorghum bicolor
  Clone ID: 11922414
cctcagaccactccgctccctccccgagctccgtccgatccgccgcccacggcccaccccatcgtgccggcatcgcgcgcagggaggaccggccggccggcccacccgcccgccagcctgccgccatgccgggctcgcccaaggtcttcttcgcctcctccgcctcgcgccgcggcggggcgctgcggcggctgctctccacgccggccttctccgcggcctgcctcctcttcggcctcgccggcttcctcgccgccgcgctcacgctctcgcgctccccgtccgtcactcacagccgctgcccggattcctcgcgcccgctctccgtctccgtcgcgtgggatcgccgcccgggggatggctccgccgcgggctccgcggagctcccggcctcgctcgccaccggatcgcgcggcc

SEQ ID NO: 20771 - DNA, 523 bp, Sorghum bicolor
  Clone ID: 11922426
tccggatggctcggagcttcgcctgacggagtccttgggtgtgaaccggacggcgggatcctagaagtcaagtgtccgttcaacaagggcaagcccgagctcgctctgccttggcgcgccatgccgtactactacatgccgcaggtgcagggcctgatggaaatcatgggcagggactgggtggagctctactgctggacgcccaacgggagcagcctgttcctggtgccacgggaccgtgcatactgggcgctcatccatgaggtgctgcgcgacttctggtggggcgacgtgatgcctgcgcgggagctggcgctcctgggcaaggaagacgaggcgagatccttcaagcctcagcccaagcaccggctcacgaacctggtgctgtataggagcaggaagctggcctccgaggccaagcatattgtgtatggatgttggcggccatgtagaattcttcaaatgagatgttctgccgtcgattgtacactgtgttatgactattctttaaattgattacctc

SEQ ID NO: 20772 - DNA, 372 bp, Sorghum bicolor
  Clone ID: 11922439
ctacccgtcaatgggcccgctactatggaggaggtggtctctcgcttgggacgcctgtgatttgcctgccacccccaacaacaaccccttttttgttaagtccagcagtgataaatgtttccttcccccaacagcccgaaacactcaccactttggccaccattgttgctgcttcatgtgcttcgtcgattaaaatcgactttgatttcatcagtcgattgaagaaaaggatttccgtctttaattaatgtgatgcaataatggtgtcaacagacaatagacttgtgcctgaaatttttataaaacacgaaagtaaacattgcacaagcagctttaaattaaagagatgaaataacatattgatgccctgtt

SEQ ID NO: 20773 - DNA, 526 bp, Sorghum bicolor
  Clone ID: 11922443
gctatgctccgccggagttctccaactcagagaacgccatggcgactgtaaagtccgacatttacagctttggtgtcgtgttgtttgaactggtcactggcaagaaaccattgggtgatgagtaccctgaccagaaggaggcgagcctggtgaactgggccagggcgatggtgaaagctaaccatgggccaagcatcatcgaccccaagatacgtgacacggggctggagcggcagatggaggaggcgctgaggattgcctatctgtgcactgcggaactgccatctaagaggccggccatgcagcagattgtcggtctcctcaaggacatcgagccaaaggtagaagagggggattgaagatctgaagaattgattacttgcagcgttttggatggtgttgaaatatgtgtagtgatagcgtaggcagtctgagtgagctcttggttgttttaccctagtggatgtcaccatgcgatgccctgctctgctgagcctgagatatatctttttcatctttttttttt

SEQ ID NO: 20774 - DNA, 205 bp, Sorghum bicolor
  Clone ID: 11922451
tctcagcctgttcccatggtttttggcatgaccggccgggcaacttattttttagtaaagttgctccatccttgtgttcccgcgctccatccaatgtgtatatcttatatttttttccgtgtcacatgaatgatatattatttgtagctcaacaaatacaattttttcccctttttgaggtataaagttttccggagtgaatggt

SEQ ID NO: 20775 - DNA, 491 bp, Sorghum bicolor
  Clone ID: 11922460
aattcgacggtaaatcaaaacatccattcgagcgctagcgctcaaatgtaggctcgggggctactgtccagggtatcggtaaggggtaccctcagcaatacgcattatgagattgcccgtatgaaggtcgagacccttaaattcgacgctccgatcttacgtgtgcgccgccatcgacggtcgcagcctcgaagacggaaatagtctcgagcgaatcggttcaggactcgagcgacgactgccatcgatgacgaaagcgggctcgagcgaactgagaggtgtcgggcgcgaggacactgtccgccgcccgacgcgcgcacgcgagccgaagcattaaatgcacctgacgcttccccacctaacacacaggtcacggaaggcgtgatagggagcaagcttctgtcccatcgttctttttgcagccttcccaccgaacgacccagggtgagtcaggacacaggaaacaaggatggaacgtataatcgggacct

SEQ ID NO: 20776 - DNA, 149 bp, Sorghum bicolor
  Clone ID: 11922470
cttcatggtgcaagcatccgtaaatcaagccggccccatcgacaattttttgacccccctttgggacccgttcaacaaaaaaatcattcacgcattttccttttcctaaggaattgtcccaactcccaaaaccttttttttccctgtcc

SEQ ID NO: 20777 - DNA, 192 bp, Sorghum bicolor
  Clone ID: 11922476
ctcatgctcgcccgcaacgtcagggaggactacttcgacgtcgaccacggcgggtacggggacgacggcgtcgccggcacggggatcgaagagaagtgatttttttttttcgtgcacgcggttcgcaacatgtagcgtcggcatatgtaacatgtaccatcacattacttgtatatgtatttcgccctgttt

SEQ ID NO: 20778 - DNA, 510 bp, Sorghum bicolor
  Clone ID: 11922481
gctggggattgcagagattaaagcggataccctttgatctaatgtcaatgatctcacgcatccctaacaagtcaaaatctccctcgataccctttgatcccctccttccgcctctagaggggattaaccaaacatggcctaactggtattctcccccagttaagccttgctctccatgcactcctgcgatgtctttagccatcaatgatcacatgcatacacaagttctgtacagccgtagatatcttgtggtacaacgatacaaactttttgggtttaggtattcaaagtactaactacaggcgagtgaataaccttttgggttcatgccttttgttgctactagccaattcgttgaagggcatgcttcttctgccttcttaaatatatgtatctaaagctttcttcatttgtaaatataactttttaacttgctaggcaaatcttagaacaagcttgaaacataaatatttggctttgttgagtaatatctatccattgtatatttgg

SEQ ID NO: 20779 - DNA, 455 bp, Sorghum bicolor
  Clone ID: 11922482
cagtgctcgacgacgaaccagcagctgctgaagggaacggccatggcaagctgccgacgagctgcgacacgagcccagcggtgaaggaaaagatcggcaagaggctgaggatcttccaggacatcacacagacagtgaacaatttttgattcgtttcggttttgttactcacaacaggcaggcttgaggtggcgatacagagaaggagaaagggcttgttttcctgggagctcctgcctggcaactaaattaatcagggattcaattcgattttaattttaatcagggatttaattaacaccccaaaataacagctgattcttttgttcgctttttcagcttgacactttaggaagcgtgtttttcctttgccacaaggctttccttgaaatagaagtggactgcatcttgttctaatttcgtttcttttgaaataacaaagttcatttgtgctt

SEQ ID NO: 20780 - DNA, 327 bp, Sorghum bicolor
  Clone ID: 11922498
ctgtcggactcgaagataagtccgccggccggaatcacgcgaccgcggcggctgtcggagacatacgaaggttcggcgtacgacatatttggcacgatggacgaccagaagggtgttgatttgggcgtgttctcgtcgatgccgaggttgcctgcccggcggcgggtggtccttcgcaaggttggcagcttgttcaggtggaagagcttcactaacaaatagccgctggctgggaaacagggcagtggcaactggttccttttttgctctcctaatcttgagggtgctcctggattcttgtgtggtgtatattactgtattggagta

SEQ ID NO: 20781 - DNA, 464 bp, Sorghum bicolor
  Clone ID: 11922511
cagtttgaattctaactgtcctgctaaatctttctcatttattcagttcggtggccttacacatgatttaataatcacatggtggtgaaatattatgcccttcgttaaacaaagctaacagtatacaaaaacaaattggcagcgcttcctagccattctgcatatcaaccagaccgagaaatgtagtcaagatctcgggtggctgagtgggtagatcaaaatgattggttcgctccatattgatttatggtgctggttccaaggccatcgatttttacaagcctgtgcttttttcagatgactggagagagaaatccgtggttctgaacttgtcatggctcttcctttcctaggtttttttcagccaggagaacagtatgatcacactcacagtagctttcagtagagaacgagataaaattgatcttcctgctctctgcattcatggttcagtttttttcaca

SEQ ID NO: 20782 - DNA, 587 bp, Sorghum bicolor
  Clone ID: 11922515
tccaacgaatggtttgtgcttgtgtctgagtcatgcattcctatatttgatttcaacacaacgtaccaatacttcctgaactcgagccaaagctttgtcatggctattgatgatcctggaccatatggacggggaaggtacaactggaatatgacccctgaggttgaacttgaccaatggcgcaaaggatcgcagtggtttgaagtaaacagggaacttgccattgaaattgtgaaggacacggtctattaccccaaattcaaggagttctgcaggcccagttgttattctgatgagcactatatccaaacaatgctctcgattgaaactccacagagcctggctaacaggagtgttacttgggtagactggtctagaattgctgcacatccagcaaggtttggcaggggtgatatcacggaagaattcttgagggaagtccgagagggacagacctgtctgtacaatgaacagaattcaacattgtgcttcttgtttgctcggaagtttgctccaagtgcattggggccattgttagagttagcacccactgtcttggttttggactaatgtatgttttttagaga

SEQ ID NO: 20783 - DNA, 533 bp, Sorghum bicolor
  Clone ID: 11922523
tgaagtatgaagaagctctggatgagttggagcggctaaaggagattgcgcctcatgagagtagtatgtttgcactgatgggaaagatttacaagcaactcaatattcttgacaaagctgttttctgctttggcattgccctggatttaaaacctcctgctgctgatcttgctataattaagtccgcaatggagaaagtacatctccctgatgaactgatggaggatgacctgtaagttcactcaagtacagtgagaaaggaacatttacttcgggttcatgatgttctgcttgcttcgtgttcctgacctgcttgggcttctccagtggaactcggatctcggagctgtaccattaaccatccagttttgtagatttagttgtagcctgtaatcagagaacacatgcgcagaagctgcagtagtttaggactctgtacaagttgagcgttggcaaaatgacgtctgtatcattatacagttgtgaggttaacaaaagaaatcgttgttaaataacggaaataatcaaaggat

SEQ ID NO: 20784 - DNA, 552 bp, Sorghum bicolor
  Clone ID: 11922532
ccatcgagagggccacggggtgcgtgccgctggtgcacgtcgacgacctctgccgcgccgagctgttcgtcgccgaggaggtatctgccgcggggaggtacatctgctgcagcatcaacacgaccatcgccgagctcgcgcgtttcctcgcggacaagtacccgcagtacgacgtgaaaacgagcctgctctccggcgagcggcttgagaagccgagagtgcgtctgtcgtccgagaagctggtgaaggaagggttcgagttcaggtacagaacgctggatgacatgtacgacgacatggtcgagtatggcaagaccctgggaatcctgcccagctgatatgagtacgtgatgctcctctatttcggccggcgatcaagactagggagtcagaacactcctgcaaaacaaagccaatgcttttgctgctagtgtgctgaaccgtagcagttgagtcagttcgtataagactagaagaatatccacacgctgccgcaggacttttctagaaataaatttgttatatgtataattttactatacggtacctggg

SEQ ID NO: 20785 - DNA, 585 bp, Sorghum bicolor
  Clone ID: 11922535
cggtgacagattgccacatacagctgctgatgcagaggcagaagatccctggtataagaagttgcccaaatacttgttgctgctggctgcacttgcagcggctgtcacttaccaagccgccatgagcccgcccggtgggctctggggctacggccaagctggccacatagctggtgatccggttcttcggagcacctatccacgccggtacaaggccttcttctactgcaacgcgacttccttcatggcctctctggtgattatggttttgctcctgatcaaaagagtgagcagcgcacagtcagcgatattggcgctgcatgctgccatgatcctggacttgtttggcctcatgggcgcctatgctgccgggagttgcaggagagtcaggacaagtgcttacatcttggcattggtggttggggtttccacatacatagttgttcttgttgttgtgtccataggtattgcaaaatggatgaaaagagtcatgtgtgggatgagagaacgcctgatccggtgcttctctgtagaagatttgtagagcctgatgcgaagaatttttaagggaagtcacaggtgtaa

SEQ ID NO: 20786 - DNA, 596 bp, Sorghum bicolor
  Clone ID: 11922536
gaatggaggtttcaattgcaagccttgcagagttagtcatgcttgctatggctataattgcgaacgatgtctcccattttggcttcttggcgattctgtctgtgtcatcagtcgctggggcagcatggatgttctgtcggtggttaacaaatccaacagatgagcagagggaactattcatgtttgatcccctttatcaagttcaggcagtatagtagatgaggcaggatgttccccaacacagccaggaaaactgcaggcgcctacttggctggtggtgcttgttggatctgcaatacccttatgatgatattaagttatgttgtgacatttaggttcaatacaaggtacacttaggatagaagcatttgctcaatacaagatacacttaggatagaagcatttgctcctcttagtctctctctctttttttaacgtaatggcaggagctctgctcctcttagtctcagccatgcgcagaattcaatttgtatactcattgatctcacccacctgtatagcacatatttgatctgtttaatcgttgcttgttatagttatagctgatgtagaacaacattaacagccaacagagc

SEQ ID NO: 20787 - DNA, 298 bp, Sorghum bicolor
  Clone ID: 11922555
aaaaacagtttcaccattaagctattttagaaatttgagtttagcaaaaaaaaaaaaaacaactctcaacaatgagctgtgccgaataaaccctaaacaaaattgttgcttttcttttcttttcttcccgtgtattcatagtgaggccggaccactgacccccaccttacatacatgatacataatatgtactctcatcactattatattatactagcaaatgtatatatgtgttgtaaagggagataaataaaatctttgtatatcaaaattatattaaaaatagaaatatgtatat

SEQ ID NO: 20788 - DNA, 706 bp, Sorghum bicolor
  Clone ID: 11922556
cgccgactccagcattgaaaaagtattcggtcgatactgggaccttgccaacacagaaattgatctcaatattgaggcacgagagtcaagggtcaactgcaatatacagctttctcagaatgaggagccaattggaggctcgttagctgacctgctaattatgatcgctcaaggggccatggaagaaaatctaaatgatctgaacatggcagggataagaggcttggaggaagcactaggcgacgctctagcagttatcaggaacaaactgacgatgaaggtgactgggtgcctgggtggccctgaacctgaagtatgcacgttctttcatcagcagtaaaaaggaagtttcagattgtatgatactagcatcttgctctgggtctactacggttgctgatttctctagcacgggcactacatgaactgatgaacatatattaactatgaaactagtaacaatcagtctgaaaattcgaagccatatgttcaaagagtggtgacttctgaggagaaaaactctctgttcatatggcttttcaattatgtctagctactagaactggctaagcctggatttggctttcttcaccagaaagaggtgaaatctttctgaagaataaagggggccgtcgttgactagcagcattgtgtaactcgtctgtggtcggacgtgttaagcttctagattcatcaagagggcatg

SEQ ID NO: 20789 - DNA, 334 bp, Sorghum bicolor
  unsure (1)..(334): unsure at all n locations
  Clone ID: 11922591
cgccgatngtatgccatctttgctctcgaatcttggcgatcccacattcccacggtgcttaaagaaatcctagccccgagctgccgcgctgcaggagcggacggcatccatggagaacgacgtgaaggaggcgaaggcgaggcaggggcagcagcagcacagggtgttcccgtgggggatgctcaaggtgttcctgctgctcggcttggggctgtccgcggccggcatgctcatggcgcggcacggccacgaggtggcggcggccacgctgttccggccgtggctgggggtctcacccgccgccgacgccgccgtcgcggcggcggcggcggcn

SEQ ID NO: 20790 - DNA, 392 bp, Sorghum bicolor
  unsure (1)..(392): unsure at all n locations
  Clone ID: 11922594
cnccngcggccttgagcttccacccggccgccttctcagtctcagctcacccacgagaggcagcagcagcgacgacgaagcagccgctccgccattgctcacctctcaggagcgtcgtccctagaagaacttgccttctcagggccaggtcctccaatgggcgcccgcagatcagtgcctcgttcggcaacagcaatgaggtgctagatgggatgccaacaggagatggtccaccggcaccggggcagggagggagcaccgtcagcatcaccgtcgttggcgcctccggcgaccttgccaagaagaagatcttcccggccctcttcgccttgttnnnnangactgccttccggagcattttacagtgtttggttatgcccgtagcaagatga

SEQ ID NO: 20791 - DNA, 344 bp, Sorghum bicolor
  Clone ID: 11922599
ctccacaacaatcagccatatgctgcataccacattttgaaagggaagaagatgccggagtcccggtacttgtttgctacatcatgttttcgaatgaacctcttgcgtgaagcagaagaaactctatgtccagtcaatgaaccaaacatggaggttccaagtggagcaacaggacactacctccttggagtgatttacaggtgcacaggcagaatttcagctgcagctgaacaatttacacaagcgttgactctagatcctcttttatgggcggcatatgaggaattgtgtatattaggtattgctgaagataccgatgagtgttttagtgaatcgactgctct

SEQ ID NO: 20792 - DNA, 207 bp, Sorghum bicolor
  unsure (1)..(207): unsure at all n locations
  Clone ID: 11922608
gnnnnagggccaccaaatcgacgacgacgggtctcagtgtcagtgctccctgccgagagcttgttgtgagccctgtttcgctttgtcacgcgagggaggtggtgaccggcgatcggcgtaagcgtaggctcgtagccagcaaagccaaaaatgtcggccggcgacatgaagaagactgcgtgcgtgaccggagggaacggctacatc

SEQ ID NO: 20793 - DNA, 387 bp, Sorghum bicolor
  unsure (1)..(387): unsure at all n locations
  Clone ID: 11922613
ccttcagattctggtgttcctgtgcaagcctgtgggggattggctcggcaatgtgcaaggaacactgcgaagattcctgaaactggaacaaattccaccgcaaggtgatgctgatgagcaggctcagggattatttgaccggcaaggaaatcttgacgccgatcagcttctgaagaagtctcgcatgtatctcctcctgctggggattcttgctgccagtgtcacataccaagcgggactgaacccgcctggcggcttctggcagagcaatgccactgatggtctgcatcactacctcgctggcgatccggtccttcacatcacctatccccggnnananctggttttcttctactgcaacgcgacagctttcgtcgcgtcgctggt

SEQ ID NO: 20794 - DNA, 452 bp, Sorghum bicolor
  unsure (1)..(452): unsure at all n locations
  Clone ID: 11922614
ctccggcctctcgctcgccccgcgcctccgcctcatcatcaagataaggctgcggcaggtgcaggcccatgcttccagaagcttccggagccttgcgccgagcctgaactccccggcggcccctgccactgtgaaggctgcatgagtagtcgcgccgccgccgccgccacaacagaggagccatggggatgctcgccgccgccgcagcagactccgctctcctcgcctcgccacaggcgtccctcgtccgccgccgccgccgcctctctggcgcgtgggcgctgcgcctgaggcccgctacctcccacggcgtcgcggcgctcagggtacannnnnttgtcccgaagtgttacgttacaaacgttgaggttgatgttagcactgtaaataaagaagaaactgtcgatgatcacccatcactgccatcagtatgctccattccggttgtcaat

SEQ ID NO: 20795 - DNA, 162 bp, Sorghum bicolor
  Clone ID: 11922636
gcaacgcaagcgagctcatcgccacttgcgaggctcttctcttctgttggctgcccacccacccagggccttggcaagatcgaaatggaggtgggggcggcggcgaggaggcgggcgcgggcggcgcatcagcaggaggagatcagggagagcaaggcgggg

SEQ ID NO: 20796 - DNA, 536 bp, Sorghum bicolor
  Clone ID: 11922648
gcacgaggctaaggagattacacgcatactggtttcccaccccatcaacgcaaagcgtgcagctgaggggaagaacatcgcgaatgttgtgctgttgcgaggctgtggtatccgaattgaggtgcctgcctttgaaaccaagcatggacttgcaccatgcatggttgctccaactaagatcatagctggcctggggctatcactggggattgatatccttgaagcacctggagcaactggagattatcgtactcacctaacttctaaagctaaagctatagccaaggcactctctgcccctatggatacaccacctcgtgtttttgtgcctggagaggatgaatataaagctggaagagaaaatggatatgactttgggttcctgcacataaaggccattggtgatgctggtcatgataaggctgtcaagttaaaggtacggggtctagaagctgttgatcgagctattggtcagcttgcaaggcttctttgggaagctgaaaaagccggacactaccagtactttctttgtgtca

SEQ ID NO: 20797 - DNA, 443 bp, Sorghum bicolor
  Clone ID: 11922658
gcacgaggcctggatgcccttacgatgaagatgctggtgcgccggagctgggaggagtcgaggctgctcttgcgccttgccttcccggcgctcctgacggaggtctttcagttctccatcggcttcgtcaccaccgccttcgtcggccacctcggcgaggtggagctcgccgccgtcagcgtcgtcgagaacatcttggattcctctgcctatggagtcctgtatggcatgggcagcgcgctggagacgctgagcgggcaagccgtgggcgcggggcagccggagaagctgggcgtgtacacgcagcagtcgtggatcatcagcgtggccacggcggtggcgctggcgccggcgtacgtcctcgcggcgccgctgctgcaccgctccctgcaccagccgggcgccgtgtcgcgcgccgcggggccgtacgcgcggtgggcggt

SEQ ID NO: 20798 - DNA, 604 bp, Sorghum bicolor
  Clone ID: 11922668
cagggtttgtgttgttttatttcagcttgcctattttaggatgataaaacataaaatatgcattagaagtaaggtcaggcataaattgtcatggtccctattttcctactcattgatgtatttattgattcgatttcagttacaagatgcaatatgtaggcaacaaagctgcactttaactcatcactctactgtcttccttcaggtctgcagcatggtgtcacgtgagatgctagctgcagctgaagcattggaatttttcattgaaaaagagagttttggagtcagaaatgttcaaacacagtgtactctgcttattttttccctgccctgttgctccccatgctatgttttccacctgaattgttagggaagcaaacttatactaaaataggtccaacaaggattgaatcaagataccaatttaatttcctcatgcaccttactcagtgcccatgagtcatgttataatttattctacaatgttagaatctatctgtgatgtgtgcagtggcagtttgatttcctatgcatggagtttacacatagcttcttttatttaagcaagcctgaacatactaagtagcagcagctgtggcactgt

SEQ ID NO: 20799 - DNA, 478 bp, Sorghum bicolor
  Clone ID: 11922672
gcacgaggcacagatatagtttttggagagacgtgtaagcatatccacaagatacatgagcctcttgaacacgcacacggggaggatctgagaacagagagaatggcaagccagagtgcagcctccatgttggctacggctgcattgcttctcggcgtctttgccaacatcgctccaaccgtggtggagtccatcggggtgtcctacggcatgagcggcgacaacctgccgccggcgagcagcgtgatcggcatgtacaaggacaacggcatctcgctgatgcggatctacgcgccggaccaggcggcgctccgggccgtgggcggcacgggcatccgcgtggtggtcggcgcgcccaacgacgtgctgtccagcctcgccgccagcccggccgcggccgcgtcgtgggtccgcaacaacatccaggcgtaccccaaggtctccttccgctgcgtctgcgtgggcaacgaggtgggcg

SEQ ID NO: 20800 - DNA, 400 bp, Sorghum bicolor
  Clone ID: 11922674
gcacgagggcgacacgcacaagcgcacagccacggtgagaagaagaagcccatccaccaggcaccagcacaagggacaaacgatccggagcggagttcagtccagtctcggtctaggtccatgggtgcgggaaaaggaggagacggcggcggcggtggcggcgaggcggccgcggcggcgcctgaggccgcgcagcccgtcgtgctgaagatggaactgcattgcgccggctgcgcgcacaaggtcaagaaggctattaagcgcgttcctggtgtcgagtcgatcgtgacggacgtcgcggcgaacagggtcgtcgtggcggggacggcagacgccggcgcgctcaaggcgcggctcgaggcgaagaccagcaagcccgtggaagtcgtctccgccggcg

SEQ ID NO: 20801 - DNA, 469 bp, Sorghum bicolor
  Clone ID: 11922677
gcacgagggcagcccacagccccagatcggacacgcctgacgcctgcagaccacgcaaccggcagagaggtgacagatcgtatactgacatgaagccgaggtcttcttgttctcccagtcccggcactagcagagcactggtcgtgctgctgctatgctgcttgtgcagctccgtcgcgatgtctcagactgccgactcgtgcaccagcaccagcaccaccaccggcctcgccgccgtcagccgcctcatccccttcgacacctccaacctcacctgcttcgacgcatggacctcccaaggcttcatcctgcgctacgggaagagcgggcagaacaacacgtggagcttcgtgctgtcggcgccggacggtggcggctacatctcggtggggttctcgtcggacgggtccatggtggggagcagcgcggtggccggctggacgaccggcggcagcggggtcggggtggc

SEQ ID NO: 20802 - DNA, 374 bp, Sorghum bicolor
  Clone ID: 11922678
gcacgaggctcctcgttccccccgccggccatctcggatctcgcgtgggtacacagatgggcgccgcggggcagctccgtcgccggacccgcgcgcggacgccgccagggccaagaccggaggccgccgctgccggcgacgacgacgatgtgaggtgcgaggcgtgcgggtccggggatgcggccccggagctgatgctgtgcgatgggtgtgaccgcgggttccacatcttctgcctccgccccatcctcccccgcgtccctgccggcgactggtactgtccgtcctgtcgctccccggcctcctccaaatcccaatccgccgccgctgctgctcacaccgtcgtcgccaagaagcctaagcaattcccgctg

SEQ ID NO: 20803 - DNA, 545 bp, Sorghum bicolor
  Clone ID: 11922682
gcacgaggcaccaagtatgtttccctctgggaaaggcagcaaagatagtcttacggtgagcagcagcgttgaggtcaacacagatgtagctgatgctgacatgaaggattcaacagacattggagagggagaacaagaaacaaatataacaattgatgacagtgataatgctgacaatctgaaaaccaaagagggaaccaaagttgattgtgagtttggtgaggttacagctagtagttataaaaagtcaaattctactcccatccgtacagaacattcagattatccactgcatcgctgtatgagaattgttgctcatgaccagaacagtggggcatttttcattgcagtccttcataaactctccccactgaacgagaaccaggtgatagatggggtaaaaggtgaacagaatatttcaaaagacaaaactgagaaacttgagaaagatttaggatcagataaggcatcatctgaagaaaatatagtgcatcatgaagtgattgataatacaaatgttctggatggagaacaaaatgaagaca

SEQ ID NO: 20804 - DNA, 431 bp, Sorghum bicolor
  Clone ID: 11922685
gcacgagggtcgtccagccaggtgctgccctcgcgcagccggaagctctggtggcggctcttcctctggagccaccgcaacctacacaagccgcggtcgccgcgcacggcccaccaagcagcgtgctcgcctggccgccacggcgggtacacctcggacacgttcgaggagggcccggccgctgaccgcaaggacaagaaggtcatggtcgacgactcgccgccaccgtccgtgcccaaccagtgggtagccttctgcgccgagaactccatccacgaccgcatcagcgcgtgggtgagcagcatcgagagcgagcctccgttccacatcgccgaggaggacgacaactacgatggagaagacgacgaggagcacggcggcgagtgtgcgtcggaacggccgcgtcacctcgagctcggggagccatcctc

SEQ ID NO: 20805 - DNA, 551 bp, Sorghum bicolor
  Clone ID: 11922690
gcacgaggctaggtgataccccgcgcgttgccgcggggattttgtagaaggatgtatgacaaatttcgaaccaactgtagaaatgaaaacaccttaaatacagtatgtaagtaaatagaattcactcccaagggagatatcttattatttataatgtattagtatcatgaaggaactgtagaaatgaaaacacttaaatattgaatatagtgtggaagtaaatagaaatcatctgaaggaagataacttattattcttcataagtatgaataggacaacttttttataataagctagaatattattttatgagtagttaggtgctccagtgcatgagaaggttgcatgacgatgtcctgcatgtgttgaggaataaaagattattattctttgagtgatttttttttgtttttacctaaagtagctgagagaaagtaaatatgaagattgatgtacttatgtctttgtagtatatatgttgtcttgtgtttctgaaaatgggcttctcaaatgctgggtgaaggactactgtctgctatgctgtttgaagt

SEQ ID NO: 20806 - DNA, 573 bp, Sorghum bicolor
  Clone ID: 11922692
gcacgaggatccccagtcggccagtccgccgtgcctcaatctcatcctccgttgaagccaaagatgcagcagaggaggagcggcccgccctcgcagagcacgcccaactccagtggactggctccccgggcgccgattcagtcatatgggacaccgaggcgagcaacaccaacaatggcctcctcatggcagtcgacgagttgctccgcttggcggcggaggacctcttcccgctctccaccgccgcgtccgtgtactgccggccggacagcgccgtgggcgccgccgcatccatggacgacaggccttgatccagggtccggtagggcagtcgggatccacgacctggtggcctggatccacgacccgacaagatccatgacctggtggcctcgctcggcactgcagtgttcaccagcgccgtaccacttcccgccgccccactaccggatcccatccttactcgttccctgccggcaacaggcagtcctcggcagcaacggcatcccgggacgcccacacctccacaccgtgccacctttgccaacttcggctccgggtaccggcagcggc

SEQ ID NO: 20807 - DNA, 479 bp, Sorghum bicolor
  Clone ID: 11922694
gcacgagggttttttttttttcctgataatacaacactttcagaaagtcagtatgacccatttgttgactatgttgaacctcctaaagttgggaatacaaataatctcaagccctccaatatatccagcaacatttcaagtcagcatacaaatcagtatgcaaatgcacatgcttgcttgattgctcctgatagaggacgcagctctagcctggatgatattatcaaggtcaaagcttatgacagaaaaaaggatgcagcttataacaatgagaaaacaagggactttcgctttcatttggcagaacatataaaggagttggtcaaaccaatatggaaaaaaggtaatctgagtaaagatgctcatagactggtagtgaaaaaatctgttgagaaggttgtggactcaattgagccaaatcaagtaccaactactgaagagttgattaccaagtacatagccacctgtggaccaaagat

SEQ ID NO: 20808 - DNA, 541 bp, Sorghum bicolor
  Clone ID: 11922697
gcacgaggcttgatgtcagcggtagcatggcagggaccaaaattgcacttctgaagaatgccatgagctttgttatccaaacccttggacccaacgaccgcctgtctgtcattgctttctcatctacagcacgtagactctttcctcttcggcgaatgacattagccggtaggcagcaagccttgcaagctgtcagttcccttgttgcaagtggtggcacaaacattgctgatgggctaaagaaaggcgctaaagtgattgaggaccgtcggttgaagaatcctgtttgcagcatcattcttctctctgatggtcaagacacatatacactcccttctgacaggaatctactagattacagtgcccttgtcccaccttcaatccttcctggaacaggccatcacgtccagatccacacctttggtttcggctcagatcatgattctgctgccatgcatgctattgctgagatctccagtggcacattctcatttatcgatgctgaaggctcgatccaagatggatttgctcagtgtattgg

SEQ ID NO: 20809 - DNA, 539 bp, Sorghum bicolor
  Clone ID: 11922713
gcacgaggataagaccagcatccctttgcaggttgtgatgcgtctcgctctcgcagtcgatcggctctggctccgcccgcttgattactactcagtactagactagatcagaaatggggcggtgcgcgtgcgcgtggcaaatggtcgtcgtgggtgccttggccgtgctcgtcgcggcggcgacgacggcgcgggcggcgccgcaggtgccgtgctacttcatcttcggggactcgctcgtggacaacggcaacaacaacttcatcgtgtccatggcaagggccaactacccgccctacgggatcgacttcgccggcggccctaccggccgcttcagcaacggcctcaccaccgtcgatgccatcgctaagctcctgggcttcgacgacttcgtgcccccgttctccggcgcaagcagccagcagctcctccgcggcgccaacttcgcctccgccgccgccgggatccgggaggagacgggccagcagctgggtgggcggatcagcttcagcgggcaggtgcagaactaccagtcggcg

SEQ ID NO: 20810 - DNA, 532 bp, Sorghum bicolor
  Clone ID: 11922717
tgagacgcctgatcatcattattaccatctggcatttttcacgaacaagaaggtggaggcatttgaagaactgacatgggattatggcattgattttgatgatgtggaagggcccagtaaaccattccgatgcatgtgtggaagtagatattgccgtgatccgaacaatacaaggaggatgggtagagcagcctcaaagcggaagtaggcggggagcgtgaacttggttggagatgagcacatcaacttttggtgtgggagtatttgatgtgcagcatcatcacttcagctagtattagtgtagatagattggaatgagggcggatgttttggaccctcgccggctgagcagcacgaacgccacctagtaacctatgccatatattggcatctaaattagcctgggattgagtacgagtaggcgtagaaagaacgcataataatacttaaatcatgtccatgtcatcttgttacagggcatcgatttcaattacatgccattgcgtggcatcatctatgccatgttggtttc

SEQ ID NO: 20811 - DNA, 520 bp, Sorghum bicolor
  Clone ID: 11922719
ctgctcttcgcgcgtacagcgtagtgtcgtgcacggctgcggcacggcacgccgggtggcagcggcacattggctggcgggtgacgggtgtggaaaggccgcggcgacttcaccgcgtatgtgtgcccagccggggcaggcagccgcagtttctctcggccgcgcgcgagtacgttcagcactccaccttgccgggctgcgcacggggacgcgggcgccgcgacctggcacatgcgcgtgcccaacggctcacgctcaccagtcaccagccataaagaagaagattaggttgtttgatgaatgccgcttgccaagctctctgttgcgggggtgctacacttgtggcgcgtaaaatcggtgccacaaattagagttagaatagtgactgttatgttgtacttttggctacctaatactccttaggtcttgttcagtttgtaaaatttttttggtttccgaatattgtaacactttcgtttatatttgataaatatagtctaattataaactaactaggctt

SEQ ID NO: 20812 - DNA, 200 bp, Sorghum bicolor
  Clone ID: 11922747
gcacatgagaaccccgtcgctatgcccgtctcagcagctgccaatgaggcgttcaagaaggcgagaagcctgggtctgggggaccaggatttttcggcggtctatgaggtagtgaagggcgcgggtggttctgggtttggccaggcgtgatggaatcatgtgtgtgcccttgttagcccgtttccatgccgatttgcaac

SEQ ID NO: 20813 - DNA, 402 bp, Sorghum bicolor
  Clone ID: 11922761
aggcgtcacaatcattcaatcaagaacaaagaagagtgccaggaccctggtgccataatttgtgaaacagaagctgttcctgcactttgtggatttcgagccatttgggtggtaccatcacgcagaagaaaacgaattgcctcaaaactaatggatgttgcaaggaaacccttttgcgaaggcaggactttggggatttcacagtttgctttcactcccccgacctcctttggcaaggggctagcatgccgttactgcaagaccagctcatttttagtctataaagacggacctgtgtaacagatgtactttaagaagaccctttttgaaactccttttccccgtgtaaaatactctgcttgttgttggagcattggataaatgatataagcaattagattt

SEQ ID NO: 20814 - DNA, 347 bp, Sorghum bicolor
  Clone ID: 11922767
cccaatcatgagatatttataaaggcctgtttgtttgctcctattttttaacacttatttcatcgaatgtttggacatatacatagagtattaaatatagactatttatgaaacttaaaatacaactagaaagtaatttaagaaatgaattttttaatcctaattagtccatgattacagccatagagccagcggtggagctgccagggcgcccgatccatggagcctttcctataaatttttatcattgatgtattttaagaaaagactgaagctatcccaagatagaagaagctccctcgaactttcctaaatattttttttaaattcattggccattaactgtt

SEQ ID NO: 20815 - DNA, 571 bp, Sorghum bicolor
  Clone ID: 11922785
cttctccgtcccactaaatcatcgccgccggctagccgcaggagctcgccgccgcgccgaggccgaaaccgccgtcgcgtgtttgtgaagctctcgaaaaaggggcgcgcagcatgagagcggccgtgaacacaccacctccgcactgctactcgcgccgccgcgccagcgccacgctgctggatgcgcgccatgtgttcgaccacgtgccgcagcggcccctgccgaccctggcagcggaactccgcgcgcggcccgtggccgcggccacccggaggcccgcgcagcgctcggccgcgtctgcggctgcccccacctgtggccccgcttcagttcctcgtttgtttaggacattcctgcaaattccagctgcctcttcttcaacttctcgcgtgcgtttaactctgtctgcgttcttgccatcaagacggaactttgaaggctatattcctcgtagctgctccagttcatcgatccagatctatagccggtcatctctgttaaatctatcaccaacttctgctctcatggtgtcctcccagctcacctcctctgacgtagcccagcgttc

SEQ ID NO: 20816 - DNA, 554 bp, Sorghum bicolor
  Clone ID: 11922797
tcaccatccccacccgacactgaaccagtcatgtcgtatggcagtggcttcatcatcaaggatgggcctccaacctcacttgttctcacgtgtcagcatgtggtggtagatgccgtgtccgtgcgcataaggagggtggtggtgggagtcggagtggaagaatttgaagctacagtgatcaatggcaatagcggcacagacgttgctgttctccgcgttcgagggctgaggagtgagcgcgctttctctctcgcgctaagcttcacatctccacttcaagtcaacgagcctgcagttacaattggatactgcaacccggaaaatttgttggatgaaatctctctcgcagggcttccagccacttcacctggatgtatccgggaggctcctgatgatttcctcgaggcgttaagggaggaggatggcaaacgaatgctcggaaaaggaccaggtggtgtagtgcacgaactgattcttctgaactgcgttagcatgagtggcgtgtcaggtggaccagttgttgataggcacggcgtcgttgggatggctaaaat

SEQ ID NO: 20817 - DNA, 552 bp, Sorghum bicolor
  Clone ID: 11922798
gcacgaggcacccgcataccatcctcctcccggtctccacgccggcgactatggcgacttggcccaacccagccgttccgctcctcctcgtcgccgcgctgctcgcgcttgaggactggctctccacgccctcttgctcgggggccccgcccgccgcccacggttccggggacctcagggccatgatggtcgccgacctgatgctcctcgggtcggatgcgtctttcgctgaccgccacttccgcgaccacgtcatgtccaagttcttcgctgtgagtgataggattcggatttcagatgcgagcgagtgccccgaagttttgcgaaattttgttacatatcttgaaatttagtatttgcacccggctaatgcagctgcaaatttgctgttctgccgtcctcgggtgctaaaaatagtggagttacacattttcatgcgattcagtgttcacttgaaggtccactaacttgttagatttgatttgcgatgttatgccttttttttttttttacagaattctattcaaagattgaagccggatatgatcgtag

SEQ ID NO: 20818 - DNA, 453 bp, Sorghum bicolor
  Clone ID: 11922800
gcacgaggagacagtagacttgatggcactggtgctgtagtaaaaagcatagatgtcactgagaaacttgtgtcaacggaagatggtggtgatggtgatgatccaggaagaatggattctagtgacatagttactagtgcagtctcatcatcccttgcatctcaagaggtatcaccaagacctgttactgatgacgttaagaatgcatcagagaatgttgatgcaactcaaaaaggtaacagagcattatcggtgaaggttccatttcgaggagcttctccaagaaggcgacttgcatccgatggcattgatactataactaaaagcatggattttgctgagaaagataagaaacccatgacagtgtcagttccatcacgtgggatgtcaccaagaagaacagcgagatctgacagtgctaatataatgtcaaaaagtatggattttgctgat

SEQ ID NO: 20819 - DNA, 507 bp, Sorghum bicolor
  Clone ID: 11922801
gcacgaggacctgtcgggcaacaggctcggcggctacatcatgggggcgttccaggagcagttgagggtgatagacctcagcaacaacgccttctccgggttgaatttcagcagtgggtatgccggctcggcgttgatgtacctcgacttgtcaggaaatgagcttacaggagaattcaccattgccggccggttccagaacctgaggcatgtgaatcttgcacacaaccagttatgcaatgctaatttgctggagtccatgggtgagatatctgggctagaatatgttaatctgtcaagcactgggctgcatgggcaaattcctgctgatttttcatcccgattggttggattgaaggtgctcgatttatcaaggaacaatatcaatggggtagtcccagacataagttctctttgtttatacgtgctggacttgtcggtgaacaatctcactggtgagatacctgtggcattggtgaagaagttggcatcgatggatcggttcaa

SEQ ID NO: 20820 - DNA, 278 bp, Sorghum bicolor
  Clone ID: 11922820
gcacgagggccgtttgtcgcgatcgacctcgtcctcctttaccggaggcctcgaggaccggacatcaattcgaccctgccaaaactaaggtagacttagaagaaagagagggaataagggaaacccagaatcgaggatgcgcgtaagaagaaagcataccagatcgatcgagcctgcgtcaggcctgatggggaagccgttgacatgctccggcttaaaatcaccggcagttgcggccctgactcgggccgcgacttcatcgtccgccggaggctggc

SEQ ID NO: 20821 - DNA, 512 bp, Sorghum bicolor
  Clone ID: 11922840
gcacgaggacaaggaggagccgaggccacacgacctccaagtctcagattccacgccctacgaatcatcgcaatgacgaagaagcagcggagcgaggcgggggcgaagcgacggcgagaccgccaccaccatcaccgccggcagctccgggacgagcgctgtgtttcctgcaccacgtttaacatcctcgcgccgatctacaagcgcatggacaacgagaattgcagggagagccagtacagggcctactggttcagccgcaacgagaagatcattgaccgccttctcgctgatcactcctccatcatctgcctccaggaggtttggttggggaacgacgaactggtcgacatgtaccagaagcgtctgggggatgccaattatatgctcttcaagcttgcgcgcactaacaatcgtggagacggtcttcttactgctgtacatagcaactacttcaatgttttggattatagggaactgctcttcaatgacatcggtgatcgagtagctca

SEQ ID NO: 20822 - DNA, 511 bp, Sorghum bicolor
  Clone ID: 11922847
gcacgaggagtgactctgagggaggtagccctctgtcaaaacattcatggaattacataagaagatacgaaggtcaatgctcaagctcatcctttaccaagatctcccacttttctgagtcatcaataatcacggaagccaaaaaacagctttcagagcgatggtcaatggttacctgcgatgagaacagccaagtgcaaccgtcgaggagaaaatgcacattgggtgagatgctctccattaaggaagcaaagaaagatgaggccaccactgggatgttttctgtttccagtaaacagtcatgtggcctgcaaaatgaactgactacacgttctacaaatgtaactatttctagaaagaatgatcacaatggggagagatcttctaagaagttgccaagatcaaaatctgttccagtgatttcatccacgtctgataacatggtggtgaatgtgcaagcttcaaatcctgagagcctcaaactgaatgtggctgttgtgtcaaataaagg

SEQ ID NO: 20823 - DNA, 420 bp, Sorghum bicolor
  Clone ID: 11922849
gcacgaggcctcttcctccctaaacgccccttcctggacggcgggacctgcttatacggtgcccacgcatcgggccgtgggaggcgggctctgtttctgactcatccttcggccgagggcgatggcggcggcggcggggagggcgcgggcggtgagcctggcggcggcggtgcgcgtggtggcggccacggcgcggccggcgtcgagcgcggccgcggcggcgggagtgggcgcgatggcgttgatcgtgcagggggaggacacggccttcgggtcgctggagtggtgggcgtacgcgggcatctcctgcttcctcgtgctcttcgccgggatcatgtccgggctcacactcgggctcatgtcgctcggcctcgtcgagctggagatcctccaacgcagcggcaccgacgccgagaaggc

SEQ ID NO: 20824 - DNA, 493 bp, Sorghum bicolor
  Clone ID: 11922867
gcacgaggatacgacccacaagaccccgctcctcccgcgctcccgaatcactccctctcggtctctccgctccacccgccgccgccgccgccgccgtccgaatcccaatggcgtccgcggccgccgcgccaacctccctctccctcgcggcccgcgcggccaccagggcagccaccgccgccgctgccgccgccgccccgctgcgcaggggaggcctcgccgcggcgtgccagccggcgcggtcgctggcgttcgcggcgggcgacgcgcggctcgcggtccacgtcgcgtcgcggtgccggcaggcgtcctccgcgcgcggcacgcgggccatggccaccatggccaagaagagcgtcggggacctcacggaggccgacctcgaggggaagcgcgtcttcgtgcgcgccgacctcaacgtgccgctcgacgagaaccagaacatcaccgacgacacccgcatccgggccgccgtacccaccatccagtacct

SEQ ID NO: 20825 - DNA, 446 bp, Sorghum bicolor
  Clone ID: 11922868
gcacgaggggagggtttgcgccgcgctgctcgactggaaggagcacaagtgtatcgctgcgattgcggcgccggctacaagcagagcacacaggggggtccaggctagcctacacctacagaggagagccagggtgtgccgtactgcccgtgcgcgctgcggagaagagggcaggggaggcaggaagcaggcagcagcagagatggaggtggggttcctgggtctaggcatcatgggcaaggcaatggcggccaacctcctccgccacggcttccgcgtcaccgtctggaaccggaccctcgccaagtgccaagagctcgccgcgctcggcgccaccgtcggggagacgcccgcctccgtcgtctacaagtgcagatacaccatcgccatgctctccgaccctagcgccgcactatcagttgtcttcgacaaggatggcgtgctcg

SEQ ID NO: 20826 - DNA, 490 bp, Sorghum bicolor
  Clone ID: 11922878
gcacgaggcgattccccgctcaaaaccctaaccctagctcccccgcctccttccctccgcgtcacccaccgctccgcggcatccctcgcggctcccgcggcccggcgcgcccggccctgccactcggccctcgcggacctagggtttctcccgggcccgagctgctcgttcgttcactgccttgggcgagccggtgcaagcggttggttgggcgaggaggtggtgagcggagatgagatgaggttgcagcggcggtgggggtggtgggaactatgagtaggctctcgttcaggccgcggccgctcgacatccacaagaagctccccatcctcaagtctgttcgggagttcgaggatgacgagccaggggtcgcgccgctttcctctgcgagggctggggtgctgctgcggcactcaggagctgagctcaccgcgtctggggcgaacaacgccacagaaagcgagggaaatcaagcacccagtaagaaaaa

SEQ ID NO: 20827 - DNA, 442 bp, Sorghum bicolor
  unsure (1)..(442): unsure at all n locations
  Clone ID: 11922883
gcacgaggctgactgtcgtcgcctcttgcgcatttccccacgccggcagcaacggcaaacgggagaaggaagaggagaacacgtgggaaggcgaagcgaggcgatgcagcccaagatcagcgcgttcttcaagcggcaggaagcggacccagatccgaacagtggcgacggtgaggggaacgggcatggaagcgacatcgcggcgacggaggcgaaacggaaggccaagggctgcaggcgcgacgagctcgtcagcaagaagaggaactacgcgcagttccatctggagctggggcagcctgatttcctacaccacacgtgctccgtctgcggcatgatgtacgcccgagggaacgacgaggacgagaaggttcacagggcctaccacaagaactactcanagggggtccctttcaagggctggaaaaatgagacagtgatg

SEQ ID NO: 20828 - DNA, 462 bp, Sorghum bicolor
  Clone ID: 11922888
gcacgaggcctaacccttcattgtggctagatctaaccacgataaaacggaggacactggagaaaatttttccatgacggcaacaccaacttcgtctatcgtcgttcggaaataaaagtcttcgtgtcgtcaaatcggtgaggatgtcaacaccgtagttgttgcccgcatcttcaacagagccgccatggagaaaacgattccaccctaccatttcatcgtggacgaagaagaggaggagagaataaatccctaaaacaaaaaaaatggcatggagagaccataaccctaaagacttaatctattagaaaaaaatattaaaaataatggatcctcactctgtccggcctctggtgattatcatcggaacgcgagggagggggaccaacaaggatgaaggtaggaatggcggtggcggctgcggcgctgagtcgcgagccctagcgactttgctatccttag

SEQ ID NO: 20829 - DNA, 409 bp, Sorghum bicolor
  Clone ID: 12497451
gcacgaggctcttccctcccacctcccttgccgaagcgaagagcacacccccacagcagaagcgaaaaaacggcaggaagcgcaagccaatcggggcaggcagagatgctcgcccgctgagcgcgaggcgacccgcagcccggccccgtccgagacgcaggcgcgccgccgccatggatccggcgtccgaggagctcgagcgccgcagccgctacctcagctcgctcatccgccgcaccaagctcagcgccgccccggctcgagctccccctcctcagccggagccggagcccgaggtggcggtggcgccaccgaatccgaatccggagccggagccggagccggaggccgcggttgggaagcgcggggaggctaaggcggcggagccagtggccgaggagaaggagga

SEQ ID NO: 20830 - DNA, 500 bp, Sorghum bicolor
  Clone ID: 12497484
gcacgaggggaggtcgacgaggagtccgcgctgccgccgcccgaggagcagtccttcttcgacgacatcaaccgccactgcaccctcaacaccacccagaggctctatggtttcgcgatatgcttggctgccggacttacgtgcaccttcttgtcaatgattgtcttcttcaatccagtgaaatttggggtaacattcacccttggcaatttgatggcccttggaagtacagcatttctcatagggcccaaaagacagtttgatatgatgcttgattccgtgcgaatatatgcaactgctatatacattgcaagcatcatagttgctctattctgtgctctctatgttcacagcaagttgttgactctactggccatcattttggaatttggtgcccttgtttggtacagtcttagctacatacctttcgcaaggtcaattgtgtcaaaggtgatgacatcgtgcttcgacactgatttctagaatcaaccatcactgcc

SEQ ID NO: 20831 - DNA, 430 bp, Sorghum bicolor
  Clone ID: 12497571
ctcagcaagaccatcatattcctcgaggcgcagcgctccgggaagctgccgcccaacaaccgcgtcaagtggcgcggcgactccgcgctcgacgacggcaagctcgccaatgtggatctcaccggcgggtactacgacgccggcgacaacgtcaagtacgggctgccgctggcgttcacggtgaccacgctcgcatggacggtgctggcgttcaagcccgagctggagcagaccaaggagctggagcacgtgcacgaggccatcaggtggggcaccgactacctgctcaaatgcgccgccaggaagaacaagctgtgggtgcaggtcggcgaccccaacttggaccaccagtgctgggtgcggccggagaacatgaaggcgccgcggacgctgtacgagatcgacgagaagacgcccgggacggagatcg

SEQ ID NO: 20832 - DNA, 499 bp, Sorghum bicolor
  Clone ID: 12497601
ctgtgattcagagctcacttatcgacttcactgacaactgtcctgaagacaaaaaggcttcagatgataaaatttcacctcccaataatgtggactggccttataagttaaattctacagtagactatgacatttgtagatctattaataatgatgagggatcagaagaattagtgcctcaagatcagttataccagtcgtgtagtgataagttcaaccttagcagtgtcatgccagagatctctaatgctgaagaatcaaaaaagttatctgctggagatcaaaattcttctgctatctctctggaaactgatgtgcaaatccaaaagccagaattttttgtggatgaagaatcaattgaagaacatgctccaaaagtattactgtccaagagaaagattatgtcaccgatgtctcaggagaagctttgtagtgctctgactggtattgatttgtgtgatggagtccaaagatcgaagagcaaaatcattattgaaga

SEQ ID NO: 20833 - DNA, 486 bp, Sorghum bicolor
  Clone ID: 12497607
gcacgagggtggcggcggcggcggcggcggcggcggcgagagcgccgccaagcgcgcaaggctctcctccggcgatgccgattcggccgccgccacaggagaggaccggctcagcgcgctccccgaggacgtcctcgtctgcatcctcctccacctcaccaccagcgccgccgcacggaccagtgtcctctcccgccactggcgccgcatctgggccctcctcccggtgctctgcttccgctaccccccagatccccgccagatcggccgcgcactcgaggctcacgaggcggccctcctgcgcctctacgtctgcacccaggacgcggaccccgactccatgtcggcctggctccccgtcgccgcgcgacgcctctccggcggcctcttgtttcacaacgttgttgtgcgggagaggggcgcccaggaaggcgacgaggaggaggccgcgcagagcggcgcctttgagctcccctgcctggagcg

SEQ ID NO: 20834 - DNA, 516 bp, Sorghum bicolor
  Clone ID: 12497659
gcacgagggtgtgttgcagccttgcaggccgccgcgatggtgggaggcggcaagccgctgggggacagcgtgttcgcgggccacgcggccgccggtgcggcggcgataagcgcctccgccgtcgccgtgcacccgctcgacacggtcaagacactcctccagctgggggcggcggggcagaaggagaagatggggctccggcaggtggtggaccggctcttggccgcttctggccctgcaggtttttacagtggcatcggatggtccataatgggtaaacttcctgggttgggagcacgttttgggacctatgaacttttaacagccttctataaagacggaagggaggacaattatgtctattattctgaggctatgttggctggcatagctgctggtgctggagaggctgttttctgcacaccatttgaacttttcaaacttcgaaaccaagttagttcagtgattccttcaaaagttatgggccctgcaaatgttgctcaagaatcatttcca

SEQ ID NO: 20835 - DNA, 508 bp, Sorghum bicolor
  Clone ID: 12497677
gcacgagggctgtgtccagattaataaaaaaaatcccctcctccctccgatggcgcttcgtcccgtgacgtacggcgaccctccatctcctggctcctccgtccggcggcggcgcgcccccccctcctcggcctcccaccccacgacgatggcgcgcaccctccccatgctagatgccgcatggcagagggccgcggggttccggagccaagcggcggctctctgccccgacgctgacggtgctcatctcgcgacgtcgtttcttcctcggtggccgtgctctccttgtggcaccacaaggtcccacgggatgcaggcaaaaggggcgggtggaggtagcccggcgtgcccccaacgcacaacagcgacggcctgtggcaacatcacggtcctcaccgcgagcttagcatgctacggccgatggtgttggcgttgttgcggcgcaatggctggatccagctctccaacacacgagggcggcagatccagtccggcacccgctgcaggt

SEQ ID NO: 20836 - DNA, 567 bp, Sorghum bicolor
  Clone ID: 12497691
ttcggcacgagggcacattctgatgagttgaaactggaggtcctggatgaccttaagagagatttctatcatagtgaggactactgggattggttggctaggcttcagcttagcaactcgaacagttccagtaattcgaatagaaaggatgctatatcgaataggttgaacagatcaatccaggtgtatgatgaagctgtcagaaggctatcaaattccaaaatgtactcattgtatgcaaagttttggatggatgttctataccctgacagagaagattccatcacattattcgaggattctgagtttgatgcttcagagttcacttcatccatactgaaagtttatgaaaatgcagaatcatgtggatgtcttactgaggatcttgcttgccaatacatatcactttacttgaaactagaaagactggaggaagctaagactcttgcagaaaagctttgcgacggccctctttcaaatgctgcaaaattgtggagcctgagagcttcaatggagataaattcaattgcgactgctcctggcagttcttccttgagcaaggagaac

SEQ ID NO: 20837 - DNA, 470 bp, Sorghum bicolor
  unsure (1)..(470): unsure at all n locations
  Clone ID: 12497695
gcacgaggctcttattccctccgaacccccaagtctccaaccgaggaggagcctctgtcgtgtcaggttacttgccggcttgccggccgtgtccgcccgacccgactcttctcctcgccggcggggagctggagcctgcctgctcgatcgagctcttgcgcgcgcgcgcgggcgggcggttggttgacgatgtcatgtggcccctctgcgtcatctccgagaagctcttcaagatggcgggcgacgacgccgtgcagggcgcggcgggctcgccgtccctcgacggacagattccactagcacgccgatcgtactacgtcgatgttccgcatgtgcagcaggccttcacctgngactgcggcctcgcttgcgtgctcatggtgcttangacgctcgggattgattgctgcgacggcattgcccatctcgagaggctctgccgcaccacgagcatttggacggttgactta

SEQ ID NO: 20838 - DNA, 257 bp, Sorghum bicolor
  Clone ID: 12497749
aaataaagtaagcactctgaactctctatttttttacaactgtgttgagatttctcaactgagtttgacatcacgatccaaggaaaggatgaacagtaacacaatcataatctatttatttcctctataagcaatgatatcactgacattgatgtgtaacaaagtatcttgacaggaacatgtgtatgtagagcttttcacaagtacatgaactgcacacaactgcaaaccttatagttcttatgatgaagcgacct

SEQ ID NO: 20839 - DNA, 434 bp, Sorghum bicolor
  Clone ID: 12497870
gcacgaggttttttttttttttaactctaatgattatatttcattgattttttttctataataacaaattatttacacccattcagttcctcagtgtctctcccctagtcaaaaatcaaactccacctgttcagacctccaaatcaatggcaatttggcaatgggggagaagtaaagcaaaaaaaaaatcattttgcttctgcttagatttctcccatggctatcggtaccgcgagagactaaatggtgacgctgttggggatgccgcggcaggtgatgcccggcccggacgtgggcgccatgagctcgtacggcagcacgccggcgccgcaccggttgcggcgtcccgtgtccgcgttgcgccggtcgatctcctcctcggcgcggcgcacctcgtccgcgaactcgcgcgccgccgccagcgccgccgggtc

SEQ ID NO: 20840 - DNA, 473 bp, Sorghum bicolor
  unsure (1)..(473): unsure at all n locations
  Clone ID: 12497886
gaaacgcatacagcaagtttgccggccgtcacatgttcttcaagctgatctctgatctgacatatatccccagctaacattgcaacctgcaacattgctcttagaactccacccctccattgttgcaagaaagcaagatcaagaaacaaccatggcggcgcatgtcctcgtcgtgcccttccccgcccaggggcacatgaaccccatggtacagttcgccaagaggctggcgtccaagggcgtggccaccacgctcgtgaccacccgcttcatccagagaactgctggcgtggacgcgcacccggcgatggtcgaggccatctccgacggccacgacgagggagggttcgcgtcggccgcgggcgtcgaggagtacctggagaagcagacggtcgccgcgtcggcgtcgctggcgtcgctcatcgaggcgcgcgcgtcgtcngcggcggaccccttcacctgcgtcgtgtacg

SEQ ID NO: 20841 - DNA, 490 bp, Sorghum bicolor
  Clone ID: 12497922
gctccacggcggcggcaagagggtgcacatctccctcgacgagcgcacaggcgctgggttcgcgtcgcaggcagcgtacctccacggcagcttcagcgcccgcatcaagctgcccgccgaccacaccgccggcgtcgtcgtcgccttctacatgtcgaacggggacgtgtacgagcggacgcacgacgagctggacttcgagttcctcgggaacgtgcggggcagggagtggcgggtgcagaccaacgtgtacggcaacggcagcacggcggtcggacgggaggagcgctacggcctcccgttcgaccccacggaggacttccaccgctacgccatccactggagccgccacaggatcatattctacgtcgacgacacaccgatcagggaggtggtgcggacggaggccatgggcgcacagttcccgtccaagcccatgtcgctgtacgccaccatctgggacggctccagctgggccacctcgggaggc

SEQ ID NO: 20842 - DNA, 603 bp, Sorghum bicolor
  Clone ID: 12498025
ccttcatcgtcgtgtacgagctgttcgagcggatggcctactacgggatcgcgtcgaacctgttcatctacctgacggagaagctccaccagggcaccgtggaggcctccaacaacgtcaccaactggtccggcaccgtcttcctcacgccgctcctcggcgcctacgtcgccgacgcctacctcggacgctactggaccttcgtcatcggctccgccatctacttcctggggatggtgttgctggtgctgtccgtctccctgccggcgctgaaaccgccgccgtgcgacgccgccaaagtgtgcccgaaggcctcggcgctgcaggtcggtgtctacttcggaggtctctacatcgtagccttcggcaacggcggcaccaagcccaacatctccaccatcggggcggaccagttcgacgagttcgacccgcgggagaagatgcacaagctctccttcttcaactggtggatgttcaccatcttcctgggcatcctcttctcctccagcgtcctcgtctacctgcaggacaacgtcagctggcccatcggctacggcatccccactctgggcctcttggtctccatcatcatcttcctcgccg

SEQ ID NO: 20843 - DNA, 624 bp, Sorghum bicolor
  Clone ID: 12498053
gcacgaggcttctctgtgtcacagtaaagaatattgctcctattcatgtgaaagatataatcgtattcattgatgcaattactattgtatttgaggaggcatccaaaggaggtgctcctttgtctttaccaattgctagtattgaggttgggcatggtcacagcttaccaaatctagcactcaggaggggcgaggagcactcttttattctcaagccagcaactatgtcctcaagggaacggaagaccaacggctatgcacctccgaccttgtcactcccaacgatgactggtgctactttaaatactaatacaccaaaggttggtgagccatatgctgatctaagcgaccaatatgctgtactggtatcttatcgctgcaattacacagaatcgaaactttttttcaaacaagcaacaagctggcggccctctgcaaccagcgatcttatgatctctgtatcatctgaactgtctttacgaaatcctagccttggcgctcgagttcctcaactccccgtgcagatactaacacttgaagctactaatatgacatccgaaaaccttacattaaatgtccttgctcctgaagcatctggttcttcttcagttgtatccttaaact

SEQ ID NO: 20844 - DNA, 218 bp, Sorghum bicolor
  unsure (1)..(218): unsure at all n locations
  Clone ID: 12498069
ggaaaaaggtagttgtaattggtggtggtgacacaggtacagactgtattgggacagccatcagacatggttgcagcaaccttgtaaatcttgaacttctaccagaaccgcctagagagagggcccctgacaatccgtggcctcagtggnccgaggatattccgaagagactatggacaccaagaagcagccagcaagtttggaaaagacccaagaac

SEQ ID NO: 20845 - DNA, 572 bp, Sorghum bicolor
  Clone ID: 12498116
gccatcgccgccatgccccgcctcgacagcaagcgccttgccctcgcgctcaagaaggaatttgatacagcatatggtcctgcttggcattgcattgttggaacaagctttggttcctatgtcacccactctctgggaggtttcttgtacttctctgtcgacaaggcctatattcttctcttcagaaccgctgttgagccactaggccatccgcgatgaggggccatggaacactctactagctagcacattctgtattcgacatttaactgcagaaggttaaggagagtagaacgatcatcgccctccatgcaaatatgtagaaccaatctgctgtaactagtttttttccatgtactgtgcactaatctgctatgtaaaccttaacattagctttcggagctgtaacttgactcggttcttcagtgcgaggggaattttctttcgcatcctgtaatgccttgtaacctttgttcaccttggaatcagtatgatctctgaggtcataacttatggtggcgaacctcaaggtttgagattcaatcatcggttgtggtagatgcatccagttg

SEQ ID NO: 20846 - DNA, 609 bp, Sorghum bicolor
  unsure (1)..(609): unsure at all n locations
  Clone ID: 12498261
atgatatggaaaatatagctgcanagcttatcaggagcttgaagcacatgaaaagtatagtggacgaaagtttgtcaacagaagcatattctttacttcctaactttaacattgccgagatcagagcagcctctgaggatgcattagaagtggagaggactacgaggaaatggctgtcgataatgaacaaagactgcagtcgcttttgtaaaatattgagcctagcaaagaagaatgatgtttcacatcctgaagcaccaaggaaacaaagaaaaataacgtttgcagatgaagctggaggaatgctctgccatgttaaggtttttaaggatggacaagcctctcttctttccgaatgccagagtgatttatagacatactaagcaggttgtcatgaaatttgatcagaaaaacaaccttttgacaatagaatagaatcaaacaagccgctcagttgaaccaaaataatgagaatgcttccattcactgtagaaaacagataatgctgtgttgaactcacagtatgtattttactgtaaattgattgatgacattgttgtggcaactcaggtattatccttgtatgtgagctcaagagtccacgaaagc

SEQ ID NO: 20847 - DNA, 586 bp, Sorghum bicolor
  Clone ID: 12498315
ggtctcagatcagggatagctcgagattgtgtatatggtggtattttcttttctacttggcaattcctgcactcagcgatgctcacctggaaggcagttaatatgagccctgaacctaggaatctagaagaagcgggtcctgtacccccttttgcctctagtgttgctgcaggcttcgcaggagtcgtagcggctgccgcttcacatacatttgatactgccaaaagtcgttcagaatgtactgtggtgcctaagtatatcgcaatggagaggaagtttcttaagtggaaaccaccaggaacatggatagagaggaagacaggaatatcccctgctgataggaatgtattgttccgtggcattggcctacgaatggcccgtagtggaattgcatcgtttgtgttagtcgggtcatactatctcgctgtgaatcacctcttgtagttgatcaagagcgatcatatgtttttttttctttttttgtattctaaaattagaactgaaattttatgactgtttatgcatgcactgattggttggaaggtggtaactttttggccacactgattattggaaatcagttcat

SEQ ID NO: 20848 - DNA, 623 bp, Sorghum bicolor
  Clone ID: 12498371
tctggacaggttaattttgttacatcttgctcaacatctgaaagaaacgagcttctctccaactgcctctgtgttttatacactccaaaggatgaacatttcggtattgtacctcttgaagccatggcagcctataagcctgtaattgcctgcaatagtggtggcccagtggaaacagttgtgaatgaagtaacagggtttctatgtgatccctctcccacagaattctccaaagccatgctgaaacttgtgaatgatcatgatcttgctgtcagattgggtgaacaagcacgagaccatgtggtgcaaaaattctcaaccaagacatttggtgatctcctcaacggttatgtcctgaatgtctatcatgagaggatggaatgatctataataccgggtcagccatgccttgcaaaaaaaaaaagtgttggataccgggtcatgagagcatggacttcggcaaacagtactgtatcaaatcaaactaaacgttcctgcaatttccatcctaagccatgccatatggaaacaatttgttcaacacaagttctttttttttgcatttttacatctaatccgactttaatgtacacaaatatggcaatacattccattaagccctt

SEQ ID NO: 20849 - DNA, 595 bp, Sorghum bicolor
  Clone ID: 12498405
tgtcatggaggacacacgatgcagagatgagctctgctggggcgcatatgaactgaagtgtgtgtggccgtgtgggggaggaacgggctggtttgagtgaatataaactgcccagcctgtacttgcttctgcagtgagtgataaatgtggttcgctgcgtaggtagtaagatacctgtcagagaaggagtgaagaatatgtctgacatagttttcactcaccagtcaccacgtcaccatgatagaaggcggcatacactgactggagagcagggttgctggggccaagagcagtataccaagcgtgcgtcaatgtataaaactatatagggcaaagatgagagaaatcaggggagtggcaactgaaggggggccacatggtgtctgcaggtgtgggctgtcggtgaactgtgtgtgtgcatagcataaccaccttccctgctagtacagtggtaataaacactctcacctagtacccatggctgccacatttatttgtggggcaaccctaagttgatccacatagtcgtcgattgcttagtactccagttgtttatgtagggtataatgtacatctgttttggattaacttcatc

SEQ ID NO: 20850 - DNA, 566 bp, Sorghum bicolor
  Clone ID: 12498409
cgtcgcggcacgacgcgccggacgacgacgcggcgcggacggcggcggtcaccaaggggtgcgcgacgttcttggtcggggaggaaggggaggccccgcggcgggtggcggtgcccgtggcgcgcctgggacacccgcggatgctggagctgctcggggaggccagggaggagtacggcttcgcgcaccagggcgccgtcgtcgtcccgtgcgccgtcgagcggttcatgcgggcggtggaggaggcgtcggcggggaacaggcacgagcaccgccacggacaccaccaccaccaccaccaccactttcgcctgcctcacgttcgcatcgcccgctgctttaggccgtcgcgcgtccttgtttaggattcacgtacgagcgcgagtagctagctacatgattttctttttgtttctctagctttttgattgaaagtatcatgatttctattttttttccttcttgtaaagcagtgactcttggtttcgtgatccatatgtggtgaagtcggttcgcccaaagatcacgagttgagcaccagccgtgctagaaggaatgttgcacca

SEQ ID NO: 20851 - DNA, 307 bp, Sorghum bicolor
  Clone ID: 12498522
cacgacaaggatgccggtggcgggtagggatgaaggggactgggcctccattggggactccttcgataacggcgctttcttcaagcagacgggcagcagggtgcgcccgaattacaacaagcatcaggccttcgcggcagccagctccaacgaagtaaggtcgctgaccaaggacgccggcgttctcaggtgctctgtcggcgccgcgtgctgatcaaatggagacaagaaccagatgcgcccgccactatcagagagttacatgttgcgttattagcttggcacgcttacatatttgtgcgttggt

SEQ ID NO: 20852 - DNA, 376 bp, Sorghum bicolor
  Clone ID: 12498536
cgtgcccatggtggcgatggcactgtggacggaccagccgactaacgctcggaacgtcgagctcgcctggcgcgccggtgcgcgcgctcgtcgcgacgcgggcgcgggcgcgggcgcgggaatgttcctgcgcggggaagtggaacggtgcgtgcgcgccgttatggacgacggcgaggaggcgtctgctgtgcgcaaggcggtggggacttggagggacaaggctcgcgcggcggtggcagccggcggcagctctgaccggaacctggacgagttcgtgcagttcgtgcgcgccggcgccacggagaagggcaaggcgctggttttgaaggaaggtgacgttgcagggtccgagatgtaatcatgtgacaaggga

SEQ ID NO: 20853 - DNA, 462 bp, Sorghum bicolor
  unsure (1)..(462): unsure at all n locations
  Clone ID: 12498708
ctcacgaaacgttttatcggagatgaaaatggaanagtgaaggcccttgaggtagtacgtgttgaatggagcaaagtggatggaagatttcaattcaaagagatagaaggttcacaagaaattattgaggcagatcttgtcctcttagctatgggattcctaggtcccgaggcggctattgccaagaagctgggtttagagcaagacaaccgatcaaacttcaaagctcagtttgaaaacttcgcgactaacgtggaaggtgtgtttgctgccggggactgcaggcgtgggcaatcacttgttgtttgggcaattgcagaggggagggaagcagcagcagctgttgacaagtacctgtcgagagagaaaacgaatgttgatgagaacgttgttgccccaggtccatgtgaatgtctggttcaacccgttgcggcataagcaaataaagcatttctgtaacat

SEQ ID NO: 20854 - DNA, 501 bp, Sorghum bicolor
  Clone ID: 12498741
ggcacaagaaaggcaaaggaagaagtttccttaaaccctaagagggcaccggagtatgtcgccaccgcgacaggagaacaggaggcaggtgatcgtcaaggccgaacctgttccctcgatcacgctcaaggtgcttgaccagcagagtcgcagggccttccacaccatgaggatgaacgacaggctgcagggcgtcatggatgcctattacaagaaggtgtccgacgacgtgacctacggcaccgggatcttcatgttcgatggctccgtccggctgcggggctgcaacacgccggcggagctcgatctgaatgatggtgatcagatcgagttcttcgagtccatgattggcggcggatgcatgggttgatgcttgcgtttaagtacatcattacttgtgttgcttgcgtttaagacttttgagtagtattgctgtcaagtttgttataatggttacctgcaccataacgtatcatccttatactatgcttgtaatgatgc

SEQ ID NO: 20855 - DNA, 509 bp, Sorghum bicolor
  Clone ID: 12498743
gcacgaggcggcgtgctgcgcggcagcgccaggcccaaggacgccgccagcatcaacctccggtccttctacctcgtgggcacgccggtggcgctcgtcctggccttctggctccactacgacttcaagggcctatggttcgggctcctggcggcgcaggccacatgcatggtgcgcatgctgctggtcatcgcccgcacggactgggcgagcgaggccaagcgctcgaggcagctcaccggagccaaggacagtgacgacaaggctggcggagacgagaagtcgcgcttgttgcttggcgacacggacatggagaaagccaatgctcactctgatcagtgttgatagctacagcgccagccgcatgtgtgctttgctctaatctactcttttcccccttttttatttcccccattttctatggcgggggaggaggaatcagaggctgacagagtgacaattttgttcgccacattggtaattagcatgtaaagatttttctgattatt

SEQ ID NO: 20856 - DNA, 384 bp, Sorghum bicolor
  Clone ID: 12498767
gaaaaaatttgctgcagtgtgccttgaacaagaacgacttggtaatttgagaggacctggaacttctcagacggtttcaggaagaactgcatcgcggggtggattgacgcgcaacctccaatagcatacatctaacttcaggcaggcatggaattcgtcgataggcttcatttccattgtatttcttcccctgttcttattcgttttgtgatcaaatagcccagatgaccctgcgatacctagacggggggaaaagagtaggttttcatctgacatgacttgcttttaatgtagtgaaggtatatccttcagtgggtgaggtttaaccctgcggcatgccctcattttgtagaggcagtgatgtggtggttgtataggttggat

SEQ ID NO: 20857 - DNA, 231 bp, Sorghum bicolor
  Clone ID: 12498779
ccccgtggcgataatctgaattctgaactgcggccatgtgtaccttttcaagtccgctatagtgcaaacagagtaaagggagaaccaacagacgagaagtgctcaatattgtcaagacctttctatataggaatttgatatgtttgttctatttcaatcatctttccgcacttactttattacagagtagtcgtatatttcccttgtgcagcagtgtaaatgtataccttg

SEQ ID NO: 20858 - DNA, 191 bp, Sorghum bicolor
  Clone ID: 12498801
gtggttcggcggcgacgaggacgatcattacgcgacggcgccggcgccggcggggcacaacttcacgtttttgccattcggtggtgggcggagagggtgccctggggccggatttgcaatggcgaccgtcgagctagtgctggcgagcctgctgtaccacttcgattgggggatgccggccggtgggccgt

SEQ ID NO: 20859 - DNA, 597 bp, Sorghum bicolor
  Clone ID: 12498828
aaaaccacaagaacctgttattgacatattgcctcagctctatgatattggttccagtggcagcagaggaccttcaactggaatgtggtctcgaactcttcgactaaaggttacaggaagagatggagtcctcaaaattgatgccaggatacctgctgggttcttagaagggatgacaagagttattccaggcttggctggagctaatatcatggaaaggcttcggaatgcgcctattgatacagacaacccccagaatggtcagatactgcttgattttgaggacgctatgggagataggatccaggtgtttattgcatgagctgattgtgctgtctttgctggaatgctcgtacacagcaaactctgaaagcatgggtgttacaagtacgatcagggtacatgcatcttgctatttagtgcaatcctatctagcagttggattagataatttggacatcaattatgcccgagcaaactagtatttacaaatgacagacttgttcctattcattgaggctggatgtacatcattgggattccattaaaacacagctggggactgcaggataagtttctccgtagcctgtttcttgt

SEQ ID NO: 20860 - DNA, 452 bp, Sorghum bicolor
  Clone ID: 12498915
ttcagggcagctgtcgttgtcactccaaactggtgtgtttacaggaggaacatcagtctgatgttgctcttgggacactggagaagctgaaccaatagggctactctcatcaactcatgaatcaacccctcggctacctcggaagaaacccatggatccaacttgtgatgcatcagcaacccttgtgggtattgtaccatcccttggtaagaggtaccttgatagcttccttgtgatgagaatgggaattgtgggtagtttgattgggatccaaagggattgaacatgtgtgaatactgggggtgaaaagaggtaggaaattgtgatgaatagttaatagggtattgtggtgaaggaaaatgatgttgctgcctagcttttttctgtggctcaccacttgtcattgcagagttcatcatatttgtgaaagatgaagctgtgttctccatgta

SEQ ID NO: 20861 - DNA, 120 bp, Sorghum bicolor
  Clone ID: 12498936
ggtcgccgtggagctcaccaccggcaaaggggtggttcagaatgtgggactgaccgcgccgctgcagacgctggcgctggcgctcaccggagtggtaggagtgctcacggctttcatcat

SEQ ID NO: 20862 - DNA, 570 bp, Sorghum bicolor
  Clone ID: 12499023
gaagaaagacagaaccgttgactgaacttgtacatcacatagtacaatgaacagttaagcatgaattggaacttggaactttgatagtccatttcttcattcttcacaataatgtggtcatattgttatttctgccatctaaatattcaattcaataattctgaagctcacatgtaaatgttctcggcaaagcatttcatgcacacaatgatggcttggaggccttgttgggttgttggtcggtgcatatggacggtatttcatgttttagagttttagtcgctatttttgttgtctctttgcatatctgcataatcaatgcacatgtttatatttatgcatctcatgggaaacagacaaagcacttgattccatggccaaactgttttctttgttacatgtgtttactgcctgaaagcacatgtttgtatttctgtaatctcataggaaacagatgaagcacttgattctgtggccaaactactttctttgttacatgtgtttactgccttagggaatcccatgaataattccttagatatatgaaccctgtatacctttcttttggtt

SEQ ID NO: 20863 - DNA, 105 bp, Sorghum bicolor
  Clone ID: 12499055
gccttggcacccacaggctaggcgtactggcctgggtgatcaactggatgaagatactacagattgagattacataatgcaaacgaacgagcgacagggctaatt

SEQ ID NO: 20864 - DNA, 507 bp, Sorghum bicolor
  Clone ID: 12499089
gcacgagggtgaaactcccccgaaatccaaatccgatcaactttcccactatccgatggagatttcatgtctttttgtttgctaacaaagcacaaatccatcgatccactcttctgtcttctcaatcaacgcaagacggagaggagggaggcgggccagccagccagcgagcgagcggctcgccgacgacgaccctctccccgtccacggaagcacggcgaggatgggcgccgcatcccctcctctgctcctccgcctcctgaccctagccctggctctcgccggggccgccgcgggcaggatctcgggcccccgcaccccgatctcgcgcgacatctaccactccagtgactctcttctgcgcgaaatcaagtctttggttgctcggcactccgacaaattgagtatggacactatcagaaccagcaacaaaggctattctgcggagctgtttgtagttacatttaatcacgtgaacgagagcatggataatggctccaaagttca

SEQ ID NO: 20865 - DNA, 475 bp, Sorghum bicolor
  Clone ID: 12499105
ctgctatgctaagactgaagcaatattgggagcaactccgctgaacaagcaaccattgcagtgcttccagcgccaccatgccccaagtgtgatcaaagaattcaaacttttgcacctaatgcttgcttctggtgacaccatactgcgaagacctcatcatgagtatgaagtgcaagctgatgcttgttgactcagtggtcagtggcagtgcagtagctgaaaccatagttctcctgcaaaaacacaagaacaaagcaaaaggatatgttgtatcccttccttatcatagaagggacagcacagcaaccatcaatgtgcttgttaattcacagtccaaacgattaagaatgacaggccaaaggaagaatttgcttatttgaacgccatgatgcccgagatttccacagcgtttccaggtgcacagcggatgctcccagtaaagaatgggagatgacactatggtagatttggtaga

SEQ ID NO: 20866 - DNA, 522 bp, Sorghum bicolor
  Clone ID: 12499135
gcacgagggttagtccctaagtcaaacagcaataaatggcctgttgtagaagggagggccctggctgctacaagtattctctgttcagaaccctattatgcaagagatggtgtcagtatgatgaagcgtagctttggactggacagctcttcagctgcttcttccagtgatcttgggtcttcgaggcaatcaaccatatgttttgagcgccttaggagtggtaagaggggtgactttgagaagtctcagataagcagtactatgagtcggcaaagcattgcttctgtgtcagatatgtcaatttgtagctcttcagcttcactttgccctcagagtgatgcggtaggaggttcctgtttcccaattgacactttggaaagcagcacttcaagaacattgatctcttctgaagaaaatgatgctttttataaggatgctttgccaagtgctatggaatgttcgtcttcttcacaggttattgctgatgatgccagtccctctgacttgaaaatccagagctat

SEQ ID NO: 20867 - DNA, 301 bp, Sorghum bicolor
  Clone ID: 12499137
cccgataggtgatcagctgggtttcccgaggtggatttctcgtttgggtttctagcacagctcctctctcttttcccctccggtccttttcgtgttccgatcgtggaaagggcccggcggctggctgttgcgacttgcgatcgaatagtatgtagtggtgctgctgctgttcatgctggggtcaagaggtttaatttccccattgccttgagctcagctaaattagtccgggaaatgtagcagatactgcattgaccgtgcaataagatgtacagaatctgatacttatattaaaatacat

SEQ ID NO: 20868 - DNA, 552 bp, Sorghum bicolor
  Clone ID: 12499161
tctttcgtgttttggtggttatggacttactcttggtgcatgtagagctgcttctttgttgtgcatacgctagtactaattcacccttcaccacattatgttgcatattagcatatatatgcttatgccagctatgctactgttgtagcttagtgtctaaactatagtctatgctggcacaatgggtcaaaactttatttgacctttttctattgaggatacggataccctaggttaaaacagattcttaggttaaaacagattcttcgttgtatcgcaaccttgttttctgatgatacctgggcctagctaactgtttgcttgtatcaggagttgaggaccatcataccgggtttgctgaccactctggatgctgatcgggggagacttattctataggcacaagaagctaactggtgcagcgggggcatttgtcggcactgatctgatgagcagtattccagctgggtaaccatgctttttacctggcaagtaatagagtagcaagtgagaagagaaatctgaaatgattcatgcttataatgtgagtgt

SEQ ID NO: 20869 - DNA, 541 bp, Sorghum bicolor
  Clone ID: 12499191
aaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccagcagccgcggtaattccagctccaatagcgtatatttaagttgctgcaccgaccagcacatcccgagtatagtagaatcacttttgcaaaccatgtctatttgcttctgtacgtctctcgctatacctcgagctttaatttgcaacatttgagctatatatttcttctgccatttggtttcaccatcgttcttgctctttacaaaccgcatctgggcctgggctcatgcttttttttctcccttttgtttaatttgctggatttcttgctgcatgctctctactcgagccattttcactatgctgaattagacggctacatggtcagtcagtaataataatacatgtcaattggcaaaagtttgtagtatctatccaggatcggaggaa

SEQ ID NO: 20870 - DNA, 436 bp, Sorghum bicolor
  Clone ID: 12499211
tacttcgcaagcagaacttccagttggttcatcatttgtcacacctcagaaaaagcaaccactggtggtgactgtccctaaagattcagcaggaatactcaacacaggaagtagcgtgatttctggctcagtcactcacacactttcaggctctagcaagtctgcctcgaatgactgtagaaataatgtgaaatatgcagcaaaggattcttctcaggtttctggcagctcaagaaagcggacaagaaaggggtggacgactctgaaacaaatagctgagaaggatgagctcgaaaagaaggagaagatgggtaattttgtaatcccgttcttcatgcactaagtaggatgttaaagtatttgcccacattgtaatcgtttggtcattagtttatctattgagaaggacaatgtaatttggggaagggagggagct

SEQ ID NO: 20871 - DNA, 556 bp, Sorghum bicolor
  Clone ID: 12499223
gcaggagctaaggacgtacttccggctatttttgctgtcaacattcttgttgatgttcatgttctgcacacggatatcaaagaacagaaacagagactccggtaacttgtttgatccttgaatgaataccaaagaaagcatatgttggggtcgccctctgatctgaatttcgggtgcaagagtgatttccgattgttgactcagacgaacaaaggcatgaaacattcagagctggaacacggctctgcttctgcaccctgctattcagacttggaaatccgtatatttggacatgacgatttgtgacaaggcttgtaggatcagaatgatgtcaggcagtgtctgtttagattacagtagatgccatgtggctaattgttaacaaaaattgtaactgtaagctgtaaaattgtccatatatcagtttttgtgatgcataggttttactatgttttgatggttattagtgcacccagcactggctatgaaggctacatttggtgggatgaattggtgtaacatcacactgctcgagtgatttatgatgcggtggatg

SEQ ID NO: 20872 - DNA, 496 bp, Sorghum bicolor
  Clone ID: 12499235
cccactttgactttttttttggtattcaatcgatagcttagtatttatatatttaaacctccattctgtaatgtttgtccatagcacaccatgtgcaaccaaggaagttctgtttccaagaagaaaaaatgaaggtgggatgaccatctacacctaataagtaaggatttaatcaagggtggagagtggaagcttagcaataacttgcacacttgatatcctcaatggacaaaaattgtggaatgtatttttctgatgccttggacaaacattgtagaactgatgaagtagcttctagtcattttgccaagtaatctgggtgagttattgcaaaagctctccttagtgagaccagtctgcttattcctgtaacacatcatttgtagttcttgtgctgcgagtagaatgtaaccagatgcattagccattagcttctatttcatttctccataactaagaaacttcttgtgtctttgctatgtacttgtattgtgaa

SEQ ID NO: 20873 - DNA, 439 bp, Sorghum bicolor
  Clone ID: 12499266
atcttttcctaaggaagagagtttgccaaagctgcctcacagacgaactccaaatcgtaaggtcaaaaggaaaagattggaaggtgaaacaactacaacggaaactgcagagaaagatgctgttgcgaaagactccccccctgtatgttctgcatcaggtattgcaaggaattccgataatatgaaacctccaaagctggagtccaagtgcaactgtataatcatgtaagtaactcaagtcacatccaagatcgaaggagatttcggatattgtgtgggacaaaaatcgatgcatgctggtttcatgttacatgcaacttgaagcacgcctacctgcttggttaacccgttgtcagcaacgatggagttcaacacagtggatcttccgctagattattttgcaaaggtgcatttgctgtgttttaggtgacagaatgca

SEQ ID NO: 20874 - DNA, 382 bp, Sorghum bicolor
  Clone ID: 12499286
tggcccaacatatttgagacttctccccacgttataaatgctgtgatggaggcaattgaggggatgagggtcgcacttggtgcagctgtgattttgaattattgcctgcaaggtctcttccacccagcaaggaaagtacgtgaagtgtattggaagatatacaactctctgtacattggtgcgcaggatgcgcttgttgcttcttatcctgccctggaagacgatggggataatatcttcagccgtccagagctggcaatgttcgtctgattaatggtactttgtattgaagctgctgaggagttgcactgatcaatcccgaggctgcagcatgtttagttcacttcaaagaacctgctaattaatcatccatcatgatcat

SEQ ID NO: 20875 - DNA, 328 bp, Sorghum bicolor
  Clone ID: 12499316
gccgccgcacatggtgccgtatgggtacccgccgtacccggccatggtgccggtgccggcggagttcttgtacggcccaccgggcatcaggtcatccccgccgcaggagtcgtacaacaatatgttcaacgaggataacgccaactcgtgcagcctcatgtgatgtcatccgccgccgccgccgcggcggtgtcctcgacgtcgagctgtagttagagagcggctctcatcatcgaaatgcggctcgtcctcgtactgtcaaattaggcggtcaaatctcttcttgaccagattttttttaactgctcggcatcatcatgtaatcaga

SEQ ID NO: 20876 - DNA, 545 bp, Sorghum bicolor
  Clone ID: 12499322
tgtggttatcatcacaggtcatgagaagacatcaagaactgaagctgaaactaatgcagttgacgtcgtgcaggcaatagttactgttttgacgactgatctgggtcttgaagttttgattggacctggaagctgccctcctgtttcatcaaaacccaaagcaacgactaaatctagaagtaatttagagcaagtatccaaagaatttactaggagaccacagggaatgataaaaatccctctcaactcactgaaccattggttgaagaagaaagctgtgaggattgcagagtgacatttccttaaactacctttttggtccatttagtataccagtaaattagcacagttattccaggattggatgtacatatgaaaacaggttactgctcctggtcatgacacgacttgaaaaagggaatcgttggcaggcaatggagtctcgactattgtccagcacattcagcaagggacttctgcaaatttaattgtagtgtttctaaagacacgaagctggactttcatactgttatatatcaatttcc

SEQ ID NO: 20877 - DNA, 547 bp, Sorghum bicolor
  Clone ID: 12499342
agccccggactcctcaagatccagtacactcgggtgccgtgcaactggaacgggatggacatcgcgttcaaggtggacggcgggtcgaacgcgaactacttgccggtgctgatcgagtacgagtccggcgacggcgagctgaggtccgtggagctcatgcagcgcggcggcgcggcgtgggcgccgatgcagcggtcgtggggcgccgtgtggaggtacaactccggcgccgccctgcaggcgcccttctccgtccgcctcacctccggctccggcaggacggtcgtggccaccaacgtcatccccgcggggtggtcgcccggcgccacgtaccgctcggtcgtcaacttcaacaactaattaaccgtgacccggatgcatcgtacgtccgggtgcacgcgcgcgcgcgcccgccgggacggcgtggcgcttggcttggtttatgattcgagctagctgtgcgtgcctacaccggccgacgacgacgctactgtgtactgttgcgtgcgtgacagtcaccgtgtatccccggaatggcgtgtttgtg

SEQ ID NO: 20878 - DNA, 568 bp, Sorghum bicolor
  unsure (1)..(568): unsure at all n locations
  Clone ID: 12499384
tgaatgcgggagagctttgaataaagccntatacctgcaccataagcgcagaaattgcccccggctagaccccattcgcagcacatctaagaaagctgatcaagtttctgcttctaacaaaattgagagagttgcacaaatgtcaagaagtacaagtagaggaaacaacgagtccatggatgagggaagtgagaagactgttgaaaggaccgcagttactgtacaacctctacatagatcaaggagactggccaggtcttctaggatgtggataattggtgtatgggcattatcaattgtggtgttcttattggtaatttccatgtttttcactgaacaaaggagaaatgtttcgagatctagggtctctagaagtttaaaggcccatgtctgagtattcctttttctaccgacaccatttctgactatagaatagacaaatatccacaaactgttactttgtggacgtataatacataaagggattatggtacctgggacatgtataggcataacatatgttttgagttcagaagaagccaaaggatttgaacctttgtgaaagcat

SEQ ID NO: 20879 - DNA, 541 bp, Sorghum bicolor
  Clone ID: 12499394
atttgagtacaaggcggccactggttccttcacccctgaccgcgtggcagtgtattgcaaatgtgagatgccatacaaccctgatgacctcatggtgcagtgcgacgcttgcaaggactggttccatccatcttgcatgtgtatgaccattgaacaggccaaaaagctagatcactttgtttgctcagactgtttgaaagaaaatggttcaaagagactttcaaatgcatatgccacttcaccaaattctgagcccaaggctgaatcaaaaaggcagaggaggtgacaactccgattggcaacaacatccatgggtaagggggagatgtgctgcttatgtggtatatcagcccttttgctgtggtcagagcagtgtacagttcactagaaccagttgtttgctgttttaggggaacggttttgttcgatgtagccagtgtggcatcatcgcatgcagttgttggtagaggggcaaagaacaatccttgtgttgacttggtcagcttagccgttgttaatgtactgtgttaactgttaacag

SEQ ID NO: 20880 - DNA, 630 bp, Sorghum bicolor
  Clone ID: 12499400
ctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctagtctcaaccataaacgatgccgaccagggatcggcggatgttgcttataggactccgccggcaccttatgagaaatcaaagtctttgggttccggggggagtatggtcgcaaggctgaaacttaaaggaattgacggaagggcatacatgaatgctaaagcttgcaccttgttgcaaatcaaaagagttaactctatggagaattttccttgtgctacatgatacggtgctgagctagctgctgtagctacattgaaacatgctttagaagctactgaactatcctgtttcgccttttcttcttcccctgatttcatgcttaaaagcacgatgcatcaaaggattcgatgtgatgttgtaatcataaaggtgtaaggtggaagatacacttcgtttatggag

SEQ ID NO: 20881 - DNA, 181 bp, Sorghum bicolor
  Clone ID: 12499457
caccgcctggtcgggcgacgcatctgtgtcgggatattccgacgtcgacgactgcaggagagccgactacaacatcatctccgggacgtccatggcgtgcccacacgtcgccggcgtcgcggcactgatcatgaacaagcacccaaactggacgccggccatggtacggtcggcgctgatg

SEQ ID NO: 20882 - DNA, 450 bp, Sorghum bicolor
  Clone ID: 12499468
gcacgaggcatgtgttgaaaacaaagatttgaagttagcactgcacttgtttgaagaaatgaaaacacaccaactgaagcccaatttggtgacgtacaaaactctcctggcagcacgcagcaattatggatcactactggaggtccagcagtgtttagcaatatatcaggaaatgaggaaagcagggtaccaggcaaatgactattatctcaaggaattaataatggaatggtgtgaaggagttctgtctagtcgcggtgataatcaagatttttacaatttggacctacaacctaagaggaaagaatcgttcaacctgtttcttgagaaagtcgtaacagtcttgcaaaaagatactgatcagaaccaaactgtcgatgtccgtggcctttcaaaggttgaagctcgaattgttgttctctctgttcttcggaagatcaaagagcaata

SEQ ID NO: 20883 - DNA, 425 bp, Sorghum bicolor
  Clone ID: 12499474
gcacgagggtcagcttataatccttgttgttccaaacataacacgtctgagttaacccttttgcataagtgaggacgaaagtgtaagataggtgctatgtgtgtgcaggcccgttccacgtgaggagccgcaccatataagcaaaatttggatgtggggtgttaggctggacctcagattaatttgactatgtaccagacatgggcgaatggatagcaaggcactacaacatttatctactggagcgaagcgcatgggctgcccaagtatccaaaattagattttaaattttattttggatacttcatggatacatatccacttcgtatctgccatgtatccgtgtcgaatatgtatccgatatgggatacggcacctacctggcgtatcgggttagcatcaacaagcatgacatggtggttggc

SEQ ID NO: 20884 - DNA, 520 bp, Sorghum bicolor
  Clone ID: 12499530
ctgacccaaatattaaacgaggcttatttctaagcatagagtgcattaacaccttgaatgaagggctcttgttgcatcatgcatctgttgggtgcccaaaaccacagtggtcaaaatacctgagtttccttaaaagcaggaggttttcagagcttacaaaaccaaagtactggaagggccaacaggttgacagcatagtgaccatgcaacatgttgcattgtccaaggcaaacagtgaatacccaaaaatacacacccttttctctacggaatgttcatcatattttgactggcaaactgttgggcttatgcacagttttcgtttaagtggacagcctggtaacattacacgcttattgagctgtacggatgaggacttgaagaactataaaggccatgatcttgctccaacacattatgttccatctatgagccgacatccactgacaggggactggtaccctgcaattaacaaacctgcagcagttctccattggctcaaccatgtgcagactgatgc

SEQ ID NO: 20885 - DNA, 528 bp, Sorghum bicolor
  unsure (1)..(528): unsure at all n locations
  Clone ID: 12499544
tggagacgctgatctcccctaaactgctttcccccttctccccgctccgcccccagcagcaaccactctttttctgcttctgctccgctccccttttctcatcttgctagggtttctgtttctcctcttgctagggtttctacccctccaaatccgtcctcgctccacggccatggcgaagacgaagcagggaaagaaggacgtggattcgtacaccatccgcggcaccaacaagctcgtccatgtgggtgactgcgtgctgatgcgggcgtcggactcggacaaccaaccgtatgtggcgcgggtggagaagatggaggccgatgggcgcggcagcgtgcgggtgcgtgtgcgctggtactaccgccctgaggagtccaagggcggccgccggcagttccacggcgccaaggagctattcctctccgaccatttcgacctgcagagcgcacacaccattgangggaagtgcgttgtccactctttcaagaactacaccaagcttgacaatgtcgggcctgaagactt

SEQ ID NO: 20886 - DNA, 255 bp, Sorghum bicolor
  Clone ID: 12499566
gcacgaggcacagacagagatagatcagtatacaactctgaaggatctcgacctgaacttcatcttcagattgaagaagcaatggtttcatgagttccaaaggcaagtgaccagggattgtgagttccttgagcaggagaaaattatggattacagtcttcttgttggcgtacatttcattgataacagagagaagcttctgactgaaggttgcattgactatgaaatcatcaatgacataccaacacctcgtct

SEQ ID NO: 20887 - DNA, 475 bp, Sorghum bicolor
  Clone ID: 12499594
gcacgaggctcccggccacgcaaatcaagtacagcgacggcctgcacctctactcctacctcaactccaccaagaatccggccggcttcatcactaagccagcgactgtccttggaacgaagccggcgccgttcatggccgccttctcgtcgcaggggcccaacaccatcactccagagatcctcaagcccgacatcacggcgcccggagtgagcgtgatcgccgcgtggacgcgcgccaactcgcccacggacctcgccttcgacccgcggcgcgtggccttcaactcgcagtccggcacgtccatgtcgtgcccgcacgtctccggcgtcgtcggcctcctccgcacggtccacccgcaatggagccccgccgccatcaagtcggccatcatgaccacagcgattgagatggacaacaagggagagctcatcctgaactcgtcgtcccggtcgtcgagccccttcgggtacgg

SEQ ID NO: 20888 - DNA, 419 bp, Sorghum bicolor
  Clone ID: 12499664
gcacgaggcggcttctcacttacttggacatgagccaaaacaacctctctgggaagatacctccggccatctctggaatgcgaatactgaactacctcaacctgtccaggaaccaccttgatggagagatacctccatccattgcaacgatgcagagcttgacggcggtcgacttctcgtataacaacttgtctgggctcgtgccagggactggtcagttcagctacttcaatgccacatccttcgttggcaacccaggcctgtatggaccatacctcggtccatgcggtgcaggcatcactggtgctggccagactgcccatggccatggtgggctgaccaatacagtcaagctgctcattgtcctcggcttgttgatttgctccattgcatttgctgcggcggcgattttgaaggct

SEQ ID NO: 20889 - DNA, 288 bp, Sorghum bicolor
  Clone ID: 12499670
gcacgaggctcaggcacagcatagcacgcagagtaaggaacaaagatatctctcagatcagcgagtggcagctggttgcttcaatcaaggatatattagctccgtggtggccatggcaatggcgcagcaagcgagcttcccctgctcgactgctactactcaatggagagagctcaccaacacgagctggagggacgatgactaccggcgcatggtgatggcgtacctgatcgaggcggggtacctgctggagctggagcggcaggagcgccgggacgccgcggcggt

SEQ ID NO: 20890 - DNA, 198 bp, Sorghum bicolor
  Clone ID: 12499714
gcacgaggggaggttcatatcaaaagcatgatgacacaaccgcatgggataaagagtatcacttgtttcaaccatctggagctatcaagtttcccctacaagtcacgaccacagatgcttggctagaaaagataaaacggctggaactactacttaccgtgaaggaatctgctatggatgttccttcaaatgtagaag

SEQ ID NO: 20891 - DNA, 240 bp, Sorghum bicolor
  Clone ID: 12499774
gcacgaggatcgcacctcgccggcctcgtccccaccatgcagcgctgcatcgagcgcgccgcggacgccatactggcgccgggtgtccagcagaacggcgacggcgacgtcgacgtcgacgtcgacttctccgacctctcgctcaagctggccacggacatcatcgggcaggcaccgttcggcgtggatttcggcctcacggcgagcggtgatcccggcggtgaggccgcggagttcatc

SEQ ID NO: 20892 - DNA, 473 bp, Sorghum bicolor
  Clone ID: 12499786
aatttcgaagggtttttcttttgaagtttgtcagtcaaaattagccaacttgagtcatgagtataaatgaaatttgttttttattttctttaaggaaattaatgcaagtcataatcgaatttctatctatttgcattatagacagaaattcgaatcattttctcgagccgtatgaggagaaaacctcctatacgtttctaggggggggttgtttatctacatctatcccaataagctatctatcgaatcgttgcaattgatgttcgatctcgaagagaaggaagagatcttcgaaaagtaggtttttatgatccgataaagaatcaaacttgtttaaatgttccagctattctctatttccttgaaaagggtgctcaacctacaagaactgtttatgatattttaaggaaggcagaattctttaaagataaagaaagaactttgagttaattgaagaactaaatgaataaaaa

SEQ ID NO: 20893 - DNA, 365 bp, Sorghum bicolor
  Clone ID: 12499798
ctcacgagctccatcacactcgtccgtgacatctccagcgcgcgtctggtcttgtgttgcctggctgctcaaatggcgtcgagggtgctactcctctgcgtttcggtggtcctcgctgcggcggctgctgccgaggccagggacttcgttgtcggcggcgccaacgacgcgtggaaggcgccggcacagcccgacgccctcgccaagtggtcctccgccaaccgcttccaagtcggcgacaaactcgtgttcaagttcgccggcgcggcggactcggtgctggaggtgacccgggacgactacaaccgctgcagcacggcgtccccgctcgcggtccacaaggcggacgccggcgccggcgccgg

SEQ ID NO: 20894 - DNA, 398 bp, Sorghum bicolor
  Clone ID: 12499817
gcacgaggatttactcagcaggttttggagaagtcactcaatcaattggttgacagaataccaattcctcttctttttatgagaacagttattcaagcgcttgatgctttccctgctttggttgattttgtcatgggaatactctccaggctcgtcaataaacagatatggaaaatgccaaagctatgggttgggtttttgaaattgtcattccagactcagccacgttcttttgatgtcttattacagctacctccaccacaacttgagtttatgttgaataaatatcccaatcttcggacacctctttcttcctttgttaatcagcggaatatgcataccaccttgcccagattttgaacattctggggttttttagtgaaccacagcagacacca

SEQ ID NO: 20895 - DNA, 398 bp, Sorghum bicolor
  Clone ID: 12499833
ccaagggcaaggccgcgcagagcaatagcgagaatggtggaaagaagcaggggaaggacagcacatcgaagcctcccgagccgcccaaggactacatccatgtccgggcgaggcgcggtgaggcgacagacagccacagcctcgcggagagggtgagaagggaaaagatcagccagcggatgaagctgctgcaggatcttgttccgggttgcaataaggtggttggcaaggcagtcatgctcgatgaaatcataaactacgtgcagtccttgcaacggcaagtcgagtttctgtccatgaaattggccactgtgaatccccagctggacttcaacaacctgcctaacctccttcctaaagatatacaccagtcctgtggcccgctgcagaactcgcat

SEQ ID NO: 20896 - DNA, 446 bp, Sorghum bicolor
  Clone ID: 12499859
gcacgaggctccccccgactgggctaccgccgccgacctacgccaggtgccgaggtcttcgtcgatctcttcgccggcgacgagcacacaaaaggatgggatacaaccgccacaggcgcggccggggatcctcctcatcgtcttcacgccgtaccaagcaagaagtctcgtgtttcagtgatgatggccctgggacatcacttccaaggcaagaagaagatacagaagacgaatttaaaggttcaagaattcagcttgcaatgtgggactttggtcagtgtgatgtcaaaagatgcactggtcgtaagctttcgagatttgggcttttgaaggagttgacagtgaccaatggttttggtggtgttgttctcagccctgttggaacacaatgtgtatccaacgaagatcatcctattgtgcagagaaaaggattggctgtggctgat

SEQ ID NO: 20897 - DNA, 464 bp, Sorghum bicolor
  Clone ID: 12499941
cgcctctccctctcctcggtcctccactcgccagttcctctccaatccgtcctttgctagctacgttcccggcagcacacggcgccgccctgcagatgcgcgtgtgcgtgtgtgcgtgtgcggacacgcgcggctccatcgatcccggcagcacgcggcgccgccctgcagatgcgcgtgtgcgtgtgcgtgtgcggacacgcgcggctccatcgatcccggcagcacgcggcgcccccctgcagatgcgctggctgcgtggaggccgagccgctcgacagtggcgaccaacccttagagacgcgaggtagcgcaaggtgccccatcctcttcgttacgtacactgaccatcgctgcagatctgagtagtgagcggtggagggcgacaacctcgcgcatggagtttcggccatgacgacagcgctcgcggtgacggacgaggtgcccctgccgacaggcggtag

SEQ ID NO: 20898 - DNA, 393 bp, Sorghum bicolor
  Clone ID: 12500058
gcacgagggaggaaggttacaaagtaatgactagtaattttagaagatatagttacagagaacttgtgaaggcgaccagaaaatttaaagttgagctaggaaggggagcatcaggcactgtgtacaaaggcctcctagaagatgataggcaagtggctgtgaagaagttggaaaatgtaaaggaaggcaaggaagtgtttcaagctgagctaagtgtaattgggaggatcaaccacatgaaccttgtgaggatatggggcttttgttcagaaggatctcataggttgttggtctctgaatatgttgagaatggatcactggctaacattttgtgtaatgaaaaaagtaatatcttattggactggaagggaaggttcaatattgcgttaggtg

SEQ ID NO: 20899 - DNA, 201 bp, Sorghum bicolor
  Clone ID: 12500086
gcacgagggttccctggaaaatacgcgctggagatgtcctccgacgtgtacaagagctggaatttcaacgagcaggctctccccgcagatctcgtcaagagaggtgtggctgtaccggatcagtcaagcccatatggtgtccgactactgatgaaggactatccatatgccgttgatgggctcgtgatctggtgggcgatt

SEQ ID NO: 20900 - DNA, 400 bp, Sorghum bicolor
  Clone ID: 12500137
ctcgcctccgccgccgacgctggcgcggtcgtcgacctgcaggacgtgttccgtcgcttcgcgttcgacaccatctgcaagatctccttcggcctcgacccggggtgcctcgacctggagatgcccgtgtccaagctcgccgacgccttcgacaccgccacgcgcctctgcgccatgcgcggcgccgccgcgtcgccgctgctgtggaaagccaagcgcctgctcaacgtcgggtccgagagggagctcagggaggccatcaagctcgtcgacgagctctcggccgccatgatccgggaacgccggaagttaggcgtcgccggcagccacgacctcctgtcccggttcatggcctcgtccggcgacgcgcgccacgacgtcgacgacaagtacctccggg

SEQ ID NO: 20901 - DNA, 227 bp, Sorghum bicolor
  Clone ID: 12500181
agccatctgggtggtagagttgctgaaagccgcccgttatcattgtcttccagaaatcgtctgtctggcactaacgtaatatacatttagccatatacatacatatatatatagctcatcgctaatactttgtagggtaggagatgtttaacttatagattcagctcacagatagaaagattgtaacacaagcgcaagccagtccggagatgtaaattttttattac

SEQ ID NO: 20902 - DNA, 534 bp, Sorghum bicolor
  Clone ID: 12500207
caagtacaacgccacggtgatggccatgttcaacggcgctccctacacctgcccgaccggcgaggcgccgcaccgcatctcggacctcaactacccgtccatcaccgtcgtcaacgtcacctcggcgggcgccacggcgcggcgcagggtcaagaacgtcgccaagcccagcacgtacagggcgttcgtcgtcgagcccgccggcgtctccgtggtggtgaacccgtcggtgctcaagttcagcgccaagggggaggagaaggggttcgaggtgcagttcaaggtgaaggacgccgcgctcgccaagggctactcgttcggagcgctcgcctggaccaacggggttcatttcgtgaggagccctcttgtggtcaaggcggcttgatgagcgccatggtgtagggttttaattaggaagggaagcaggtgtagagaggatgcattagtttggtgatttgtgaaaactgaggctgggacgaacttggcctctgattcgataaattattatataatatatattgaactctcgcgtgt

SEQ ID NO: 20903 - DNA, 456 bp, Sorghum bicolor
  Clone ID: 12500319
atcacataacaaaaaaaactgatgtttttttccagcgccgtttactgtttgctaaaagtagtaaaaaatgaactaaaaataaacagtgaccatcagaatgctccaaaataaggtgtagggggagccttacaattcatactccctctattcttaattataagatgtttggtttttctaaatatataggttttgctatgcacttaagtacagtaatttggaatggagagaataattgatataagtcagattgcttcctttggaacacaaagtaaacatgacaaacttggatatgcatctgttaagttcagaatgcgcagattagaatagattggatgcagtcttatcttattgtgagcttgatagttttcatgaatgtgaccctataaaaaacgttttcatgcatccttgtacagttgaggttcggatttcatagaagcttttagaattttccattgt

SEQ ID NO: 20904 - DNA, 221 bp, Sorghum bicolor
  Clone ID: 12500343
gctgggcgggaaacatgttgtgtttggcaagctggtggaagggatggacgtcgtcaagaagattgaagctgaaggccaagcgaccggcgtgcccaaggccaaggtggtcatagtcaacagcgggcagctcccatcatagagaagtgatgatccatctatctccatcccatccatcttgttaagaaaccaaacatgtgctgtgtttttcagtgtgccattgc

SEQ ID NO: 20905 - DNA, 460 bp, Sorghum bicolor
  Clone ID: 12500359
gctcacgccggaccacgtcagcgcgctcaccggcgagcgtggagcagcgcgggcggcacccgtgcgcgcacatccccttcggcatcggcccgcgggcgtgcgtggggcagcggttcgcgctgcaggagctgaagctgtccatggtgcacctgtaccagcgcttcctcttccggcggtcgccgcagatggagtcgccggcggagctccagttcgggatcgtgctcaacttcaagaacggcgtcaaactcgtcgcagttgagcggtgcgctgccatgtcgtagtatcgtgtacggacggatggtaacggcaagtcgagggtgtagtagtggtcacttggacgactagtttcgtggaaactgatctctcgaaaatagtttcgtggattaggtgtaaagaatgttccagtgcttgcagctagttgaaactctttgaagataacaaaactcaaacgtgtgcatcg

SEQ ID NO: 20906 - DNA, 598 bp, Sorghum bicolor
  Clone ID: 12500373
tctatctaattacattgtatttccattgacaaaggtctattgaacaaatagaatttgtagatagatgggtctctttattgtcactccatattaggtatttctgtctacacttcgttcaaatgatagggttgcccctcttgcatgtactctcatacaagattattttacttctttaaataaaaattgccaaaaaaatcacaattttgccattgtgattggggctgctcttagccttagtgaaattgaaccggatctgttcattttggtatttgagtgtttttaatggattagaaaatctttcttttgatgtcttgctaattcaatgttttgacaggagcgtccggtgtaatttcatcgatttttagattttgatcgtatctaagagatcctattttatctgggttgctaactcaatggtagagtactcggcttttaagtgcggctatgatcttttacacatttggatgaagcaacaaattcgtccagacttttggtagagtctagaagaccacgactgatcctcaaaggtaatgaatggaaaaaatagcatgtcgtaataaaatcaatttctttttttttaaaaaaaaaagaaatgtat

SEQ ID NO: 20907 - DNA, 493 bp, Sorghum bicolor
  Clone ID: 12500381
gttaaggaattgcagcagctagagaaacagctagaatgtgctttgtcacaggcaagacagagaaagacacaacttatgatggagcaagtggaagagcttcgcagaaaggagcgtcacctgggagaaatgaacaggcaactcaaacacaagcttgaagctgaaggttctagcaactacagaaccttgcagcatgccgccgcctggccagctcccggcggcaccatcgtggagcatgacggcgccacgtatcatgttcatccacctgctcactcagttgctatagactgtgaacccactctgcaaattgggtaccctcatcaccagtttctgccttctgatcaggcagccaataatatcccaaggaacgcccccggaggcgagaacaacttcatgctgggatgggttctttgagttgttctctcaatccatccatcagatgggcaatcatgttaaacaaataaaaggcattcagtgttgtatatgcatgcatatt

SEQ ID NO: 20908 - DNA, 506 bp, Sorghum bicolor
  Clone ID: 12500385
ggaggtgacccgggacgactacacccgctgcagcacggcgtccccgctcgcggtccacaaggcggacgccggcgccggcgccgccaccgtgccgctgtcccgctccggcccgtactacttcgtcggcggcgccccagggagctgccagaagggcgagcgcctcctcctcgtcgtcatgtccgacaagcacggccgtggccgcctgcggggccttgccccggcgcccgagccggctgctgagtcgccgtttgcagccagcttcgtcgggggccctgccgcggcgccggcgccggccaccggggccgcggggaggacggcggctgccgggaacaccggcggcgctctgcttgtcggcgccgctgcggttcttggggcgctgctggtctggcgctagtcaaagtggggcagcgttttttttgggagattaattctttgattcgtcctgcttgctaagctcgaagagagaaagaagcaatctgctgcttcttctgtcagtgatgataaat

SEQ ID NO: 20909 - DNA, 360 bp, Sorghum bicolor
  Clone ID: 12500415
acacaagcttcttcctacacctacaatgaggagcaaagaatgtcagtactagaggaacaccgtccctggcagcaggactcgagacttgccaacctagccccaaactacagctgccccaaagccggtagtagcagcgagcccagtagcagtgggtgtgaaatgatgcacccttacaatctgggtactttgtcaaggcccccatcggcacgctagggaaacaaatcccatagtgtgcatggccagatcttatatgtttttgttgcattttgccggttgctattaagggtcctatctaagagtcatttgttgcatctcatgtcttgtgcttagcggcagaagttatctttcatgttttttggc

SEQ ID NO: 20910 - DNA, 588 bp, Sorghum bicolor
  Clone ID: 12500440
ctgtcttgtgtggaagctttatcagcagccctcataatatgtggggaggaagatacagcacatttgctgcttgggaaattcaagtggggtcacgcattcttgtctctaaacagagatctcttgaaagcgtactcccaatgtgaaaatggatctgagattatcaatgtgcagaactcatggttatcgagtaactcaagtgttccaaagccacccgtaaacgggacagaggaagcacggcaaagcacggaggagggatctgaaggtgattcagacgatgacttgccccctctcgagaagaatctgaaccacctgaaccttgatgaagatgaagaaagcgaggaagagagtgaaagcgaataaaattatgggctgccaactttacggcagttttacaagtgaacttcagctgcctttgggttctatacccttttcttcttaatatattttgatgcgcagatctcgtgtgtattcgagaaaaaaaacagttgcctagctactactgtagggttccttcagtgtctaatcagaataaacttcagtggtcttttcgtcctgatgttgaatgcatggttcgaaaagaaatccttg

SEQ ID NO: 20911 - DNA, 214 bp, Sorghum bicolor
  Clone ID: 12500448
gcaaggaaccgatcagccagaaagaattgcatgacaaatgcaaagtttgagtggagagggtatgatgggattgaccaaatgaggccaagtcaagccaagtgaagccgcaacatcttagatgttttggtttagaaacaagtgtcttggatattttttgtttgaataatgtttgtgttgtctcagtttgaatttttggatcgtttattctacatgt

SEQ ID NO: 20912 - DNA, 365 bp, Sorghum bicolor
  Clone ID: 12500506
cagacgaggcgccgtgccggtaccggaggttcagccacggcgagtacagccgccattacgtcaccagcaggctcgctgatccgatgattcatgataacttgacggatcgcacggccctcgtgccggcgacacatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgactcatgaggaaacctccacgtagtcgcatttggtcaagctgcctctacccgtgcttgcaagtttgcaaaagc

SEQ ID NO: 20913 - DNA, 388 bp, Sorghum bicolor
  Clone ID: 12500627
cgtggcggagcggatgggcgccggcgtccgcgtccgcgtccgcgcggacgacgacggcggcgtcgtggtggaggcccacgagctggcgcggtgcgtggaggccgccgcggcgtcggatgccgtggcggcgcgcgccgcggcgttaatgggcaaggcgagggcggccgtggcggacgacgacggcggcgggagctcgcaccgcaacctgacggagttcctcaggcagatcgcccgcggtcccggcgaataaaccgttgcaagcttgccttgcatttctagcgaaaccatccatccatactgttgattgcgatttggacgatcgagaataaccggaatcgatctctagttttttttttttcaattgcgagcagtaaacaagagtgtacaa

SEQ ID NO: 20914 - DNA, 618 bp, Sorghum bicolor
  Clone ID: 12500760
ctcacgctgtcgatcggcctgtgggaggacgcgagcagcgacgacgcagacggctcgagctccatcagcgaggagctgctgctgcctgctccggcagcaggcgctcgccgcgtcgccgccgccgtgaaggaggaggagagcaagccggcggctctgaacctggacctgaccatctcgtcgtcttggctggcctgagtctgacgacgccgccggcggccggctggcggcgctgtgcgtgaccggcacacgtacgtacagttccgtacgtacgctcgtgtacagttatacggactcatgcatgcagagcagcagactgtgtgatcaggccttcagtactagactgtatatggcgtggcagtagtcttgctagataggtcgctcggattttcgtgtcctgcccttgttagccactccgttttagtctcttctcttcttttttattttttagatttgtataacattttcgggtccattcgattaggaaccgggcttcagacgacggtgggtgaggaatttctgcagtcttttttctttgtctggggagaaggcgctgattcctcacctgtcatcgtctgaaatgttctatttctgatcgattgtctagactctagaaaagga

SEQ ID NO: 20915 - DNA, 440 bp, Sorghum bicolor
  Clone ID: 12500799
ccaggacgcgatggactacgcgtgcggcatgggcggcgccgactgctcggccatccagcccatgggcgcctgctacaaccccaacacgctgcaggcgcacgcctcctacgccttcaacagctacttccagcgcaacccgtcggcggcgagctgcgacttcggtggcgccggcatgctcgtcaacgtcaacccaagctcaggaacttgcatgtaccagacatcatcaggtttcggcgccggttacagcccggggacgacgggcggcggcgtgcccggcggttacactccggggatgtcgggcaccggttacaacccagcgggagggatgtcgggcaccatgggagggggctccggttccacggtgctgaacgccaacaaccctgggggctccatgtacggcggctacgacaacccgacggggctcaccgcggggtcggacg

SEQ ID NO: 20916 - DNA, 424 bp, Sorghum bicolor
  Clone ID: 12500838
gtggcgcatcagcgagctcgacacgacgcggggcgaagggtcccccgcgaggacgacgctgggtgtcgtcgtcgtcgacgtcgacagccccttgaggtctaggcctctcagcgggtcgtcccagatgcggcccgacgagccctgacgccggaacgacaccgacgacctatgcagcctcgacattgacgacgggtgacggccgtccggtctttgcgtggcacgaaaggccgatgatgggtgcgtggactccagctcgaagactcgcctttttctcttcttataatgtagcgtccggcgggccgcaggcgatgatgcgctggtggtaggcaggtatgaacacccgtacgtcgttgttgtggttggttagcctaacataggaggccagtttggcgcgaaaacatatatatagggtggttggtgcgta

SEQ ID NO: 20917 - DNA, 514 bp, Sorghum bicolor
  Clone ID: 12500917
ggaccacatcttcatactgtttatccacatggctccactgatactcttccttttgccacgatgggttctggatcccttgctgcgatgtcagtgtttgaatcgaagtacaaagaaggcctcactagggaagagggaatacaactggtgtcggacgcaatatgtgcaggtatcttcaatgacttgggtagtggaagcaatgtggatgtctgtgtgataaccaaggggaagacagaatacttgagaaaccaccagttgccgaatcccagaacatatgctagttcaaagggatatagcttctccaaggggcagactgaggtactgtcaacaaagatcacacctcttaagcagaaggttgaggtcactgagggtggtgatgctatggaggagtgatcctgtattgcattcaggcaaacactcatattctttttatattattacttagtggagcagctagaacaagacaagaacggagatctttgttgtactttctcgattgaatccagactttcatgcc

SEQ ID NO: 20918 - DNA, 190 bp, Sorghum bicolor
  Clone ID: 12500953
agccccgtcgaccccgccgacgaggtcgccgccggcagcttccgccggtccaggtactcccggcccgtgtcgcggtcgagctcgttcgccatgtaccagcagccgcagcacgacgcccccgccttgcacgcgtaggattcttgacagcccaagagtacgtgtgcgtgtgtactaggcgtcaaaggggaga

SEQ ID NO: 20919 - DNA, 599 bp, Sorghum bicolor
  Clone ID: 12500987
ccgccacggcggcgacgcaggcgagcacgagcacccgagcggcggcgaggccaacgtcgagcccgcagcagcagcagcagcagcatctgctggtgctcccgccagggagaccatgccggcgccgccaccggaggcgatcacatacgacgatcgctgctgccgccgccgacgcgggcgcgcattgccgttgcccgcgttggtgccgatcatcctggtcgggctcgtcgccgggaagctcccggcgctggcgctggccgtgctctgcgcggcgttctcctccaggtcagtcgagagaattccagttccagttcctgccagtggtgatccgattccgaaggtagcagcaggtagctagcggagtgttcttgtgttgcagctcggattctgccccggaacgagaaccgaccgagggatcagaatccggatcaaatttgtttttcttgtaattgcattccttcttgaatccgaataagaagaagtgaaatgggtgacagaagaaaactgattttcttgtaaaggcatgcgtgatcttccattccattccattgctcggtctcggaacagctgacagtgaagacttgggctccaacgttcaaaag

SEQ ID NO: 20920 - DNA, 101 bp, Sorghum bicolor
  Clone ID: 12500989
aggtgcttcgctcgccacgcttcgttctatctgctgcataggtgtttaggctctgttctcgtcagttctagccttctacgcgtgcgttgttgttcttaaga

SEQ ID NO: 20921 - DNA, 585 bp, Sorghum bicolor
  Clone ID: 12501070
tcagaactcaattttaggatgtcaatcccaccgcccttcactgtgggttcgcacactatttacgccaatgaaaaaaacagggagctccgtacatccatatgcgcttcgttattcagagccaattgctcactttgctctttcgaccggagcattttcagatccacctgtaaggctgtacacagccaagaaattataccatcaactggagcaagccagaaccgagttcattcaagcaaatgtgatggtccggaagcagaccatcttcctacccaaagttctccacttctatgcaaaggatgcttctctagagttggctgacctaattgacatagtatgcgagagcatgcctgaactacagcgaaaagagataagacaatatcttaggaggaggattgacaagtgcattgagtggttgccctacaaatcttctttcagatacactgtgcatgggagtttggctgagtaggcactcttttcctctatatatgtgcttgtatgtaagtgaggagccaagattctaagaacaatctgttggtgcttgtgtaaaactgtaaataggtaatgtgatagttctttcttagagag

SEQ ID NO: 20922 - DNA, 455 bp, Sorghum bicolor
  Clone ID: 12501105
atggatgcccgagcgtggctaatggaagtcatgaattcaaagcattaagaagtcaagagggtggtcatccgcctgtgggcggtgtggtacgcgagatgaaaggcgatccatgaccatgagaatcagtttcaaagcccgttcttgacacatagttttgtagagcgatattgggcttgaggagatcaaacaagggagcccggaggtgcggccagtggttgtgcaactgccgtgctggataagacccccaagcggtttggcaaccttgtttagttccgaaaaattttcccctacgagttctaaacagaagatgcattattcattggccaaaaatgttcactgcctcccctgatttaagagcgtgaaatgattctctaactgagactaaaacagaaagaggaaagtgcagtgtgccatgagctcctaaatggcaataaaagcactgaaaatatccccaa

SEQ ID NO: 20923 - DNA, 644 bp, Sorghum bicolor
  Clone ID: 12501206
cgatcatcctatcatgatgttgtgagagtttcagagatcgaggacatccttgatattagtgatgtgcagacttatgtaatcaatagtgcaagggtggtattcttgaatgagcgcccacaactgcgtgcttctggtgtccccatctgtaaggcaccttcgtcatcaacacatagctgcgagacatgcaatcgtgctctacttgatgcatttcgcttctgctctcttggatgcaatgtaagttatcacaaagtacctaaggatgttattttctaaaaaaatacaaaattaggaaataagttccataattaatggatttcatatatctaataaaatccttatctttcatagcttaaaggcttaaatatggaaatgagtacgccatccatggttgaaaacagtcctcaatccaatggtaaggatcatgtcactatgattgacgatgttggttcaagtactacaagtgacaaagacagctgcaatgacaagaacaatgaagaaccaccaccaaaaagggttgctcgtcaccgacgcaagggaattccccaacgtgcgccattcttctaatgtgaagctcatgacaatatccattaaatgttggggcaaataagatgagagaaatgtatgtcatgggtagaataaaagaa

SEQ ID NO: 20924 - DNA, 463 bp, Sorghum bicolor
  Clone ID: 12501232
tcagaggaatttgcagcgtacatcaagcagagaggttatgacctacatgatgtggaggcttatggacagatgctgaagagtgctggttttcgtgatgtcattgctgaggatcgaactgatcagttccttggtgttttagagaaggaattagctaaatttgaaaagaacaaggatgatttcctgtctgacttcacccaggaggactacgatgatattgtgaatggttggaaggcaaaactgcagaggagttctgctggtgagcagaggtgggggctgttcatcgccaccaaatgatgatgcagatgtgcgtggacgtgcaagtgcaaataaagcatccttttattataattgttgtcgccttagttcttctgaatccaggtgttacctgttagcctgggttagtacctactatcctgtttatttagtgcgtggagaaaactcgtccagttttacaatcaccgtg

SEQ ID NO: 20925 - DNA, 670 bp, Sorghum bicolor
  Clone ID: 12501234
gaaacgagaagctgaggctagattaaaagagattgaagctgagaagaagaaaccttttgctcgaacaagggatgaccctgagcttgacaatatgctaaaagaaagaatccgatggggtgatcctatggctcatctagtcaagcggaaagatccagaatttattttggaagacttgggagatgatgaaaagatgaaagaatctggtttcatagtaccccaaaatgtacctcctcacagctggctgaaacgtggagtggatgctcctccaaaccgctatggcataaaacccggtcgacattgggacggcgtggatcgcagtaatgggtttgagaaggacatgttcaagctgaagaatgagaagcaagcaatggagcaagaggcctatctttggtctgtctcagatatgtgagcccaaatgttgtctcttacgagaggaatactgtggtctaaaggaagaacgaagaaccaatgaagacctttcacacgattttctttttcttacaccaaatgacatctttagtgatgctgtgctggtagcttgaatatatattttttccccctggaaagctcgatgaagctgcatttgttggaaatctcaaatctgttactaccctttgtcatccttcacattttgtaatatagacgaacgtacgtagaaaaaaaaccacag

SEQ ID NO: 20926 - DNA, 586 bp, Sorghum bicolor
  Clone ID: 12501242
tttgtacatcaagatggagaagtattcagatgccgctgccttctttttaagacttggttcatctgctgataagtgcaatgccatcaatagccaatgcaaggcttatctgagtgcgatcatcgtctatctttatgcacatgactttcagcaagctcagaaatgctacaatgactgctcagaggttcaagccttcctcaatagtgaccagaatcgatgcgcaacaaaactattgtctgcttatgaggaaggtgatgcggaagaaatcaaacgcattgctcaatcaagtgccttcaatcaccttgaccatgtggtaattaggcttgcacggaagctaccgacaggtgatctgcaggccattaagaaagctgatgatggcgaggaatccttggacgaggatgacctaacttaaaacaatctcccgagccaaaagacgcagagagcaaacgagcgaggggacactcatagtttgccatcggtgagcgggaatgggaacagttgtaaaaagaagttatgcgagttatatacaaacttgtgggcagcattcccgcatctatatctataacatggaatttgtagggctcaatat

SEQ ID NO: 20927 - DNA, 385 bp, Sorghum bicolor
  Clone ID: 12501348
gcgggtggcgggcgtggtactaccggcagcaggtgcccgggtgggcggtggagtacgaggaggggctgacgctcgtcacggtgcgcggcgcgggccaccaggtgccgctcttcgcgccggaccgctcgctcgccatgctctaccatttcctccggggtcaggccctgccggccgcacgctcctccggctaaagctgctagctcaccgatgatcccctagtggtagatcgcgttctagttgcattggctagcagcgactggccacgtgtagtgtaggtaatgcaatggcgttgtgtgtgtgtgtgtgtgtgtgtgtgtgtcgatgtaccactgcagatcggtaccgacaaaacgggaaaaatcgatcgacccaatggagaaactga

SEQ ID NO: 20928 - DNA, 187 bp, Sorghum bicolor
  Clone ID: 12501372
tgactgtggtatctgttgatatctttctgttttatgatagtggcagtgataccaggctgttaggagtggggtggggaggtttcaaattcaacgtacgtcatgaacatgtgattcctctttattggcctgactcacccatggatgttagtgtggatgcaatgtagacatgtagtacagctagttgtaa

SEQ ID NO: 20929 - DNA, 471 bp, Sorghum bicolor
  Clone ID: 12501390
gcccaaggatatacccacctcataacaatgtctcagagcagcgggaaaccacgtgcatgtaccatgatggcacgaagctggagcgacctcctgccagggctgttgctgaagctgaagaatctcgtcaattcgcttacacctacgcaaggaggaagccacccaagagaccaactatggtggaagatccagtgccaccaagtgtgctagacagcatggccaacatgaaagcaaatgcaatcaaactctgaagctgaagcttggcggttgcagacattgagaactgaacataattggggttggggacagaatttagcatccatctaacatagtaaataagtatgaacttttttaccttcctactgtaatatcgatagaccaaaccctccagtagattatatgtctgttgccattgtcaaacgggataagtagcttacacatttatagctcaaatgttaagcatgagatcagtat

SEQ ID NO: 20930 - DNA, 152 bp, Sorghum bicolor
  Clone ID: 12501396
gaaattggatgggtcgcccgggaaaaaaaggtttgtcaaaattggttcggcaggtgtttaaaaacggtttcctgttggcaaaaaattggatccccgggcagcttattgatttgtttggaggtgttggattcattgaaggttcaatttgtgat

SEQ ID NO: 20931 - DNA, 551 bp, Sorghum bicolor
  Clone ID: 12501429
caacagcatccagcctgtgttgtcaggcgtggcgatcggtgccgggtggcagtcgttagtcgcgttcgtcaacatcggcagctactacctcgtcggcctgcccctggcagctgtgtttgggttcaagctgaagctcaatgcaacagggatttgggtgggcgtgttgattggaacagtattacagactgtgattctgtttgtaatcctcagcagaaccaaatggcagaaagaggctatgctagcagaagagagaatacgggtgtggggaggaaacgtcgagctgccacagactcaagagacgagaccaagtgaaaacactgccgcaactgtatcataggaaaccaatagagaataaaaaccaggaatcgttaccatattcagccgtcagaaattcagaatcgtctagtgtgtcattaagtgtggagtagtagtacttgtaacagatgggaaaatgtgatacgcctacagctgtgtgcgtgcgtttgacgttgcaagcattgagtggacacttgattcgcaaaaaaaaaaaaggaacgaatcgttcacgattc

SEQ ID NO: 20932 - DNA, 165 bp, Sorghum bicolor
  Clone ID: 12501447
tgacggtgcggtggaacgggcccccggccgtggggggccccgaggggaacctgaagtgggtgttgaacgagcacgaggtccggagcccgattgtgatacccccggccaaggcccccgggtaggggtagctccccaattcaatttgcttaacggccggcatgaccg

SEQ ID NO: 20933 - DNA, 618 bp, Sorghum bicolor
  Clone ID: 12501483
gacgctgaagaagactccctttgtattagatccatctttgtcattgaaggctccatattggtgtgcattgaggacctagatcagtttggtggtatcccttatgattcaagtcccccatacttttctcttgatgcatcttgttctattagcaatatccgagaagtggtcatggatcagggcaacgacaaatgtttgacattgattttggatagtcgtaggcaaggagagtttcaggatagcatccaaaatcctcaaaacaagcagtctgatgaaatcggcacagtacatacatggaaacttaagtggttctctgaagaagcatctctgaagtttatttctgtacttaaggctctatactcgacagcagcagcttcgtctttacctgtaaagtgtatatcctgataatgtcggttattatagttctacggtgatttcattcattcttttggggtttgtatatgtagctgttaatctgtacagtttgatagttaggttctagttttgtgtttcctgtattctttgtagtatggttttcccagccagaagttgtacagaacagagcgagtaggagtgtaaatgaatggggttgcagttttggcagctggcggaatgttgttc

SEQ ID NO: 20934 - DNA, 124 bp, Sorghum bicolor
  Clone ID: 12501487
gagtgcctagccatggatgtgaatgtgactggatattgttggactgctgctgcctgcctgtgaactgtctgtgatccatctggagcgagcctcccggccgggtggctgctgcctctcgtgtgca

SEQ ID NO: 20935 - DNA, 196 bp, Sorghum bicolor
  Clone ID: 12501491
tggtcggtggggtttttatgttaaagtcggggtcagggccaatttggggtttttctttatcccatgttttgggaatttttgtacccccctagcccttgtggtatgtgctcctgtgggggttccttagtatcaaaaggaaacccctgctggccctggagtgtttttctctttattagtcctttgtttaaaactaggt

SEQ ID NO: 20936 - DNA, 376 bp, Sorghum bicolor
  Clone ID: 12501503
gcgccatccgcgtccgcgacgacatgctgctggccgcatccgaggcgctggcggagcaggtgacggaggagcacttcgttaagggcctcattttcccgccattcaccaacatccgcgccatctcggcgcgcatcgccgccaaggttgcggccaaggcatacgagctcggccttgccagccgcctgccccgccccgatgacctcgtcaagtacgcggagagctgcatgtacacccccacctaccgctgctaccggtaaggggggcaagctgagccatggctgggcgctggggccggcgcaaaggaaaggaaacgggtgaattattattacagactacagagtgatgagtgaataaaaagttgagctgatgattgtgc

SEQ ID NO: 20937 - DNA, 559 bp, Sorghum bicolor
  Clone ID: 12501557
gaagtgactgcattcaagaggaaactttgtttcggtcaaaaggatggtaagaagaaaggaaaggtgcatttcgaggaagatgaagatttatttgaagatggctctgattcagattctccacatggtagcccagtatatggtgagtcacaggacagcagctctgctagttctgacgatgaaggtgatgatgacgtggagggagacaaaggtgatggtggtacagcctgtgtaaccaaaggagatggtgcaggtgctagtggtagtagagttcgtggtagttcatgtattggaattgggaaacatattcatatcggtccaaggtcaactagaaagaagaaaccaactctcaagagtgtcaaagatctctaaaagcatatggatgctttaatggtaaactggtgatgcaaatttaagccctaatggagaagatatggagctgcagtgtagtgtgcatgttccatcattttgcatatattttgggaagtacttaaacatgtaatattgggcacttcattaatttgcaatgccatgaacatgtaatattggaactttgcaagtc

SEQ ID NO: 20938 - DNA, 465 bp, Sorghum bicolor
  Clone ID: 12501589
gagaagaaatgcccgagaccatcagcatcttccccttcggttgagctgatgatccatgcttgtacatctggcactaacaattctacatgcatttccagctccattcaatgctttgctaacctaagaggtcccgtttccggtattttacatttcgttcaatctcttttgccgtttttttcgtcagttttgatcaggaaatgcgtgagcaaaactcgtttagctcaaagagtgtctagcgtaggtggaaaaataatgtacgtctttcacaactgaacctgtaattccgctttccggcaaccaaaggtgtatcccgttttttattaatactgtatatctacttattgtttcccataggacaaagtagcttgtgttgtgtgcactatcttgctattgtcactgtcttactgtactcgagctcttccagacagcccaattatgaacagacaagttggtactgagtgcccc

SEQ ID NO: 20939 - DNA, 544 bp, Sorghum bicolor
  Clone ID: 12501591
ttttaaacaatgacatggcagaagaatatgttgatatgtgggctaaccaagacgaactcatcacaatgcacgagaaagcatcgccgatgttcagatacgagcttagccggatatcagcgagtgtgttcattgctctggggaaaggaagaatccagtgccccagcgacacgaggagccaattattccatggatggttcaggccaatgcttatggacttcggctggctccagaggtgctccaaggggctagatgtgagagtcctggaggagaacctggggcaagccctgctcacccttccacttcaccaacagcagagcttattcgttgaatggtttcagtgctttgcatctagaggcacagaatgccctaatctcagcagagctttccaggtatggtggaggaggtcatttgttagatcatctgtagaggtgcgtcagtgagcgattttttacttcactgtgaggtatatcatatatatgtgctgcgtgcatcattgtaaaattagagctatgcaatatctaatagattcaattatttttttctt

SEQ ID NO: 20940 - DNA, 478 bp, Sorghum bicolor
  Clone ID: 12501597
cgcttgctgtgggctgggcaagtatggaggcttgatcatgtgcgttcttccacagatggcgtgcagtgatgcatcaagccatgtctggtgggatgaattccacccaacagaggctgtcaaccgcatcctggcagataatgtgtggtccagtcagcacaccaagatgtgctatcctttggacctgcaacagatggtaaaactgaagctgtagaaccaatctcgaatgacttgtttaacatgcgtttcaaagaacttaagaggtgacaagcctaattgaaatgtttagaattgtgaattacaaaatatttataaggatagacttgtcagttttagatagctcagggtacatgaaaagcaagaggttgttccttggtatgtagatgcaatgtaggggatctatttggcgaaactggaacacatactatcaagcatatgtgctaatgactgatgaataatttaggcgacagaaagttatttt

SEQ ID NO: 20941 - DNA, 143 bp, Sorghum bicolor
  Clone ID: 12501608
agtatgaactaatgaactgccactgcagtgtagcaattatccccctaaacatcatcctcgtgatcctgctgtgatagagattttgttgcgttcagtgaaaccagtgttgggcctgaattcaatggttaatggaaatcgtggtt

SEQ ID NO: 20942 - DNA, 526 bp, Sorghum bicolor
  Clone ID: 12501651
tcttttctacaccagaaaaacctaaggaagtgagcagtgtataccgggaaacagagaatgcacagtcccaacacaagaaggaacattctggcagtcatgatttcagtgtgcatagaaaggatctgtggtccatggaaaggaaatgacgggcctcgagatccttctggtacacaaacatctgtgatggctacaatgtggccctgtctgatgttcctaaccttggtcgctgtgtgcaccatcttctgtctaccaccgacgtttcccggggttcctgagatctgaagagatgttagtagtagatttcgccggagctgttgccttgcccacggccattttgattgatcctgctgacattgctcactccaccctgtacagtagtagatgctagtcctctcctcaagatatctgtctccgtcttcctttgtaaagtggttgctggggggtgaatctgatttttggaccaagaactctgtaaatttgccgcggttctctcccttcttcagtaaatccaatgagaaaagctttc

SEQ ID NO: 20943 - DNA, 496 bp, Sorghum bicolor
  Clone ID: 12501653
cgtcacctcctccatgtcgtcggcggcagcgtcggcgagcagccggaggcgcagcaagtacgccgggctcacgcaggacccgtgcttctgggcgagagtggaggaggcgagggagcagacggagagcgcccggagcgagcgcgacgtggcggagctggcgatgaagctggaggagctgcaagagttcgagagctactcccgtgagctggtggcgagcaaggaggtgtccgtcgacgtgctcgcgccgcagtcgagctacacgctgtgggtggaggagtggaaccagctcaagctcagggatgaagtgagggcaatgttgcttcggttttgagctgatgaatccgtaggtagctgatgatgggcattctccaaatagttcagatatacatgaatcattgggtcatggtccatggatgctagtataggtgattgtagatatacctaaacctagaagtactactgcagtggattgcaatatatttgttctttcatgggt

SEQ ID NO: 20944 - DNA, 403 bp, Sorghum bicolor
  Clone ID: 12501679
tgaccccctgcctgaagaaacatatcgtggtctactcaggctccttcccggatgtggagatgggcaaagaataccaatctggatctggaggtagtgatgccggtgatgcaagcatcaggctgtcgtttcacaggcatgcctatggtctaggcgagcactacaactcggtgattccagccgaatcatcttaacaagagaaactcgatgttctgatggtctctaatacattttgattgtttatgagtggtgcttgtctgagtctgaacacaatagatgactttttattttcctggttgctgtaatctttcaatctgtcgatgaaggtagtgtaccaatcaaagctgtattggggagtttgtttcccaaacaattttgctctcttcagtgatatgttttgggttgt

SEQ ID NO: 20945 - DNA, 477 bp, Sorghum bicolor
  Clone ID: 12501681
tcttcctgtctcaaacgtccatgttcctcaaggtaccatgattgcagtcccgatggagccaatccattacgatgaacagatttacccccaggcacgcagtttcaatcctttccgcttcgcagatccaaacggcgttagtaacatcgtcgacagcttcaccgctaaagaggatctcgaggctggcaaagaaggtgcgggcgaacgcaaggccaagtcgaccgctaccctcgatgacgcgttcctcgggtttggttttggaaggcatgcctgccctggacggttttttgcattgaacgaaatgaaagtatttattgcacacatgctcctcaactatgatgttgagcacatggcagtaagaccaaagccactggatacagtgtggttgaaactaccgctgcacggaggaaagatacgtgtgcgtagaagatcgtaagatgatgtagtcaaagcaaaccaaattcaaagtatttttatgtc

SEQ ID NO: 20946 - DNA, 255 bp, Sorghum bicolor
  Clone ID: 12501709
gctggatccagagaacaaagagcttgtcagcgcattcagggaggccatcgaagctgggagaaagttccatggcgtggacacgccaagctcaacccaatgagacgaggattatgtggtggggactgaagctgtgctgtttgatgggaagatagatatgataaggtggaggtagtctagttggatggccattattattaatattttagttggaatccgttgagatgaggaatgatgatagtgcaactcaagttcgat

SEQ ID NO: 20947 - DNA, 510 bp, Sorghum bicolor
  unsure (1)..(510): unsure at all n locations
  Clone ID: 12501715
ctgatggctcatccaccaattatggcgacaccgtcatcatgacaatccaaccactgacccgcccacaccttgctgcatcggccgcgagcggcaacatcttcccgctctcgaatgatgatggagctcttctgatcgtcaatgtggagctttactgggacagcaaagacgatgacgattactgggagcagcagagccggcgcctgcatgatgcctggatggaagagttcacgcgcatcggcgcacttccttcgacagggtggatttaccccaactatgcaggcccgtggcaggagacttactctgcagagaggctgggtacgaacaccacgaacgagctgaagaagattagggagaggtacgacggacaaggcgtgtggaagaggctggttcctggagtatggcactactaggctttttcatcatacaccaagaaatcgtgcgcgcaacacggcaagaagaattaagcaanacattgtaatattctcgcacaagtataatcggcccgttgtc

SEQ ID NO: 20948 - DNA, 495 bp, Sorghum bicolor
  Clone ID: 12501755
cttagctggcttccatgtatatacagtattgttacattcaatctgtcatattcctcatgtgtgagacaacctaaaaggggaaaggaaggggacagaattaaaagggtgaaaggaagaggacagaatcacagaacagaacaatagcagtggaatttattaaaaaaaaaagcaatggatgggtgtgtcattcttcctgaggttctaaggctatggtatttcttgcagagtaagaccatcgtgagaaccatgatttgtgattggtatgaaatgttattgacatttctaacaatggagccctgaattgatggcctcattatcccatttttttttaaactctaaaactacttgtatatacaatcatgccgactacatcattggcatgattatttttctgtattcatgaacaactggaactgctcttacggattccatgtatcttctgtatcaaaattgttttctgtttgtgaattgctttcaatgtcaatctgctggtgc

SEQ ID NO: 20949 - DNA, 426 bp, Sorghum bicolor
  Clone ID: 12501761
tgggcatcgaggccggggacagccaaggcagcgtgctcctgggcgccagcagcagcgaaggcggcgtctcttggctcgccaacatggccaccggcgacgcgtccgccgcggccgccccgcagccgcaggtggctcggttagtggtggcgccactggcaacgttgctctgcggcctccatttgcggcagcttctgctgtagaccagtggaggaggaggaatccggtggttttggatctgccgtgacttattattactgtaccttggtactaccttgtagcagtgtctgtagatgattactatcaattggtgatgttcagtttagtcccaggattagatacttgtgttgtggctgctagtactactagttctagatcgaggagaaattaatgcatgcatgtatggtgccattatttaaaaaaaaaaaa

SEQ ID NO: 20950 - DNA, 391 bp, Sorghum bicolor
  Clone ID: 12501765
acaaccacagacaaaaagggctagatctgaaatctgcaggggttaatcagctgcggctcaaacagggtagcctaaggccgcagtgatctagaaggggccatcattggtcttttgcgcatgaaaatgcttatgatcctgtagatggttctgccatacaattaaacataagaactgtttgaaggcctgtttgttgtataatatccaggccattctgcatctatctatctctataatacaatgaaacgcaactctcctgtatttttagaaaaaatttttgcatctatctagcgttacttaaactcagttgctccctctgcagcttatttattgtataatatccgtgctgctactgcctcagggagaatccgtatggtacaatcgtctgtttctg

SEQ ID NO: 20951 - DNA, 531 bp, Sorghum bicolor
  unsure (1)..(531): unsure at all n locations
  Clone ID: 12501787
agcacaatcatgaatttcttccgtataccactcaacctgtttgtntgcgtggtgctatacaatgtgaatgcattcccaataactgtcatgttcggcatgtgctccattttcctatttatggcagcaatcttgcagaggcgcttaatggttgtctctgatcttcacagatcgacaatggagatgactgcagaagatgaggcctttgaacccttagaaaacaacaagaccatataagtgaatcagaagtcaaaatggccccaatctttgatttgttcccatggggttggtgaataatatcgatatccaaaggctgtaacgactgtaacagaatgcagtttagtgtgttggattggtgctagtgcagtttacagttttgtcatgatatagagaacatgatgtagcaagtcctgactattgtgccacacgcggcagtggagctcggtatagcctccccacgttttccccatattttcttcttgtgttttctgatagggttgacatttgtattcaaatgccagaagtantcatatg

SEQ ID NO: 20952 - DNA, 242 bp, Sorghum bicolor
  Clone ID: 12510226
tagatctggtgtgaaatgtgtcttcataaatcgtaagggaaaattggtgattctttgacgcattgcacgcattattagtgggctcacattttataaaataatataatttaccttcactcttatcaggatatacctccaagaccttgggtcgaacaatatatattattatattattacattatatggatgtatttttcctacttcaggagagtagttactttcatcttcactaaaccacattg

SEQ ID NO: 20953 - DNA, 163 bp, Sorghum bicolor
  Clone ID: 12510239
aaagtgaactgttgtggttagtggaacaaaagttttccttctataatataaaatttgtcttaaaaatgtgattgcattagatgatttataacttctacacatgttagggcacctatatggggttttgagtttcggagttgctgtacaaaactccatttccttt

SEQ ID NO: 20954 - DNA, 454 bp, Sorghum bicolor
  Clone ID: 12510318
cgcgaggaagaggacaccaccggcttcgtcttcctcaagggcaaagtatacggcgtcggcgaggtgtacctgggccgcgtcaccgcgccggactcgcgcgtcatcttctccgacacctacctctccaggaccgtcaacgccgccgggtggaccaccataggctacaccggcagcaccgacaaggtgatgctcgcggagttcaactgcaccgggccgggcgctgacgttacgaatcgcgtgccatggtcgcggcgcttctctcagaacgacgcggccaagtacctgaccatcgacttcatcaacggcaagtaatggctgccggcgtactactactgatcccacagctggatcggacatgcatcttgcatttgtgtatgttgccgtgtgttcggccgagacccttcttgcgcgctgctgctctcgagtagtagtgtaacccgtgtaacgccaaatt

SEQ ID NO: 20955 - DNA, 605 bp, Sorghum bicolor
  Clone ID: 12510328
ggttaatgcatggcttttataaagccaatggctgttgcggttatgtgaagaaaccagatttcttgatgcaaacttgtccagatggaaaggtgtttgatccgcaggcagatttgccagtgaaggcaatattgaaggtcaaggtatacatgggggaaggttggcaaaaggacttcaagcagacacatttcgacacatactcacctccagatttttatgtaaaggttggcatcgccggagttccattagactcggtgatgaggaagacgaaagccgtggaagacagctgggtgccggtgtgggaggaggagttcaccttcccgctgaccgtaccggagatcgcggtgctccgcgtggaggtgcacgagcaggacgtgagcgaagacgacttcggcgggcagacggcgctgcctgtggcggagctgcggccagggatccgcgccgtgccgctgttcgaccacaaggggctcaagttcaggagcgtcaagctcctcatgtgcttcgagttcgcgtagcgtcctgcagcagaaaacgattatgctgccatgtgcgtcgatcgatgttcgtttgcaataggaatcgacctttctttttactgttatattatt

SEQ ID NO: 20956 - DNA, 493 bp, Sorghum bicolor
  Clone ID: 12510371
aagagagagaggaaaagaagatttggttccctaggtctgacagcaccaggggtttccggtcactgccatcatcaccctctaagatcctgggaatgagaagaggcgtggaatgcatgggcaggaagcctaaggtggctggcgacgatgactgcagatatggctatgaggattcagtgtccacaagcagcagcaagttcctcagcagatgcaagcaggcaatcaagaaagcagtacacaaataggtcattgcaccatacatctgaacctatttattcttcttttcagtgtgttcaaaatcgatgccatttgttatagtctcggtaactgaataagtgagaatgggcaaagctcgcagacttccgtctgatgctttgcctgttacttgtgtgatatttttttatggtcaccctgacgtgatcagattagtgtgtgtacaacaattttttattcgttactttgttagaaaagaataaatctattcctgttcctgagc

SEQ ID NO: 20957 - DNA, 166 bp, Sorghum bicolor
  Clone ID: 12510409
ccacacaaggaaagtaaaacctcttacacagacaattccagagtcttctacttcgtaacgttccccccaattcattttctggtagtcaactaaccattgatatacatatggttctaatcgtcggcatctctggttcacaattttgttgttgtatattattatcttg

SEQ ID NO: 20958 - DNA, 333 bp, Sorghum bicolor
  Clone ID: 12510425
catgtacctgtgcatcgctatggagtgttggagtctattggagaattcagtttcacaatgagtcaatgaccaattggggctgttggatcacactcatcacactctagcctgaattgaaaagttcaattcgtgacctctgaaaggataggtataaaagtccagtttcagattgtgttactcatattaagaatcatctttatagttatttcttcttagtccttttagcttggtataatctttaatgtgtatctttttcatcaagtttggatgtctgtactcagtaccatatcaacatcctaaatatttaggtaatcggcaaacatttaagctctt

SEQ ID NO: 20959 - DNA, 326 bp, Sorghum bicolor
  Clone ID: 12510449
gggttttataacagccgcactcaatgccgtagtctggggagttgctggtgcattctggtggaaatttttgggtctttattgagtcttggggcagtagaagtacatgaaaatggtaccatatattaaacaagtacctcatgatccaccatcggaggtcggtgttcgttttccttctgaggtgcctatgagtgcataataacagaggaacgctcatctttagaaagtttttgagcatgatcaacctaggaagcagatgagtttcgtaggttgtaaagatcatcttatatacccctgatttattcatgaccaccatatagtcctcccca

SEQ ID NO: 20960 - DNA, 286 bp, Sorghum bicolor
  Clone ID: 12510451
aaggctggatatctagactcaggacaaattgcatgacatcataatagtcgtcgacatatatacaaagtgtttttagataaaggatatagtaagttaaatttgattttggctagacatttctgagtgcttctcaactcaaaagagtccatatggaacagtaggtaaaggaagactgaacatcaagagagcctatttatttcctcctttattccttgtcaagttttttttcttgtactttaaatcatgggatttgcaaagatatttgcgtgtataagactggtgatgc

SEQ ID NO: 20961 - DNA, 621 bp, Sorghum bicolor
  Clone ID: 12510467
gtcgacggcgtacatgctgtcgtggctgtcgagctaccagatgcagcggccgacggccatgggctctccgggcagcgtcgccgccgcgttcgtcaccgtgaacatgcagctcatgttgcagcaggcgacgatcgtcacgacgggtgctccactatgcgtcgacggcggctgcccggcgtgcgagtgcaggtgcgaggaggagcgctgcgtgcagccactgccgccgccggtgctcgtgccgtccgggcgcggcgacgacaccttccgcgtcaaccccgtgtacccgcaggacgtattgttcaacgccattaaccaagcaatgaagcacatgtacctggcgttggtccaggcgagcaatctcacgcgatgcgacgctgctgccggcctcgaggttctgccggcatgatccggcgagcgacgacgatcgattgacggagaattttattaactactacccttcataatgccgacccatcatctagctagggtcctaccgtataccgtcctgctagtacggaaacaaaaactaccgttcatggtgtgcttgcgattttattaactactccgtttataagtactgtacaaccaagcttgtagtggtataataagcaatcgatcata

SEQ ID NO: 20962 - DNA, 542 bp, Sorghum bicolor
  Clone ID: 12510471
gcgggcggcggaggaggtcgggttcgaggcgatcgtgaacgagtcggacgtggccaacgacatcgcgcaggtcggcgggctcatcaactcgtgcgacgccatggtgggcgtgcacggagcggggctcaccaacatgatgttcctgccgccgggggcggcgctggtgcagatcgtgccgtggggcgggctgcagtggatggcgagggcggactacggcgacccggcggaggcgatggggctcaagtacatccagtacgagatcggcgtcgacgagagcacgctcaaggacaagttccccagcgggcacaagatcttcaccaacccgacggagctgcacaagaaggggttcatgttcatcaggcagacgctcatggacggccaggacatcaccgttgacgtcgcccgcttcagggaggtgctgctccaggtgctcaacaacctcgcgcagtagacgccggcgtgctcactgctcagcacagtcacactgctgctctgctaccccggccctacatagtagtactcctgtagtatatatacacatt

SEQ ID NO: 20963 - DNA, 578 bp, Sorghum bicolor
  Clone ID: 12510473
agatgtgctactcaactcctgtgcaattgattggggatctatgacctactgaaggcacaaagattgcgcaaacaaaacagttccagttcatcctatgaacatactaattcagattggagaacgcccaggggctcagcaaactgtggtctatggcttcgaactttgccaattcgatacctgatagatcattttgagacgagttaagcccctgtttggagtgcaagaaacaaaacagatggagaaggaaagaggtgtcagaggagataagacccagcgcctgatcatcgtttattcgtttttgatactatagccactggaatcagtctgcaaccaaatcgtagtcctattatctggaactgtaatgaacatcagttagcatataattgagagatgttgaatggattgcagaaaagtatctgcatcaaatcccagtaatttcagttaattcactctgttgtgttagctatgttccagtgatgttgcgacatgttaattattgctctcatctttgagggcaatatgctgaactgatggctccgcaagccgcaaaacagtgcatcttcagcattttataaagc

SEQ ID NO: 20964 - DNA, 246 bp, Sorghum bicolor
  unsure (1)..(246): unsure at all n locations
  Clone ID: 12510477
aagccttgaacttttcccttgtgnagctctctctnacagatgtnctgcctactggaccacaaatgcttatgcttggattagtgttgtaccttgaagtagtgtgccctcccaacttgctgattattgtaatgtatacaggttttggcgcatgtttatataccaggcgtgatttttttacataccacttggtgggtgtgtctgtgcaatgactgtatgtgctgatgttaaaaaaaaaattcggccaaa

SEQ ID NO: 20965 - DNA, 107 bp, Sorghum bicolor
  Clone ID: 12510479
atttctgaataaaaatctctccgtatgaacgtacgtgtcgtcgtgtacgctgtgatacgcttgcatcttagcgcatgtacgtacgtgcgtgtgtacatgtgtgtgtg

SEQ ID NO: 20966 - DNA, 502 bp, Sorghum bicolor
  Clone ID: 12510507
gccttgatgttttttttttgaggacaagtgtggggattttcacttttgatctgaagtccatccgtttcatcacaaaggtgtgcgaagaaagtttctgcgatgcaagtttcccctacatgagcttctgcactccagcattgggagcagcctctgccgagggatcaagaacaggcacctcaaatgcctgataaacataaggttctccattttgcaggcttgtcgatcaaggttaaaagggatgatcgttgtgggtaatagtttattttggaggtgggacaactctttagcatgagtaagattagtggtggtcttagtttgttggcctttaggggttcttcattttgtgcaagggttcacatctctctgtctgttatcttgatcatcactgtgaagtttgcttgggaccctgtattatcctactctatgtgtactcctgaacattagctttaatggaacccttgaatggttgaatgtgtaggtatcttgttcaagaaaatgcgca

SEQ ID NO: 20967 - DNA, 436 bp, Sorghum bicolor
  Clone ID: 12510530
ctcaacaccacggcggcgccgtaccgggcctggttccaggggaagcaggtgggcgggtggacgcaggtgttcggcggcggcgcgctgtccttcgccacggtgcgcggcgcctcccacgaggcgcccttctcgcagcccgagcgctcgctcggcctcttcagggccttcctcgccggacagcagctgccggaatcgttccagtgatgatgcaagttggagatagggccgggggagccaccagccacgcttcctcgtctactcctcctgagtcctgtccttcgaattcctagctatatatgttgtgagcgcgcagtgcagtgcaggtaacgcaggttgcgttgcgtgtgtcgtggggtccggccgctcttgagactggcaaaaaccccaattgggttcttctccaagtgtaatcaggactaataatatcatgaaaggg

SEQ ID NO: 20968 - DNA, 181 bp, Sorghum bicolor
  Clone ID: 12510532
cttctcagcgtcaagctgctggtggagaaggacctcgaggaggagctcggcaacgagttgctgagcaacaagttcgccggggtggagaagatgctcgcgccgtcgccgagcactggaacgaagcgtgagcgcctgaagaagagcatcgtcctgctgcgtcagtccaaggaggtcgtggcca

SEQ ID NO: 20969 - DNA, 469 bp, Sorghum bicolor
  Clone ID: 12510570
cgctcctgggaggggcccttacaacttcaatctaacagcaaagtgtggcgagcctggcgcttccgcatgtgctgatcctacaacgcactggagctgggatggtattcacttgacggaagccgcatatcgacaaattgccagaggttggcttcatggaccattcggagaccagcctattgtgcaatcgtcttgagtacagccagccgctcctcctgttgtacctcctctagagtgtaccaaaatagcacaccatgacaccaaactggatccgataaggtagtagtagttccatgtatatctccttccatttcatcattgcagtcaggtaaagagccgagataggggctattaattaaagcatgatttcttcattcatggtggtgtgtataagtacaaagtgtaatgcacacaacagttcatatgatacagggatgattccctgttgtccatgatgactcccagttagaaa

SEQ ID NO: 20970 - DNA, 527 bp, Sorghum bicolor
  Clone ID: 12510580
tgcaaactgggtgcatatcttgtatcagagccgtcatgatgcacagaaagcacttgccaaacatgggcagcagttaaacattgttcttattattggtgtgaagccagtggatccatggcagcggcaatacctgaatgagaacaccaacgagaactatcagggcagtgctacaatcacatttacatcgcaacctgtagcaccaagtggatttgcaaccaggaacgcactagcacctttacctagcaactctgtgccaaatggcagctgcaacgagagcaaccgtggcgcatctggggccattgcttcgcctacaaaatctgtcttgtccaaagttatggacttgatgtttggcctttaagttgcattgttcactcaaatggtggcaactttttttgttccttttggaaattctaggccaaaatgaggttcacttatcgatgttacagtaaaaacattatttggtcaccgtggttcgcactttgtatcattgtgcagagtgttatgctgttatcttattctttcggcat

SEQ ID NO: 20971 - DNA, 279 bp, Sorghum bicolor
  Clone ID: 12510626
gactgtatttgtcgtcctcccctgttgatgcatcggataccaccattgacgctaactcgctattgtcattgagacccacaggtatgaggcctttttggccattgtcttcgctagatattttgtttttgttgcctgcctggccgacgaccatggccttgccctagctggccctgcttgctcttggccaccggcgacaagctctggcaacctatggcgaatggccggccataggtggttgtcctggaggtgaatacttatcttgtatatacgtcatttacc

SEQ ID NO: 20972 - DNA, 315 bp, Sorghum bicolor
  Clone ID: 12510649
acatcgccgtgctgcagacgctgtgggcggtcaccatgggcgccggcgtgctcccaggcaggtcgcacgtggacggccccgacggcgagatggcgtacatgcgcgggagcttcgagcacaccgtcgggtcccgggactcggagtcgctctacatggtcggaccgcccggcggcgactgcccggagctcgccatcttcttcgttaggctatgaatgaaccatagtaccaaacgaacatgctacagtgtacacgtcgcgctcgtggtgtctaatctctctcgtctggtctcgttcgtgttcagccgcagctaccagc

SEQ ID NO: 20973 - DNA, 269 bp, Sorghum bicolor
  Clone ID: 12510741
gcacgaggcaaagcagcttccccgcgcgcttccccaccccacacacctccgccggggacggacagcgaggccgaggaggcagaccaggcgggggcgtccgcggcggagatggggacgtacaagtgctgcatcttcttcacgcgcaggttcgcgctcgccgacacctccacgccggaggacgtgcgcgcgctcttctcccgctacgccggcggctcgccgtacatgcttgccgacgacctccgccgctacctcgccggctggggaggtgc

SEQ ID NO: 20974 - DNA, 354 bp, Sorghum bicolor
  Clone ID: 12510755
gcacgaggagaaccctctcatgcttctttgatcagtagttcacatccactggagtcaacaagtttagcttcatcttcccacattgcttcggataatagtttttcattgcataccaaaagcaacaacagagcaactgcagatggtcacagtagagagcgtgcacagcccttgggtatcaactctgagcgaacacatcaagctttagcacttgagcaccttgaggatatgtggacaaagggaaagagttacaaatcagaaaatgcaaaacatatcaaaaaggtgtctgttggatctgcttctctaagttcgacttcagttcagcaatcagttccttgcagcacttcaatttgtcaa

SEQ ID NO: 20975 - DNA, 241 bp, Sorghum bicolor
  Clone ID: 12510771
gcacgaggctccccaccaccagcagagcagagcggaccatcacatttcaccaccacctctccctccctcgctctctgcgctggcgcctggcggccgagcgccgcgagcttggcctcggcctcggcctcggaggagctgaagctgaccccgcggccggccgccgcggcgacgagcgacgcggattcggcaggcgtgcgcggaatgcccgtggacggagggagggagtgacggcgcatctgac

SEQ ID NO: 20976 - DNA, 342 bp, Sorghum bicolor
  Clone ID: 12510775
aacttgcagatacggtacagatcagtcaatgctactgcaaaagagtgaagcacttcatcacctaggttttagcagaccggaagatgatgaaaacatgaaccatgttggcaaaggaaatgtggataagtggctccatatgctcatggataaccaacaagaagatcatgctgtataccattcttcagatgaacatgataatgacgaggagaatgcttcagatgagcagcaaatgcagagcagaattgacgaagagagctgcaggaatggggtaactgaatgttctgatgagatcgttgaggtcgaggacgagattgtttctgaccaaggagcggaaagaggcag

SEQ ID NO: 20977 - DNA, 299 bp, Sorghum bicolor
  Clone ID: 12510786
gcacgagggtcagcatggtgatggttcatcaagttctggtggaagatctggcataggtggtggaggtgtagcaggaatcattatatcgttgctggttgttggatcagttgttgcatttttcctgatcaaaagaagaaaacgcaaagctgctatggaagaacactttgaacagcaccagccgttcacttccttcccttcaaatgaagttaaagacatgaagcctatctatgagtccaccgcagtagacatagagtctttggcttcacctgcttcaattaatctgaaaccacccccgaaga

SEQ ID NO: 20978 - DNA, 298 bp, Sorghum bicolor
  Clone ID: 12510798
gcacgaggctacgacgtcatcgacgtgaacaacgaccgcgaggtgcactgcttcccgcggatcgtcatcggctccaccttccaccgcgccatgggcatcgacgcgtcgcggtcccccggtggcgagacggtggccgacttcaagcgcgtgctccgccgcgcgttcaagctggaacgcgccgtggcgtcgcggtcgggggcgccccggcgcaaggaccggcccaggctcctcatcatctcccgcaagagctcgcgccggttcgtgaacgagcgcgccatggcgcgcgccgccgcggcgg

SEQ ID NO: 20979 - DNA, 425 bp, Sorghum bicolor
  Clone ID: 12510807
gcacgaggagcgtcaccctcctgagctggagcgccgtcgagtatcgcgacgaggtggcggcggcgggccatctccggtacctccggtccgccatccagtggggcgccgacttcctcctccgtgcacacacctcgccgaccaccctctacactcaggtcggcgacggcaacgccgaccaccagtgctgggagcggccagaggacatggacacgccgaggacgctgtacaagatcacccagagctcgccggggtccgaggccgccggcgaggcagccgcggcgctcgccgccgcatacctggtgttcagggacgaccgggacaagtccttggccacgcagctcctggccgcctccagatccctcttcgacttcgccaacaattacagaggatcctaccagttgtcctgcccattctactgctcctac

SEQ ID NO: 20980 - DNA, 231 bp, Sorghum bicolor
  Clone ID: 12510837
accctattcgacgacaccatgagggagtgcatcgttgatccacatcggccaggccggtatccaggttggaaacgcgtgctgggagctctactgcctcgagcatggcattcacgctgatggccagatgcctggtgacaagaccgctgggggaggtgatgatgctttcaacaccttcttgactgagactggcgctgggaagcatgtaccccgtgctgtgtttgttgaccttga

SEQ ID NO: 20981 - DNA, 444 bp, Sorghum bicolor
  Clone ID: 12510848
caagatcgtgaggaagtgctgtgagcttggtatccaaatgaactctaatccttgcttcatacacatatcaaagatggcagtgctctccgatccacatcgactaaaggaggagctaaacaaagcaaaacaggctgcagtgagcaagaagcagaggttgcagctccttttctgcccgatgtccgagcagcacccagggtacaagacactgaagctgatttgtgacacacagctcgggatcctgacccagtgtttcctgagcgaccgcgcaaacaagccaaatgggcaggaccagtacatgaccaaccttgctctcaagattaatggcaagcttgggggcagcaacgttcagctgtttgactcgcttccacgggtcggtggtggggcacctttcatgttcatcggtgctgacgttaaccacccgtcacccgggaacgtggagagccc

SEQ ID NO: 20982 - DNA, 129 bp, Sorghum bicolor
  Clone ID: 12510877
gcacgaggattggactcgattacttgagacaaacaacttccctgaatttactggacgagtttgccctgctccttgtgaggggtgctgtgttctctgggatcattgagaatccggtgtctatcagaagta

SEQ ID NO: 20983 - DNA, 286 bp, Sorghum bicolor
  Clone ID: 12510878
gtcttcgccctccacacgcacacccatcccatccatcccgctcccctcgagttgccttctatcttcgagggagaaccggagagcctttgccgctctctcactacgctctgttttgtatctaccccgtacgacgctgattccctcctcgtttgtcgccattgccgccggtcgtgccgtgtcaaggacatggcgacctcgggaaagaaatctctgaattcagtgaccttgctgttcaaattgccatattacacacaatgagggcagagtcttctgattgccgggtcgg

SEQ ID NO: 20984 - DNA, 479 bp, Sorghum bicolor
  Clone ID: 12510903
gtttgcataaggacggttaggccagccgcccttacagagcttatttagccgtccttacagtgcctgactgtagtagtgaagagagcaagaggtcgaggaatgaacgatgcagggggtggaagcctagcactggtcttcgaaaagggttcttcgatcagtttatttaccacgcggtaggcctgtagaaattgcggtatcttgggagttaggagttactcagtagcgaccgagattcctgcagattcacgatgcataacagttgtgagatattgcatgaatgacgatatataactccagaacccatctcgtggcaagtttgttttgattacgttcagacagaagttcagaattgtagtaggagtagtactcaatcccatgcataaatgatgtgccagggccaagacagaaagctgaaatgcccgccctagcccttgcaagaactgagatgctttctttgttctgtacttctgttagtcttt

SEQ ID NO: 20985 - DNA, 338 bp, Sorghum bicolor
  Clone ID: 12510953
ctcgctcgctctctcgtccccaccctgccggcgagcgacggaccgggcgatcgacgcgatcgtgctagggtgccgcgctgccccgcgccttgtaagccttgagaaagatgcggaaagctaagaggggtggcggagatctcactacgaacttttgtaagaacagaaaagcttgcaaaactgagtggatctcaggtcgcttgcgtgatggggactctagtcaagatgtttgcactaagctacctgattggggtaaaagtgtcgtctcaatttctttatgcaatggagacataaccttattttcgtgctcgggcatggctataggacacaatgggtaccgc

SEQ ID NO: 20986 - DNA, 246 bp, Sorghum bicolor
  Clone ID: 12510966
ctgttagtgtgcattgtggtttctacagcgacaatggtggcttcaaaatttctgaggaggacaggagatacatgagagcctgtaaaattgttgtgtctacctgtgcatttggtggtggggatgatctataccaacctattggaatgaccaattcttctattggcagggtttgctatgtggctttcacggatgaagtgacacgatcaactcaggaagctgaaggaaaggtaattggtgatgatggca

SEQ ID NO: 20987 - DNA, 397 bp, Sorghum bicolor
  Clone ID: 12510975
gcacgaggggtgtgcaagcaaagtcgttgtagaaacactagatcttcgtcctcgcagcagagcagaactgcagagggcagagtagagccatggcagccagcagctccgatcaagttcctccagccgcaatgaagctggagggcaaggtggcgctgatcaccggcggcgcgagcggcatcggggagtgcacggcgcggctcttcgtgaagcacggcgcgcgcgtcgtggtggcggacatccaggacgaagccggcgccgctctctgcgccgagctgggcgccgacgccgtcgccagctacgtgcactgcgacgtcaccgtcgaggccgacgtcgcggcggccgtggaccacgccgtggcccgggtcggcgcgctggacatcatgttcaacaacgcggg

SEQ ID NO: 20988 - DNA, 205 bp, Sorghum bicolor
  Clone ID: 12510981
ccgcccccgattccgagcagccgaccatctcggcgacgatcctcgcccaactgcccacccaggagcgcctggcgtacaagctcatcttcgaggcgggcaacaagggcatgtggatgctggacatccgcaagaagttgttgatgggccccaacatcgccaccaaggtcgtgcgcaccctcgtggggcgtgggctcctgaaggagtc

SEQ ID NO: 20989 - DNA, 466 bp, Sorghum bicolor
  Clone ID: 12510991
gcacgagggaagagctttgatgttacaaagttacctggagaagagataccttgggggtattgaagatggcaattctgcagcagaatatattgacactcaaggctatgagttatctcctgatgcacgggcccaagcagatataaaacttacttatgttgtttcttgccaaatatatggacaacagaagcaaatgaaaaaacaagaggctgcagatattgctctcctactacaaagaaatgaggctcttcgggttgctttcatacatgaagaggaaaacatatcaagggatgggaaggctacaacaaaagagtattattccaagcttgtaaaggctgatgttcatggcaaagatcaagaaatatactgcattaaactgcctgggaaccccaagcttggcgaaggcaaacctgagaaccaaaaccatgctataatcttcactcgaggagatgcagttcagacgatcgat

SEQ ID NO: 20990 - DNA, 422 bp, Sorghum bicolor
  Clone ID: 12511000
gagagagagagagagagagagatctagagagagagagagaggaatagagacgatggagtgatagattagagttaccatcagcacctcatatccccaacaatggcatagccaactagctactagtagctaccaattcccaggccacaacaattgccaagaaaaaaaaacacctttcaatttcttggagcaacctttccatggggttcagctgcgcccgtgatggtgacttctctttcttgctgtgtgaagaggacgacgtggtgggggacatttttgggtgcaatggacaagaggaggagcttccggtgttggggatggacatggcctttgctgctctgccatcacagagcgatgaggtcgttgcatccctgatggctaaaggagaaggagcagctgcatagtgttgcaacgggagattacct

SEQ ID NO: 20991 - DNA, 504 bp, Sorghum bicolor
  Clone ID: 12511015
gcacgaggcaaattagaagaatggtcaccaatatccgcttgttccatgcaaagaaaatgcatactacgtcgagagtactgccagttccaatgacgtggctcgttttcacactcctgctctcatcagtggccgcagccgcagagacggtgaaagtgatcaccacccccgtcttcgctcagatccctcgatttcagtcaagcaaagacttccaggtgctggtgcgcgtcgaggcgccaccggcggcgcagcagcagaggcgcgtcccaatcgacctcgccgtggtgctcgacgtgggcaccggcccggtgaggctggacgcagtgaagaaggccgtcaagtttatcatcaggcagatccacgacgacgaccgtgtcgccgtcgttgggccgtcgtccaacagtcggctagtcaccgggtttctgagcactcgtgatgctcgacgggatgccgaaaactccgtcgacgagctcgagcctcgtggcgagttcacatctggcgccggcg

SEQ ID NO: 20992 - DNA, 434 bp, Sorghum bicolor
  unsure (1)..(434): unsure at all n locations
  Clone ID: 12511017
agcatgaacgaggtctccaacttcgtcgacccggcgccgctcaacgcgctggacgacccgccgtaccgcatcaacaactccggcgtgcgccgccccatcaacaacaagaccacgccggcgtccgcggtgcactacggcggcgtgcgcgagtacgacgcgcacaacctctacggcttcctggaggcgcgcgccacgcacggcgcgctgctcgccgacaccggccgccgccccttcgtcctcagccggtccacgttcgtggggtccggccggtacaccgcgcactggaccggcgacaacgccgccacctgggacgacctccggtactccatcaacaccatgctcagcttcggcctcttcggcatccccatggtcggcgctgacatctgcggcttcngcggcaacaccaccgaggagctctgcagccgctggatcca

SEQ ID NO: 20993 - DNA, 406 bp, Sorghum bicolor
  Clone ID: 12511019
gtcggctgctccgtcatctgcctcgtcttcctcctctcctcccgccccgacgccaccgccttcgacaccatgagccccaaggcgtcgctggtggccgcgcgccgcccggtggccgtatagaccctgcggacctcctccgccgccgccgccgccagaggcttcggtggcgatttccatgtcgacgtccggccgcagcatcatgacgagcagaccgccggcgacaagacgatcacagaatgggtcagagacacggtgatcgtggaggagagcagcgaggcagagccggaggagacggagcccggccgtgacgccagtgccactgccgcggcgtcgtccaactccgacgaccaccctgccgcaccaggtaccgagaaggcgggccacgacgccgccgcgatcaccgtgc

SEQ ID NO: 20994 - DNA, 484 bp, Sorghum bicolor
  Clone ID: 12511021
cggcacgaggctcatgggcctagcctcatgggcctcatactcatatactctaacaggcacacccgacacgaccttggggttatgtgggactcatgcaaagctgtcagaggtatgtgagacaatgacctgagcatgtggaccatataatctaggaggttctgccacagaagtggatttgaaggaagaagcaatgtccctctaaattaataattttcttttgttaaatatttcctttccatttctgtattgagcttgtggttgtagtagatggtctgttaagtagcatgtcattttgtcttggtgtgaagtgggatcttgttgcatctgactattatcacattttgtaatatagagtttcaagcatagttattgcagtgctacttgattttcctatttttgattcaatatttccattaggcccgtttggatccttggaattgaataatttaggcacagattaattaagataatatgggtgtatatg

SEQ ID NO: 20995 - DNA, 242 bp, Sorghum bicolor
  Clone ID: 12511025
gcacgaggcccaaatttctatatagtgattaggaccccccacatttggctatttccactgtgttcagtatatagttctaccatgtttaactatgtttgttggttctttcccactataataaatttcatttgagattccatttcctgaatgtgggaagtatataagttattcatttctcagtatactattgttttcaatcatttaatatactgttttcagagttatgcttttgcagaatccat

SEQ ID NO: 20996 - DNA, 459 bp, Sorghum bicolor
  Clone ID: 12511032
cataaatcacattctgtaagacgagcccgctctcctgacatgcataaccacagaaagaggagcagagatgcagatgtgcggtctaccaagagggcatctcagccagttgttggtgcaccacgtcggcttcttcagtttgctgttcgtgatgctgtcaaaactgtgcagccagttacttctagttcagaaccagcttccaagcgacttcgttctgtagtgtctacattggcatcagattccacacttgatattactcatattaggttacagaagaaaacacattcagatttgaaaataccaggtgccacagcagcactaagagctgcagctgaggctgctgaagatgctctcaaggatagcttttctggaagtgtttttagtagattgggcagaatgcccacaagaaatcctactgaacaatcacctgctcatagagaacaagatcttgaaggcaaagaa

SEQ ID NO: 20997 - DNA, 374 bp, Sorghum bicolor
  Clone ID: 12511048
cccaaatgcccaatccaccgcacgcaactgtgccgaccaaaccctagcttcgatccgcggcgagcagcatggcgccgcggccggcggcggcggcggcggcggcggcgctgatggacgagctcgtggaggagatccttctccgcattccaccggacgaccccgcgcgcctcctccacgcggcgctcgtctgcaagcgctggcgccgcatcgtctccgaccccagattccgcagccggttctgtgagttccatcgcacgcccccgatgctcggcttcatccgcaatcacgagcgagggtcgtccttcgtgtccacctcctccttccgcgcgccccctgccgatcgcgtcaacagccgcgcgatcgacgcgcgccat

SEQ ID NO: 20998 - DNA, 410 bp, Sorghum bicolor
  Clone ID: 12511079
gcacgaggcagcagccacactccaccaccaccagtccaccacactgtaaacccaccattgtttgcacttcgcaacatgtccaagaagctccagatgggggggcctaagcaggctaagggcgcgaccgacgacggcaagggtgacgtcgctggcgccgggggcagcgcagtgacggcgagcgccatcgcggcctcctacgacgaccagatccgcccgctgctcgacgcggtggacaggctgcgccacctcaaggtgacgcaggagggcatccagctgcccaccatcgtcgtcgtcggggaccagtccagcggcaagtccagcgtgctcgagtcccttgccggcatcagcctgccgcgcggccagggcatctgcacgcgcgtgcccctcgtcatgcgcctgcaggacgaccc

SEQ ID NO: 20999 - DNA, 468 bp, Sorghum bicolor
  Clone ID: 12511132
gcacgaggcaccaatccccctccccgcacccggccacgcctccgcaggcgactgcgacaccctcgcctcagccctcgcgtggtgccggcctcttctcctcgccaatgcggtccaacggctcgccggccccctcggcgtggtggaccccctcgagggaggagaagcccagggaggggtcaccgatggatggcgtcgtgcagcaccagcagcagtccccgacgacgccgtcgggtcagcagtcacagcagcagaaggtagcgctgatcacgctgccgcctcccagggaggttgcgcggccggagatgccgagagattcggctccggctgctggccgggtcgacgaggaggaatgggtcaccgttttcggatttccgcctggtgatactaacatggtgctgcgagaatttgagaagtgtgggatagtcttgagacatgttcctgggccaagggatgcaaactgggtgcata

SEQ ID NO: 21000 - DNA, 510 bp, Sorghum bicolor
  Clone ID: 12511144
gagagagagagagagagagagagagagagagagatgatgatgatgacgacgacgacccatgagaggcacagcagcagcataccatcaaccagagtggccaggcacatccattaacaggaaaactgcattcagatcatcactcttgatgcaaattaccattaatcatcaggcttgaatatcagaatgccccataacaaaaccaaaacactgaactactagcttcaaaaataaaaccaaataaatcagaactttttccaggcactacatatggcagttatgcacaaataatcttatgcgcatacaaaggtactacaggaatgtctgtcaaagcctcaattcctattttacctacacacatcctagtcggagcccactcagccagctttgtggaagaaaatcagagtaaaatatgcatggatagctcgatggattggatttaaacttggaattggacttaaacttggaatcggagggagtacatgatccaacacaacgccaagccgacatcaa

SEQ ID NO: 21001 - DNA, 475 bp, Sorghum bicolor
  Clone ID: 12511174
ttcagatgttctttctgcctggagtggtatacgtcctttggccacagatccgtctgcaaagaacactgagagtatttctcgagatcatgttgtatttgaagactacccagggctaataacaattactggtggaaaatggacaacctataggagtatggctgaagatgctgtaaatgcagcagtcaggtctgggaatttgaaaccagctaatggttgtgtgactgataatttgcatattgttggtggatatggatgggatcctgctgcttttacagttcttgctcagaattataagcgaatgaaaaagacatatggtggcaagggtattccaggtgcaatggacagtgctgtatcgaagcatttgtcacatgcatatggaactttggctgaacaagtggctactattgcccagaacgaaggcttgggaaagcgccttgctcatggctacccatttttggaagctgaagtagcatac

SEQ ID NO: 21002 - DNA, 438 bp, Sorghum bicolor
  Clone ID: 12511176
gcacgagggcggcatgccgccggagattggaaagtgccggttgctcacctacctggacctcagtcggaacaacctgtctggggagataccgccggccatctccggcatgcgaatactcaactacctgaacctgtcccggaaccaccttgatggagagataccggcaaccattgctgcaatgcagagcctcacggccgtcgacttctcctacaacaacctgtctggccttgtgccggcgactgggcagttcagctacttcaatgcgacgtccttcgtcggcaacccgggactgtgtgggccgtaccttggaccatgccattctggtggcgccggcacaggccatggtgcacacacccatggtggcatgtccaataccttcaagttgctcatcgtcctcggcttgcttgtctgctccattgcgtttgctgccatggcaat

SEQ ID NO: 21003 - DNA, 433 bp, Sorghum bicolor
  Clone ID: 12511194
gcacgaggccacagcctccggctatccatcgcgctcgaagccggccgatcgggggagcgcagcagcaggcgggccacgccgccgccctgctcgtctgctccctcctccgtgatggccgacctcgacgccgacgccaacaaccatgatcccgagcacaggacgcgctcggcgtcctcgtcatcggaggccgacgacgtcgacacggacgccaacaaccatgatcccgagcacaggacgcgcgcatcgtcctcatcatcggaggccgacgaccacgacgcggccggcaagacgcccatcatcccgctgtgcccgtccccggcgcgccaccacgcgggacacgcgctcgaggagccgcctcggcggaaggcgccgcaccgccggtcccgtcccgttcggatgttcaagagcatgtgccggtcgctgccgctgctga

SEQ ID NO: 21004 - DNA, 421 bp, Sorghum bicolor
  Clone ID: 12511206
ctccgatcccacctccaccgtgccccgcgggcgacgtcgggcggcggcgatggccacgtcgtcgccgggggcgcgcaggaaggcccccagccccccgaagcaccgccacgacggcacctcgccgctgccgctcggcatggactggagccctcccccgaagagatgggagggaaggaacaccatatggccacataaccctcaaacaggttggagttactgtgtgatgatgccttcttggatcactcaaacacctgaaactggtgtgaccgctgatagctttttgaaatctgtcgttttttacaggatacatgttggtatacaatctccagaaggctttagctctagccatggaattctcagaaggtttagtgactttctgaagctatcttctgatcttaagagtgcgtttcccagaaaagac

SEQ ID NO: 21005 - DNA, 557 bp, Sorghum bicolor
  Clone ID: 12511234
ctttgctaaacaacccccctgatttccatagctttatgctgggtgcccagtgcccaaaaatgagtactacatataattgggttgatacagaagctcaactggagcatctggcaagattattaggtgaggaaagagcttttgctgttgatacagagcaacatagcattcggtctttcctaggatatacggcactaatgcagatctccacccagaatgatgactatttgatagacacaatagcattgcatgatgtgatgggcattctacgaccagtctttgctaattcttctatttgtaagatattccatggagctgacaatgatgttctttggcatcaaagggattttcatatttatgtactggaatatgtttgatactgccaaggcatgtgaaactctatcaaaaccacaaaaatcacttgcatatttgcttgaagtatattgtgaagtatccactgacaagaccatgcagcgtgaagattggagactgcgtcctctgactcccgaaatgattgagtatgctcgcactcatgctcactatctgttgtacattgcaaa

SEQ ID NO: 21006 - DNA, 500 bp, Sorghum bicolor
  Clone ID: 12616539
gccagatttagctttgtgccatcctgttaacttgttattcaactttttgtaagagatagatatttatgtctctaaccgttccagtcaattgtttgtggcctggatcgttgggttaactagaactagaaggatacgccacgtgttgctacaggactcttagaaattaaattactgtatgtgtgagttaaatcatgtacatgttcttacatccttttttatcaaaattggttgcattaagaggttggaagttagtgggatgacatgacttttagtgggagacgatgtggatagtgaggggaagatgatgtggatagcttgcatgttaagatggaacatgtagtggggattagctttataagagatatagatttgaggaattggactattttaggactatgcagttgatacttgataccttacatagatggaacttgaagcatggggacacatctttttttgctattaattaatatatattaaccagtagggggggtacccct

SEQ ID NO: 21007 - DNA, 110 bp, Sorghum bicolor
  Clone ID: 12616546
gagcccgcgctctctacccctctgtctgcgccgactgcctgtgccaccgccgccgatctcttcaccggggaagaccggccaccacgctccggacaagggcgagatggcgg

SEQ ID NO: 21008 - DNA, 576 bp, Sorghum bicolor
  Clone ID: 12616553
gcacgagggataccttgctcttgatgaggcatatagaatgcttgatatgggttttgaaccacaagttacaagaattgttgagcaaatggacatgccacttccaggtgtaaggcagacaatgctgtttagtgcgacgttcccaaaagagatccagaaaatggcatcagatttcctggataactacatcttcctggctgttggaagagttgggtcaagtaccgatttgattgcccagagagttgagtttgtgcaggaggcagataagagaagccacctgatggatcttcttcatgcacaaagagatacaggaaagccaactctcacgcttgtctttgtggaaaccaagaggggtgctgattcattggaaagctggttgtgcatgaatgggtttccagctacttctattcatggagatagaaaccagcatgaaagagaatatgctttgagatccttcaagagtgggcaaactcctattttagttgcaaccgatgtggcagctcggggcctcgacattcctcttgttgctcatgttgtgaacttcgatctccctaatgatattgatgactacgtacacag

SEQ ID NO: 21009 - DNA, 501 bp, Sorghum bicolor
  Clone ID: 12616554
gcacgaggctgcttcttcctttctttttgtttctgttcatttatacccttcccgacttgattgtcgaccgttcattcttacagtctctgtcactgaacacgaatatcttcgcgataacattttacccaccctcacaccgttaaccgcgatcaccacataccgcctaaatgggttgcggaatgagcaccgaggataaggagggcaaggcgcggaacgaggagattgagaaccagctcaagcgcgacaagatgatgcaacgcaacgagatcaagatgctgcttctcggagccggagagtcgggcaagtccacgattctgaagcagatgaagctcatccacgagggtggctactctcgtgacgagcgcgagtctttcaaggaaatcatttacagcaacaccgtgcagtccatgcgggtcattcttgaggccatggaatctctcgagctgcctttggaggatgcgcgcaacgagtaccacgtgcagaccattttcatgcagcccg

SEQ ID NO: 21010 - DNA, 470 bp, Sorghum bicolor
  unsure (1)..(470): unsure at all n locations
  Clone ID: 12616561
gcacgaggaacacctcctgtcaaagcaagcaagaacactgaactgcagaaacaatctgcacccaacttgacaataacaaatgggcacacaagtacaaaggaagtggctaaaacagagcaccctatcaatgatgtgaaacgcattaccacttggatctgcaaaaatttggcctgtaaagctgttagaccatcagaagattccttctgcaagaggtgctcgtgttgtatttgccacaagtttgatgacaataaggatcctagtcaatggttagtttgttcatctgaaaatgatagcaagaattgctgtggttcttcttgccatattgaatgtgctttccgagacaagaggttaggatgttttgatctggagcaaattatacatctggatgggagttattcttgtgcctcgtgtggaaagatttctggaatactangatattggaaaaggcaattagttattggaaaagatgc

SEQ ID NO: 21011 - DNA, 252 bp, Sorghum bicolor
  Clone ID: 12616568
gcacgaggtttactcacacctgagggcttgcatgccatcaatgctcccctgactgaggtgtttatcatgtgagcgtctgcattttgcaatcacaggaaatcccctctcatggtccactgtaggtggagttcatttattcccaaatattcgagctttggcttttgggggctctaaatagttcaaaaattctcaagttgttgggaaaatctggctggcctcttagagcttttatatagcccttgctcctctttc

SEQ ID NO: 21012 - DNA, 462 bp, Sorghum bicolor
  Clone ID: 12616569
gcacgaggatgggcttccactttgcagccgtgaacctgctgttcctggaagcgccggtgggcgtggggttctcgtacacgaaccggacgtcggacctgcggcggctgggcgaccgcgtcacggcgcaggactcgtacagcttcctcctcggctggctcgacaagttccccgagttcaagggccgcgacttctacatcgccggagagagctatgccgggcattacgtcccacagctggcggagctcatctacgacgggaacaaagcggcgagtagggacagagccatcagcatcaaaggcttcatgatcgggaacgcggtgctgaacgacgcgacggaccagctgggcatggtggagtacgcctggagccacgccatcatctccgacgagctctactcggcggtgcggcgggagtgcgactccttcaaggaggaggccgacggcgggcggcccggcaagggct

SEQ ID NO: 21013 - DNA, 382 bp, Sorghum bicolor
  Clone ID: 12616570
gcacgagggcctcacccgctcccttgcctctctcctggctctctgctcgccatggcagtccaccgccatggacggacgagcagctcaagctgctgctgcgccactgctgcctgcagcccgggctaagctagtgcccggcgtcgtggcctgcagtccccgggcttcgacactcttcctccatggtcgcaagtgcccatggccggactgctcctttctctgctctctctgttcgttagtctgatggaaggagaaggaccttgtgttagaataagaaacaattcagggttccagatgcgaagccaacactcatatgaatagtgtttgtgggctgttgcgtgattcttggaagatccagggttcccgacgcaaaagtgttttcctt

SEQ ID NO: 21014 - DNA, 369 bp, Sorghum bicolor
  Clone ID: 12616575
ctcttgtcaccaaactgaagccttatttcaggaaaaacgagtacccaaaaaaaccaccaaaattttatgaagttacaaataactcaaaggagaggccagatgtttggatcgagagccctgataagtcagtcataatatctgtaacaagtgacattcgtacaatcaagtccgaggtatttgcttctccatactgtttgaggttcccccgtattcagagagtgagatatgacaagccatggcatgagtgccttgatgtgcaggcatttgtggacattgtgcattcaagtaatggtacaacacaaagggtggcagatgataacagcctgaagaatgatgacacgaatcgctcaagaacaaacaaaaaagtgg

SEQ ID NO: 21015 - DNA, 443 bp, Sorghum bicolor
  Clone ID: 12616578
gcacgaggctgcctttaaagttcttcagggtagcttgttttcacttcggagacttgaggaaaattctgtatttccttctattctggcagctctctttgtcattgaatgggaatgtagcatgtctttagctcttgttgaagaaaattatttggaaggtcatgtagaagatacggaagttggtgtttctatgtccagcagttcaaaaagttatttggatgagaaaatgcatttgaaggctaaccttgcagaaagcatacatgcttttcgccaaagcttaagtccatccttttggaataatcttcactcatgcacatcgaatagattggcaaatattctagctcagtgtgtcaggtatgctgtatttcagactagagacttgcatgcggaaaggacagcaatcttatgttccgagtgggtggtggacatgttgaagctcatatgtc

SEQ ID NO: 21016 - DNA, 190 bp, Sorghum bicolor
  Clone ID: 12616586
gcacgaggcagttccgcttcttcttcttcttcctcctccccggcagcagaggcggccgtcgtcgaatgagttgaagatgacggcatactcctcgtcctcctaggaaaggtcagggaaaggaaggattcgagggaacagaggacgctgttgggctcctcctccatggagggctaggcggacggcggcggcg

SEQ ID NO: 21017 - DNA, 448 bp, Sorghum bicolor
  Clone ID: 12616596
gcacgaggcaaagacggagacattaccatttcctcaggtggtaccacgatggtatggttggtaagtttgcatccatgagcaatctgttgaggagttctgatacgagtgctagtcttggagagaaggttcccatctcgcgcaaccgggtatatgagaagcgtttcccatgtcttagtcttagcagtaccactccaccagttactatcaaggatgaaattgccactgtttcatcaccaatgaaacgagccaaactcacggatgggccattaagcactcattgttcaaccagacatcatgaaacagcccatgtagccaaatcagcagaaatgaactcattggaaagtcagaacttccatcctatcaatgatcccaggcaaaattgtagtaaactacccagaggtgtactgaaaataaggactggttgtgcttctgttattggtgacagtga

SEQ ID NO: 21018 - DNA, 366 bp, Sorghum bicolor
  Clone ID: 12616597
ccacgatgcggttcgacctggatggcctgccggtgcacttcccgtacgcggcgatctacccggagcagcacgcgtacatgggggagctgaagcgcgccctggacgcgcgcgggcacgcgctgctggagatgcccacgggcacgggcaagacggcggcgctcatctccctcatcacctcctactccctcgccaacccgtcccgcccgctccgcctcatctactgcacccgcaccgtgcacgagatggagaagacgctcgccgagctccgcctcctcttcgcccacctcccgccgcccgccgcccgctccctcctcgcgctcggcctctcctcccgcaagaacctctgcgtccacccgcaggcgtccg

SEQ ID NO: 21019 - DNA, 569 bp, Sorghum bicolor
  Clone ID: 12616600
gcacgagggtttggaccattgatgcatggaatcgaattaaggttacttttcaagatagtggtaaggatgatagttgtgtggtagtgactacaaggaatcaaacattagctaaatactgtagtcccccatcacacatccaccaacctgacttcctagggaaagaagaggctagaaccttgtttctgaaaaagacaaacagaagtcttgatgaactggagaaaggtgacaaaaccaaaggaattgttgaaaaaatattgaataaatgtggtggactaccacttgccattttgacaattggagccgtacttgccaataaggacactgaggagtgggagaatatatacatgcaactcccctgggatcttgcaaacaatccaagccttgatgcgctaaggcgagtggttagccttagttacaaccacttgccttcgcgtctcaagccttgctttttgcatctcagtatctttcctgaagattttgagattgaaaagaaacacctagtgaataggtgggtagccgaagggttggtagcagatgacacaacaacaataacacttgaagaagttgct

SEQ ID NO: 21020 - DNA, 129 bp, Sorghum bicolor
  Clone ID: 12691522
ggagatcttggttggtttccgcgtggcaagatggttggaccatttccaggaggttgctttcaacacacctgtgggaacttgtagcgcaccattcaagtccacgcatgggtatcactttatcctctgcga

SEQ ID NO: 21021 - DNA, 392 bp, Sorghum bicolor
  Clone ID: 12691525
gcacgagggagggaattcaacctcttatcttgtcactgctttcactgaaagaggctgcaaggacaagcattgtgtcgagaaagtggagaatgatctggacacgccaccctaatctctgctttgatggcaccaaaaagcggcccaattatgaggattgtgtcaaaatagaaagagcaaagttcattgagacagtcaattctgttgttcagcagcacagcgggatagggctcaataagttcagcatcaggtgcagccttccaaagaattcctccgatcatcttgatatgtggattcgctttgccgctgcagcaaaggcgaagattatagatattaacctatggtcaaaaaggtatattggaggaccaatcaaagaacagtatctcttccctctt

SEQ ID NO: 21022 - DNA, 496 bp, Sorghum bicolor
  Clone ID: 12691527
gcacgagggcggcacacgtgacctgcttctccgacgcactggagggccaccagttcttcaaccagcagcagacgccgccagaagccgacgccacggaccacctcggcctcgccgcctcctcgccgttcctgctgtccggcttcgcgcattacgggccgctgcaccacggcgcgacgagcctggtgcagctcctggagggcagcgtcgtgtacgctgccgccggcggtggcggcctcccggacatgtccaacaagcagcaacaggagcccgtgccggcgccgacgtgcaaggtgggcggcgagcgggagcggctgagcttgtcgcaggacacggggctcacctccgacgtgaaccccgagatctcctcctcctccggcgcccaacggttcgaccacgaccacctctgctggggctactgatcgagccgcacatcatcgcgtacgtcatcgctagcgattagtatagcactgctggaaataagcacatctacatctgt

SEQ ID NO: 21023 - DNA, 143 bp, Sorghum bicolor
  Clone ID: 12691532
tgcacgaggccgtgtgctgcgcggcacctccatgcccaaggacgccgccagcatcaacctccggtccttctacctcgtgggcacgccggtggcgctcgtcctgcccttctggctccactacaacttcaagggcctctggctcg

SEQ ID NO: 21024 - DNA, 480 bp, Sorghum bicolor
  Clone ID: 12691548
gcacgaggctcaagcagctcttgcaaagctagcttccagcaacagctcggtcaagcgcagagcaaatggccaaggaggtggacgtgtccgcactggaggccggcggcgcccgtgactacatcgaccctccgccagcaccgctggtggacatccacgagctcggcaagtggtccctgtaccgcgccgtgatcgccgagttcgtggccacgctgctcttcctgtacatcacggtggccacggtgatcgggtacaagcaccagacagacgcgacggcgtcgggcgccgacgcggcgtgcagcggcgtggggatcctcggcatcgcgtgggcgttcggcggcatgatcttcatcctcgtctactgcaccgccggcatctccggtggccacatcaatccggccgtcacgttctgcctctttctggcgcggaaggtgtccctggtgcgcgcgctgttgtacatggccgcgcagagcctcggcgcca

SEQ ID NO: 21025 - DNA, 214 bp, Sorghum bicolor
  Clone ID: 12691550
gttggcggctcggcatcccaaatcagacgccttcctccgtcctcccttgctgcgctgcagcgctggtgaggccaagcaatcaagggggggtgttggtccgtcgagcggaggccgagtatggcgagggccctcgaccgctacacctccggcaaggatgtcgcctacagttgtggatactgtggctatgcattaaacttgagctcctccgcacgga

SEQ ID NO: 21026 - DNA, 333 bp, Sorghum bicolor
  Clone ID: 12691561
cgggtcgctaccccaccggaagctccgggcgatggccagaacgcacggtccggtcatgctcctgcgcctcggccgcgtgcccatcgtggtggccttctcggcggctgcggcgcaggaggccatgaagacccgagacgtggccttcgccagccgataccgcggaccgatggcggagcgccttctctacggcggccgtgacatggccttcgctccctacggcgagcactggcgccaggcgcgccgcgtctgcgtgctccaccttcttagccaccgctgcgtgctctccttccgacgcgttcgggagcaggagaccgccgccctgctccgccgcgt

SEQ ID NO: 21027 - DNA, 374 bp, Sorghum bicolor
  Clone ID: 12691572
gcgattactaggcacactagctagttcgggcagcgagcggggtgacgacggctagctatggcgtgctactccgccgtcctgcagcatccgctgggctcctctctcacgccgtgctccgcctcgcgagccccaccacgcctccagcgcgtgggcgtggcggcaaccccctcggtcgccgcctccgcccgccctcttgcccgcgtcaggatctcaccgcgctgcgcctactccggcggagccggcgccacccctggtgggtctgaggagctacccgcagcggcgctccggcgggtcctggagacgcctggagcgcaccaggcgcccgcctgctacgacgcgctgagcgcacgcctgagtaagcgcgccgggttcag

SEQ ID NO: 21028 - DNA, 505 bp, Sorghum bicolor
  Clone ID: 12691577
ttcgtataattttgaaaatataaatttgaagtgcaacctgcaccttctaaccaaggaagaactatttattcggcgaaatggaaagttaatgtttcttcggaaggcagatcagctagaaattggtgacattgcctatagaccactgcaggatggtgatcttattctcatcaacaggcctccttcagtccatcaacattcactgattgcattctctgcaaaaattttaccaattcactctgtcgtatcaatcaatccactatgctgtacaccttttctgggagattttgatggtgattgtttgcatggatatatcccacaatctgtacgatcaagaattgagcttggagagctggtaagcttacaccaccagctgttgaatatgcaagatggtcgaagtttggtgtcactaacacatgactctctagctgctgcacatttgttaacaagtacagatgtttttctgaagaaatctgaatttcagcagcttcaaatgctgtgcctttca

SEQ ID NO: 21029 - DNA, 434 bp, Sorghum bicolor
  Clone ID: 12691581
catccacggcggtgtctccacgaggacccccgggaagaaggcccgtctcgccgccttgggaggcttcgtcgtccgttcccgcgacggcagccatcgtcgtttcgtccacaaccgcccagagagcaggcctcggcgcaaggggaacgcgccacgcggcgccgagacgagggaggcgcgcgtcgctgccgccaacgagcgcgaccgcaagctttcagccgacgcggccgtcgagcgcaggaagaggcgcgcggaggccgcggcaagagccgtcgaccggtacgcccgtgaccccaagtaccgcctcctgcacgactgcacgggggatctgttcgccaagctcctcgccgaggacctgcagaagctcgccgacggcaagctcagcgacatctcgcttgccgccaagtggtgcccgtcgctcgacagctgctacgacc

SEQ ID NO: 21030 - DNA, 378 bp, Sorghum bicolor
  Clone ID: 12691583
gcacgaggccatcgcctcggctgtcatgctgtgcttagagatgtggtattatacggcagtgctcattctggttggatgcctgaagaacccagagattcaagttgatgcgatctccatatgcatgaactatcagctgtggacactgatggttgctgttggcttcaatgctgcagtaagtgttcgcgtgtcgaacgagctcggcgccaaccatccaaaggcggccaaattctccgtcgtcgtcgccaccgccacatcggccgtcatcggggtgatcttcacggcggttgctctggcggcgaggaagcagatgcctcggcttttcacgggcgacgacgtggttctcagggcgactgccaagctggggtacctcctggccgg

SEQ ID NO: 21031 - DNA, 480 bp, Sorghum bicolor
  unsure (1)..(480): unsure at all n locations
  Clone ID: 12691612
gcacgaggcttgaattcttttaacgacctcctcccctagagttagtagccacttcacaaactgaccccttttctgagttggaaaatggctctaggaatatgctggcaaatgggacaccatccaatacaatgagcaagttaatagaatcaagtccaccccatacatatccaagtccacagtcacctccacaatacaaggaggacattctacatcgcagactttttctggaggaagaatttttgcagatttcaggacatcttcattctgttggttcacttggtagtggtagcagctgcagtgatggttcttcgagtgattttggttcatgcaattctgaagatgattgtgaagaaattcagacaaagatggagttgtcttgtaatggccagatggttttatttccttttgtaaatggtgatgatcatgaggcaaagaataacttagagcatttttcangggagaatactttgtttgaccact

SEQ ID NO: 21032 - DNA, 379 bp, Sorghum bicolor
  Clone ID: 12691616
acgggcgccactctatggcccggctcccccggacagtatctataaagtcgccagattactggagcaagccaaacgaccggtcttcttccttggtcagcgtgcttccagccacatcgtggtggaggccttgcaccagttcctcaacaaacaccctattgcggttgtcgagacattccaggccgctggagctgtatctcaagaaatggcaccaaagatcttcttcggtcgtgtgggcctcttccgaaaccaagtcggcgacaagctcctgcaaaattccgatcttatcgttactctaggctatgatccgacagaatacgacgccagctcctggaaccctaacggcacactaccaatcgtgcatgtcgactacacatcatgc

SEQ ID NO: 21033 - DNA, 156 bp, Sorghum bicolor
  Clone ID: 12691617
gccagggacgccttcgaccacggagaatggccacgcatgtctggatccgaacgggggcggatcatggcgaggttcgctgacctggtggagcagtacgcggacgagctggcggcgctggagagcctggacgccgggaagtacccggccatcaccaat

SEQ ID NO: 21034 - DNA, 153 bp, Sorghum bicolor
  unsure (1)..(153): unsure at all n locations
  Clone ID: 12691619
gcacgaggcatctcgcgtcgcgtgggaagccgccgcccacgccgcgaagccagcgaagcagctcgttacctacctctcccgacgttgccccctgccgtggatcgggttggcctctccggcggaaccgcctaccccgcttaccgcgccgtgncc

SEQ ID NO: 21035 - DNA, 398 bp, Sorghum bicolor
  Clone ID: 12691627
gcacgagggaaacatatatacagctcgttccttgtctgtctctctccctctctgtcttccccggcgccgacgaggaggcaggcaggcaggcggtcgagatcgtcgctgcgcggacactcactcactcgctgacatggcgggcggcggcgtcggtgacgcgtacggcgaggaccgtgccaccgaggagcagctcatcacgccatgggccttctccgtcgcaagtggctacaccctgctgcgggacccgcggcacaacaagggactggccttcacggaggcggagcgcgacgcgcactacctccggggcctgcttccaccctcgctggcgtcgcaggagctgcaggagaagaagctcatgcacaacctgcgccagtacacgcagccgctgcaccgctaca

SEQ ID NO: 21036 - DNA, 451 bp, Sorghum bicolor
  Clone ID: 12691650
gcacgagggtcctctgaagcatggacggtagcggcagcagcggtggaaccaacggaggcagcggcggcgatggtgccgggtggctgcgacctatggacgcggagcagctgcgggagtgcggccaccggatggtggatttcgtcgccgactactacaaatccatcgagaccttccccgtcctcagccaagtgcagccaggatatctaaaggaacttctaccggatactgctccaaacaaacctgatacattggaggccctttttgatgatatacgagagaagatagtaccaggagttacacattggcaaagtccaaattacttcgcctattatccttccaatagcagcactgctggcttccttggggagatgcttagtgcagcctttaacatagtcggattcagttggataacctctcctgctgcaactgagctagaggttattgtcttgga

SEQ ID NO: 21037 - DNA, 115 bp, Sorghum bicolor
  Clone ID: 12691659
cggttacatggaggacgtcgaggacatgcccgtcttcatggagtccgacgaccccgaggcgcacctcgcgccaacgttcgggtgggatagggcaccggccgtgcaggacctcttc

SEQ ID NO: 21038 - DNA, 492 bp, Sorghum bicolor
  Clone ID: 12691661
gcacgaggccttcatgaccgaagaccaaattcccaagaaagggaatctagctattcacggtctcccagtaggaagagtgaaaggaggcatgagaagaagcctgatgatggagaaactaattcatctaggagtttgagtgtctctgacaataacgatgatagaaaaaaggagacactcttaagtggtgatgataaagaggatcatgaaatacagctgaaacaaataagacaggatatggagcttttgcgcgatgataaatctcacttggagataattttggatcagaagaatgctgaagtgcgcaagatttctagcagagtaaatgatcttgatctgcagctaaggaaggagaaagaggaatgccacaggatgacatcaaaaatgaaaaagttcatcaaagcccatactcgctttttgaaagcacaggaagaattgaaaaggtcacaagctcgttttgagagacttggtgatttgcttgcttcagatattctg

SEQ ID NO: 21039 - DNA, 329 bp, Sorghum bicolor
  Clone ID: 12691680
gcacgagggcggcagcggcgtcttcgggggctccgacgccggctcggcctccgaccgcttccactacgcgtaccgccgcgccgggagctcagcggcctccactccgcgactgcgcagcgggggcgccgccctgtcgagtggcgacgccacgccgtccatgagcgtgcgcaccgacttccctgccggcgacgacgaggaggacgacgagatggcgtcggaagccgctggcggatgtggtggtggtggcaaggacgacgacgccagggagtgggtagcgcaggtggagcccggcgtgctcattaccttcgtctcggtggcgcaagggggca

SEQ ID NO: 21040 - DNA, 308 bp, Sorghum bicolor
  unsure (1)..(308): unsure at all n locations
  Clone ID: 12691681
gcacgagggctcgcactctcgctcagctagctgctggtggaagcctccccctgctccctcccatggccacggccgccttcgccccatgctgagccaaacccctagcgccagcccagcataggaggagcgcgagagatcctcgcctgcctcggcgccgccggcacgcccttcggtgccccgccccaccactcacatgggggactcgacgcaccacaccatccgccgcgccgcggcgcgcccgcgcggntggtgctgctcgttcgcgggcgtcccggacagccccgagcaccgccgcgcgctcccggggt

SEQ ID NO: 21041 - DNA, 218 bp, Sorghum bicolor
  Clone ID: 12691682
gcacgagggtgactaccacaatgggatgtctgaagctgaccacaagattctatcagcagaggtaaaacttgaatcccagtactacttctacatggaaactcaagcagcactagcaattcctgatgaagataactgcataacaatctattcctccacacaaatgccccagctcgcacaaagtttgatagcaaggtgccttggcattccatttcacaatg

SEQ ID NO: 21042 - DNA, 435 bp, Sorghum bicolor
  Clone ID: 12691684
gcacgaggagagcacgccaccactaagccgagcgcgccaactcaccgccgccaccgagcgcgcgcgcccgcaggaaatggcggtggcgcccttgctcaccctcttactcctgctgttcctctccggttccggtccccgccgatgctccgccgccgccacagcgaactcgacgtcctcaccttctccgcccccgcggccggcgccgctagtcccggcgctcttcgtaatcggcgactccacggccgacgtaggcaccaacaactacctgggcacgctcgcccgcgccgaccgcgagccctacggccgggacttcgacacgcaccgccccacggggcgcttctccaacggccgcatccccgtcgactacatcgcggagcggctgggcctccccttcgtgcctccataccttgaacagaacatgcgcacgggcgccgc

SEQ ID NO: 21043 - DNA, 181 bp, Sorghum bicolor
  Clone ID: 12691691
cgaatgcgccctgggagacgccgctataggcgaggaaaccctaaactacgacggcgatgacgtcgagatggccgacgcggactcggacacggaggaagccctagcagctgaggtctccgctggaactggaggagccgccggtggtggcgggcacgcggagaaggacggaccggagggaaag

SEQ ID NO: 21044 - DNA, 359 bp, Sorghum bicolor
  Clone ID: 12691693
gttttttgtcttttttctcttctgttgcttttttctccgccttgaggtgcactttcttttttttttttaaatctttttttcgctcttttaaaaaagaagaaaaattaaagtgttatccaaggctgtcgttcttttgtttatacattttctcgcccaagtacataccatccagcagatatatccgccgtcgcaagtgcccagcgcttaacaattcatatcgccagccgatctctcatatcgctccctattcgacggacttaaccttgcgagctgtctctttgattgcttgccttcgttcctttttacctacttatcgacgtttatatctggaacttcccggggaagtttgatttcacagt

SEQ ID NO: 21045 - DNA, 313 bp, Sorghum bicolor
  Clone ID: 12691697
gcacgaggctgggtttgacaaggggttggtggtcgagctcgccgtggccgcgatggaggagctggtgcggatggctcaccttggcgagccgctctggatccctgcccttgtcgtagaccgtgctaccattgagactctcaatgaggaagagtatgcccgtgggttccccagcggcgttggtcccaagttgccggagctccgatcagaagcatcacgggagaccgttgtggtcatcatgaatcatgtcaacctcatcgagatgctcatggacgtgaaccagtgggctacgctgttctcaagcattgtgtcacgg

SEQ ID NO: 21046 - DNA, 126 bp, Sorghum bicolor
  Clone ID: 12691710
gcacgaggcacgatgtcgtcccaaggctcctcttctgccccccggacgccatccctgcggacatcattgtgggaatgcagctgcatcaatggccggcacggactcgccaaacaggcgcggtgacca

SEQ ID NO: 21047 - DNA, 213 bp, Sorghum bicolor
  Clone ID: 12691717
gatatgatcaagaatgtcctgaaaattaaagatacacaggtgagggaagtaatgacgcctttggtggacgtagttgcaattgatgctattgcaacacttattgatttcaaaaacttgtgggaaactcatcagtactctagagttcctgtatttgaggagcgcatagatcatattgttggaattgcatatgcaatggacatgcttgaatatgtt

SEQ ID NO: 21048 - DNA, 441 bp, Sorghum bicolor
  unsure (1)..(441): unsure at all n locations
  Clone ID: 12691720
gcacgaggctcccctccgcacccgtccggtcgtcttcttccccgctcccggactggacggaacggaccctctctctcaccctccccaagctcgcccggtccttcctttataaccgaacccagcccaagggcaaccgtttctctcggtacggtctctgctactagcacaccaactccccccattgtttgtccttatcccccactccagaaccttctagaaggccggcgccggcacccgggcaaggaaggatgtgcgggatcttcgcctacctcaactacaacgtctcgcgggagcgccgctacatcctcgaggtgctcttcaacggcctccgccgcctcgagtaccgcggctacgactcctccgggatcgcgctcgatgccgacgccgncgccgcccagctcccctccccctcccccgcctacgccggggcgccgccgctcg

SEQ ID NO: 21049 - DNA, 400 bp, Sorghum bicolor
  Clone ID: 12691724
gcacgaggtaaatcatcaaaagctgaaactgagtcattgcagtgtcaggtgacagctttgcttgcacaggttgaaaaaattgaaggtgagaaaagggagctcgaaattgctcttgcagacgccagagatcagcttggcacatcatgtgataccctaatggttgccaacaataagttgattgatttgcagatgcagttggacttggcaaatgagtccaaacatgctgctttcggagaagccgagcgactggatggtgagaggaaagatttggcattacaactggagtctaagtctgctcaagttaatgagcttgagctgatggtggcatcgctggaagaaagagtagacaggaaggagttagaattgcagttagagttaatttctgcagaggcagcagatc

SEQ ID NO: 21050 - DNA, 403 bp, Sorghum bicolor
  Clone ID: 12691726
gcacgaggctccctcggtccgtccctggctccgcgcgcaaccggatccaagcgagtccggcttggacacgtcaccagttttcctctccgccgtctgatcgaggttagcaaaaagggaaaccgacctgcaatcgcacgggtaaggtaaaaccaagctgtagcctttttatctgtcggccagtccggtctgtccatccgggagccgggttcgttccttggcgatggaagaaaccctagccgtcgaatccgccgccggcgagacggcggccgcgcaggcgcctgagcggaaggaagagacgctcgaggaggtgctctcgaggcacaggaaagagaaatcaaaactccaggataaggaaacaagcctcaagaaagctgctgcaaaaggaagcaaagctgagcagaag

SEQ ID NO: 21051 - DNA, 295 bp, Sorghum bicolor
  Clone ID: 12691728
gcacgaggggagctcatcatcactcccacccaggctctcttgcctttgtcaatcctctttgttgcctaccatgccattcgtgcattgttcttcgggccaccggcctcaaagcactgggagcagctgccagttgttggtctcggaaaaggatggctcgcatgggtgtgggctacactgaagtctgtacggaagacccaggactgggcattcgagggttaccgcaaggtatggtctaatgcaatgcgtgtgaataccttactcaacagtctgtttccagtttgccccccaaaacagc

SEQ ID NO: 21052 - DNA, 458 bp, Sorghum bicolor
  Clone ID: 12691732
gcacgaggcaagacttgaggaaccacaaagagtcttgcataatgtgccaagagtgcatccaccacaatcaggcgggaaaataaagaaattgacaaaaaacctttgtcaatatagcgacgagtccttaaatggatcaggaagtttggattgttgccatcaaggccgaccaggaaggcgaaaaaatcaggattacaccgctgatcctggaaggaatgatctgcctgtcgctgctcatgaaccacaagttgttctcttaggatcagatcgcaggtataatagctattggctcttccttggtccttgtagggaagatgatccagggcatcgaagggtctactttgagtcctcagaggatggacattgggaggtgatcgattcaccacaggaattactttccttgctatctgtcctcgatagcaggggcactagggaagcacatctccttacatcgatggaga

SEQ ID NO: 21053 - DNA, 539 bp, Sorghum bicolor
  unsure (1)..(539): unsure at all n locations
  Clone ID: 12691741
gcacgagggtagtcaaagtgatgtctcaaaaaaaaaccacaagatggcgatgaaggtcaaataagaaactagaaagtattttatgaacttgaatttctccctctagtgaaatgcattttaagagtaaaaggttggtctagtgttgaatcttcattttggcgtaggcttccctgtcttttctattttttgttaccaaagtttgatacatcaacctcaactcagtgtttctatgctgctgtggttccagaaggttcagagtacgtgctttggtatcacagcttttttttctttagaggaaaggaaaccatccatatccatacgggatcatcctgtttcgtcactttctgactctccagccttttttcattttgctccttgttgcctcaaatttttacatcgtatactccagtacaactggtttgcttgaatttgctccacaataataccatattacatttacatgtacttgagtacttttgagcaaggcatccattggatcctcctttntgtgcaggctggggaattgcattggtctctca

SEQ ID NO: 21054 - DNA, 391 bp, Sorghum bicolor
  Clone ID: 12691745
gcacgagggtttcaaactggaacgtagatgggattatagaacagatgctacctaaagaatatggggaaaagtctcaatcgaaggaagcagcatctctgaaatcaggccgaacacaaactgttgaggtgtcacctgaagcaaagaaaagatccttggaagccaaatcaagaggtgatgatgccttcagaagaaaggactaccttgtagcagtggatgcttatacgcaggctacagagttggacccaactgatgcaacagtgctctcaaacaggagcctctgctggctgcgagcagggcaagctgaacgcgctctggaagatgcgaaagcatgccgggcattaagaccagattgggcgaaagcttgctacagggaaggtgcagcccatcctct

SEQ ID NO: 21055 - DNA, 524 bp, Sorghum bicolor
  Clone ID: 12691748
gcacgaggatcattgcgtgagcttccgagatgcgtgttgagtcggtattggcagctgcccgctgtctctttgggacgtgcgaaggcgagagcacatctttgtcagcatcgaacatttgctcctctctcgagacgctcgctccggctaatgtcttgtacgctggcgacgatgcatacggcattcgccagaaagcctactttataaaccagcacaaggagatgcaaccagcatgtcgctatctcccaagtgatgcttatgatgtgagagcagcactgcgacgtctggtcgaaagcgatacctccttcgcagtccacgcgggaggccattcttacaaccctggaacttccaacatcgaaggcggcgtcaccatcgacctcagccgcctcaacagtatcaaactgacagacaacaacactgccgcctgggttggtcctggtgcccgctggcgcgatgtgtacaaatctcttgagcctcacggtctgaccacgcctggaggccgcgtggctgatgttggtgtcggcgga

SEQ ID NO: 21056 - DNA, 535 bp, Sorghum bicolor
  Clone ID: 12691751
gcacgaggcctagtcctcactctttcatgcaattataagttgtgctacacttttgaagcacttatccatctttagtttggcacagtaaatgttctcttttaggagcatctccatttcccatggcacagtaaaagagaacatttacttatttaaggatcatttcacatggtcatttcacaggctcttatttcttttgcacaaggctaaatatcttgtatatttggttgaagggagtggtagctagcagcgtaacttcagttatttcaaagggtattctactattgggtgtaccttcccatttagttgccattagggcctaaaggcttaaacatctttacctactcttaggatttcttagctttaccaattacacttaataaccctaccatttgttttttttcttgcatggtgaaatttttcttaatatttgttgactcatataactaacctagtatgcttgcagattatttcaattgtcaagagtagaaatacaaaggacaaaacttttgggaatttggcctttgcatgtggatat

SEQ ID NO: 21057 - DNA, 500 bp, Sorghum bicolor
  Clone ID: 12691778
gcacgaggctctcgccttctctctctttgaggctgttcttggttcgtccactctccggagttccgcccattttggatgtactggatttgttcctgtgaagtggagagaaattttgtgggggataggtttcgtctcggaaactcttcaactaccgttgctttctccttgctcctctggatttgcgcagagacgcaaccgctataattatcagcgattccttttgttccactcgatccagccttgttgctttcccttaaaggcggtgtctttgccaatcccacttttggtgagacagatgtttattggatctagtctagttcttgaagaagataagattttcctcgcagattagtctgttgctttgctctatcctgtttgattttgtcagttttgcccccaattttcacccggatcaagaggacccgagcattctttgattttttttcgccccacaatggccatgtcgctgagccgcatctcccactggatatggccgggga

SEQ ID NO: 21058 - DNA, 508 bp, Sorghum bicolor
  Clone ID: 12691782
gcacgagggtacattggtcaagggagagaaaaggcaagaatggtcagcaaattacacaagtttgtaatacagaacaagatgatgaagcaagaagtatttttcgtgaatcctctcaggatacacatcataacatggatttgatctggcagcaggcagacaccagcaggatctctgaggacaaaaacattactggtttgctcatagaaagcaccgaaaaggcatcatctatgactaatgtggatatgggacaacaaacagcaactatgggaatctatggccaagaaataaggagtgagactactgcaggaactagtttaccaagtggttcaagtgccaaggaaagcatgctagaatcagctgctcgattagagaaatcatctacctttcctgttggacggtttgttgatgagctccaaaagggagtctcagatgcagacgctacttcaacaaagaaaaatgagaagtccatagtggaaggtatagcaagctcgttgtcaatgtctagaac

SEQ ID NO: 21059 - DNA, 375 bp, Sorghum bicolor
  Clone ID: 12691789
gcacgagggtgagggctgaggggggaggttttgccgccggcaatggagatgaatctccgggcgcagagcccgctctgctcccggggcaggcccgccctcgtcgtgcgcccggccgctgccgccactggcctcacgctgtctgtcatgaggtgcagcagattcacgagaggcgagctcgttcgatgcatggtatcaagttcagattatcctaagaggaatccgaggaggacgtcgacttctaagagcaagggcgtcgcgtcgggagggtatgcttcaagacctactgctgaatccagcacaaagaagatagaacagagcagcaacgatgaaggtgattttagcagagccaatgggtcactgtatggtgaggcaaca

SEQ ID NO: 21060 - DNA, 190 bp, Sorghum bicolor
  Clone ID: 12691790
gcacgaggcacctgtgttacctccacgaacaggacacggatgggcttgcgttcctgttatacctagcatttgtaatattaggtcagaaaacagactatgcgccattacaaagtctcttcctcctgctcaaggatggagtgcaaatgattcctcctcgttttctcgtgaagaacccctctatcctctccaa

SEQ ID NO: 21061 - DNA, 421 bp, Sorghum bicolor
  Clone ID: 12691791
gcacgagggccaccacgacgtatagtacaccgcagcgcgcgtgtgcagcacacaccggccggctccaccactcgctcgttattaagcggcgccggcgagcgcccgtgcgtccatggcgaagcagcagcagcagcagcagcaagtctccgccggcgcggaggccacgggccggcaggcggcgtcgttcctgctcggctgcgtcgccgcgctcaccgtcgtcctgctcctgcagcgccgccccgaggagctcaccagggcgccgatggtgcgattcttcggagggggaggggcacggacatcatcgtcgtcgtcgtcaccagcggcagcgtcgtcgccgtcctcctcctcttcctcttcaccaccagcggcaggtgaacatgcagcagcacatcttcagacgacgactgataacgccgccgca

SEQ ID NO: 21062 - DNA, 488 bp, Sorghum bicolor
  Clone ID: 12691800
gcacgagggcctaacgccaccgccgccgtgctcgcgccgcacgcaactctcaactctctgacgcctccgccgccgccgcctcctcctcctcctccgtcgactccgccgagaaagacgcaaaccaaggagggaggagggagcgcgaagatgggcgcgggggacggcgaggtcgctgcgagcaaagagaagggcagcggcgccggagggggcggcgtcgagcggacgtcgctggacggggtgcgggataagaacgtgatgcagctcaagaagcttaatacggcgctcttccctgtccgctacaacgaaaaatactaccaggacgccatcgcctccaaggatttctccaaactagcttactacagcgatatttgtgttggcgcgatagcttgtcgcctggagaagaaggaaggaggagcaatccgagtttacattatgaccttgggtgtcctggcaccatatcggggtcttggtattgggacaaagctgct

SEQ ID NO: 21063 - DNA, 576 bp, Sorghum bicolor
  Clone ID: 12691801
gcacgaggggtgaatgataaagtgcagtttttggaaccaacagtagataatgattatttagcaaagagcagtgatgtgactcattcacatgctaaagagccatatggtgtattgtcctatgaaaaatcaccaagttctgtgtttgatgttagaccttcccagtgtaacaatacatcgaaaattcaatctacattccctcaagttggacttcccaatttcatgcatctcaataatggtcccatttgcttcaattgcttaatgttgaattcttccaaatgtgtatcagtggatttgcttatatcaagacatgctatcttctacaacagaaggacttcctacaacatcttccatggcaaccacatattaaacagaaggaaaagatcagatgcattatctcttataatacatatatttggaatcaagggatgctgcacaaatttactgaaacgtgactgccatgtgtctagtacaacaaattctaattgcttgtgcctttcactgcctaaactaatgaataagctcatcagaaattctaagcgctgccagtataagaaactatttctgaagcattggtct

SEQ ID NO: 21064 - DNA, 434 bp, Sorghum bicolor
  Clone ID: 12691802
gggcacgaggccactggtcaactatatgcatgaccatcttctcagggaaaaacaacagctaagcatcaatggggtgcctattcctgctgatttttgttgtcccctttccttggagctgatgtctgatcctgttattgtagcgtctggacagacctatgagagggtttatatcaagttatggcttgatgagggctttactatctgcccaaaaacacgccaaagacttggccactccaatttaatacctaattatactgtgaaggctctgatagctaactggtgtgaatcgcatgacattaggcttcctgatcctatgaaatcattgaagttgaacttcccttctgctgcctcctcccttcaggattcaagtgctgcaggtggcagccctctacatcctagtgttgtgtcaagggctaatattcctgggtccccag

SEQ ID NO: 21065 - DNA, 402 bp, Sorghum bicolor
  Clone ID: 12691803
gtacatactacattattcatttttttgttccccacagagctccccggctaggctgctcccccgcagctgacgcgtttgaatacgggcgttcgcgcctagagtgtgcccagctgaaattccgatcttggtttcccagtaccaatgtggctccgctagggctcaagaatgctattgaatcttggcctcacagcggatgccgcagctgcccacacgaatgaacccaaggaatcagaaatacaccccgtcactgcccattcaccaattttctcattgtctacactgccctttttgaacaccttctgctctcgccccacgacccccgatgggtttgatgcgtgtccaggggttgtttccgccatggaaatgaggccgactgagttggaatcgggctccagtgaaatg

SEQ ID NO: 21066 - DNA, 573 bp, Sorghum bicolor
  Clone ID: 12691810
cgaccccgccacgctcgccacccccggcgacatccgacgcgccgccatccagctcgccgaggactcctcttcctccacgccggacgcctccgccgccgccgctgccgtggccgtggcgtcatctgcctccgtcggccaggccacgccctcgtcgtccgcgtaccaggccggggacgacgccacgggggctgcaatgtatggcgccgagtacgcggcggcggcaatgtatggcgctggcatggacttcgaccactcgtattactacgacgggatggtgggcgggaacgagtggcagagcgccggcagcagcgggtggcatagcaacgtggacgccggcgacgacgaaggcgccggcgacatgtcgctctggagctattactgagctctgcactgcaccagcacaaattcaggtgctggggctggcgctgataggggcaggggagtctgaatttgaattcaaatgttcgtagtagtatacacgagggaacggcgaaagggcgcgcaagaatgcatttgccgttcttctgcctttttttttggtgggagagaataataaaagaacctgcaactctg

SEQ ID NO: 21067 - DNA, 460 bp, Sorghum bicolor
  Clone ID: 12691829
ctacgccaacgagtacgccgacaacgttctcaagtccaggggtgacgctacttgctactggaacgacagcgagtaaacacgtgcaagcatgtctccccatttgcgggcttcttcggtcgatcttgtgagctagactcgctcaacgacctgcttgtctgacattttcatgaaggcaacgcatttgctttttcgacacaaaacattttcttccgatcacgaacgaattcccgagcgggaaagatttttgcacatggtttcctatggggcgagcagcacccagagctcagcatggtgaatgggtttccccttgttttgcatctggccaacagaaaagccatcgggcgtttctgatgtggaaaggaaagctggtacttcttcttcactacacaccttttttatgcacccaagcttgcttctttttctttcgtttgtttccaaagggatgcacggtatttcttct

SEQ ID NO: 21068 - DNA, 647 bp, Sorghum bicolor
  Clone ID: 12691839
ttttcttatatctacacttgaagtcgttggtctttttcacatacccccgcgaacaattcgcgacaaccacggcagttggtctttggttcttgttttgttttccctgcccttgactttgcatatgagtcattactcaatacatcatctattcatggcgttccaggttctttcttttcttatatcttgaggctctgggttggcacagcatctctttgcgcgatacgcaacaggaaggtcgccccaattgactgcgccggtacccatcaaagtgtaatatgcgagcggccttcaatgcaggttgatttggacaaaccaaaagcggacaagcatgctgtgggatgcgggatggctttctcaatgattagccggcgtactggaggacttactggaatggtaatatggagggatgaaggcacaagcagtcgatgacgaaggggaggtggctctaagcaggccatcgtgcactgtatatgagccgcctcatcttttgtcttttttgtttttcctagaacgacgtgatggatgaatggaaggatgaactgtgaggatgagatggaaactgcttggattgttgggataggatgggaaaggccaagaagcaataaacacaggaatggacgatgataaaacaatgcaattttgaatgc

SEQ ID NO: 21069 - DNA, 543 bp, Sorghum bicolor
  Clone ID: 12691853
ttatgttaattcagttattttcacttaggcgtagtggatatttacatataaccaataatcattgctataaaacttccgagagactaaatcttgaattgtttggtgcgcagaggtagttgaatgtactctccggagcataacaaatatctttttaagtttagtatggggataatgaaaaaaaaacagggggatataaatctgtctcataaataccctttttaagctatagtatggggtaaggaaaaataagaaagtttatgaatttataagtgttaaataaactactaacttatcaaatagacatgacaatatcaaagaacagaaatgattaaagtttcatcgtaagagtaaaagaagtttcataatagacatacatagaagaaactaggataaactcctatctctccccctcaccattatattgacctcaaacaaggagaaacatatagtccataggtaacttttatattcccattggaacaagaattcttctagaatacgatgagatacatgaaaccatcaaaattatagggggaaaactag

SEQ ID NO: 21070 - DNA, 633 bp, Sorghum bicolor
  Clone ID: 12691870
aggatgagggcgtggtgcctcccgtactggtggctgctgcggctgctggaggagctgccacggctgcaatcgcagtggtcttgctcaacctcaagaggtaatctggtggtccggtgcacgggaagttttgatctgctgctatggcctatatgagaatggattgtctgttttgtcgtgctactagtgttactggactcagtagtagtatcttcactatcagctggataatagattagagcgacctatatcgcaagtacctctactttctgcagttttccatgctaataagagttgtgaacacaaatgagagagatagtgagttctggtctgttcttttgaagttgcatctaattccagacttcgaattattatgacttggatggtttgtactgttatgcctcgtgtctctagttgttatctttgtttgtgaagtctcatgtggtggagatgttgatggctcagaatcagggtgcgttgttactgggggtgaatagcttctggttgtctgtttgacttggcaatagtgaggctgtggattggctagcccagaaagtgttgtttatcataccaattttcttgcgacatttgttgtcagtgttttcaggtggttgatgagcaaggatgctgttttgt

SEQ ID NO: 21071 - DNA, 497 bp, Sorghum bicolor
  Clone ID: 12691880
gatcccgaagaaagaccgtccatcgcgggcgagtcgatcatggtagcggggaacagcaggctgccaaggcagcacgcagcacgggcctttgctagtctgcctatgcaggcgtcgtgtaaatgtattgtattggcagggatcctgtttatagcactagtatggcctgtgccgctgtgcgacaatgttggagctgcctgcggctgatgcacgtcgagcataatgttgttgtacagcttcccccatttttgtgctcctgttcagatcactgaaggaggcaggcatgctcgctggtgcagtgcaggactggaaagaaacctgactgcctgagagttgtagttttttttttttttggttgttgacattgcattgggatgtatgatgtattataatcagctaatgtgcgatgtaagctgatgtaattggctcaatgcatttccattgttagtatatgagttaggatgccattgttttttttttatgaaagttaggatggcatt

SEQ ID NO: 21072 - DNA, 579 bp, Sorghum bicolor
  Clone ID: 12691884
tgatcaggtaagggtcaacattgcaaatggagatatggttggccatactggagacattgaagcaactattgttggatgcaaggcagctgatgaggctgttaagatcatcctggatgccgttgagcaagtgggtggcatttttgtactcactgccgaccatggcaacgcggaggacatggcgaaaagagataagtcaggaaaaccactccgggacaaggacgggaaggtccagacccttacttcgcacacgctgaatccggttccaatcgcaataggaggccctgggctttcacctggggtcaggttccgtacagacctcgcaaatgccggcctcgctaatgttgcagcgacagtcatgaaccttcatgggtttgaggcccctgatcattatgagccaacgctgatcgaagtcgtcgacaagtgatgccttggcctttgctacttcctgtctcaataaactcatctgccactgctttgcattagtttgtctatgtataggagtatactctacccagggattaatttggtttccgcttcgctagttgtgggcctgtggctgtcatcatctgaaccgattcc

SEQ ID NO: 21073 - DNA, 375 bp, Sorghum bicolor
  Clone ID: 12691902
gcacgaggcaacattctagacaccactcgaacgatcgccacttcaccaccgccgccgccgaatccatggagtacggcgtcgccgacgactacgggtacgggtacggcgggtacgacgaccagcaggatctgccgtcgtcgtcgtccgtggacggtgacgagtacgcgacggtgctgtcggcgccgccgaagcgccccgcgggtcggaccaagttccgggagacgcgtcacccggtgtaccgcggcgtgcggcggcgcgggcccgcggggcggtgggtgtgcgaggtccgggagcccaacaagaagtcccgcatctggctcggcaccttcgccaccgccgaggccgccgcgcgcgcgcacgacgtcgccgcgctcg

SEQ ID NO: 21074 - DNA, 530 bp, Sorghum bicolor
  Clone ID: 12691908
gtttgattcttatccatcaaaccttgcatctattgcacgattccattcaaaaagggtgctgaaattgaaggaagctgtgctaacaagctaccgcagaaatgagatcaagttcacagaactaactttggatacattcagaatgctacagtgtttggaatgggagcccactgggtcttatcagattgctgctaaagaacttacagaaaatggcactgtaagtgatcagagtggaccctctggtctgatcgatattcagctgtcaacagaaatatctgatggaagtctgccttcaaatcctcaaaaagcaatcatatatcatcctacagccgctcaccttttagcggttctagcaacaatttgcgaagagctctctcaagatagcattttactcatctatatatcagcgtcagggtccactgagcagagttttgctagtcaaaagcttggctctagctcctcatctcgtgggaggcctgccttccccgttgacaagccaaattcacatatcagttctgataatcatctatggc

SEQ ID NO: 21075 - DNA, 237 bp, Sorghum bicolor
  Clone ID: 12691919
gcacgagggacgccgccgcgcgccgactatagagtacaagcagaagcagagtgtgcttgattagttccttgctactagttctgtactactcttctggcttatatatatatatatatatacacatatatatatatatgaatcacggcatccacggtcggaggtatcctttctctgagtcggcaatggagcacgacgtcgcccacagtggtggcggcggcgctgtccccgcaggcgaag

SEQ ID NO: 21076 - DNA, 252 bp, Sorghum bicolor
  Clone ID: 12691920
gcacgaggcttcagcatcagggtgttcgcggcggccgcggtgctcggggtcggggtgctcctgccggtgaacttcctcgatcaccagctgcaggagatcgacttcaccgacctgcccaacaagtccatcgatctattcagcgtctccaacgtccacgacggctccagcaaattgtggctccacttttcacctgtgtatatcataactggaattacatgctacctactgtatcatgagtacaaatatatctgt

SEQ ID NO: 21077 - DNA, 574 bp, Sorghum bicolor
  Clone ID: 12691933
gcacgagggatgatggccctgtgatggcagctgaggcgtgtcaagacgctctcaagcgttcaattgccaaggtgctataccacactggatttgaggagcttcagccctcggccatggatgcctttactggaattgtcgccgattacttccaaaagctggtccgaactttcaacgtatacaacgaatccgaaaagaaatcggtgcccacgaatgtcgaaggaccaagattccagcctagattcactcctgaagaagtcatccttcacactttggacgagaacggtcacgatattagctcactggaactgtacgccaaggatgacattgatcgacttggtagcaagttggacggtctgcatgagaggatgaagctacatctcacagatctgttacgacctgctttatcgcaagacgctggagttgatggggttggagctttcaaggacggcagcgagcagtttgtcagtggtgactttgccgaggaccttggtgaagacttctttggattccgggctttgggtctggataaggagatgggacttgatatgatctcagtacccttgcatctcctaca

SEQ ID NO: 21078 - DNA, 540 bp, Sorghum bicolor
  Clone ID: 12691934
gcacgagggatgtgattccgttctttaggtctctgattgttcctcaacctcatagtatttgaatactactgccaaaagattcatactcaaagaagtccagtgctcaactattttgatcagattacctgtcatctggaatggggcatctcaagtcatgaaatagagtttagcatttcctttcttatgaaattggtttttacgtaagtttttgcatattattatattccatctagatggtgttcatctcagcatgcaaagtagagtttgccatttccagttttatgaaatttgattgcaggtggcctttttactcaaaaatgatttctttagttttgtgcacattgtacatcttgcctctctttgacgttatggaccaaataccacacctttgatttaactgtttaatatatagtgccacaatttcttccatgcaactctttatcatcgcacacttacatagtgacaaactattctgtatttttagctttggccattgcaggcagaagcacatccagggcataatggtattggatttcttct

SEQ ID NO: 21079 - DNA, 369 bp, Sorghum bicolor
  Clone ID: 12691945
gcacgaggtttagttttttttttctcctctccccccgccccccgccccccattcggactccacagcccggtctccatggccaagagaaagcagcagccgccgccgccggctcccacggcgaagaaggggagcaaggttgtgcccccaccgaaggctctgccgctcccagaggaggactccgacctcgacgtctccgacgccgaggagctctctttgtcggacgctgaggctgacgagctctcgggctcggacgcagatgccgacggaggctcgagcagcggcgacgacgtggaggaggaggaggaggatgaggaggaggaaggtgatgaaagcgacgatgaaccccttgcggacgacttcctcgctggt

SEQ ID NO: 21080 - DNA, 448 bp, Sorghum bicolor
  Clone ID: 12691963
gcacgaggggcaattattgttgggaggccattgccgctggtgggcggtggcttccccttccaccccgtattagcagcagctctggtctctggacctcggccggtgaactccaacagagatcgcctcccctctccctcccttccgtccgccatctctgattctttttgcgtgcgcaagttgttaaatcagcacacgacctctctgcttttggagtggaggaggggcatatacgggggttcactggtgcgccggggccgccgctttttctgctggcctctccccggccctcccattggagcgcgcaaagctgggcggcacaccatttaaagaagcaaactgcactccaccaccaccagcaccaaggcgccaccaccaagcacaccggcacgccacacgatccaacgcgcaggcaggcgaggatcagaccggccggagctcaattggcttc

SEQ ID NO: 21081 - DNA, 360 bp, Sorghum bicolor
  Clone ID: 12691966
gtccgatgggatgatgatgtagattttcgtcgaccgaacaggatttctccttgggagattgagctgactagttcagtttcaggatcccatctgtctgcaccaaatgcaaagagactcaaaccatgtcttcccccggactacctagttccaaatggaagtggttgtcctgattttgcggaatctgcccaattccacaaggtcttgcaaggtcaagaattattgggttatagaactcgtgacaatgctgctgttgcaacttctcagccatgtgaagcaaggaacatgcaggacattgatgagcgaagtcgctccaataatgtgagtaacagtatcccacgggttcctagaattggtgtcaga

SEQ ID NO: 21082 - DNA, 560 bp, Sorghum bicolor
  Clone ID: 12691972
gcacgaggcggcagattacatgctgggatcagcagtgcattgctgagtccaatgatacaaattgcaacttgagatttataagttgtgagaatagtggttctgatgattattctgtgtgggcaaaaaatacaagtatatttgccaactgtgatgccactaatcctaataatatatcatttaactacgggatgtttcttagtgcactgggaaaaggcgctgtctcatctccattccttgagaagtacttcttttgtctatggtggggcttgctgcagcttagttcaagcggaaatcctctcataacaagtgcatttatcacagagaacttatttgctatagctattggcgctatcagtctcatactctttgctcagttgattggcaagatgcagacatacctgcagtctatcagtaaaaggcttgaagagtggaggctgaggcaaagggacatggatgagtggatgagacaccatcaactcccatctcatcttcaagaacgtgtccgacggtttgttcaagttaaatggcttgctacaagaggagtggaagaagagtccatc

SEQ ID NO: 21083 - DNA, 509 bp, Sorghum bicolor
  Clone ID: 12691975
gcacgaggtcgtcgtctgtggaccgtgccttcgagccggttgagagagtgatatgtttgagtgttgcgatcgcgagttcgtcttgccatggtcgtaatgctaagcatgtcccttctctcgtgtagtcgttgttctttctgttgctatttgcctgaggactgagccctcgagccggtcggggaagtggtagtgcacttgaccatttcgatcgtgggttcgtcccgccgtgatcgcgatgccgagcgtaactcgtttcccgtgttcagtttgactctgtcgcgctacagtcgttagctttgttcttgtctcgcagacgtggtcatcgtggactcgatgtctttatcgacgcggttcttacccgcacactcaagacctatgtggcctagtctagtgggataagaattaggggacaacctatgtggaacagtcggaagccaactcgttaggtgaggctcatggtcgcgagtcgcctcgccatggccatcgggcttatcccatttttctcgcgt

SEQ ID NO: 21084 - DNA, 460 bp, Sorghum bicolor
  Clone ID: 12691981
gcacgagggcatagcgaaagaaagggaagatagaaaggagccactgggagaaaatgaagctgtgatgggagatgagacgtcactgttctattcagatatcatgcctcttcttgtgaatgaagagccaagtgttggggaagaagcttacgtatggtttggatctgtattccctttggcttgtgacgtggttaatgctcgattcacatatgaagctctcactgctaccacagctaacaggctgcattatcctgcttatgacagattcctgaaagaaatggataagtatgctgcctgttccatgattggaccaaatattcttcatttgtcgacataactgtcaaatgtattaagaattacatactctaatatcttttaggtccttcaagttctttcaagatttgccaactcctaccggaattgaattcgctgaagatgaattcattttgcacatggagggcac

SEQ ID NO: 21085 - DNA, 570 bp, Sorghum bicolor
  Clone ID: 12691982
gcacgaggctgagagagatctttctgtgcagcagaaagaaaatgcagaagccatgttgaatgctaaagaagaactagaagcacagctgtgttcagcaaacaccgaaatggggaaactgcatgacattgtcaaagcactagagaatgaagtaaaaaaggagaaggcactgcgtgaagaattaacagcacagattcagataaaggttgaagcagctgttgatgcagttaaaaaatcattggaggcacagctgtgttcagcaaatactgaagcagggaagcttagagatgttgtgaaagcactcgaggatgaggtagaaaaagagaaggcattgcatgaagagcttgcagcaaacatagaagtgaaaactaaagcagcaagaactgctgaggctgttaaagaatccttggaggcacagctgtcttcagcaaatgctgaaatacagaaactggaagagatcacaaaacaactacagagtgagttagaaaaggagaaggcacttcatgaggaattctcagcacagttagagatgaaaattgaagcagagagagctcgttctatggagtctgctaa

SEQ ID NO: 21086 - DNA, 443 bp, Sorghum bicolor
  Clone ID: 12691991
gcacgaggcagtaaagcaacctacccttctttctaccgctaccccgccgcggccacgaggaggaaggcgacgacgcctcttcccggcctgcctgtgcgcgctgttcaggagccgagggacgctgcggcgtgcgcgcgcgctggtcgttctggtcgtcgtccgtccgcctgttcccgtccgtcccacgccgccatgacggtggtggatgccgagtcgcggttccatgtcctcgcggtggacgacagcatcgtcgacaggaagctcatcgagatgctcctcaagaactcgtcctaccaagtgaccacggtggattccgggagcaaggcgctggagctgctggggctgagggacaacggggcggaggacgcgtcgtcgccgtcttcctcctcccctgaccaccaggagatcgacgtgaatctcatcatcactgactactgcatgcc

SEQ ID NO: 21087 - DNA, 509 bp, Sorghum bicolor
  Clone ID: 12692896
gtagctagtgccactcctctccatggatcggatgctgtgctgaaagcccacaatatggctgaggatgtaaggatccaatacaacgatcaggaagattttgagcggttagctcgtcaatttggaatattcgaagaatggaaggatggcatcccaagaacagctttcaaaggagtagtggtcttccggtacaacagtagtcaaaggcgaatatttcttgtcagcccagattctcttagtcagctgggagtgtagtgtattgagaaggtaaatttcactatggagttgaggtgaacccttgttttagcaacggtggaaaggcaggcgaatatcagggaacgcttaattgattcctgtgagcatggagcaatcgggatgcatggtgaagaaaattttgagaagtgattgtgttgacccaaggtactgagtagtagaagcatgggcttggtttattggacatttgcaagatataatacagtgtttagtcagcaagggactttttagcctgtagt

SEQ ID NO: 21088 - DNA, 631 bp, Sorghum bicolor
  Clone ID: 12692976
tgacggcaagataagcacttcttacaggggacaaactaaatggttggatcaatcactagcgctcactgacagcaactggaaaatagttgctggatataatccattacttgtttgcaatggggaagaaacaccagaaacaacaaagttctatgtgccatttcaacacatttttgcaaaatatgaagtgaatgcatacataagcatgggtgggttttgcggttatttccaccaagacaattcaatattatacataggacatcccagccttggcgatgaccaaacaagtgtagatggttttttcttgcacagagttagacccctcgagatggagtcaatgttgatcaatgtagaaggcaagttggttcagagatctgttgttcagcagcatggaaggggagccatgtgaacctcatgactcagtttctgttccattatgtcatagcgccgaacaaaggcacataacattgtattggattcattcagttcaaaaaaaaaaactgaattaggtttttgtcactttgcctgtttcaacatgtctaagttcgtaaggaactttaggtagcatttaccatttttacaaacaaacaagagttcactatcaaatgcagagtgctgcccaagcagcgcagaa

SEQ ID NO: 21089 - DNA, 468 bp, Sorghum bicolor
  Clone ID: 12692992
ggagatctcaaagcagcacagagggtttttaatcgaacagagtccaagggatccatgacctgcactgcgataatagaagcttatgcagtgaaccaacgccataaggaggcgctgcaactctttacttggatgctgtcaaacaaatttgttcctaccaaggccacattcaatgtggttctgaaaatctgcgatgccgcagggttgcacgatgaagcccttggaatttttaactccatggtgcaagaatacaacctagaaacatcccaagagaattttgactgcatcatccgcctccttgctggtgctggcaggaattctgaagcacagcgctttgctgacctgaaatctactctgtttaatttaccaactccagttttgaactctgaacaggattgattttgtacagattcttttctttctacattgtactgatatatgctgtatatttttcaaatagatactgatagt

SEQ ID NO: 21090 - DNA, 556 bp, Sorghum bicolor
  Clone ID: 12692997
acggcagcaacgccaccggcctgctgcgggtgcgcggcaactgggcgtgcccgctggcgctgcacaacctgccgcccgaggtgtacgagacggagtgggacatgttcatgatcgacgcgcccaagggctatttcgcggcggcgcccgggaggatggccgcgatatggaccgcggcggccatggcgcgcgcgcgccgcggcgagggggacaccgacgtcttcctgcacgacgtcgaccggagggtggagaggatgttcgccgaggagttcctctgcgaaaagtttcgggtcggcggcaccggccggctctggcatttcagcatcccgccggtttcacggcgcgggaatgccacggcgaccgccggtgaccggagaccgttctgttaaaccggatttatatcgtcggccctgcagttggagtggagtttttgttcaaaaagcagatgtaaatttttgtttcaaattggaagcagagtgctagcaggccaggtagtaccaaacacatgtactttgtattactctgtacctcctttctttcggaggtaaagtaaagcagc

SEQ ID NO: 21091 - DNA, 648 bp, Sorghum bicolor
  Clone ID: 12693003
tctactccctgctcgtcagggactacttcatcggggtccccaacgccgtcggcttcgtcctgggcacggcgcagctggtgctgtacctggcgttccggaataaggcggcggagcgcaaggacgacgacgacgagaaggaggctgcggcggcggcgccatcatccggggacgaggaggaagggctggcgcacctgatggggccgccgcaggtggagatggagatgacggcgcagcagcgcggccggctgcggctgcacaaggggcagagcctgcccaagccgccgacgggcgggccgctgtcgtcgtcgtcgtcgtcgtcgccgcaccacgggtttgggagcatcatcaagtccctgtccgccacccccgtcgagctgcactccgtcctgtaccagcacggcctcgggcgcggccggttcgagcccgtcaagaaggacgacgtggacgccaccaaccactgactgactgactgatgtccgatcgatcgacgtttgtaccggtacagagtcgtcggcctttgacgcgtgtactgtagtatttatcattacgtgctcgtggagagattcagggtagcgttcgaaacttcgaatggacaggatttgagtggttcttcacaggtttgcagggttcgaaacccagagaattaat

SEQ ID NO: 21092 - DNA, 465 bp, Sorghum bicolor
  Clone ID: 12693011
cgccgtcgtcgtcgtcgtacgccgtggactgcaccggcgcgaccctcgacctcaactacccgtcgttcatagcgttcttcgaccccaacggcggcgccgtcgtcgagcggacgttcactaggaccgtgaccaacgtcggcggcgggcctgcgagctacaccgccaaagttacgggcttgagcggcttgacggtgatcgtgagtccggagaagctggctttcggcggcaagaacgagaagcagaagtacacgcttgtgatccgggggaagatgacgagcaagagcggaaatgtgttgcatggtgcgttgacgtgggtggacgacgcgggcaagtacaccgtcagaagtcccattgtcgcaaccaccgtgagctcagatcagttttagaatccggacgtacttatatcatatagcatatttgcatatatatttgttcaagtcgatataagcttgaggcaagtaaaag

SEQ ID NO: 21093 - DNA, 655 bp, Sorghum bicolor
  Clone ID: 12693015
ttgaagtcaacaaaactgagttcatgactccctcagcattcatctttctctacgaaaacaatctattcctgacattctgcaataggacagttgcagcctggaattttcgtggagagctagttacatcgtttgaggaccatgagttgtggcatcctaactgcaatacaaataacatatacatcactgctgaccaggacttgattatctcatattgcaaaatttcaaagcagagcacagattgtgctgacagtgaagctggagaagtttcatccatgggatcaattaacatgagcaacatctttactggaaagtgcgtagccaagatctcccccagtgaccctactctcacaattgctcctcgaaagagaggcggcaacagcagatctaccatccacagcactgtcccggaagctcttgaggacatcactgctctcttctacgatgaggaccgcaatgaaatctacactggaaacagcaaaggcttggtgcatgtctggtcaaactaaccttgacatccaccccctaccttgtacataccccttgcacctgtactcgtttttccttatagaacaaagatgaaattcctgtctgattatagcgggagtgtaacttcccagacatatatcattggtagaagaatctgatgtagaatatg

SEQ ID NO: 21094 - DNA, 447 bp, Sorghum bicolor
  Clone ID: 12693017
caacagttcctcctcctcctcccatcatcatgccatccagatccagggcagcactggtaatacgtcggtcaccaaggacgccggcgccgccatcgccaccgcggctgccgaccccatcacgcggtggccgctattcgcgtacctgggcggcgcgatggtgtgcctgctgacgagcagcgcgtgccacctgatcctgtgccatgcgcgagggcgcggtgtacacgctgaatcatgtcagcaagcacgtaagcaaataagcaatgctgctgtactgtacacatgctgcggccttgagaagagattggtgaaactgtgacagagtgacaggtgggcccggccgatatatgcatggttggtcgcagaagttcatcaagaggtttggctagagaaagattatgccgtgtacctaattagtagagtagacgattttaaaagaaggatgtgaga

SEQ ID NO: 21095 - DNA, 593 bp, Sorghum bicolor
  unsure (1)..(593): unsure at all n locations
  Clone ID: 12693023
tttccggaaaaagtatatganaatgaagaaactatgcgactgtgtgctgaggctgcattaaaatctgttcttgggggacttgaccatacatactttgttggcaatgctccaatggctcatatggcggttgaacaaacggattcaagtgtttcaccattcaagcgtttcttcttcaagtcacaagtggttggcacaacgaaataccatattggaaaatgcaaggatttcgcgtgggtgaccaaagatgagctgctggagtattttcctgagaacaaggatttcttcaacaagatgatcatccacattagatagctctgtaatcaggccatgagctatctgaacaattaccattttgtttcttgactggtgtacaagtttagcgcccctattttatcgtcacgactcacgagcagcattgcttggcaagaaaccaccagtgcgggcagttgacacatggccattttgcctctctttccttgggctgatcatgtatcaatgtttggcgctatgacattgctgtagcatgtagtcctctcctagctgctgtatgttcacatgacttatgtcagttgcaggaaaaaaaatattagcag

SEQ ID NO: 21096 - DNA, 657 bp, Sorghum bicolor
  Clone ID: 12693029
agtgtcattgtttcagagtgtggttttgatgttgttcaatgatgcacaaaagttaagtttctttgacatcaaagattccactggtatcgaggataaagaattgagacggacactgcaatcacttgcatgtggtaaagttcgggttctccaaaagataccaaaagggagagatgtagaagataaggatgaatttgtattcaatgaagattttagtgctcccctctatcgcataaaggtaaatgcaattcaaatgaaggagacggtagaagaaaacacgagcaccactgagagagtgttccaggatcggcagtatcaggttgatgcagccatagttcgaataatgaagacgcggaaggtcctcagccacacccttctaataacggagctttaccagcagctcaagttccctgttaagccagctgatatcaagaaaagaatagagagcttgatcgaccgggagtacctggaacgggacaggagtaacccccagatctacaactatctggcttgacagcgctttggcggaccattaaagacactatgctcactttattatgggaaaagacattgtaaattaatttattttccagttccttggtcttgtttttgttttctgggagggagttgtagctgttgcaacgtgtctgtatacgagaa

SEQ ID NO: 21097 - DNA, 176 bp, Sorghum bicolor
  Clone ID: 12693052
aaagagagtgtgagtgtgtatctaaccatggtttgcaggttgtattatttgtcattgtaattttagttgttgggtcatagtttttttattttttttatatttttagttaacggagcaggatgctcatcctttgtttatttttggctcggtgtgtcttttttttattttatttttat

SEQ ID NO: 21098 - DNA, 489 bp, Sorghum bicolor
  Clone ID: 12693062
cctctgacaacgctctcatcgaggacccacagacaaagccgatggttgaggccttcgcccggaacgaagcactgtggcagcagaagttcgcccaggcgatgcagaaggtcggaatgcttgacgtgctcatcggcgagggcaagggccaggtaaggaagcagtgccgcctggtgaacgagcaggagaaggctatcgagcagcagcagccacaacaggaggagcagcagcccccacaggaggaggaggagcagcagcagcagcagccacagccacaccttccgtggttcctgcagaggcgccggccccggccgcagcatcggccacgtgtaccgtttcgccgtcatcctgtggccgacctggtcaacggatttttccgtggttttcactgaggccagcactagtacatttgttccaggtctgttccttcgctagatgctcagggacgtagacctccaaaatatacaatgatctataccgtgtatgcatcac

SEQ ID NO: 21099 - DNA, 239 bp, Sorghum bicolor
  Clone ID: 12693063
ctgatgccgatctacgccgagacggccggccggccggctccctgttccgatcctcgacgccggcgcggccccctggtgaatgaaccgtagcgtcccacgtcgtcgcccgtgcccgtgctgtctcgaagagtttgcttccgtggtttggtcttggccctgcgtacttttccgcgtgatatgatggatggagcgcgcctacatgcatgtagcaagggaaaaaaaaaaagagtatgcctgca

SEQ ID NO: 21100 - DNA, 530 bp, Sorghum bicolor
  Clone ID: 12693065
ccgtgtttcccgtggctattcactattcagcagtctccggtggctcggtgacgttttgcttgtgaggtcactccggcccggccatccatgttgcagctccggttgctgctggtaaccatggttacttttacttgcagttgctgccacccatgtctgagtttatccatccacagttcaaggggcattccgattttggcgcttgctgaaatgataggagagggatggcaccataccacttgcacagcttgatgttagagaattagaaaaacttgttgccaatcattggtgtgcatgggctctgtagatacggcggcggcggcgctctgggccgcccaatccggggcgccggagattggagattggaatggtgcagccctgtcattggcacgaaagctatctgctgccctccatgccagggcacactgacgcttccaggatctacacaaaggtagaggtgtaccatcaggccttcagtcttgcaaaagtagacaagtagtcaagccattttcttaggagtcaggacaggcgct

SEQ ID NO: 21101 - DNA, 544 bp, Sorghum bicolor
  Clone ID: 12693103
gtggaagacagcaacacagatgacagcactgactctgcttctcgccagcagagacccaagtctgcctgcgcaaggtgctctagctgcccctggtgttgctctactttacgtttccgctggactcgccatatggtccctagtggtgtacatgagaaagatatggcggatacttctaaaatagtattagcatatatatagtgtaatagaagaaacagaagcaaggcgaggttccattcatgatcgtacaacttttggaaggctgtttagttgatttggtagcctgtgccaaagctggttgtgatcctcattcctcagtaacttgtgcgtcatctatttttggtggatttgccgccaaatttgctgaagctgccaggatcctattagattcttagaaacaagatatgatgtgaccctgcgtgcgtaatcggattttagtctgcaagtccaatgcagaagattgtaaccttatacgaacacaaaacccggaggtttgtgcgtgtggagttccattgtaatctacacataatatcatatgccaggagca

SEQ ID NO: 21102 - DNA, 461 bp, Sorghum bicolor
  Clone ID: 12693105
actctctaatgtgtgctggctgctatcaacccatccttgtgtttagctgcaaactgaagctacatttatgttagtttccttggaatagaatgggtgatgaagagggaaccttgtacaatccaaaagctgcagcaaatattgtaacaatttagacatctattataggtcattgtatattttctgcgcatttgtagtggcgtcatcatgttctttatcattccaaacaggaagtatatactcaggatgctatggagctacatggtccagaatttgatgcgatgaatgcctccattgacaaagttagtgtgtacagggctgggtatgcccaacaaatgtatcctgtactaaccattcaaattcttgtatcgacatgctaccttgtgaagagctatagcctatctatgttggcttattgacaagtgccttgtgtaacgtgtgtttaagtcaaactattatatagc

SEQ ID NO: 21103 - DNA, 533 bp, Sorghum bicolor
  Clone ID: 12693113
ccaacaactcctggagccagaacagatcatctccatctatcctgggtcagccaagcggtgatgctaacaagtctagcacttggggtgctcccagtggagcagctggtggcggaggttcttggggaaagagcaacgaggataactggaacccatctggaggatctgccaaagagaagccttcatggggcggtgggtcaggagctcctcccaagaaagaggacggtggtgccgaggggagcgggagccaaggaggtggcactggcagtacctgggataaagcggcagatggtggcactggcagtacctgggataaagcggcagatggtgcatggaacggcaacaagggtactgatactggcagtggtggatggtaaagctttcgcgaaaatcaacttgcgccttattggcgctgacatgtaaataatgtgcccgtgctgtgtgaacatgtgttggtgcgtgtctagttcgaatcagttattttggccgtgcgaactcaagagcatggcttgtaaccagttaaatgttaccaagtg

SEQ ID NO: 21104 - DNA, 515 bp, Sorghum bicolor
  Clone ID: 12693116
ctccgactccgctccgtcctgtgagtgtcgcccccaatccaccgactgccggcctattgaaccaaccattcttgattggttcttgaatgcgcttgcgtcccaggtgtctgtgcccggagccgtatccggaggcgaacctggagttcctccgtgcccacgggatcaagctcttccagtttggaatcgacggctccaaggagccgtttgtgaacataccagaagatagaatccgcgaagctctaaaagttattctagacgcaagtaaccatccggttcttattcactgcaagcgaggaaagcatcgaactggctgtgtggttggatgctttaggaaattgcagcgctggtgtctaacttcaatatttgacgaataccagcgttttgctgctgccaagacaagagtttctgatctccgattcatggagctatttgatgtatctagcataaagcatttgccagcatcgtacccatgctaggaagcaagcctcagctgatgtccgtgctccgagaactga

SEQ ID NO: 21105 - DNA, 484 bp, Sorghum bicolor
  Clone ID: 12693129
cccttcctgtgataaactcggcatcaaacatcgccatagttgccaccggagaagacagggcaaacgctgtctctttttccatttctgactgtcaagaaggcccagatgctaaaacaataccggctggaatggttcaaccaactgatgggaagttggtatggtttctggacgaggccgctgcttcatctcttgaagctgcaaatggtgcttacgagcatcaagggtactgagacaactgcaactgttgcaaccgcagcggagttagacatcctttttgctgtgaatgaagagttgttcatgtagttgacagatttggacgggagaatttctgtaccttgagacatgcagactgggtgctacctttgcgagccctactctctctgatttcttcagagtcgaaaatttccatatcttttgcagttggatgtggccaagagtgaagtaatttgtgttttaaatgtcgagacctcatatcagagtaaat

SEQ ID NO: 21106 - DNA, 323 bp, Sorghum bicolor
  Clone ID: 12693141
gtggctgcgcgcgcagatggggctcgtcagccaggagccggcgctgttcgcgacgtcgatccgggagaacatcctgttcgggaaggaggacgccacggaggaggaggtcgtcgcgccggcgaaggcggccaacgcccacaacttcatctcccagctgccgcagggctacgacacgcaggcaagctacctatttaccacaccacttttgcaactggcgtatgcatgcaattgtattgttttttttttggacgagaaatgcatgcagttgttttgttcgctacgcttttcattacccttggaagtcactgtcaagttttccatcc

SEQ ID NO: 21107 - DNA, 585 bp, Sorghum bicolor
  Clone ID: 12693143
tctactgaaatccgtggatgaagttgaggatgatcggattaaacaggctttgatttctcactcggaacaggcaatcctttgcaaaagcctggccacgttgcgttctgatcttccttcttatatggttcctttcaagacagccgaccttgcatataagaagccacaggatgatggagtcaaattcataaaactcttacgagcattggaagcatatgcagaaggctcctcagcagacccaatcatcagaagagcaacctatctttggaacaaactaaaatgatgatgacgctgatgctttcagcattgactaaaaaggaattttagcaaggctaagagtttggattcaaagcctggtgacgtagtggtcaatactgatgccattgacttctgtggattcggcagtcagccatacccaaattgcaaaatcaaattgttgctgccataggtgtgcagaaatgcataaatcgaaggtgccgctgcttaggcaaagaagctgtgtgtttatatcacgcaacttagttctgtagataaaaaatgcacaacattgttccgccttttttgagaaagctcgcggaatccatctat

SEQ ID NO: 21108 - DNA, 278 bp, Sorghum bicolor
  Clone ID: 12693155
tgcgagatcgcgcgcggcgccgccgcgccgtccgtcgcgccggcctggggcagggagatgttcatggcgcgcaacccgcctcgcccggcctacccgcacgtcgagtaccgcgagcccgcgggcggcgttggcgtcgaccggatactgaccactcccgccgctgacatggttcgggtgcccttcttcttcggggcacgggagatcgctgggctgcgccagcgggcgccgcccgggatgcgctgctcccgggtcgagctcgtcgccgcgtgcatctggcg

SEQ ID NO: 21109 - DNA, 417 bp, Sorghum bicolor
  Clone ID: 12693164
gcacgaggggtcgctctacgacgacctgtacctggacgcggcatacgactgctcgtccgagccgcagatcccgcctgcctctgcggaacccgccgccccgcccccgtcgtccgtggcggcgatccgcgacgtggacggagcaaccaccaccacaaatgctgctgcctcatgcggcggcgtcgcccgtcgcggcgtggtggccgggagccgacggcatccgcggcggtggctgggcaccgtgggcgcgcacctggcgtcggggtcctggacgctgagccgcgagcaggggaacaagctcctggccagccgcttccgcggcgaccggctctacctctgcgactggccggggtgcgtgcacgcagaggagcggcgcaagtacatggtcttccgcggcgtgttccacaacttcgcccgctc

SEQ ID NO: 21110 - DNA, 549 bp, Sorghum bicolor
  Clone ID: 12693199
gcacgaggtggtactgtgatcattatgtgtcgtgatgaaattcctgaagaaagcgatttgaaaaatctgatcgttggaaaaccaacccgcttggaatctcaatttcgattaacatacactatgatactacatcttctgcgtgtggaggaactgaaggtcgaggacatgctcaagagaagttttgctgaattccatgctcaaaagaatttgcctgagaaggaaaagctacttctgcaaatgctccgtcaacctacaaggacaatagagtgcataaaaggagagccttctattgaggaatactatgaggtggctctagaagctgagaaacatagggaatctataacacaagcaattatgcagctgcctaattctcaacagtttcttacgcctgggagattggtggttgttaaatctgattgtgatgatgatcacttgcttggtgttatactgaaaaatccatcaccaatgctaaagaaatatgttgttctggtattgaccggtgattgcagttcatctgtactagcccctgagttcaataaaaatgaaaag

SEQ ID NO: 21111 - DNA, 370 bp, Sorghum bicolor
  Clone ID: 12693208
gcacgaggaaacctttcagtggaatgctcaagctcaagaatcctttgataatctgaaggttgccatgactaccactcctgtcctgagtttacccaattttcaactaccatttcaggtggaaacagatgcatgtgctgatggtattggtgttgtgctcatgcagtcaggccaaccaattgcatatctcagtaaaggtctgggggagaaacacaaaaacatgttcatctatgaaaaagaattcttggctttgattttggcagtggagaaatggaggccctaccttcagagacaagagttccagatcctgactgatcacaagtctctttcctacctcaatgagcaaaacctgcatagtgacatgcaaaagaag

SEQ ID NO: 21112 - DNA, 343 bp, Sorghum bicolor
  Clone ID: 12693214
gcggtttagctagggatgccaatgccatgtgcgcacgattgtctttggaaaggagttatatgcgacaccgtggtacaacaccctacgtgcgacaccttgtgattgtttgacgcgtgtatccatgcccaacaagtaaggcaaccgccgaatggagcgagtcgcacagtgcgtgattcctgcaaagccaaacgaccgaatggagcaagtagtacacgtgtcatgggatcacagggtgtcagtgtgtcgcacactgagtgcttgtgacggtgtcgcataaaaaaaattcatggccgtttggtaatcagcacctttggtaatcagcgacacaaggatacttaatacc

SEQ ID NO: 21113 - DNA, 462 bp, Sorghum bicolor
  Clone ID: 12693227
gcacgagggcttctccaaccagaacttcatcgcctcgccctccaacagcgacgacaaggtgctcatcctcatgaacacgcagaacgtcaccgcgccgttcaaggtgttcgacgccgccgtcgccgtgctcctcaacgccaccgccgcctacgcggccgccaattcgtccaagaggttcggcaccggggtggagcggttccagaccttcgacagcaagaacccgaccatttacggtctggcgcagtgcacgccggacatgtcgccggccgactgccggaggtgcctctcgggtattattcagatggcccccaagtatttcaacggcaagccgggtggcaggattcttggtctgcggtgcaattacaggtatgagcagtactcgttcttcacaagcaccccgctgcttcagctgccggagcctaccgtgggggcgccggcgcccgcgcccgcggtggtgaacgg

SEQ ID NO: 21114 - DNA, 420 bp, Sorghum bicolor
  Clone ID: 12693233
gcacgaggcccagctctgctctgctcccgtcacagcagtacagccacatcccagaggcggcgagtcctgtccggtggccagcggcgggaaggccatgggcggggctacctccccttcgccatggaggcgtcactgcgccctccacttcctcctcctcttgttctggggtacttccgaggcaaatgaagaacatgccgtgttacctccaagagggtggaactcgtatgattctttttcatggactgtagacgaaaatgcatacctgcaaaatgcacagatcatggcagagaagttactcccacatggatatcagtatgcagttattgatttcctctggtaccggaaatatgttgaaggtgcatacacagattcatatgggtttgacaacattgatgaatggggtcgaccttttccggacct

SEQ ID NO: 21115 - DNA, 500 bp, Sorghum bicolor
  Clone ID: 12693234
gtgtttgtctcctctcctcagtcgatccactacgcgaacgcgacgcagcttgcagctgacagcaccagagacagagaaggttgacgggcatggaagaagcggcagaccgcgggcgcccgccgtggcgctgcacggtggccgtgcaggccgcgctctgcctcgcgctctacgcggccttcagcctcggcgagccgcagctcatcccgcgaggcggggtgaacgcactcgggcggggcgcgcgcggcggcggcggcggcgacgtcgccttcctcagcgtcgctggcggcgcgcggggacccatcgagcaggccaggctcctgaggcagatggagaccatagcaaaggtttatgaagtcaagttcgtgctggatgttgctcaactgggagaggatgatccactctggcaaaatggttccatgtacttccaagctctgaacatcccctggtactccactaagtcatcacatggggcggcagtcggcaactttttgaagaaagtg

SEQ ID NO: 21116 - DNA, 299 bp, Sorghum bicolor
  Clone ID: 12693237
gcacgaggggaagctggttatatggagaaagttgacgagctttgccagcgatactctcttgaaagttatgttgactctttggtcccggagaaggttttctgtgtatctgattacttggatctgaagaaattggatgtggaagaaattgtctgggttgatgagatcaatgggctgcttagtgcaacaagtaatattgaagcttgtaaaattattggcatggattgcgagtggagacctaatttcgagaaaaatactaaacctagtaaggtaagtgacaccttgctttgtactggtatatg

SEQ ID NO: 21117 - DNA, 257 bp, Sorghum bicolor
  Clone ID: 12693244
gcacgagggcagtccgcacctgcacgcctgcacgagtccaccaggcccccgagctgcccaccgacgggatctctacccccgcccgccatccccttctctctgcccctcccgagttcgatctttcgcggaattggcggaggggccggatatgtcctcgtcggttggggtcggcagcgcgggtggcggaggaacggacatcgccaccctgctggagaaggccaatgagctggaccacctgaacaaggaccaggacgaca

SEQ ID NO: 21118 - DNA, 322 bp, Sorghum bicolor
  Clone ID: 12693246
gcacgaggctccctcctggaccacctctcccaccgtggcgtcccggccaccgcctccgccttcgccgcgctcctctcggcgtgccgctcccttccgcatgcgcgccagatccacgcgcacctccgcgtccatggcctggacaccaacgagttcctcctcgccaggctcgtcgagctctacctagcgctcggcgccactgacgacgcgcgcggggtgctcgacgggatgcagcagcacgcggcgggggcgagcgcgactgcctactcgtggaacgcgctccttcacgggcacgtccgccggggacgcggcgaggcggcgggcc

SEQ ID NO: 21119 - DNA, 452 bp, Sorghum bicolor
  Clone ID: 12693251
gcacgaggcatcacagcacgcacgtacggacggacgggcactgcacgcgggcgtcgcgtcgcggtccgccggacacgatccccggcaaggcaataatgagggcgccccccggccgacgcggcctggtcgccgccggcgcctgcgcgctgctgctggcggcgttcctcctcctcggcagcctgctggtgacgacgccgctggcgccgtacctgctgccgccgctggcgctgtcgctgccgtgcctgcccaaggtcaccgcgccgtcggggtccgggtacggcgcggcgcccggcgtcgcggagctggcggaggccgccgtgacgtacgccacctcggagaccgtgccgcagcagtcgcccgaggagatctcgctgtcgctggccgtgctccggcgacgcgcgccgctgcggctgctggtgttcggcctgggccacgactccaggctgtggcac

SEQ ID NO: 21120 - DNA, 474 bp, Sorghum bicolor
  Clone ID: 12693255
gcacgaggctccatcctcgtcttcgcgtcgccgatcgcgacgttccggcggatcgtgaggaacaagagcacgggggacttcacgtggctgccgtacgtgaccaccctgctcagcaccagcctctggaccttctacggcctcctcaagcccaagggtctcctcgtcgtcaccgtcaacggcgccggcgccgcgctcgaggccgtctacgtcacgctctacctcgtctacgcgcccagggagaccaaggcgaagatgggcaagctggtgctggccgtgaacgtcgggttcctcgccgtggtcgtcgcggtggcgctgctggcgctgcacggcggcgcccggctcgacgccgtggggctgctgtgcgccgcgatcacgatagggatgtacgcggcaccgctgggctcaatgcggacggtggtgaagacccggagcgtggagtacatgcccttctccctctccttcttcctcttcctc

SEQ ID NO: 21121 - DNA, 530 bp, Sorghum bicolor
  Clone ID: 12693258
gcacgagggttctacaagtgggcaattccttgagaactctggacttgacaaataacaagctaggtaatcagaatttattcgtacctgtttgttacattcagctttcaatggacatatcacaagcacaaaaggaattttgtgttttactaatcttcaatgtcagtgtttgtttttctttcatttgttggtactttctcctcttttatgaaacagataaagattattcttagcacctcgcatgggcatagtttctgaatatgaatccaaataacctcacctactataaactgcatgtgctcattttttgatatatttttaaaatttattatgcttcctatgagcagtgttaattgtttctattttatgttgcagttgagattccccaggaaattggcagacttgtgaatatgcaaaggcttgtaagagtttccattattagaagtcatcatatttattatctgattagaaatgcatactgaaagaatggttcttccttctaatgtttccctgtcttctgcattatggttgtt

SEQ ID NO: 21122 - DNA, 502 bp, Sorghum bicolor
  Clone ID: 12693263
gcacgaggcagcccggtcgcgctggcggccaccacgctcgtcttcctcgacgcgtgcgacaacctcacgttgctgtccaagaaccgcgacaaggtcatcctctgcgacgccaccgcctccctgggcgacgccgtctcggcattggaagtggcccaggtgcacgcgggcatgttcctgtccaatgactcgatcagggtgctgtatgagtcgttctcgttcccgggcgtcatcctgagcccggaagacgggcccctgctgctccagtacatacggagcagccgcacgcccaaggcggcgatcaagttcgaggtgaccatcctggggacgaagccggcgccgatggtggcggcgtacacgtcgcgcggcccgtcggggagctgcccgacggtcctcaagccggacctgatggcgccgggctcgctgatactggcgtcgtgggcggagaacatcagcgtagcctccgtcggatcaacgcagctgtacagcaagttcaacatcatct

SEQ ID NO: 21123 - DNA, 572 bp, Sorghum bicolor
  Clone ID: 12693267
gcacgaggcccgcccgctcgcggccaccggctcccacctcgcccggcctgcgagagccagggcgaggccatggaacaccaccacaagcccggcctgcgcgtgcgcctccgcatcaccgccgcgcggcgccgcgcgtggctctccgccggtctgcgctccacctgccgcaagccgccgcgccgcgacccctcggactccgtccacaaggtcgcgcgccgcgagatcggcggcggccaccgacgcccgccgcggcccgcggcgccctcctcctccgcattctcgtgccccgagaaattccgcaacttccagctccaggaagaatacgacacctacgatgacgaggtccattttcttgtccagttgccatttttgtggaccagaacaaaaattattgaaattgttgcagcaaaggatgttatatttgcacttgcacaatcaggtctatgcgctgcatttaatcgaacaacaaacaaacgcatatgctacttgaatataagtcctgatgaagttattaggagcttgttttacaacaagaacaacgagtcacttatcaccgtttcagtttatgaatc

SEQ ID NO: 21124 - DNA, 263 bp, Sorghum bicolor
  Clone ID: 12693268
ccaggcccgagctggggaattccgatcccaacaggccccaccaaggcctcgcgccgatcccaaggactcgtgcctcccgtcctccgatgccgcaactcatcccatccggcttctgaagccgcgggctccgacgtcaattccggtggcgggcggcatggattccgccgccaacagcgtcggcgagtctgtgggcgagtctccggcgccagcgccggcgccggagccggagacaccggcggccgaaccggtcaccaagggccgcg

SEQ ID NO: 21125 - DNA, 202 bp, Sorghum bicolor
  Clone ID: 12693270
gcacgaggtaaccaccattggcaggcaccagcatagctagcttgcttctaatgcatggttccttgtcttgaccagcttcacaacacaaccacattgttgtggtcttatgcaagaaaggccactgccagggccactgctgcaccagccaaggctagctacaacaccaaaaggtgctggaattatacatctccaaggtccaagc

SEQ ID NO: 21126 - DNA, 484 bp, Sorghum bicolor
  Clone ID: 12693275
gcacgaggggccatagtgagcaggttgctgcatcaactaataaagaagttgatgctcagatcccaaactacccaaacctacctccacaattaatctgccagcttcataatgtcacaatgcatgctgatgcggagactgaagaggtgtatgcccaaatgacactgcaaccattgagcccggaagaacaaaaggaaccttttcttccaatcgaattgggtgctggtagcaagcagccaactaattacttctgcaagacgttgactgcaagtgatacgagtacccatggtggattctctgttccgcgccgagcagctgagaaagtcttccccccattggatttttcacaacagcctccagttcaagagctggttgcaagagatctgcatgataatgagtggaaatttcggcacatttttcgtggtcagccaaaaaggcatctactgacgactggttggagtgtttttgtaagcgcaaaaagactagt

SEQ ID NO: 21127 - DNA, 415 bp, Sorghum bicolor
  Clone ID: 12693276
gcacgagggtttacgttaagtgacagccggcgagctcgagctcgaggcgttgaggtgacgatcgaagaggaagagagcatggaggtccagcaccagcaccagcagcagcagggagagggaggagcccctgccccagcggcggagctcgaagtctccctccgcgagttcacgctgtccgacgcggacgcggaggcgttcatgtcgtgggcgtcggaccctcgcgtggtcctcttccagcgccgcgacgcctacgaccacatcgaccaggcccgccgctacatcgccgaccacgtcctgccgcacccgtggtaccgcgccatctgcgccggtaccagcgccggcgccggcgcgcccctccccgtggtcgggtccatctccgtgaagcctgctgcccccgccgaagccgacgacgacg

SEQ ID NO: 21128 - DNA, 316 bp, Sorghum bicolor
  Clone ID: 12693281
gcacgagggttcacggcgctaacaggcttggtgcaaattcacttcttgatatagttgtatttggcagggcttgtgcaaacagggttgctgagatatccaaaccaggagagaagcagaagcctcttggaaaaggtgttggagaaaatactattgcttggttggataagttgaggaatgcaaatggatctttacctacttcaaagattcgtctcaacatgcaacgggttatgcaaaacaatgctgcagttttccgcacacaagaaactcttgaggaaggctgtgaactgattagcaaagcatgggagagtttccatga

SEQ ID NO: 21129 - DNA, 226 bp, Sorghum bicolor
  Clone ID: 12693297
gcacgaggcgcgccgccaacgaatccctgcgtcgcggcggcggcgtccgcgggcccccaccggcctacaggcaggagcctcaccctcaccaaccgcagtacggctacggctatggctacggatacggccagacgcagcagccgagcccgccttatgggttagtgccgtacaactactgccacccgcagccgctgccgccggggcctcagtacggctacggggctac

SEQ ID NO: 21130 - DNA, 271 bp, Sorghum bicolor
  Clone ID: 12693314
agcacgaggcaacggcctgcgggtggggttctatggcaagacgtgcccggtggccgagagcgtcatcagcgatatcgtcaacaacgaaatcgctatggaccgcggcatctccccaggcctcattcgcctcttcttccacgactgtttcatcacgggttgcgacgcttctattctcctggacgtgtcgcccgctggcgatgtcccagagaaggagtcgtctgccaacggcttcaccctcgtcagccttagaaccatcgacctcgccaagtcc

SEQ ID NO: 21131 - DNA, 480 bp, Sorghum bicolor
  Clone ID: 12693319
gcacgagggttagagctgatcaaggattacgacctggaagtgcattatcaccctgggaaagcaaatgtagttgcggatgcacttagtaggaaaagctatgtcaacagacttcagctgacatttattccagctgagttgcgagccgaaatagaacacctcaacataggctttgtgaatcataccatgggtctagaggtagagccaacattggaacaagagatacgtaagagtcagttggaggatgagaaattaaaagagatagcagataatgtagtgcttggaaaggcaccaggcttcaggatagatgagaatggtaccctatggtttgggaaaaggatatgtgtgcctgaagtgaaggctatccgagacacaattctgcgtgaggcgcatgactctgcttattcaatacaccctgggagtaccaagatgtatttggatctaaaggagagatattggtggtatggattgaaaagagatgta

SEQ ID NO: 21132 - DNA, 389 bp, Sorghum bicolor
  Clone ID: 12693325
gcacgagggccaacaccaacgccgccgtctacccgtgcccggagtacgcggaggtcgaccccaccggccggtacggacggttcagcgacgttcttggcaagggcgcgtccaagattgtgtacagggcgttcgacgagtaccaggggatggaggtggcgtggaaccaggtgaagctgcacgacttcctgcagagccccgaggacctggagcggctctactgcgagatccacctcctcaagacgctcaagcaccgcaacatcatgaagttctacacctcctgggtcgacgtctcccgccgcaacatcaacttcatcaccgagatgttcacctccggcaccctccgccagtacaggcagaggcaccggagggtgaacatatgggcggtgaag

SEQ ID NO: 21133 - DNA, 557 bp, Sorghum bicolor
  Clone ID: 12693330
tattttgtaagcagcttcatcttctttgaatatgaacggcaaacactataaagaacataaggacgagttatcatctaggctataattctctacgaatgggaaaactgatgtaactggtgcatttgtttataactatttgtttttgaggaaaaactgtggagccttgctccccagtgcaaaaatcaattaaaagagaaacaaagtacagagttcttacacaaggttagcaggaagctaacaaagaaaaagctggaactaaactatttgttgaggtaactctacttaacatgtcaaatcagggattcatgcatcagatgtattgcatattgaacattacatgtgcaattagttcaaataacgccacaaagaaacgtgaaaaagtatatctgtattaggatttaggacacctgtgtatattctgccatatcaaataatttagcacactttaatgatttgctaaaagcacagtgaagtagcataatcatagtagtaactctcaatttccaaaaaaaagcaaggcagaagtggagtatgatgaaaagaaactgaggataaga

SEQ ID NO: 21134 - DNA, 291 bp, Sorghum bicolor
  Clone ID: 12693361
tcctctctgcggtggctagtgctgacctcgtgcgcgggcttccgagcaagggcgccgtagttctctctgcggtggctagttctctccctccacctcttctccttttccatccccctctcgacactagggtgcgctccgttgcacacgtcccggcaggcggacggcggcgcggcgatgcctcggcatggcgaccccagacgcgcggctgcgcctagcccgacctcccaacgacgtggcaacctcaacacgggcagcgccgtggcggtgccgtctctacttggcttccatccc

SEQ ID NO: 21135 - DNA, 410 bp, Sorghum bicolor
  Clone ID: 12693369
ggcacgaggccgaagaacaaccgatcaaaaaatccctctcggacctcgagctccgcgccgcaatccagttgagaagcttagagcaactccaccaccagattgagaaacttgaccctccacgcgtgctatcggatttggatttgtatatcctccgccgaggtatgagacaggaggcggcaaacagcatagtggtgacccaggaggacgccctgcaccaccgcgaggagctgcagccgcccccctgccgccaggacgatccgccagcaccggctgcgtcgctctcatggccgtcgtcactgtcggagggcgagccggcgtccgcggcagcgggggaggagctgttgttggtaccaccactcaacttcgccatggtggaccacggcgtgtaccgctccggattcccggacgtc

SEQ ID NO: 21136 - DNA, 436 bp, Sorghum bicolor
  Clone ID: 12693370
gcacgagggaatcttggcggctgctggaagagatgtaacggcgcatgtctgggatattcgttccagtaagcagatgttcaagcttcaagggcatacaaagtggataagatcaatgaggatgactggagataccataataaccggtagtgacgattggaccgctagagtgtggtcccttaaccggggaacatgtgatgcagtgttagcatgccatgctggtcccatactatgtgtggaatactcaccttcagacaaaggaattatcactggttcagctgatgggctcatacgattttgggaaaatgaaggtgagttcttagtgattgtaaacctaatttcggttactgcattgatatttttgtttcttgttttttgggggaaactagggtgtggttttctgcatactttacggtgggttgtttgagtgatgtttatt

SEQ ID NO: 21137 - DNA, 548 bp, Sorghum bicolor
  Clone ID: 12693372
ggaacatcgtaaaaactccgaagatccttttcactatagttagtgacgtatccaaattctgtatactattggtggacgggacattccgcttccttctgctttgttttcacgaagcgagcgctttcaacaagcttctttggtaataagcaaaagtgtgtaaagtcctcctctcactgggaaagctttgttgtcttcgttttctttcagccgtagtatatcgccgcatatgatctggcttttaaagtgggttagtaagaaaactgacctttctgggtaagtgccctttttttgtttaagagcgagttgagcagtaaaatagaaataagagctgctaaaacaatatctttttcttaaagttcctacgatgctagtttttaaaaggcatatacactcagataatgcaagagttccccactaccaagtaagctctttctacttgttcacctgtgtacttatggatgaaaactacctggctttgtttggctacttttttgattggctagtgtgattttatatctcacgctagactcgattgagctgtcttacat

SEQ ID NO: 21138 - DNA, 260 bp, Sorghum bicolor
  Clone ID: 12693375
tccagcaagacaactgtttgtgtggaacttgagcgagagagaaagagagggtgatctgagcagccatcgacgagcgagcgagagctacacggttgtgttgtgcgcggtcaccggccgggcagccagccagccagccatggcgacctacgacaaggcgatggagtcgtacaagaaggcggtgacgacggtggcgtcgctggcggcgtcggcgatgctggtgcgcggcgtggtgaacgagctggtcccctacgaggtgcggg

SEQ ID NO: 21139 - DNA, 399 bp, Sorghum bicolor
  Clone ID: 12693378
gcacgaggctcctcccctctccggctctctgcctctgacgtctgacctctcctccccaacggtgaggccggcgcattgccgtttcgagcgcggacaccgagggctagaactagaagtggcggcggtgccagggctcggcgctcggtcggcaatggcggggcggcttatgctggcggcgctccctattctcctcttcttattgctcgtcgggcaatgccacggcggcaagattggcgtatgctacggacgcaacgccgacaacctgccggggccggacaaggtggcgcagctaatccagcagcaatccatgcaagtacgtgcgcatctacgacaccaacatcgacgtcatcaaggccttcgccaacaccggcgtcgagctcatggtcggcgtacccaact

SEQ ID NO: 21140 - DNA, 155 bp, Sorghum bicolor
  Clone ID: 12693387
tcgcgacgacgtgcacccgagtacgcctggttctgtcggtctgtgcctctgtggagacacgctgcgagtcccaactccaagccgaccggagacgcgcgagagagaccggggctccacctcgcgccgccgccgccggcgaccatgtccctggcgtc

SEQ ID NO: 21141 - DNA, 298 bp, Sorghum bicolor
  Clone ID: 12693393
ctaccgcctaaacggcctgaaaacgaggcctgcttataggtagctcgtagccgtaggcagcttggccacaagagccgtgagccaaagtcaattctcttataggagtatatactctattatatattgcccatcacgattcacaaaaacccggccgcaacaggggcagggcaaggttgttacaagcgagacacggcgcggcgagtgcgcgcggcggggtggcaggcagcgacgacgacgtcgacctcgatcgccggccgacgacgacatgggtaaggacgggccgacgcaggcggcggcg

SEQ ID NO: 21142 - DNA, 513 bp, Sorghum bicolor
  Clone ID: 12693404
gcacgaggcaaagacaagaccgaaaagcccatcacctttcctggcaggttctaaactgagaaaaatccggtcgaaatcccacatcataacacagtcagaaatattgaagcttatatctcctgagacatgggaaaccccctcccatggggcatctccaatgaacaaaggcacagctgaggtcagcatccatgagaacaagtcgccattgtgctcatctatgggctcaaatcagcctgttctatcacagtgcccgtcatctcttagtgcaggtcttctacaatgcatatggaaaaatggcctccctcattttgaactgtcactggacgatcctattgcagtatacgctgcaaacccaatcagggtgcaagaaaaggacaaggccctcgattacgtctacatgattcattctggagagcaaggaagaaaagattggatgggtcactcaagcaatgtgtccagacttgtgggcaagatgaaggtgtctagttctttagttctaaactcagacaagtc

SEQ ID NO: 21143 - DNA, 636 bp, Sorghum bicolor
  Clone ID: 12774861
tgttggtgcaggagttcacggcttcagcagagaagatccgagcggtggcacacactgtaatatcatcagctgagagaacaagcttactggctatgcgaacttcattctctgaaataatgcagaagaggcacaggcagcctttcagaataactccttgggcaacatttggctgcagcatggttgcatgtgctggccttgtgatgcatggagatgggatcgagtgtgcagccgaggcagcaccttctgttcccatgattgcttctctgggccgtggccttgagagcttacgtctcacatcccaggaggtgagacaaacaaagggccaaaatgtgaaagaagctttgcgagcattaatgaacagcttgaagaaatcagcaaaataaagggccaacagttcacaactggagctgtatggatttttgtcttgtgatttgggggcaagactaaaattatcatgagctgtgaagtgcacttttctgtttgccaagatagtgaaattatgtgattgtgctttgtgggcgtggctagcttgagcttagggagcacttgagtgagatgagtgtgtttttttattgactttctgtacatacatacaagatataagttcttatggtataaaaatattcaataagattt

SEQ ID NO: 21144 - DNA, 312 bp, Sorghum bicolor
  Clone ID: 12774884
tgacagatgtcaagaagggtgcagaaactgtatttccaaatgctgagggaagccatttacagtacaaggatgaaacttggtcagagtgttcaagatctggcctggcagtgaagccaaaaaaaggagacgcgctactgttcttcggtcttcatctcaatgcaacaactgatacaagtagtcttcatgggagctgcccagtaattgagggtgagaagtggtctgcaacgaaatggattcacgtcagatcattcgataatcctccaaatgtaaggatggacgcgccatgttccgatgacaatgagctctgccgta

SEQ ID NO: 21145 - DNA, 642 bp, Sorghum bicolor
  Clone ID: 12774900
ccaagctccgcaaggacaacttgggcgtgcccccacaggcctcggtgcttctcaagaagatctgcgaggatggcgggctccttcgccgtggcgtggatgccacggagctttccgataaggtgttcaagctgaagaaaaagttcatgaaggccgctgccaaggttgctgccagcaacggcaggcaccttcgcaaataccgcaaccgggtgctctacaagacatccatggaggcgtggccggatctgctgcctgtcgacgccgcggctgctgttcagggcctctgatcatcgtctgatggacatcacgttcacgacaggaggttgagctctttttgtgcactgctgcctctacttcaaatcaaatctatgagcaccatcaccattaggtgtggtgtgacctactatacatataacatatgcacgaccaatctagctagaaattggctagtgctcacgctgctgtattgtatctagtcttcctgatgtggaattaagtagcaaccgtgtctatatgatctactagtgtcttttaggtatgaacaatcatgtctactatcctgtagtgtgctttgtgcttttgtgttggatataagtatctagtctctgatgcatcaattatcaagtataagttatataacccaca

SEQ ID NO: 21146 - DNA, 493 bp, Sorghum bicolor
  Clone ID: 12775001
gcgattgggagctgccgcgagcggtctcatcagggccaggcaattggtcgagtgacattggcttgactgaaccaactgaagcagcaccaccgtcccggccaatccctggcggttaccacttggttggcaacaccaagcagacgttcataggatgagctgagcaaggggtttgaagctgtttaatttccttttaggttaagcagcaatgcatgggctcaagttatgttatggcgacgtgttttggctgggacggtctgtcttttggggggttatgctgcagatgaactcatcgtctctgctactttcgtcagatggcaatatggcatgctagccgttggaacactgtttatgttgcctgaatgtattctttgatcgaaccctcgtcaggtcgaagtggaacactactcgatcgccatgtgtggcttttgttctctctcagattacggtaacttgaaacgcaaagctatgctatgatatatgccccgatcctgag

SEQ ID NO: 21147 - DNA, 384 bp, Sorghum bicolor
  Clone ID: 12775012
tagcggacaagattaggggcaagacgcctgatgagatccgcgttgccttggacatcgagaacgactacacgccggagcaggaggccgaggtcaggagggagaacgcctgggcattcgaggattgagccttgcttaccagaagaaataggcacattcagtttgatgtcaagtaggcagatcagtagataggtcagtttgtgggaagtcaatgcaaagcaaactgggtgagttgagcttctaactctgaaagctttggtacgaattgtggatagatggatgtctgttcaactggttttcatcagcactttgttcagtttaaggcatcgctagtctgtactccaagctgggagaacttacatcatcttagttgcaaatcttgttcag

SEQ ID NO: 21148 - DNA, 477 bp, Sorghum bicolor
  Clone ID: 12775013
cctcgttacaaggtggacataagagttgcccctggatcacacgcaactgaagctgccgtgaataagcaactgaatgacaaagaacgtgttgcagctgcattggaaaacccaaacctactggacatggttgaagaatgcttatcaccaacatttgattgaggccatatctgggcgccatggcgttttatgttcagaagccacacaagcttattgcctatggagttcactcctgtctttcaagtactgaaatgttttggctgttaaaggacgtgtgcatgattttttttccatccgtccacttttggacgtttttttgtgctcgtgacctccctgaccctgagcagagggagatgtaatcagatcttgtgctgtagctttcggagtgttgtcacttgtcagtaccacaccattttgaggctgtgtaccctacacaatcaactgaacttggtaggagagtcctagaatcctcaaaatcat

SEQ ID NO: 21149 - DNA, 469 bp, Sorghum bicolor
  Clone ID: 12775018
cccctcgccggcatgataatcgggaacgccatgaccgtcaccggcgtcaccatgaagaagctccgggaggacatcaagatccagagggacctggtggagacggcgctggctctgggcgcgacgccgcggcaggcgacgcggcagcaggtgaagcggtcgctggtgatcgcgctgtcgccggacatcgacagcgccaagacggtggggctgatcacgctgccgggcaccatgacggggctgatcatgggcggcgcgtcgccgctggaggccatccagctgcagatcgtcgtcacgtacatgctcttgagcgcctccactgtcagcagcatcctctccacctacctctgctggccggcattcttcaccaaggccttccagctcgatgacaaggtatttgcagactagggaggatgcttttgcgttgcagggaaacgaaaaacagtaacttttggctttgggtgatgctgaa

SEQ ID NO: 21150 - DNA, 604 bp, Sorghum bicolor
  Clone ID: 12775031
tcctgcaggaccacgtggaggggcttcaggtcatgcacgacggccgctggctcaccgtcgaccccgtcccgggatccttcgtcgtcaacgtcggcgaccacctagagatctacagcaacgggcggtacaagagcgtgctgcaccgggtgcgcgtgaactcgacgcggccgcggatctcggtggcgtcgttccacagcttgccggcggagagggtgatcgggccggcgccggagctggtggacgaacaggccggcaacccgcggcggtacatggacaccgacttcgccacgttcctcgcctacctcgcgtccgccgacggcaagaacaagaccttcctccagtcaaggaagctgccagtgccagctgctgctgcatgcgtctagctagcagctgcaccatgcagagttttcgtcgtcgtcgttgttgcttattaatctcatgacagaataaaattaattaactagttcagcgcacagtgcacaagcctgctgtggacttgttttaattagttctgcaccttgattgtattcaaggtcaacgcgtgcatacaagctaagccttgaccggtcagatcgttccatcgatcgattgcattgcatcgcag

SEQ ID NO: 21151 - DNA, 560 bp, Sorghum bicolor
  Clone ID: 12775111
gcacgaggcttacttatatatatctagactagatatatatataactcgatctggtactaccatatatatatgagaagctactagctagctagctagagtctgaaagaattgagctgctagcttgggatagagcgaggtgaaggctgcataccggggagagaggcagcagggagaatgagagggtttgagagaaaaggggtccggcagtacaaccgatcagaggtgccgcggatgcggtggacggaggagctgcaccggcagttcgtcgaggccgtcgagtgcctcggtggccaggacgaagcaactccgaagcgaattcttcagttgatgggcgtgaagggagttagcatatctcatatcaagagtcatcttcagatgtacagaagctccagctccagcagcagcagcagtactcatcagtccagcctccagaagttgacatcgtcaaccgcggcgagcaacagcaagcgcgtgttcttgagccgtgaagatcactgcgcttatgcgtcacaggatggcaacactccagctccatcagacaagaacatttataccaccat

SEQ ID NO: 21152 - DNA, 475 bp, Sorghum bicolor
  Clone ID: 12775121
gcaaagcccatcccacaccgctctggttctgacgaacccctttgccgccgccgccgccgccgccgcagtctttgcttttccggtgaaaggttttttgcttaggggaccatggaggagtacggagggggagacctcctgagcgaggctatgggatctgcggcgcgggtggtggtggtagaggactgcgtggaggcaccaggggccttcgtgctccacctcctcctcaagcgcgcgctcgccagcggcggcgcggctgccttcctcgccctcgcgcagcccttctcccattacgaccgcgtcctgcgcaagatgggttgtaacctttccctgcataggaggaacgagaggcttcatttctttgaattgctaggattcccaggtggagcaagggaaggcacaattgctgataggtttgttcaattgtacaatgaaattcaaagactggtggaggcaaacaggactggagaaaatgcat

SEQ ID NO: 21153 - DNA, 521 bp, Sorghum bicolor
  Clone ID: 12775126
gcacgagggacgagttctctccggtcagcaacccggcgacgacgcccgtgagcaacccagtgaccgtgccggccacgaaccccgtggccaacccgatggctccgggattcgtcaccgtgccgtcgaccaacccgggcaacgggttcgcgaccaacccgaacatgccgccgctgtacccggagccgacgacgccggccaccatgcccatgcctgacccgacgacgccgacgatgccgccggtgaccgtgccatcccctttcacgaacccggtctccgcgccgaccaccatgccgggtacagtgacaaacccggcagcccctgccgtgacgaatccggcaacgacgccgtcgcagttcccgggcacgtcgccggtcaccaacccggtgaccacgtacccgcagcagggcggcgtcggcgtcggtggcggcatgccggcaacgcagccagtgtaccagcctccggcgacgacaatgcccggcaccggcacggtgcagccgggcgcgcccaccatggccgggcag

SEQ ID NO: 21154 - DNA, 426 bp, Sorghum bicolor
  Clone ID: 12775153
gcacgaggacaccctcctcctcctcctcctcctgcgcgagcgctagcagtagcagcaagtgcgtcgtcctccttcccctggtctctgcctgccttcagtccttcacgcgcttgagcttgagctgggctgcctcagcggtgttcgttcgtggacagctgctctgctaccggcaaggcgcaaccccggccgtacgtcgctgcatgccgcggtagaaaaccgaagagagatggcggcagaggcgctggggttcatggcgcggggagccaacggcgggagggcggcggagctcgtcaccagggacttcctcggcgggtgcgccggttccgacgacgccagggacgccgcgtccgccaggaatgacgccgtgcccgggtgggtgtcccaacagaagcacgcgtgcccggcgacgccgagggacctcaacct

SEQ ID NO: 21155 - DNA, 239 bp, Sorghum bicolor
  Clone ID: 12775161
ggtagatgcgcaccctactgctgcgcgtgcgacgccgggggatgccccatgcaggcgcagaacgcggacgagatccgccgccgccgcctcgcgggcctctcctggcgctcgccgtcgtctgccctgacgacgacgacgacgctggccgccgccgccggggacgcggaggccaccacgtctgggctctccactatgacgcctgccgatgcggcggcgccggcgccgccgcccccgcagac

SEQ ID NO: 21156 - DNA, 529 bp, Sorghum bicolor
  Clone ID: 12775176
caaaatctcaaagttggactattgaattttaatagcactgagtatggctcttggacacaattgctctcagacagccatgtttccattataagacttgagcatgccaaggacagcattacttggcaaacactgtatcctgaatggatcgatgaggaggaagaaacagagataccctcttgcccatcacttccagagcctgatgtacgaagagatgtacgctttgatgttattgctgtaaagcttccttgtacccatgtggcaggttggtcaagagatgttgcacggctccatttgcagctctcagcagcaaaattggctgtgacatcttcgaagcgcaaccacaaggtccatgttctttttgtaactgagtgctttccaatcccgaatctcttcccttgcaagaaccttgtgagacatgaaggcaatgcttggctatatagccctgactcaaaagcattaagggaaaagctcaagcttccagtcggatcctgtgagcttgctgttccactcaaagcaaaatcgagacttt

SEQ ID NO: 21157 - DNA, 507 bp, Sorghum bicolor
  Clone ID: 12775200
gcacgaggatggagagatgaggggaaggattctgagcctcttaactttatgtctctggaggaattgaggaagaaagtttgcctcgtggcgaatgcactcgatgccctggaactgccaaagggatctgcaattgctattgacatgcctatggatgtcaatgctgttgtgatctaccttgctatcgtattggcaggatatgtggttgtctcaattgcagacagttttgctgcacctgcgatatcgatgaggttaaagatatcagaagcaaaggcaatttttactcaggattacatccttcgtgatgacaaagaactgccattgtacagtagagttgtggaggttaacgcccctatggcaattgtgattcctgtaagggggtctttgccaataaagggactacgtgttgatgacctttcctggcaagacttccttggaagagttaataataccgaagcggaaaattacattgctgttaagcaaccgggcgacgcgttcacaaatatccta

SEQ ID NO: 21158 - DNA, 508 bp, Sorghum bicolor
  Clone ID: 12775241
gcacgagggcggaatcctccgcctgcggccaccgctcgccgtcgaaccgccgccgccgccgctgccgccgaagggattatcagatcagatggggacttcggtgcaggtgacgcctctcagtggggcgtacggggagggtcccctgtgctacctgctcgctgtcgacggcttccgcttcctcctcgactgcggatggacggacctctgcgatacctcgcaacttcaacccctcgccaaggttgcaccaactgtagatgctgttcttctgtcacatcctgacatgatgcatctaggagctttgccttatgctatgaaacatcttgggctctctgcaccagtttatgcaacagaacccgtgtttagacttggccttttgaccatgtacgaccatttcctatctcgatggcaagtttcagactttgacttgtttactttggatgatgttgatgctgcattccaaaatgttgtgagattgaaatactcacaaaattaccttctgaatgataaa

SEQ ID NO: 21159 - DNA, 469 bp, Sorghum bicolor
  Clone ID: 12775262
gcacgaggctgaatttcctcgccactttccttcttctctcccaccagaaacgcggacgcgcaaagcctcaccgcgtcacgactcacgccacgcctccgatgctcgccggcgtcgtcggctgcctccggcgatgccaacgagcccgctgaagcgcacgtccggcggcagcggcggccgcctgcgccgcctcctggcgtccctccgcccgccggcccgcgcggggccgctccctgtgcagaccggcttcccgacctccctcgccgacatcgtcgtcaagaaccacggccgcctcaggaactccagacggcgacaccgcgcacccggcgccgccgtcccgccggccgcggagctccagcaaaggagcaacctttcggtgtctcatcacgacgcggcggcaccggcaccggtaccggtgacgacacgcccaggcaaaggcgcgggcttcagcatccggccgggtctcctcgtg

SEQ ID NO: 21160 - DNA, 474 bp, Sorghum bicolor
  Clone ID: 12775274
gcacgaggcaggaaatcatgctgctgagagagctgtcacatccaaacattgttcagtactatggcagtgatttgtgcaatgagacactctcagtctatctcgagtatgtttctgggggctctatccataagttgcttcaggaatatggtccgtttggggaggcagttcttcggaattacacagcacaaatcctttctggccttgcgtacttgcatgggcggaatacagtgcatagagatatcaaaggggcaaacatacttgtcgatcctaatggtgacatcaagcttgctgattttggtatggccaagcatatatcagcatatacatctatcaaatccttcaaagggagcccttactggatggccccagaggtaattatgaatagcaatggttacagcctttcagtagacatttggagccttggctgcaccatacttgagatggcaacagcaaagcctccttggagtcagtatg

SEQ ID NO: 21161 - DNA, 512 bp, Sorghum bicolor
  Clone ID: 12775304
gcacgagggctagctagctaccatcattagcacagctcctgttcatcgttctcgttgagctccctccacctgcggcctcttgtccgtttgcacgcacctcgccttgccttcctcctctgcaatctgcatggcaagcgatacatgctctgcttagctgactgaaatttcaccgttcgcagacatccaatccaaacaacaatattcttcttcttctgacagctcatggcacgcagcaagagctcatgatatatattgcatgcttggccttgacacttggtaactgaaagcacagagcatccatcagccatggagatggcgaacgccggacggctacaggcgctcaagcaaagaggcttccgcggcgacgaagaaacaccaaatgggaatgaggatcactcatcatcctatctgcaacaccgacactcaagaagtgctatgatcacgtctgtaaatgttcctgacttgtcaccacgactctccgatcacatacctgcagtcaatcgcagcaagat

SEQ ID NO: 21162 - DNA, 583 bp, Sorghum bicolor
  unsure (1)..(583): unsure at all n locations
  Clone ID: 12775321
gcacgaggatctggagaagtcgtcgatccattgccaaggggtgtagtgctggtgtggtgagatcaagtgaattttagaagtccacaataaggccttgagtgagaggtacctggtatgctgacagatgtgggcacatcagtcaacggtgctttcaattatcttaaggaccgagtgtggaagaaggtgcaaggctcgatggagcaatgcctgtctgcaggacagcaggaggcaaggaagttctaattaagcctattgctcaagccatcccaacatactcaatgtcttgcttcaagtttccggagaggtctatgaaaacatatcgatggtgttttgcatgatttttggtggggaagcatggaaggcaaatggaggactcttgctgggtcgcttgggacgatatgtcaaagcctaaatgtatgggaggcctaggtttcagaaacattgagctctttaatccggcattacgcgcacgccaggtgtggcgtttgttgcaggacccggagatgctgatttgggtgacctcttagttgctgatttgggtgcgtcaccatcnaaggtgtggtgagcggtggtggacgatgtt

SEQ ID NO: 21163 - DNA, 436 bp, Sorghum bicolor
  Clone ID: 12775323
gcacgaggtgctaggttattcaccagatactttattttctattcatgctgaccaagaggatggtaccccacattgtgggggttctttgccacctcctttcccgtccccttgcacagtgaggactgcgcttaccagacatgcagatctgttgaattcgcctaagaagagtgctttactggcgctggcggctcatgcatctgattctaaagaggctgagcggcttacacatctcgcgtctcctgctggaaagaaggagtattcacaatggatagtcacaagccaaagaagtctcttggaagttatgtcagagttcccatcagcaaagcccccactcggtgttttctttgcagctatttgtcctcgcctgcagccgagatattactcaatatcttcctcaccgagaatagcaccaacaaggattcatgtgacatgtgca

SEQ ID NO: 21164 - DNA, 432 bp, Sorghum bicolor
  Clone ID: 12775324
cgctcgtgaggcggtgcctctgtgcacccgaggaagacttcacagcgctctcagtcatggacaatctcaggctgttctcctacggggagatcagagcggctacaaacaacttcaatcagagtaacaagcttggccgaggtggttttggaactgtctacaagggagtcttgagagacggcactgaatttgccgctaaggttctgtcctctgaatccgagcaggggatcaaggaattcctcgctgagatcgagagcatctcccaagtgaagcacgcgaacctcgtcaggctgctgggctactgcgtgcagaggaagaacaggatcctagtgtacgaataccttgccaacaacagcctcgaccatgcactcaaaggttcaggggacggagcagccgcagtaaatctgccctggagcaggaggtcggacatctgcg

SEQ ID NO: 21165 - DNA, 475 bp, Sorghum bicolor
  Clone ID: 12775351
ctgcaaccttcagtccaaaagaattcgctgaaagagagagctgcagattcgtagccgtttctgcttcggcgcacttgttcagtgtggaatgatggaggtgagcccgtctccggagcaaggagtgatggcgggaagggagccgttcgggctgccgaagaccccggcgacgccgccgtcctcgggggtcacgcagagcctgcgcatggcgtacacgacggacggcaccgccatcttcaccccggtgagctccgcaccgcccgcaacggcaacgtaccaccagcccgtggctgcttcaagcttggctggcgtaggaggcaatggtggcgcgccggtgcactcgggcggcgcgggtgagccggtggccaagaagaagcgtggtcggccaagaaagtacggccccgacggctccatgtcgctggcattggtgcccgtgcccgcatccatcgctgcagcaccggcgccggcgccggcggct

SEQ ID NO: 21166 - DNA, 522 bp, Sorghum bicolor
  Clone ID: 12775375
agaacataatagactactgattctacaatgaaaagggagatggtgccttcatggctagagatattactcgcaacacaattctttactacttgtgccaaccatcttcttgcttgccgcaatgagtgtaacctgttttgcactcagtgcgaggctacaccagctgctttctgcaactactgtcgttcaatcaatcattccactcatcgtgtaatccaggtaagaaatgtgtagttgtgtagtcaatggaaaggcaaaacatttcatatatcatacatgtcgtacaattcaaaactttatgatttggatgttttttctcttgttgcttcttatgccacctcacaattaagaaatgttataaaactttacataaaatgtgttttgatttgggtgtataaaaatagatttcatccataggccacaacgacctttgagcaagaacacatgtgatctatgaaaacatggtagtatttaagtttcaaataattggatgtttcagataaggcgatcatcctatcatgatgt

SEQ ID NO: 21167 - DNA, 538 bp, Sorghum bicolor
  Clone ID: 12775391
gcacgaggattaatggtcactacaagaatgcatcctttatgtgtgctgatgtgacatccgaggacctggtgcttccagctagctccatcgatctgatattttcaaattggttattgatgtatctttcagatgaagaggttgagcagctagttcaaagaatggtaaaatggttgaagattggtggctatatcttctttagggaatcttgcttccatcaatctggagattcaaaaaggaaagttaatccgacacactatcgggaaccgagtttttatactaaggttttcaaagagtgccatacctttgatcaagatgggaattccttcgaactttctctggttacttgcaagtgtattggtgcttatgttaaaaacaagaaaaaccaaaaccagatatgttggctatggcaaaaggttcagtctacagaagacaagggatttcaaagatttttggacaatgtgcagtacaaaactagcggaatattacgttacgagcgcatctttggagaaggttatgtgagcactggtggaattgagac

SEQ ID NO: 21168 - DNA, 524 bp, Sorghum bicolor
  Clone ID: 12775392
gcacgaggcaccaggaccctgaagacatctcaccaccacggaggaggaagcaccaggaccctgaagacatctcaccaccacggaggaggacgcaccaggaccctgatggtgatttgtcacccccaagaagaaataatttggggcaaagtcacaaatctgcaacggatgagttatctccacgtaagaagagagacacttctccctcaaggaatagtaaaaaggaaagagcctcaaaacacgtgatgaaagctggactgatgacagcagaggaagttaaagaggacataagaaagattaaggagactgagatggctaagtttgcgtcacaggatccttcgctggttgggaaaggtgcaaaggcagtattcagagataaggaaggcggataagtgaagaagaaatgcgcaaggcaaaggaacctgagaagccaaaggaaatacatatagaatggggtaaagggttggttcagaaacgagaagctgaggctagattaaaagagattgaagctgagaagaagaaacctt

SEQ ID NO: 21169 - DNA, 499 bp, Sorghum bicolor
  Clone ID: 12775430
gcacgagggcggctgatcgggccgctctctgtgccggaggagacgaagcagttcgtgctcgcgctccgggagcctggcgggtcgacgcaggacccgcaccgggacggcgccggcgtgatctacatcctcgccgcgcagaacctgtcggagcagtccgcctcggacgccgagcgcctgatcagggaggtgcggccgagggccgtggtcacccaggtcgcgcgcacggccctcgaagacgtccggatcgaggaggattgcctggccggcagtggaagcgggggcgtgccggtaccggcgtcgccgtttcaggtgatcaagcggtgcgtcacggagaagaggagcaaggaccagtacgtgaaggctgccgcgtgccaggtcctgcaggagatttttggggtcgggttctatggccatctgcttgctgccaagagagctgcagaggagacgggttcgtgttttctattgcttgagtctccgtatgagaggaattgtggtgggg

SEQ ID NO: 21170 - DNA, 407 bp, Sorghum bicolor
  Clone ID: 12775454
ggcttctatgatccggcgcgcgtcacccagctctcctggcgccccagggcgttcctctacagcggcttcctgtcggacaccgagtgcgaccacctcatcaacctggcgaaaggcagcatggagaagtcgatggtggcggataacgactccgggaaaagcctcatgagccaagtgcgcaccagctccggcgcctttttggccaagcacgaggatgaaattgtctctgcaattgagaaacgcgtagctgcttggacatttcttccggaagaaaacgctgaatcaatgcaggttctgcgctatgaaatcggtcagaagtatgatgcccactttgattattttcatgacaaaaataacgtgaagcatggcgggcagcgatttgcacctgtccttatgtacttgacagatgt

SEQ ID NO: 21171 - DNA, 441 bp, Sorghum bicolor
  Clone ID: 12775458
gcacgaggctcgttttaccacccctgtcctcaccaccactgccatcctccactacagcaattcaaatggtgctgcaacagtaccacctcccgcagcgcctacagttgagatcgatttttctctcaaccaggctagatcgattcggtggaatctgacagcgagtggaccaaggccaaatcctcaaggttcttaccactatggcctcgtcaacaccacaaggaccatcatactcgctaactcacgggcaaccatcaacggcaagctgagatacgcagtcaacagcatctccttcatcccggctgacacccctcttaaagttgctgatttctacaagatcccaggggttttcacgctgggcagcatgcccgacaacccaaccggtggcggtgcttacctccagacatctgtcatggcggccaacatgcgggactatgttgagat

SEQ ID NO: 21172 - DNA, 359 bp, Sorghum bicolor
  Clone ID: 12775466
gcacgaggcccagattggggaacgagcgagaaatggcgatcggcaatcccgacgacggcgccggcgtcggcgacgacagtggagcaaagaagcagagggttgatgagcaaggggacggaagcgaggtggtgggtgcggatccgatctcggtggatcgcatctcggcgctgccggacgacctgcggcggcgcatcctgacgcacctcgtcctcaaggaggccatccgcacaggggcgctcgcgcgcgggtggcgcgacctgtggaggagccggtgggaccgtggctccatcgaggtgtgcctctactcccgcaacgacccacagagggagttgggcgcgttggagcaggaaccgcctccg

SEQ ID NO: 21173 - DNA, 472 bp, Sorghum bicolor
  Clone ID: 12775470
gcacgaggcacccatctccaccatggcaccaaccatccccttctccctttccccacgcggcaactgcgcggccgccgccatcagcatctcctcctctgaatccgatccttcgtttaccaacaccctcatcgtcctgtcctcggcgacctactccaccagctccgtcgtcatcgttcgtgactcatccgccagccgaggcggcgacgaggccaggcgcgggcagaggagcgcgctgccgcaccggcgtccgccctcgctggcgccctccgccctgcccgtccgttcgtcaaccgtcgtcaccgcagcttcatccgccaacggaagcggacatgcagccacgacggcggcggcgccgcaccagtgcccgtcgccgtgctctgtcttctccgtccgcgcaccaagcggcgtcgtcccaacccctccctacagcggcggccgcggcggcgacgacgatgacgaggctaccagccgg

SEQ ID NO: 21174 - DNA, 375 bp, Sorghum bicolor
  Clone ID: 12775536
gcacgaggctaaacctaaacgaccaaaatcattgaggatatatgaaacacatgttggaatgagtagcccggaaccgaagataaacacatatgcaaactttagggatgaggtcctcccaagaataaaaaaacttggatacaatgcagtgcaaataatggcaatccaagagcactcatattatggaagctttggataccatgtaactaatttttttgcaccaagtagtcgttttggtactccagaagatttgaagtctatgattgatagagcacatgagcttggtttgctagttctcatggatgtggtccatagtcatgcgtcaagtaatactctggatgggttgaatggttttgatggtacggatacacattattc

SEQ ID NO: 21175 - DNA, 419 bp, Sorghum bicolor
  Clone ID: 12775549
gcacgaggacaacctccgcgacctgttctatctccgtgacgaggaagaccttgcatcggccgggcgccgcgccgccgtcacgctctcctccgccatggccgccgagaggcaagtctcggcgccgtcgccgccatcgtcgtcgtcccccgctcttcccgccggcactggcactcaccgtcgccgaggccgcccctctctccttccttctcacagactatgtcgtccgtccgaccaccggcggcctcccctcctcactcagatccagatccgttcgtctcattgcttggcctcgtcctcaaatccttgagtctccttgctcatgcagctcctgggttgctccagtgcccctctgcagctcaatctacaaatttctcctaggcagctcctggacatgggatggagcagcggtgtccgtctgc

SEQ ID NO: 21176 - DNA, 373 bp, Sorghum bicolor
  Clone ID: 12775578
gcacgaggccgcggaacttcccgttcgtgctcgccgccgacccctcgggcctgctcctcctctccgcgatcctcgacgccccgctcacccgcgtccacgtcgaccgcccgggcgagcagtccgtccgcttaagctactccgaccctcgctacttcgtcctcgacgccgccacgggctccgcgctccgcctcccggacccggaccccaagttgcccatccagcaccaggcgctcgtcggcgtcctcgcctgccccagcggcgccggccgctacgtcgtcgccgagctcctgcccttcatgggcactgacaagggcgacctccgctgcttcgactccgacgtcggcgagtgggtcaacaagcgcgtgcgctaccc

SEQ ID NO: 21177 - DNA, 439 bp, Sorghum bicolor
  Clone ID: 12775596
gcacgaggaagctctgctcaacagagcagctgctctgtacgggccggtcggtgatggagcggcacgcgggcatggcgttcctggacctggtggcgaagcaggttgacccgggcgcgccggggttctggcgcgacttcctgctgggcatgctgaagccggtggcggcgacggccgtggtggccatggccgtcgcgctcagcttctcgcagcgcctggggctggagggcgagatgctctacgccaccgcgcgcgccttcctccagctctccgtcatcggcttcgtgctccagttcatcttcacccagaagaacgcgctctggatcctcctcgcctacctcttcatggtgacggtcgccggctacacggcgggccagcgcgccaagcaggtgccccgtgggaagtacatcgccttcgtctccatcctcgtcggcaccgccgt

SEQ ID NO: 21178 - DNA, 445 bp, Sorghum bicolor
  Clone ID: 12775610
gcacgagggcaccaattgtaattaatcttccacagctcacgatcgattccaattccaacactagctatagctcgctaggctactgtacacacactcaccaccaggtgtgtgaacaagtgtgtagtagtgcaagctactacgcgtcacctagctaaataagctagttatacgagcttggttgcggcggcgccaatggcgatcgtcgacttggccaacgcccagctgcagcaagcaggagcaggagcagcagcagccacgatgagagaggacgacgacggccatgaccatgagcaggagtcctcctacgactacggcgcctgcctgatgaaaggcgtcaggcacctctccgacagcggcattaccaggctgcccgacaggtacgtcctgcccgcgtccgaccgccccggcgccgccaccgtccttatttccccctcgtcgacgatcc

SEQ ID NO: 21179 - DNA, 424 bp, Sorghum bicolor
  unsure (1)..(424): unsure at all n locations
  Clone ID: 12775615
gcacgagggtgctttgttggcattcattattatcatgaccaaaggtaccagcgattaactgcaattggtacaagtacaagagtgtttaattattagacaattgccttctggctcatggggtccattgcaccttagctctatgcaacatgaaggcgccatgtagcagcttttggaactgttcccagggcaacagtggcatgctgcacatactttccgtacttgtgtgtccagtggccagaatgtttttgttgactctaatgcgctttgtcctgtgatgccgccgtcaaacactgcatcgccttggctgcagagactggtgcgactggtgtggggaagaatgatcataagggtgagaagcatctttgtaattntttccataggtgcttttgctctgaaatagactattttccacttggtatattcc

SEQ ID NO: 21180 - DNA, 491 bp, Sorghum bicolor
  Clone ID: 12775627
gcacgaggatcccctcgagctcgagcgccgccgcctgcgggagccatggcgcggtccccagccgcctcctcctcctcgtcctacacggacagcacgggatcgtcctccgactcgggctccacctcctcggggagcgaccgccgccgccgccaccaccaccgccaccggagcagcagcagccgccgcaaggagggcgcggcgtcctcgtcctcgtccgcgctgaaggcgcgcaaggaccggaggtctcgtcacaagcgccgccgacgcgagcgggagcacttcgcgccggcggtccccgtccgacgacgacagctacagcagcacaagctcttatgacagcgaccgtgaggtgtctggcagatctcggaagcataagaagagcagcagatcaagaaagtctagggagagggagcgaagcaaagataggcatcataaacgagacaagagtaaacacaaagagaagaaagagagtgagcatgctgatggccctg

SEQ ID NO: 21181 - DNA, 392 bp, Sorghum bicolor
  Clone ID: 12775672
gcacgaggccgcgtccgagggttgcagccctccgcatccgccggaccccaccgggaatggcggcgtgaggaggtccccgtacttactagggttcttcggcccgggaggccaaggggacacctggttggactttggagcgaggggcccgccatggcgaccgacgtgcccatgaccccggagctcgagcagatcgacggagagatccacgacatcttccgcgccctccaaaatggattccaaaagatggataagattaaagattcaaataggcaagctaaacagttggaagatcttactgtgaaaatgaaggagtgcaagcgcttgatcaaagagtttgatcgcattctcaaagacgaggagtcaaataatccacctgagatcaacaagcagct

SEQ ID NO: 21182 - DNA, 593 bp, Sorghum bicolor
  Clone ID: 12775687
gacggaggtacagacatgaagtttcgtcactaatgaggcaactctccgagaacaaacttgctagaaaaaaacaaggaccacgtgaaggttgatgcagctgtgcattccctgcaaggtgagctagaggatgagaaacgtctgaggaggcattctgaggacctccacaggaagttaggcatggagttgtctgaaataaagtcagcatttctcaagtcagtcaaggaccttgagaaggagaagaaaggaaatcgcctcttagaagacctttgtgaccagttcgcaatgggcatcaggaactatgaagaggaactcagagtggtaaagcaaagaaatgtcaagagttatgagctcaactttgataattcagtgctccatatttcagaagtatggcttgatgagcgaatgcaaatgcaaaatactgatgtcaatggggaattggctcataaaaccacaataacggaaaggctcagcagtgaaatacaggcctttcttctttctagaaaagcaggtagctctatgaataatgaaaaacatatgaatgatagtactagattgcgacgtcaatcccttgagtctgtccatttgaatggagc

SEQ ID NO: 21183 - DNA, 383 bp, Sorghum bicolor
  Clone ID: 12775710
cgagcctcgctctgctgtgctccacctccattgctctcacgacgatcccatcgacacatcgatggagttgttcgcaggccgaggcgcagcgaccgccgacgaaggcggccgagaccgccgcttccccgagcctccgaggcatcacgctcctgcagaagactcgtcgtcgtcgatgctggtgatcagggacgcgctgctgtcgcagctccagaaggaccgacttcgccaggagattatcctggccgagctcgccaagattgagcgcgccatggccctgcgcgccgccgacgtcgaccgtgctaaccccggggcgcccttctccttcctcgagctcgaggagatgccgcgcagcagggacgcggttggtcctgcagaccatggta

SEQ ID NO: 21184 - DNA, 543 bp, Sorghum bicolor
  Clone ID: 12775736
tttatatgatgggtccagaggatgtgccaaaaggaagtacaaatcaaattgttcacgaagacactaaacgtgtggatcatctggtgtcagttactgcgatggggctagctgatatctgcctgaatgtttccttatgagaattgacatgccaagttgggagtgaaagaagtgagaatgtgtcagatttgaaggaatattctgaaatggacatactcgatacagaaggggcaatctcctttcagaatgataatcaaagcagtgaagttgattggtcgggtggaaacgtcccactggattccattagttccactacaactcaaactaatgaggaggagggcagctcagaatcagttcatctagaggaatgggaggattgctcaaatcagtgtgtactgcagttagtctctatggagaaggcaataaaatcagcaagtgacaagatggaagataaaaaggtggaaagtgaggagttggatctctggcagtatgagaatacagcagaagctgctaaaacaatatgctctggtgtaaaatttctgtggt

SEQ ID NO: 21185 - DNA, 218 bp, Sorghum bicolor
  Clone ID: 12775745
ctgaatcaatgtgtaacaagggctactgtcagtgactattgctcagaaactgatactgaaggtggttgcgcatcacataatatgcttgatgctgagaatgactatgggcaggctgcaaataactactctgaggaacctgatgatgatgttacgcttgcttcacttgttcatacgagtggaagctcatccaagattaaggcacccaagatatggagttc

SEQ ID NO: 21186 - DNA, 498 bp, Sorghum bicolor
  Clone ID: 12775746
gcacgaggcttttccttctccctcggatcggcggcagttcccgtcccgtgtccgtgccccacagggacaggggacgcggctcgcctacttccccgccaatccacctgccctagtgagccgctagcggagagaagaagacatggggagcaacgccgccggcaagccgcctgccgctgccgccgccgccgtgtcgtgggaattccacgcgacggggcctcgcaacctctccacccccggctggagggacctcatccgctccagctggagagatccaaactacagaagaattgcaatgtcatgcttcgtgcaggccgcatatctactggagctggacaggcaggagagcagaactggtgaagctgcactcgctcccaactggtggaagcccttcaaatacaaggtggtgcgccctctcatcgattccagagacggatcaatctatggggcacttctagaatgggaccagctctctgccctcacagatctgatagtggtcaa

SEQ ID NO: 21187 - DNA, 438 bp, Sorghum bicolor
  Clone ID: 12775747
gcacgaggatgagattcgcatcaggggttccaggcgccaagattggatatccaggcgagctaatccgtatctggtgaacctctacgatcagtggtcggagactcgaagcagtagtaggatttggaccagagccccgagatgcctgactccagggacggcaggagggcggccctcgctgacctctcaagcggggttggtggcggagggttctttatcaggagggtggcctcgccgcgagccctggcggtgaggggtgctgggaagccgttggcgcggcgttatatgtcaccatcgaggaacaaggagaacctgctgccaatttgggcgttgagggccacaccggcaaagaggagcccgcttcctggatggtaccccaggacgccgctccgcgatattacggccattgcaaaggccattcagagaagccgtgcaaggatt

SEQ ID NO: 21188 - DNA, 562 bp, Sorghum bicolor
  Clone ID: 12775763
catgcctcctgctcgacaaggcgtgcgcgtacacgacgttcgcgacgacggtggcggcggcgcaggcgtgcgtgatcgcgctggacggcgcgcacgcgctgcagtggaccaagctctgcaacatctacacccgcttctgcgagcagatcgccggaagcctcgtgctcggcatgctcgccgccgtcggaaccgccgtcctctccgccgcctccgcgcgcaacgtcttccgccactactcgccggggacctacgcggcgcactagatctgggcccaaaggcgtcagctgggccggccgtgcttctccgaagaatctaacactgggccctgacgaaggttcaggcccagatgaagggtgacctgagctattaaggtggagataatagagttctactactactctagagtgtatgtactcctacagtcctactctctctctctctctctctctctcaggtgtgtacttctattttctttgtttttgtgcatttatacactagtggagacatgagtatgtacgttcgtcagtgtattatattgttgttgtataatacacgctaagcg

SEQ ID NO: 21189 - DNA, 511 bp, Sorghum bicolor
  unsure (1)..(511): unsure at all n locations
  Clone ID: 12775767
agcctatattgcaaggcaggcggcaaagagcattgtggccagtggtcttgcccgccgttgcattgtncaggtgtcatatgccattggtgtgcctgaaccgctatcagtgtttgttgacacatatgggacaggcaagatccctgacaaggagatcctgaagattgtgctggagaactttgacttaaggccagggatgatcatcatcgaccttgacctgaagagaggcgggaatggccgttatctcaagacggcggcatatgggcactttggcagggatgatccggacttcacctgggagcttgtgaagcccctcaagtgggagaatccttctgcctgatcaaaaacttgcagccagctctacattggaacctttttttttaattacctatataaagttgcaatgttacttttgatgccagtctacccgtcaccacatgttatctcacttccccactcactgctcgagtagaaagtgtaagaccttatgcatacggttatctctttcaacaag

SEQ ID NO: 21190 - DNA, 476 bp, Sorghum bicolor
  Clone ID: 12775786
ccagtggcgcgaaggctaccgtgtgccggattatgactgaacgcctctaagtcagaatccaagctagcaaccggcgggtgctgcggtgggcgcacgcgtacggctacttcctggacccggagcgcgacgcggccaagcgcgcgctgttcgacgacctgcagaaccaggccaaccggtggctcgagtgcctccacgccgccgccgagctcgagcggacggacctcttcggcgacggcaagggcaagaaggcggcggacgcgcctgctgtggttgttgacgccgaggcgttcagggcgtacaggcagaaggtggctaacctcaccggagtgacgcgcaagttcttgggcaacctcgtcagggcgttcgagaccgacctgccggaagtggcggcggcggtgaatcccaatccggcgaagtagtagataggcgtagataagaggatgtatgtatggattccccatcatccgtgttcgtgt

SEQ ID NO: 21191 - DNA, 665 bp, Sorghum bicolor
  Clone ID: 12775795
ggcaagtaattactgcagtgaaggaagcatgccgagaagctgttcttcagagcaagccaaggcttgtgaaaccaatgtacttttgtgaattgaccacaccgacagagcagttgggtgctgcgtttgctgttctgggtgattgtcgggccaaggttctgaaagaggagatgcaagaaggaacatctttgttcacagtgcaagctcacttgccagttgccgaaagctctgacttccctgagaaacttagaaagcgaacgtcaggtgcagctagtgcgattctagcatttagccactgggaggttatccctcaggaccccttctttaccccgaaaactccggaggagattgaaagattcggtgatggctcaagcattggaccaaacttggccaagaagctcatgaattctgtaaggcgaagaaagggccttcatgttgaagagaaagttgtggagcatggcacgaaacagcgaactcttgggaagaaagtgtattttattcatgagaataggaagttggtgccttgagctccagattttgccctggtaaactgaaatataatcaaatgtgcaaattatatatagggatttaaagttctattgtacgagttctttttttttttgggtgtcgtgcttatgagttctatggagcaaaggatcaatataact

SEQ ID NO: 21192 - DNA, 579 bp, Sorghum bicolor
  Clone ID: 12775798
gaacatagatgacctgtacaagtactctgatgctaaagacaagctggaattcatggaaagaacactgagatggcgccatcttgctcctactgctccaaatagtctaggctgttatccatacacagacaaggatcctttccttgttgaaagttgcccgcacgtctactttgttgggaatcaagataaatatgaaactcgattgttggaagggccagaaaaacagaaagtgaggctaatctccatcccaaggttctctgagagtggagttgctgttatgctcaatctgaggaacttggaatgcagcacattgagtttctctacaagctttgatgcctgaatatgctctgatgtttggaagtgcaaaagatttcatgaacccatagggggttcatggaaggatgtatttgtattagaacagccagaacagttctttattagatgtatgatgatgaccttaggttttgccaattagatctgttggaatgcagttgttgtaagttgtaaccacaactgaaactgaggccatgtgtagtgtgtaacaatcaaattgggtgtcatgcctcgtttaacaatcacaat

SEQ ID NO: 21193 - DNA, 184 bp, Sorghum bicolor
  Clone ID: 12775833
gtgttgatcatattcagattttgccaacaggccagaccggctatcacagtgagaagaagctaaccatcgatcaagaatttgagcagtatttttcgaacctcatgctgtaggttatagtgcataattttgtgacaaaaatggcgttgggccctccaaatatggtttgcttgatgggcaaagtggc

SEQ ID NO: 21194 - DNA, 507 bp, Sorghum bicolor
  Clone ID: 12775847
caccgattctcactgaaggaccacggagacggatgccatgtcaaatgcttagctcgaggcagggttgagctcgtcgctttcagaggatgcaattaagggaacgaactggtgcttgagaggcagtgaaagaagattaaaataaattatatagtgtggagtatatgttgcatatagagcaatatatggggtgaggtacacagggattaagtcaagaacgaaccgcgtgctaggctttaattgcttgagcaaacatgttttactattgctcaagcttgatatgctcatgtggtggttcgggtattgacttaagtctctggcaaagaaagtgaaacccctagggcttctcctatattatatatgtagcagtttgttttaaccattttgtgaagagttttgttttttgtttttatttctctgatatagggaaatatagagagatgagagatatgcatgccccctaggatatatggctttgtttttgtaacgtttgtgtagtgttataattcg

SEQ ID NO: 21195 - DNA, 364 bp, Sorghum bicolor
  Clone ID: 12775858
agcagtggatcagaggcgccagctctcattttctttccccctcttgagcgctgttgcatcagcaacagcgcccaccattgtaacaggtgagtagtgtagggccgtctacttgctgatggaatccagtagctgaagctgaaggaggcaggaacacagttacgcagagcactcaattctctcagaccagaattcagatcacgccacctgctgccgcactcgtgtcacgctctagtagattgctgatgatggctgagttaggttatttgccagcaacggcaagtttttgctggtgtaaacattggctaggttggtgtgaatgaaatgtatgaacttctgttgttgttgatgctgctgctaaattgga

SEQ ID NO: 21196 - DNA, 595 bp, Sorghum bicolor
  Clone ID: 12775919
gcatttcgtgagccatggccgcaggtccataccaaatgccaacgtgccctctgaaataaggaaccccgagcaaatgcagaagagcaggcagcagaaggcaatggaaatcacgcggttgaagaacaaatccgcgaaggatggaaaattccagaacaagttccagaagaacaggcggcccgatgggaacgggaatgggaaagggaggggcagcgggaaaggggccgggaaagggttcagcaaaggcgctggtggcaaaggtgggaaaggtaagggcaaggtgaaagggaagggcgggaggtgattgttgctctccggtcttcacatttgctgcagaagcagagaggatgttttcgaagcagaatggtggtctaagattgatggagcgatgatgttcaagttattattgcagcagacaccacctttgctgctcacagttttgtttatttgtggcggtggggggaaatatggcaaagaccataccgtaagaactattatgatgtgtgtcttgatgtgagtgagcatcaatgaagaagcacggttctcctggccagtacaatttctgtgttgcaaacggacatggtttttctgagcctta

SEQ ID NO: 21197 - DNA, 528 bp, Sorghum bicolor
  Clone ID: 12775950
gccgcgccggcgcacgacgcgcccaggcggagcaagaagcctgcccctgtccctgcccggcctgcaggcgccaggaagcctgcgccctccgccgccgtcgccgccgcagacgccgacaccgccgccgcccaccggatagcgcacctcgccagaggcggactcggcgtccccgtcccaccaggcggcacgccgcggcgcacgttcctgccgtaccgcgaggagctcgtgggcttcttcgccaacgtgaatggcatcagccggagccaccaccatccgttctgacgtcttgtcacaggcgaacaaactattcgatcagttacacaccctgattaattattcagttttcagggcttggattggattgcggcaaaaaaaaaaaatcaaattctactgtatgtgattatcgctttttttactagtgcgtaagtaggcggttatagctaatgatttcgggttagaaattgatcacgcgactggtggtggtgaggtgaagcatactccctccataccagatttaagtgacgttct

SEQ ID NO: 21198 - DNA, 698 bp, Sorghum bicolor
  Clone ID: 12775964
atctcatcctcatcaatcagccggacttagatggctatcaatgcttgttgggagacataacactgcccccacaaattatgtacatgcacctggatatattaaatgatggacatgcttttggagccactttattcaaggtgcttaggatgtgttctggtttaagaagattgtcatttgaattctacacaaatagcgacttggaggcacaagttacttgtccaccaggttgcatttgtgatgagcaagaaaagtggaaaactgaggaattccttttgaatcgcctccaaatagtagaaataattgggttgagaggatctcaatatgaagtaagctttgtaaaacaagtattccattgggcgaaggctgtaaaatggatgaaatttactttcaactcttcagtgtctgaaaacatggccaaggagttgtgtcaggttttccaaagcttctccaggccagaaatatgtatggagttctacaacactagtccaaattaaaacactagttctccaggccagaaatatgtatggagttctacatggagaaggacatgatcaaggtgttgtatgcgcaagaaaactaaaatacttgtccaaattactttcatgtgccagacaaagaatatgtagtttctttttctaaaaatggaacctttttcattgtggtatgtatttactaccatgcatagatttagaacagga

SEQ ID NO: 21199 - DNA, 470 bp, Sorghum bicolor
  Clone ID: 12775978
gtctccggcgacggcgacgcgctagccacagccccagccccagccccggtactgtcgtcgggccgccggctcgtcctcaccggcccggtccggtcccctagcccgaacgggcgggagaaggtgttccgcgtcgagaagcacggccgcggcgggtacaagctggtgtggtgcggcggggccgccagcggcagcacgtcgtcgtcgtgccaggacctgggcgtgttcagggacgacggggaccgccgcgcgtggctcggcaccaccgagacagaccgggctcatgccgtcaagttcgagaaggcagcgaccgtacatgcttgaatcgtgatgcggtgctttgtgtagcgtgcgtacatatgcatgccgaataattatggatttgttccgttattggcgacgaacttgctgtgagtactatttctatgtgatcagtccagggcccagatattagataaagggtaataaagcaa

SEQ ID NO: 21200 - DNA, 535 bp, Sorghum bicolor
  Clone ID: 12776048
accatcttatatgctggtattgtggtacttggtattgcctggtatattatgacgtggtgcataaataagggagggcctcacttcgtttctgtcttccaaccgttgcaaactgtgatggttgctatcatggcttctattttccttggtgacaaactctacattggaggagttataggtgcggtggtcatagttgcgggtctctattgtgtattgtgggcaaaaagcaaggagaccaaaagcgacagcgacctgctttctgaaagaagcttggaacagaatctccttcatgaagaaaattacattatgagggaagatctataagaatttttctcctacgaactatggtcgtatagcaggatgtgtaggtgtgtgtttatagaggcgagtatacttgtacctacgactgtttctacgctgtgatttgaaagtaaagttggaatattagttttgttccgtaattttagcacagtggccattggataagtggtagtaaggtcttgtttagttcaccctaaatttaaaacttttcaagatt

SEQ ID NO: 21201 - DNA, 590 bp, Sorghum bicolor
  Clone ID: 12776058
aaagcttctcatgagacctgccaaggttgtaagagacggtgaaatgtctgcgccttgtggagcgatggttcttcatccagaaggcggtggcaacatccacgccttgagagccattactccctgcgccatcctggacattttgacgcccccatactcttcagaggatgggaggcactgctcctacttccgtagatgcccaagatcagacccatcgggcgttttattgaaccgaagaaagggatctgagtttgtgtggctggaagaataccagccacatgataactttatcattagaagggacctgtacacgggacctgctttaaagttatgatgagaaagaagatcatgctcccaacaatatatatatatatatatatatatatatgcttcccttaattagcttcttaagttatcgattgagaggcctttagttgtgcaaagcatttcatttccccttactgctttgcacttttatttatattacagacagttaactattatgcacgtacggtctggtgtatgtattttaagataatgttattgtacatttcatgatgtaactcactgacagaacattatttatataatta

SEQ ID NO: 21202 - DNA, 534 bp, Sorghum bicolor
  Clone ID: 12776063
aacgatgcatgttgtcgtccgtgcaccaacttcaagcaaacagtctgataaaagagcagcaaagaaagcgaaagatttcaggtgcggttgtgccattatgtgacagcattgtgaatagtagcaaagagaatgtggctatgtcagtttcctccacccttttctgctcttgctagagtgttgtattatgttcaaggcgctttctccttttattttgttttgaagtatcacgagaaaacttcagcagctgttaagtgccctttaatcatgagtttgcatcaagcacaaaatttgatggcagctggctgctatttgcccttaatcttgagttatgccaagcacacactttgaaggcagtcattagtgtctagactacgatgtctgtcttatccaattgcccatggtttcacgttctcttctatatttattatgctactccaggtgacgtgtttaatatatgccttccatgctagatgaacttttcggaatggcattctaactgatcaatttctattatgtaccactaaaaccaattgt

SEQ ID NO: 21203 - DNA, 499 bp, Sorghum bicolor
  Clone ID: 12776078
tcgaaaccacaccactaggctctcgcgctcgctctcgctcggcacgtcccccgcgcgcggccacgcgacttgtccgaagcgccggcgctagcgagcgagcgctcggttggcgcgcctcgcgcctgcctgcatcctagtagcaacaaagcgatggtggcggcgagggtgtcggaggtgaaggcggagggcgtgctgcggggcgcgtgcgcggcgctggcggcggcggccgcgctgctggtggggctcagcacgcagacggagacggtgctgctcgtcaggaagaaggccaccgtcaaggacgtccaggccctctgggtgctggcgatggcggcggcggcggcggcggggtaccacctgctgcagctgctcaagtgcttctacctcggccggcgcgtcggcggcggcgccagcccctgccgccggagcagcagggctctggcctggacatgcctcctgctcgacaaggcgtgcgcgtacacgacgttcgcgacgacggtgg

SEQ ID NO: 21204 - DNA, 603 bp, Sorghum bicolor
  Clone ID: 12776121
gtggcagcctgttggaccacttgggttatcaaggaggaggaattccacaacatgagtctccaacactggatcatggacttttggttgatccagctgatgcaattccgtatttatctacagattctccgcccttcatgaatgatcaaatcacttgtaatgtaatgaaatctgcttcagctagtccagaatcttcgatgaaacaacctcaagaacctcttaatatagaatctgatgtacagaatgatgcagctgaacaaaatgttcacaattgtaactctgaagaacagatcacttctctgggctgtgatgaacatcagaacacagaagtgattggtgcagtgttgcctccaaagcttcttgaaagcagtggtaatgatatatcaaactttcaaccagaaactacatattctgatgcctaccatggtgactctttgttaactgaaaatagtagtaagggttaccagcttaacaatagtggggctcctgctgatgatattccaaactctcctgcgcttcagatggaaaatgaggagatggaaaagttacatgagacttctcacaatgaaaacagtgggtcagaggatgatcaaatgaatggtagga

SEQ ID NO: 21205 - DNA, 552 bp, Sorghum bicolor
  Clone ID: 12776153
gcacgaggcacggcaccgcaccaccgtccaccgcggcaccgccaccgatcggtagcaaaggcaacgcgcgcaacgcaaccgtgtcctcgtacggcagcagccggagagagagaaatgggcgaccacgagggtcgcggggacgattttgagaagaaggccgatcagaagctctccggatggggcctcttcggcaacaagtacgaggaagccgccgacctcctcgacagggccggcaacttcttcaaactcgcgaagaactggagcagagcagcttcggtatacaaaaagattgcagattgtcatttgcagggagatagcaagcatgaggctgcctctgcttatgttgaggcagcaaactgctacaaaaagttctcaccacaagatgctgcacaagcacttaacaatgccgttaatcttttcctggaaatcggtagactgaacatggctgcaagatacagcaaggatatcggtgatatctatcagcaagaacaagatttagagaatgctgcagtctacctgaatcgagctgctgatctttttgatagtgaggga

SEQ ID NO: 21206 - DNA, 317 bp, Sorghum bicolor
  unsure (1)..(317): unsure at all n locations
  Clone ID: 12776166
gcacgaggcacgccggtggggcggaggagcatgctgaagctggcgcagcggatgacggacaacttctgcgcgggcgtgtgcgcgtcggcggcgcagaagtggcggcgcctggacgagtggcgcggcgtcggtgagggaggaggaggaagcagcgccgggaacggcggcggcggcgccgcgggcgagggggaggaaaaggtgcgcatgatggcgcggcagagcgtgggggcgcccggggagccccccggcgtggtgctgagcgccaccacgtcggtgcggctgccggtcacgtccccgcancgcgtgttcgactacct

SEQ ID NO: 21207 - DNA, 528 bp, Sorghum bicolor
  Clone ID: 12776238
tgagctttcagctcttgcattctcggaacgcctgaaatcatttaggccaaagcagactattttagaggctgagggtgaagctgctaaagcacggaattcgaagggttctaatcaatggctagatgtgatgaagaagaaacgagaagttcatgaggggattataaatttagttcaccaaaagagttcagaggatccaaggccagaggttgaagaggtggatgacatttcaaattgggagaaaaaagaagtttgtggcaagaaacggaagttacagagctttagagatgaggactactacataagtacagtacctcaaaaccaacatttggaagctgggttgtcagtgagggacaatgaaggatttgttgaaaatagattcgatgcggctgttcttgatttagttgatgatgaagcttctggtatgcaagcacagaaaactcgatatcactggatgaagaacaaatttgtcaagttgaatgcaggggatcgtgtcactgctactggaaagattaaaactgaaggtggtgc

SEQ ID NO: 21208 - DNA, 438 bp, Sorghum bicolor
  Clone ID: 12776270
cccgcgggcacggccgccccggccgacgagctcttcgccgacggccggatcaggactttctacccggtgttcggccgcggcgccagcagccacggcggctgcacgacgcgtccggctgctccggcggctgccccgccgcgggtgaggggccagctgggaaagttgttcctggaggaaacccgggagcgcaactcctccactagctccacgtcgtcgtcgtcgtcgtcgtcaggggccgccacggacgacgacggcctggaaggcgtggcgccggagagctactgcgtgtggcgtccgggctcgtccgcgtcgccctccccgccgacgccgcccaggaagagcgggtccacggggtccatggcgcgatggctccgcatcagcgacctcgcggtgggccgcagccacagcgacggcagggagaagttcctctttctcgcc

SEQ ID NO: 21209 - DNA, 592 bp, Sorghum bicolor
  Clone ID: 12776285
ccggaggtacgcttcaaccccgcccccgacggcaaccgcatccgcgacgcgctcgacgcccgtgacgacgccacgtcgtcgctccgccgcatctccgtcaccgccaaagacgccgcctctgattccgtggcggcctggcttccgtccgccgcgcgtcacctggtcggtgaccttatctaccgcgtagtgggtccgaagagctccgtcaacgaggaggacgaggaggatgaagatgaggaggatgaggaggaggtggtgaaggaggccggggagagaggcgtcgttgagctgccctgcttcgagaaagcaagcaagatgcagctgaagctaaggtatcaacgcctcgccttccctctccagggcgtcttcaacaagctcaccagccttttgctgagccgcgtccgattccacggcccgggcgacctcggcaatgctgtctccgagccacactccccgtgcttgcagaagctctgcgtcttggaatcccgcgggctgcacaatctctccatccactctaagtcgctcctgaagataaagctgttcaaccttggtaggagcttgcggcagctcacaattgtcgcgccgaatctca

SEQ ID NO: 21210 - DNA, 402 bp, Sorghum bicolor
  Clone ID: 12776298
gcacgaggcgaactcagagtcacagagtcacttgacactactctcctcgtcgtacatacgcaagccaacgcaaaactgcccacagcttcagccatgggcatcccgcgcgccgcgcgcctcctcgtgctcgtctccgtcctagccgccatctccctctcgtgcggcgccgcggcggcagcactgccgccggtgtacgacacggacggccacgagctgagcgccgacgccgactactacgtcctcccggtgccccacgggagcgggagcggcggcgggctcaccatggcgccgaacggcctccggtgcccgctcttcgtcgcgcaggaggccgacccgctccgcaagggcttccccgtgcgcttcacgccgctgccgcagcagggtgaccgcaccgtgcgcgtc

SEQ ID NO: 21211 - DNA, 483 bp, Sorghum bicolor
  Clone ID: 12776306
gcacgaggggaagcggatcttcgtcgccgcgaggaggcgcgcgccgagctgcagcgggagctcgagaaagagcgcagcgccgcggcgtcggcggccgaggaggccatgtccatgatcctgcgcctgcagaaggagaagtcggcgcttgagatcgaggcgcgacagcagcgccgcaccgctgacgagcgctgcgccttctacgaggacgaggtcgaggagctccgggacatcgtgctcgtgcgggagcgcgaggcgcgcgcgctgcgcaaggaggtggacgcctaccgacgcctgctcgggcttggccctgccgaggatgacgaggaggaggatgacgagcaggagatggtcacaccgcatagtttcctcatgtccgaaggagagcccagctcgtccagatcggtcgatgcgaatcggatgcagcattttcggaataattcttctgggttcagcttcaagacgccatcactgcgtgagcaacta

SEQ ID NO: 21212 - DNA, 456 bp, Sorghum bicolor
  Clone ID: 12776313
ctctctctctcccctgttcttctctcgcttttgccaacgagaagcatcgaggcgacgcatccaatccaagcatctcccccctctcatcctcctcctcctcctcctcctcctcctccaaacacaacccgcgattccgcggcgaacatacccagcggtgccgacgactgccgagcaaggcaaataggccaccaagccagcgcctcgcaagcgagcgagcctgccccgggccccggcgcggcgcggcgcctattcgttcgctgatcaccaccaggctagtcaacggccggctgaggccaccgaccctcgctcgcgtgggaggagtgagtgcggacgcggggacggcggcgatggcggggctgccgccggtcgccaggcggcgcccgctcgcgacggcgtcgctgctgctgctgctgttgctcgcggtgaccgcggcggcgcgcgaggagcggggcctcg

SEQ ID NO: 21213 - DNA, 499 bp, Sorghum bicolor
  Clone ID: 12776371
gtcttcctccaacctgctctagctctccctatccccgatcctacaactgtagcgagattgttagtctgaaaattagagatcccatggcgatggaggagggtgccatggcgaaggtgaagctggtagcggcggtgctggtgctggagatgctcatagcgggcttccacgtcgtgtccagggcggcgctcgacatgggcgtcagcaagatggcgttcctcgtctacagaaacggctcggcactgcttgtgattgctcctgttgcctacttcctcgagaagaaagataggccacccctgacgttacgtttgatgattgacttcttcatgttggctgcagtgggggttacattcacacaggggctttatattcttggtttgtactacttgtcaccaacttatgtctctgtcatccaaaactctgtccctgcaatcacatttgtgatggctgctgttttgagaattgaacaggtaaatattaaaagcagacatgggctggcaaa

SEQ ID NO: 21214 - DNA, 478 bp, Sorghum bicolor
  Clone ID: 12776383
ctcatcaggaccgaccctcctcctcctctggcgtcgccccttcttttccttccaagaacaccaggctctagtgaaagggaagctcagtctcacactgacttgaagacaactgctgtcgaagtaattccttttattttgtatagataaggattttatctgagagtggttaaaacgttttggcttagttgttaagttataacaaatgccttccactacgatggatgcaaatgcaatccagaagctctatgaggtctgtaaagtatcattatctgagaaagggcctctatcttctgaatctgtcgacaatgtccgtgctgtattagacatgattaccccggcagatgttggccttgagtgcgaagctgaagctgtgcgtgtttggaggagtccacgggccctgagtaggaaaagagtttttcattccagcccggccatcagataccgtcatatttacgagtgcaaaagcttctcatgagac

SEQ ID NO: 21215 - DNA, 141 bp, Sorghum bicolor
  Clone ID: 13064782
cttcaggcttggtgtgggtttccgcaaatattctttttaggggggttccatggggcagtaaaatgaaatagagagaaattgcagcaattctttgttattttagcaacacttttcttcttccaagagcactatgtacaatgg

SEQ ID NO: 21216 - DNA, 325 bp, Sorghum bicolor
  Clone ID: 13064788
ccgtagtctgcttgatttcgtgccggcagtcctcctccggcgctttgggtttgtaccagactgacgacagagccaatgcccattgtcctgtgaagaaccatgtcatacacttcggcataaatcatcttggattcatggaccatggtggtatacattatacttgcagtacagatactggtatccttggaggttcagtctggttgtaatgcggcgagaatactgattttgctatgtatgtgtatcagatatatatttctcgtgaaaatttgaaaaaaattgtgtggaaagtgcctcctacttgctcttttttttccctttcaaagta

SEQ ID NO: 21217 - DNA, 470 bp, Sorghum bicolor
  Clone ID: 13064828
tgctaacaggaaacttgaataaatccgtcttacgcaaaaaaaaaatagtgaggttggaggagctcatagcgaaattgctggagccactccccaggtcattctgacgccgttctcttggtttgccccataagtgaaaataaaaatcttattgctgcaaacgattctacaaaatcgcaccagtacaaaactggcgtcagcactgagatgttttattgatgatgtactctgtataataggttattggatattcttactaggaagtgcagtgatcagagatgagcttttggttgcagcgtttcgatgtttggtggtgtccgtctcgggaggtcaagtattgtactgtgaacttgtaatttctcttcttaaatgtacgggtagagcgaatagcgctcatgcccgtagagtagaagaaaataataaattctgtcttggaagttggaacttaagcctgggcctggcgccaacacgtg

SEQ ID NO: 21218 - DNA, 491 bp, Sorghum bicolor
  Clone ID: 13064876
ccagctttgtgtttcaagaccttgttcttcccctgtggaaccttctcgagaattgcttcagtcgccaaggacaggccaatgtcttctggagaagcttgcaatgatattatggcatactccctaatattgtcctgctgctgttatacatgctgtgtaaggagaaagcttcgccaaaagttggacattgcgggaggctgctgtgacgactttctttcacatctgctgtgttgttgctgtgcacttgttcaagaatggcgggaagttgagattcgtggggcatataccgaaaagacgaaggttaccccaccgccatgtcaatatatggagcattgaacagctatatgcccgtatgggtagacctgaacttctgtaaagatattaacagaatatctgatgtcgtactgccagagtagtcatactacactatttctgtgtagtatttatgcttactgtctattgttcgtcctggtacttccatgtatatgttggga

SEQ ID NO: 21219 - DNA, 610 bp, Sorghum bicolor
  Clone ID: 13064908
aggtcttttgacaatttccagtttgtcaacttcactgcgatcatgtcaaaaatgataagtcatagcaagaaggagacagagttcgccctttccgcactaatggaaattccattgcaatacaaggcaacattagagcttggaattttaggacgtcgaattggagagtcacctgagcggatttcacttcctcctccctttgcaagttatagcacagtttcaagagcagaatcatcttgggcaaatagctatcgaagtgtgccttctcatcctagggaggagccaactgtagattcaactaacacagcatcagttacatccccatcagctgccgaaagtagagttttagaaccccagatgtgcccagtttgcctttccaaaccccgggacatggcatttggttgtggtcaccagacatgttcggaatgtggaccgcaagtcgcagattgccccatctgtcgaagacccattgacacgagagtaaaattgtactaattatttttgggggtagaactaggtttaacggagcacatgctaggagtagaatccttcgaaataaaactctattggactattaatggtgtagtgcgccattaatttaataaatcagccc

SEQ ID NO: 21220 - DNA, 464 bp, Sorghum bicolor
  Clone ID: 13064918
cagagaacagcttccttagagtaaaggtcataaactttgggtcagatgctgtgaccctgacaatctccacgactggactccaggccagtatcaacgctctgggatcaaccgccactgttctcacatcagcaaacgtgatggatgaaaattccttcagtaacccaaccaaggttgtgccggtgaagagcgatatgagcaatgctgcagagcagatgcaggtcacgttggctcctcactccttcagctcgttcgatctcgccctggctcagtccaaacttgtcgccgagatgtgagctaggctggtgcaggcaaactgactggcagctacactaggagcatatacaaaggtgtggtgtgatacgtaggggtggttgttaccatcctcataaagctttgtgtaatgtatctttttttttaaaaaaaagctttgtataatgtaacattatgcagatactattaaataa

SEQ ID NO: 21221 - DNA, 125 bp, Sorghum bicolor
  Clone ID: 13064924
aacatatgcatcatgggtggcatagtggtcacctaatgcccccaagtttgacctcgtggtggggattgcagttggtagtgacctctccagtatagccttcgctaatgtcatgatgtgggactcac

SEQ ID NO: 21222 - DNA, 549 bp, Sorghum bicolor
  unsure (1)..(549): unsure at all n locations
  Clone ID: 13064950
tgaattcctgatcattaagaaagccatatttcctagagagaagccaaccgttcaaaccgaaaacaactcntaatgcaggcagctcaagcataccaggttgctctcaaggtagtaactgaagaagacagtaaacaattgatgtaaaggcatattctaatagatgtgtatctaggtgtgcattttatttgtcctcacttagttgtgcgttataacaaacatgtagctgcatagtgccaaaagctacttcattcagttgttttgttttgcagctatccctgctaaatggcattagactatccggaattcgtcgcgaagctcagacctaggtgctcttcctatccatgtagtgggtccttggctactaaagtttcacattttagaaggtgtagaacactttggtattatacagtttagtgatttcacttagcactagaggatggttgtgtattttaagctttcacctattttttggtggcttccatggatatcaagcgctagttacatatgtggagacaagcatagtttgatttttaagtgacatgattgcat

SEQ ID NO: 21223 - DNA, 377 bp, Sorghum bicolor
  Clone ID: 13064970
gggtgtttttcatggtgtatttaatctttccactggatatcctatatgttcgcagcatgtgagggactttcttcaggaacaacgtgttggtttgggagcccaacgatgccgaggaagcttagagcatctttcgccgccgcctctatgcctgcagacgcctcccaactgaagcagctcttccctccggatcccgctaccacccgcctgttgaagctagctgtgtgaactatgcacagatgtcttttgctcaagtcagccgtgtgaacaatgttgaagctacctgtgtgaactatgtcaggacagctgtgtgaactatgtaatgtcatttgtgataactatgcttctgtcaggtgtgtgagaaccaagttaaatataac

SEQ ID NO: 21224 - DNA, 581 bp, Sorghum bicolor
  Clone ID: 13064984
tgagtgcacgagtgagagcatcatgtcaaggaaccagaggaaattgcacagcagatgaaaagtgcagagctctttccgttggttagaataaaaactaaccttctttccgtaacaacagcatatgatgaaaattaacaagattcaacggaaagataaaaaaaaagtgtcattcatttgagaggggaggagagggagggaaaatgtcatggctgatgaggaggcacgtgagcaggagccaaagtgaaggtgaaagaggaataaaggaaaagaggacgacgagaaaagcacagctttgtctggatacattttgagtgcatcattttggagggaatacatactaagctacaagctttaggaggtgtttggcagaactcttcacgagaagctcctctgttttttataaaaaaaaacggcttctctagaaaaacgtttggcagggttcttttggaggagctagagccggagcccgagaggagccctgccaaacagtcccttagttaaagttgttgcttaaactgttgctttgaaccgtttgtgcagctcattcttatctttattgagcttaaagaggatgaagactt

SEQ ID NO: 21225 - DNA, 408 bp, Sorghum bicolor
  Clone ID: 13064998
cggccgccggatcaccggctgcgtctttggtgacgtcaagggcaagtcccagctgccagccatcgtcgacaagtacgtcaacggggacctgaatataaactttgatgggttcataacacacaacatgcccttctcggacatcagcaaggccatccagttgctggaggaaggcaagtcccttaggtgcgtgctccatctctgatgggccaagcatgggagattattgtccttgtttaatttggttatgacaaaaataaatatagaatccagtgttgagtggtacaattcacatgtgcatcagtgctatttttcttgtaaagaagggtgtgattactgaagagaactattagcagtaggaaacagagtaattcacatgtctttgtgctgtaatatatctcaagttgtctc

SEQ ID NO: 21226 - DNA, 231 bp, Sorghum bicolor
  Clone ID: 13065026
cttcattcaagtatgccatgaattaggaagcccatgatcacctaatctaccttatgcagctgctgcttatcctaagcttgaggcctccatctagcttggtgttgtcttgtctcagctcctagacaaaaacttcctgtgaatgtgcaatgatgttccatcatattttatgctaagttgtagagaacaatataccgcttctctatgtctgtacatatttgcactgtataatgt

SEQ ID NO: 21227 - DNA, 590 bp, Sorghum bicolor
  Clone ID: 13065028
accagcctggggatcaatggtgacgagcactgttccaggtgcctctcagtatgctgcgtatagatttggtgttgctatacgtcttcttaagaacgtttgtctgtggaaagacatccttgcagagcatgttgttgagaagcttgctttagacgaattactgagagggaagattcttcctcatatgaagagtatcatcctggatgttcacgatgcaatcactagggctgagcgaatagctgcctcactttcagaagtttggcctaaacaaagtcaaaagctgcagccttttgtagatctagtggttgagttgggaaacaagctggagaggagacacacgtcaggcattagcgaggaagagacacgtggtctagctcgtcgattgaaaaacgtattggtcagccttaatgagtacgataaagctagagctattttgaagacgtttcagctcagagaagccctttagctcatcctggatgtagtgtgagaaatccagttttgacacaggttctacatccttccattttacagagatgttgtaattctgttatctatacatctgatcataactttagtccagggctgaggatcaa

SEQ ID NO: 21228 - DNA, 612 bp, Sorghum bicolor
  Clone ID: 13065058
tgtccgcacatagacaccgagcatgtgtactcctgctacagcgcgatggttcaggacgacgacaagtcgccgacgcgctcgacgtcgacgggggtggcgtcctcgggcgtctctgtcgccgcgcacgccgggagcgggagcgggagccccagcccgggcgcctccgtgtccgtgggcgccaataatgccgctggcaccgccacgccggacaaccacagcaacaagaggagacgggagggggtggccaaaaatgcccgaatccaaatgggggcgagatttgattcttcggattagtgcggtgtcagcagggtaatttagtgctggaaagatttttggttttgaggagatctttcccgggatcaaagggggcatggcagtgtaaggaccaaagctgaaacagagcaaagctcttgctcaaagcgggaaggcctcagacagacctgacttcacagggtacctaccatggtaaaagtgagtgaagtcaaggagtagggagtcaattgtttttttttgtgtgtgaatacccgtctgtaccaggctaccagctaatcccggctgtctgtcatcttttctttctctgtttattaattattaatagccagtcactgcatc

SEQ ID NO: 21229 - DNA, 381 bp, Sorghum bicolor
  Clone ID: 13065108
acagaatgccacacttgcatttgaagcagccatttggaggtggatgactccaatgaagaggaagcagccatctgctcatgatgtgtttgttggtaactggaaacccaccaagaaggacacattatccaagaggtatcgtggctttggtgctgccatgaacatcctgtatggtgatgccatctgtggtaaaggatccaccgataagatgaggttcattatatcccattaccaacattatcttggcttgatgggagttggccgtgagcgctctgaagataacttggatagtagtgtccaggtggctttcaatccatcatcagagagttgtgacttctaagaatatgtttcaaaaatccctgaatgctaccctgtatatctggg

SEQ ID NO: 21230 - DNA, 546 bp, Sorghum bicolor
  Clone ID: 13065156
ctgcttgggcgcacttatgatcgagatcatatctgggagggttcctgatccagatgatcataaacccatatgcagctgggcttctgagtatctgaaagacaagaactacagcaagctggtggacgcgtcgctgaaggagcacaaggatagcgagctggaggccgtctgcgaggtgatccaagagtgcatcgacgccgacccaatgcagcggccatcaatgagagatgtcgtgggcaaactgcaaccacctctcggcatctcgccagaggcagcagcgccgcggctgacgccgctctggtgggcggagctggagttgctgtcggtgaagtcaacttagtggagaacgctgtatatactgatactgtaccaacatgttccaacgcccctctctaacaagatcacatattgtataggaggctcctgctgttggtgctaccaacatttctactgaccgtaagtggtcatggttgatgcagagaagtgttgtaaaaatgtatcgatgtaactcattacatgctatctttaccaaggaggggaaatacagta

SEQ ID NO: 21231 - DNA, 540 bp, Sorghum bicolor
  Clone ID: 13065174
gggcttctcggcgctgcccacgcactgcctgcagctgtgcgcggggttcttcgcgttcgcggtgctggcgaacctggcgcgggacctcctcccccgcggggtcgcgcggttcgtgccgctgccgatggccatggccgtgccgttcctcgtgggcgccagcttcgccatcgacatgtgcgtggggagcctcgtggtgttcgcgtggcacaagatcgacagcaagaaggccgcgctgctggtgcccgccgtcgcgtcggggctcatctgcggcgacggaatctggacgttcccgtcgtcgctgctcgcgctggccaagatcaagccgcccatctgcatgaagttcacgccaggaagctagagagcaagtagtagaatccgtgtcgtagaactacaaatcaggcctgttctaatgtccatatgagctggtggatcgtgtacggtgtatatttgtaaaatgggaatttgaaggatgacaagacgaagtgcttatcgtctagtagcataatatagtacagtagagcattaataaaactcttacat

SEQ ID NO: 21232 - DNA, 266 bp, Sorghum bicolor
  Clone ID: 13065220
gcacgaggcatggctcgcccccgcggcctcgtctgaccccccgccacgcctccccggagagcggcgcccgcgatctcgccggagatgccgccgcctcctcctcccccggcgggggcgcagcagccgcagctccacggggtggtcatcatcacgctccctccatcggaccagccctccaagggcaagaccatcaccggcttcacctacaccgacgacgccccgccccctgcccgggccccggagccggtgatggggtacccgggcgg

SEQ ID NO: 21233 - DNA, 316 bp, Sorghum bicolor
  Clone ID: 13065226
gcacgaggggcatgcacacctctgttcttctccctcctctcgtattcctcccgaattcatttgctcaacaccgcatggcctaaccaaacaccctcctctacacctctgcaccggcgaattaaactgtcctgactggtccgtccggcgaacatggcagcctgccgccgcgacacctttctcgctgtcatcattgggatcaatgcagtcattttggcttccgcggcgaagtacaagccgccggagtccatattggtggattgcggttcagcaaaagagggccaggacgccgatgggaggaaatgggtgactgaccaat

SEQ ID NO: 21234 - DNA, 370 bp, Sorghum bicolor
  Clone ID: 13065244
gcacgaggattgggaatgttgcctggaaagagagggttgatggctggaaaatgaaacaggataagggaacaattcccatgacgaatggcacgagcattgctccctctgagggtcggggtgttggtgatattgatgcatcaactgattataacatggaagatgccttattgaacgatgaaactcgccagcctctatctaggaaagttccacttccttcctccaggataaatccatacaggatggtcattgtgctacgattgattgttctaagcatcttcttgcactaccgtatcacaaatcctgtgcgcaatgcatacccattatggcttctgtctgttatatgtgagatctggttcgctctttcctggat

SEQ ID NO: 21235 - DNA, 386 bp, Sorghum bicolor
  Clone ID: 13065289
gcacgagggttgctttcaaagcaagtacgagttctaccacacagcaacattggccgagtccaacaaaggaccggtgccaatatggtttcactcagttaagcaggcaaaagtacaggaaaaaatttgcagcactgcatgtgacagctacatcaggaaagctagacctagatttcactgacccttcttggaaccaaaagtaccaggaagactggaacaggcgttttagtttgccacacatcactgatatatatgatttggagccaagaagaactacattctctttgaagaaaaacagaattcccctgggtgatggtgatggctcatcagctgatatgtggaacggttatgtaaataagagtgatagagcccttctgaaggtgataaag

SEQ ID NO: 21236 - DNA, 532 bp, Sorghum bicolor
  Clone ID: 13065329
gtcgcacgggggaacactggagccgcgggagaaccagagacgcacaaatcaggcggaggtcccatagctgtccaccttgcctccccacaggatgttccagcctacgaagtgcgagataacttttggccctttcatgccctagggttttgctggggtggatatgaactcagcttaattggtttggttctaaacctctctcgcctttcacattcatatgtgtagtttcgtagcttacttttccctgaggaatagattaaatgtgcaaataatgcatttaggtgtttcctgatctaatgaacaggtacaatatatcattggtttcctgcagtcttagagaggttcagtttaatgatttactaaaaaaagaatttaggtgtttttagaaagtgacaaaaggctgataatttatcttacgcatcaaaggtagtatattgattctacgttagaaaacattagtgccatatacaacagttcacttatatatatttacatgtgctatttttaaatatttggtgatgatgcgtgggtacca

SEQ ID NO: 21237 - DNA, 195 bp, Sorghum bicolor
  Clone ID: 13065361
gcacgaggatggccttcgctgcctccccttccctctccgcactcacttcgtccaccaccgccgccgccgccgccgccgctgccgctggcgccgcctcctactcctgctcaacgccttcttccaacgcttttcacgaaccgaggcctgtccacctctcgctaaagcccatctccccggtccccaaaccacatgcgc

SEQ ID NO: 21238 - DNA, 231 bp, Sorghum bicolor
  Clone ID: 13065415
tggaaccgtagtgtacctgtcatacccatccatctgagtcgtctgaggtctcggctcggagaggagaggccacgaccaccacccacccacccatatggcggagaggctagaggcggcggcgccggccgctgccgacgagtacacgcaggacggcacggtggacctccatggcaacccggtgctccgctccaagcgaggagggtggaaagcctgcggcttcgtcgtagtgta

SEQ ID NO: 21239 - DNA, 141 bp, Sorghum bicolor
  Clone ID: 13065421
gcacgaggcaacaaggcccatcttccttcctcttgtaggctgcaagcagcagtgtcacctctcagtctcatcagtcacacacatggtgggtatgagaggtgcctacggtggtggtggtggtgctaacaatgacagcgagag

SEQ ID NO: 21240 - DNA, 388 bp, Sorghum bicolor
  Clone ID: 13065451
tcttaagatatatttcgaatagatagaaatagtaaatttgaattgagacacatattctatgacagatcttaacttaccctctattttcgtacctttagtaggcttagtatttccggcaattgcaatgacttccttatttctttatgtgcagaaaaataagattgtctagaaacgacggggccaaattttctcaatgtatttccaggatcataatacagatatttttttgtgataagtagtataatatgatagggtatgtagctctttctacacacaaatgaaaacgtctatggatgcagatataagctacgagcataaatgcatgcatatgcgtagccgactatagcgagtttttttttattttaagtggatccactaattgttttga

SEQ ID NO: 21241 - DNA, 402 bp, Sorghum bicolor
  Clone ID: 13065462
gcacgaggctgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattgtctccaccccgtaggaactacgagatcaccccaaggacgccttcggcgtccaggggtcacggaccgaccatagatcctgttcaataagtggaacacattagccgtccgctctccggttgggcagta

SEQ ID NO: 21242 - DNA, 356 bp, Sorghum bicolor
  Clone ID: 13065464
tgccactccagttcgttttcgttcagttcctgtgtgcagtgcaggccggtgcgtgagaagaggtagccttcagcgcgaaggccgcagggccgcgcgggctgggagagataccataccatggggcaccactcctgctgcaacaagcagaaggtccggcggggcctgtggtcgccggaggaggacgagaagctcatcaagtacatcaccacgcacggccatggctgctggagctcagtccccagacaagcagggctgcagcggtgcggcaagagctgcaggctgaggtggatcaactacctgaggccggacctcaagaggggaagcttctcgcagcaggaggaggccctcatcgtcga

SEQ ID NO: 21243 - DNA, 406 bp, Sorghum bicolor
  Clone ID: 13065470
tttttttttttccctcctccgtctttccttcggcctctcctccggttcccccgcagccgccgccttgttctcctcttctcgccgccgttccgcagcgcgactaggctcgcgccctttgcatcctcctcccagactactcgtgttacaatagtattgttactgctcctgtcacggcactcctgcttcagaatttactggctgcctcacacgccatgcacgcagcatgttcgcgcaatcgcctgagcgagctgcttcgctcccggagccagaggcactggcggtgccaatgcccgtaccaactctcgtcggctcgaggcatgacgcgcggccgcagcgtgaaggaccggagcaagaagaagcgcgtgcacgcgctcgaggtggccaccgagcgctggaaggtgctctc

SEQ ID NO: 21244 - DNA, 394 bp, Sorghum bicolor
  Clone ID: 13065530
gcacgaggctctcctcatcggcatgagcggcttcttggcggtggtcggcaagatcggcaccttcctgctgtgggtgctgttcctggtcttgcagactgccaccaggatcgtcggcagcctccttgccagcccagctgagcagcaggaggaccaccaacaggaatcggcggtgggacggcgcaggtcaccgccagcctccccacgtcgcgaactttacgagccggcgtctgcgccgccggcgcagctgtgggacccgccgccgcttccgtaccttgcttttgctcccgctgcggatgagaacccgtcctccagcttccggcggcgagccagtgcgccgctgccccgagcggatgaagacgttgtcgtgtcatcgagcgcttactcgcgtcccacg

SEQ ID NO: 21245 - DNA, 265 bp, Sorghum bicolor
  Clone ID: 13065542
gcacgaggcagcagctcctctcggccgactccccgcgtgcctcgccgcggtgcaccatcgcgccgcgctggcggagcctccacggggaaggcggatgggagggcctcctcgacccgctggactcggacctccgccgcgagctcctccggtacggcgacttcgtgcaggccgcgtaccacgcgttccactcgctgcccacggcctcggcgaggcaccgtgggctcatgctccccgaccggtcctaccgccccacgcgcaggctctt

SEQ ID NO: 21246 - DNA, 304 bp, Sorghum bicolor
  Clone ID: 13065544
gcacgacgcgcatccggggagctcgcgtcttccttcggatggtggatgcatgctcaaccagagttgacaagtggaagcctatgggtaccggcaaggacgcagcccctcgcgccatcctctgcttcttgtttctgttctgcttaggctgcaaatgcctggcatcagagttggaggccacccagacggcgaccctcacggtcgatgcctcgccgcagcttgctcggaagatccctgatacactatttgggatcttctttgaggagatcaaccatgcaggagctggtggcatatgggctgaacttgt

SEQ ID NO: 21247 - DNA, 474 bp, Sorghum bicolor
  Clone ID: 13065548
gcacgagggagcgctgatcatatccatgactcacgtgagcttgtgcctaaaattagtatgaaggcccatgatggaggtgtagttgcagttgaactttcaagggtgatggggagtgctccacagctcattacaataggggctgataaaactttagccatatgggatactgttactttcaaggaaataaggcgcattaaaccagtgcctaaacttgcttgtcatagtgttgcatcgtggtgtcatccccgtgcaccaaaccttgatattctaacttgtgtcaaggactcccatatttgggccatagagcacccaacttattctgctttaacaagaccgctctgcgaattgtcatcactagttcctccacaggttcttgcacagcataagaaactgagggtttattgcatggtggcacaccccttgcagccacatcttgttggtactggaactaatattggtatcatattaagcgag

SEQ ID NO: 21248 - DNA, 458 bp, Sorghum bicolor
  unsure (1)..(458): unsure at all n locations
  Clone ID: 13065568
gcacgaggctggacggcatatgaagactcatgcaggcggttttacttcatccatgctgaatcctgatggtgactatggcaatgttctttcgaaccatgggggatcgagttatcagggccaaccaacagagacaatgtacgcacaatacttgcaggcaaaccctgattccccccttggttcagctgcaagcatgagtcctttccaagggaggggttttactggttcaggacacttggatagtcctggatatcaaaaagcttaccttgggtcattatttgcccagcaaaagctacagtatgggataccatacctgggcaagtctggtgctcttaatcaaaatatatatggcaacgatcctgcatttggcattggaatgacttatctaacaagcccaccatctagtccgtatatctcatctcctcaaggccatgtcangcaaggagatcgactgactcgac

SEQ ID NO: 21249 - DNA, 484 bp, Sorghum bicolor
  Clone ID: 13065580
gcacgagggaaaactttccccttttcatttcgtttctagcggcggcgctcctggtcccggcttccggcagggcggcgctcctgctcccggcgatgcgacgctcgtgctggctggtgggtctcggccacggggctcgggctcgcgcctcacgggacgcggcaacgcgcgaccgcggcaagccgcgagcgtccacagcgagtcggcgagctaccggcgatgcgacgctctagatcccgacggtaggctgtgctgctgctggcgagtcgcgggttcgcagttgcagcctcgcaggacacggcatcgtgcgtgaccatggcaagcggagggcagccgcggcaagccacgacccatgagcttccacggcgagcgcgcaggcatccggtgcacggtgagccggtgagcgactggcgtttgcggagcttgaatccagcatgcggcgggcgtgcagatccaggcctgcaagcggtcattggctccctgggcg

SEQ ID NO: 21250 - DNA, 418 bp, Sorghum bicolor
  Clone ID: 13065584
gcatgaggcaagacgctgctgacgaggaagaaccacttgacaggggtggagtacagggacgaccccaccatcctggcgtgggagctgatgaacgagccccgctgcaccacggacccgtccggcgacacgctgcagcgctggatggaggagatggccgcgtacgtcaagtccatcgacaagaagcacctgctcaccgtcggcaccgagggattctacgggccgacgagcccccaggagaagctgaacgtcaatcctggcatttggaaggacaacaactacggctccgacttcatccgcaacgccaagatcccagacatcgacttcgcttccatccacctctaccctgacacctggctgcagcagcagcacgcgacggtggacgagaagctcaagttcgtgaagcggtgggtcgcgtccc

SEQ ID NO: 21251 - DNA, 319 bp, Sorghum bicolor
  Clone ID: 13065586
gcacgagggatactggcaatttccaccaaggttcaaaataaaacagaagttcacttggcaacaaaccatacggagccacttattcttcactggtctttggcaaaaaaggctggagaatggaaggcacctccttcaaatatattgccatctggttccaaattgctagacatggcgtgtgaaactgaatttactagatctgaattggatggtttgtgttaccaggttgttgagatagagcttgatgatggaggatacaaaggaatgccatttgttcttaggtctggtgaaacatggataaaaaataatggttccgattttt

SEQ ID NO: 21252 - DNA, 382 bp, Sorghum bicolor
  Clone ID: 13065592
gcacgaggcctaaccctagcaaccgcgagtgatggcgcgcccgaggggtaagaagcgcacggcgtcccaggcggccgccactgattcggtcgagctggaggccgccgccggtgcttcgagcaagccggaggcggcggcggcggagccggcaacacgggggcgggggaagcgcgtcaaggcgccgcccaagcccaagcccgagacggactacttccctgagaagagaaatctggaggatctctggttatctgctttcccagttggtactgagtgggaaaacattgataagataaaggagttcaattggagcttcgaaaatttagagaaagccttagaagaagggggagagcttcatgggaagacagtttatatgtttggaagc

SEQ ID NO: 21253 - DNA, 457 bp, Sorghum bicolor
  Clone ID: 13065604
ggcacctgatattgccaagaaagaggacaaaaagagtgatcggcatgagaaaaagaaaaggaaagagaaagataaacacaaagagaagaaaaaggagaaagaggcaaagaaggagaaaggggaacataatcacaaagagcatgataagacaagagagaacaatataagttatccaatagatagttttaacttgaagccctcggtccctcctttagccccagcagttgatgatggaaaatctgttgtgcctgatgagaacctgaagaagcgaaagaatcatgaaatgaatggttacttacaaagtgagtttctagcttttcttttttttgcacttaacagcatatgtagtcttgtatgacaccattatccttttttatggcgctttatattataagacttctgatgctatacagacaatcttgaaatgcgggctacaaagttgccgagaccagccctc

SEQ ID NO: 21254 - DNA, 479 bp, Sorghum bicolor
  Clone ID: 13065614
gcacgagggatattgacaaatatatatggctggcaactgaccgccattacattggtgaattatgcgagtctcgacagagcatactacgatcagatattgagatcagacatctggaacttggacagacaaatataactgatgctgcaatcaaaactcaaaaagctacatggatggcactggctcagccctcagcgcaggaagcaacgcaggtccatgactcgcagcaccttgaatccgtccaggctacaccccagcacgagcctcggcttcttcggcgccggtgggcagtgcaggtggcgttcagttccagtgctgttcgccgccgatggcggtgaaagctgtcgtggaccttcgtcgtcgtcgccgccgctgccgtgggagcacctgctggatggttctctttcccaggatcttcctttgcaaacccatggtgaactcggtttaacctgcaatagcggagtagaaagggagattgttag

SEQ ID NO: 21255 - DNA, 249 bp, Sorghum bicolor
  Clone ID: 13065624
tgctcgcgcacaggtacccggcggtggcgtcgggcccggcggcggccgcggccgtgtgcgtgctcgtggacctcggcttcggcgctgggggcgcccacgccaaccaccaccaccaccgcgaggcccgcaacatgctcgccgtgctcgcctgggtcttcctctggtgggtcacgggcgccgtcccgctggccgtcgcctccatggcgccgctcttcctcttcccgctcttcggggtcgcctccgccgacg

SEQ ID NO: 21256 - DNA, 369 bp, Sorghum bicolor
  Clone ID: 13065630
ctcaccactagagccaagaaagagctccattcatttcccccctctctgtctctgaaaagcaaaccagctagcaaagggccggagagaagagaaccaacaaggcatcaaccatcaatatcgatcgaagacaccatggcagccaacggcaagagcagcttggcgaacggcgcctcctccacccagggaaagcccatcaattgcaaagcggcggtggcgtgggcgcccggcgagccgctggtgatggaggaggtggaggtggcgccgccgggtcgcctggaggtccgcgtgagggtgctcttcacctccgtctgccacaccgatctcagtttcttgaaaggagagaacgagctgcagcgcaagttcccccgc

SEQ ID NO: 21257 - DNA, 524 bp, Sorghum bicolor
  Clone ID: 13065640
gcacgaggattgatgagtgtgctgtcaatgttccacggccatgccctgggcactgcatcaacatacctgggaattattcttgcccaaatgaaatgcctccgagttcttctggccctgtcgtactagttgttggtctaagcactggggtcgttattgtggtcataaccatcaccggcacatatttgatccttgaaagaaagaaattggccaagatcaagcggaagtatttccatcagcatggtgggatgcttctgctgcaggagataagattaaagcaaggaactgccttctccatcttctcagaagcagagctcattcaggcaaccgacaagtttgatgacaagaacatcctcggccgtggtggccatggcaccgtctacaggggcacgctcaaggatggtagtctcattgcggtcaaacgctgtgtttcaatgaccagtgagcagcaaaagaaagagtttggcaaagagatgctcatcctttcccaaatcaaccacaaaaatattggcaaactacttggttgc

SEQ ID NO: 21258 - DNA, 374 bp, Sorghum bicolor
  Clone ID: 13065662
gcacgagggtcattctcgtctatttcgccgggttttcttccacagccgcctttccagctgagccggccgttcctcgctgcacacgcccggcgggtgtccgttaggtgtccgtcgtggcgggccaccctatggggactgctgttgtggctcccccttttctcgcccgtgctggctgtgttctggttccggaggtccgcgtggttgcgttctgctgtcccgtgtttggtttctgggtgttattctcgttgcttacatttcttgtcccttgtagacttttctcattctggactgaagctttcttagggatcatggggcttcaggtattgcaacggaaaagtcttcctgtaggagtcgtgagagcgatctgcatgcaa

SEQ ID NO: 21259 - DNA, 411 bp, Sorghum bicolor
  Clone ID: 13065664
gcacgagggctattgaatctaggagaatcaaatttgatagttccaaagctcagaagccgatgaagatcgatcaacatcctttcccaacaaatatgttggatgctaagggaaagaccatggtcttgacgtcggaagcagctgaaaggaatgcatcggtagatcctcagcatcaaattactgctaccgatgccaaaggaaagggcttgatccaagagggaactaactcgggaaggcctccccgatctggttttgtgataactcatagaaggcctcaggagacttggcagcaacgtgaggatcggtatcggcgccagcaagaagactatcgtcgggaagaagaaagacgccgacaggagtggaatcggcacaaggatcactggaactgccccattctttatccattgctgggag

SEQ ID NO: 21260 - DNA, 540 bp, Sorghum bicolor
  Clone ID: 13065666
gcacgaggcttacctgtctgctgcatcaaatgctgcccaagcagcagcagctgctgctagggaaagttccaacctcccacctgagttggatgagtttggtagagatatcaacatgcagaagcgtatggatcttaagcgcagggaagagaacaggagacgaaggaaaacccagtcagagaccaagagattggcatctgcagtgaaaaataagggcattgagaagattgaaggagagctaagcactgatgaaagtgacagtgagagcactgcttatgtttccagccgggatgagtttcttaaggctgctgaccatgtgttcaatgatgctaaagaggaatactcgagccttagaactgtcaaggacaagtttgaaggctggaaaactcaatacccctctgcataccgagatgctcatgtagccctgagtgcaccgtctgtgttcaccccttttgtgagactggagctcctgaaatgggatcccctccatgaaacaaccgatttcttcgacatggattggcataagggtctttttgactaccg

SEQ ID NO: 21261 - DNA, 373 bp, Sorghum bicolor
  Clone ID: 13065698
gcacgaggcctccgccctgctgctctcctcccactggacgaccaaaaatcttttccttcacttttctctcccttttccccgcgcatgcacgggctctgattgacgccatgggggacgccgccgccgcagcggcctccacgtccgctcccgacacgcccacatccatcctcatctgccgggaggacggcggcggctttctcgccgacgccgacgacgatggcgacggcgcggacctcgtcgtcgcccgcgacgaacgtctgctggtcgtggaccaggacgaggagtatgtcgcgctgctcctgtccgaggagagcgcgtcaggcagcggcggcgccccggcggaggaaatagaggagtggatgaaggccgcgcg

SEQ ID NO: 21262 - DNA, 425 bp, Sorghum bicolor
  Clone ID: 13065700
ccaccgcggccgccgcccaggcgtccacgaccggagcccagccgccgccggtggatccgcaggcgcacgtgcccgtgcagggcgccggcgccgggagcggcagcggcgtcgcgcgaggctgccggcaccacgcgtacagccgcaagcagaagtcgctcggccttctctgctccaacttcgtggcgctgtacgaccgggaggacgtggaggtgattgggctggacgacgcggcaaagcggctcggcgtcgagcgccgccggatctacgatatcgtcaacgtcctcgagagcgtcgggattcttgtgcggagggccaagaatcggtatacatggctcggattcgggggagtccctgccgcgctgaaagaactcaaggagagggcgttaagggagatgtctggattaccggtgttactgccaatggag

SEQ ID NO: 21263 - DNA, 431 bp, Sorghum bicolor
  Clone ID: 13065794
cttccgcgggagaatccccagagaatttggagggttgtttgctctagaagtgctagatttgagcagcaacaagttggatggaacaattccagaagaaataggggctatgccactgctgaaacaactatcccttcatgataatcagttccaagaaggcgttcaagccatagctgatgatcaggaaggatgcttgagcagaaaactagggtgctggtctttgctgtacaagtcggactttaaggattggatatctctcaatggtctccgagagaaatataacaccaatgtaccaaatttcagtgaggcacacgtcatgaagaacttgcagtcatttgcaagtgccatgcgccgcaggcttcttagtgaaactgacaacctgcctgctcttttgggaaatgatgctaaatcttctgatccacaaaatccaaaag

SEQ ID NO: 21264 - DNA, 257 bp, Sorghum bicolor
  Clone ID: 13065806
gcacgaggcgcctttctcgccctctttccggctttctcacacgtgcttcgccttctccgctcctcccctccctctccgcccgcgtcctcgcagcggcggcgtcgaccggcagcggcgttcaactgcgcccccacgagccacgagcaggcttcttggcccggtcgatttccagtgacttcagtctagctcagtaagcatctgattgactttgaggtgacagacaggtcctatgctgccttactgggatgaaaggcggc

SEQ ID NO: 21265 - DNA, 306 bp, Sorghum bicolor
  Clone ID: 13152047
gcacgaggctcaggagcaacacggcggtaccttgtcccagcaatcagtgatgatgttgaagcgggaccttcagctccaactgatgattccttagatcttcagtaccaagccaagtctccaataatccgcaaagcagttgataaactggaagttatggtgaagaaggccaagagagccatgactactacagctgatacaaccactcaagccttggttgctgagtttctgcatggctttgaagatgtcttgcaagatcttggtgagatccagaataatagtgacttagctgttgcaccttttcattcg

SEQ ID NO: 21266 - DNA, 165 bp, Sorghum bicolor
  Clone ID: 13152063
gcacgaggccctttgggttcagtgctatcagtgctgatacgatcaaccctacagagctaatttctgccactggtgatgaagttgtagctgttgtcctcccggctggttgctctgctcgtgcaccaccactgccagcgatccttcggttggtgaaacaggtggctc

SEQ ID NO: 21267 - DNA, 426 bp, Sorghum bicolor
  Clone ID: 13152065
gaacgagggcgcattcctagtcctccttcgtcacttgcctgatattttccctgcttcttccctcattttagctagcttaatggatcacgctccttcagccatagctacgaacgttgattccaccactgaagtgctcgatcccgtagatcctgtctccggccttccactcatcatatgtcctcgttgcaaggacacacgccggccttactgctcttacttgcgtccgcaacaccaagaacgttgacaaaaggttctttaaatggcagaggaacaaggagaaggaccctttgtcttgtaaatcctacttttggcaagatgactatgaggcacatctttgtgccaacggctacgtggtgcaacaggtttcggatcttacagagagtagtctcggagggtcacaggcaccccagtacaaacagctggaca

SEQ ID NO: 21268 - DNA, 259 bp, Sorghum bicolor
  Clone ID: 13152071
gcacgagggcttgctgttgaactcatgtcacggaatgaactcactacagaagtgtcctcgctaagaacagaatgttctaatctgaaacaacagttggaagaaataaaatgttctaaactctcgcacaacaagtttgacgtccaaggtaaaactatgattaagtatggtaactatattcttgctacagagtccattcatcatctccaaactgaatggctgcaaggtttgctacttcttgaaagtaaactgcagcagacca

SEQ ID NO: 21269 - DNA, 468 bp, Sorghum bicolor
  Clone ID: 13152093
gcacgaggtggaaatgtaccatgcttcactggctgcctgggatgaataggtgtgacatcagtgaggatgagacaacagaggctctgaatgcattgtttgccattccagcgactgctgcaactttttcttcgggtggtcctcatactgcaggtgcaggtacaggtacagcaacatccagtgcctataatataagtggacagtttgagaggagtaggaaaaggaaaaatgctccaagcaatggaaaagatctggctgggagttcttaccgcacaccattgttgactccttccatgagcaaccaacaggaccctatcagagatgaaagaactactgatgacatgcactacagttccaagacagattctgtgagcaaacatggtcccaggccagtgagtaaatcagctgatcttgtttctgaaaagctgaagcctaagcacaggaatcacagtagctactcagatgaaggag

SEQ ID NO: 21270 - DNA, 532 bp, Sorghum bicolor
  Clone ID: 13152104
gcacgagggttcagatgagctcagagttggagtcgagcttgattctcgagctgatatactggtaagtgaaattcttgattctgagctgttgggtgagggtctcatacctactctacagcatgcgcatgacatgttattggtgaaaaatccaaagacagttccatatcgagctactacatatggagtgttagttgagagcgtgtccttgtggaagatgcatgatctgcacagcaatgaagcaaatgctgaagatggtgtgtggcttactcccagtggaacacaaaatgtcctttctgtgaagtcacaacaacatgcgatgcaatgtgatgctctggcagatgaaataagattgctgtcagaacccttcaaagtttttgaatttgacttttcgaaacggccagatagtcgtcgtgaaacaaagattgagataaaagcaactgctgatgggcatgctcatgctattgtttcatggtgggtgcttcaactggattctgctgagtcaatcttttactcaactgctcctagatgggtg

SEQ ID NO: 21271 - DNA, 442 bp, Sorghum bicolor
  Clone ID: 13152112
ttcggcacgagggtcccgtctcgtctcagccgtctcgctcctccgactcctcatcccgccgccgccgccgccagcggtggacgcggagagccgtcctcgaccacccgccttctctccccgactctccagaccccgcgggtcgcggcgagcattccgggctccgggtcgtcgggagccgccggcggtttcgcgcggatctgaggctgcccgggctggagaattccgcggctggactcgggatgagttgatttggcgagtttagctgtgcggagggagaggagttccggccttccgggagggagaggttgttggtctgcgaggggttcgtgtgcgggagtgcgggcgggcgtgcgacgtacatgtacatgcgccccggaggccgccgccgtcgctgcttcgtcgtcctcggggagcgatgatcgagcagttcgtcaacttcgtc

SEQ ID NO: 21272 - DNA, 439 bp, Sorghum bicolor
  Clone ID: 13152126
gcacgaggacgagtcaaaatctcgacgactaaaagggggcaccaactatgacttatcatagtcgataccccctcgggggctaccagagggggtgatcccccccaagtatcgaaaaagccaaaaaatcctctcttccctacttagtaaaccttgcgcggtcgagtagttgaggcgcctcgagccccttaagggccgagagacaacgagcctgagaactcctatgcccccgggctatggaaactctactcgcttcctcacccttaaggcgatcgaggctgttgtaaacaaaaggctaaacaaggaatacgaacgtaggcgcaaaaagaaacaaatgagcctcgagcggaaagacagataagaatttgacaaccacttaaaagacgtcatactgcttaaagatagtgtaacaaagtactgtacaaaggggcctaggcaccca

SEQ ID NO: 21273 - DNA, 595 bp, Sorghum bicolor
  Clone ID: 13152135
gcacgaggcaagttcatagatgccattgagttcaatacacatagctcatcaactccagttcgtgtcacggccgcatgggctttggcaaatctctgttcttgtattcgttttagagcattggaagtgcatacagatccttatgcaggtgtactgaacaaatcaagcatctctcttttggttgaagttgctttgcgtctggccaaagatagtgaaaaagtaaaatcaaatgctgttagagctcttggttatctttcaagatttatcagattcaattaccaggctggcacaataaatgacccaagtaacagtgattcagttttttatggagatccggtgtggctcgaaagaatggtgcaggctttggtgtcttgtgtgacaactgggaatgtaaagggcatcgagtgtttatagcatacttttacttctaatccgtgactcaaacaattataagataaagatgcatgcagctgttgctctagctgtgccagtgtcaaggcttgattacggtagctcattcccagatgttgttcgaggccttgtgcatgctcttgagtcattgaattcaaacaattcatcattaccttcaaatttcaaa

SEQ ID NO: 21274 - DNA, 525 bp, Sorghum bicolor
  Clone ID: 13152141
gcacgaggctaaaccccaaagctgtctctcaagtctcagcgatttcaaagcgacaaagcgtgaagaagctctgttcgcgtcgtcgcctccgcgtccgccacccactcaacaacgcggcggcgaatcgcggccggttcgccgccgccgccgaccgccgcctccgttccctctccagcggcccccgctccagaagcaatggcactggacctcgccgtcgggggctcggcggctcgcagggccgagacccaaaccctagcgcccgtgctgctcatgggcccgccgcctccaccgccgatcccaccgacgacgggggtgtacctcccggggcccccgcccccgggggcgctcctgtcgcgcccgatccccatggcgctcccgcgcgaggtcatcgtctacatggacgagtgtcggagccgctccctcctcaagttcatttccgacgcggggattgtgccttcgctagaggacgaacggaggagggagcgggtagtacgcgagctcggcaagatagtgatggagtgggca

SEQ ID NO: 21275 - DNA, 432 bp, Sorghum bicolor
  Clone ID: 13152166
gcacgagggccataccaatcaatgctcgcccttatcactattccccacatcacaaatctgagattgagtcccaggtgcagcagctgttgactgatggcctcattacacacagtcacagtccttttgcctcaccagttctcctagtcaaaaaaaagatggcagctggaggatgtgtgtggattacagaaagctgaatgctatgactattaaaaacatattccctttgccaattgtggaggaaattttggatgaactgtctggagctaggctgttcactaagcttgatatgaaatctgggtatcaccaaattacaatgtgtccatctgatgagtacaaaacagcctttaaaacacatcaaggacattatgagtacaaggtcatgccttttggcttgactaatgcaccagcaaccttctagtgtctcatgaatta

SEQ ID NO: 21276 - DNA, 245 bp, Sorghum bicolor
  Clone ID: 13152174
ctggacagagcaaagaaaaatggaagcccttaagctatattatagggttttggaatctatgtgtagggcggagtcacagatcttgagtgggaacaatcttacatcacttttgtctaatgagcgtttccatcggtgtatgattgcatgttctgcagagttagttcttgcaactcacaagactgtcactatgatgttcccagctgtgttggagaagacgggcattacagcctttgacttgagtaaag

SEQ ID NO: 21277 - DNA, 593 bp, Sorghum bicolor
  Clone ID: 13152179
gcacgagggagagttgggccgttaaatgggccttttgggccctttcttctttctcccccattctgtccactgatcttctatttttttattttcttttaagtatatttaagtatatatacatgtattaaccaccacctaggaaaatgccttgaaacacctaggctctaggctatgggtcagcgcctagaaaccgtctagcgccttcttaaactttgatcaaagcatataattttaggatttgactagtaccatccctgatggagtgtgtcattgctttttatgaggtactttgggcactaccttatgcaattcaaactcaggtcaagtcacataagccattaatagaagctatttctatccatccagacacatcatcatcacacttttctttttttggtgcacttgtgctagaattattgcttagccacctgtgtctcccattttgtctgcaaagctttttagttattgctctataacttgaagtcacttaggaatctatataggtcttttcttttgttcctgtaataaattgggaaagttggtttttgagtcctgcaggctattgaagtttcaaaacgccaaatgaaactaag

SEQ ID NO: 21278 - DNA, 584 bp, Sorghum bicolor
  Clone ID: 13152182
ccaagatagtgtcttggagtgccccattgtatgactataagaatttggcagcagtatcgacatcacatgatgaatttctaaagaaaaaattaccattggccacacctcttgctgcggcaactttgcctgctctaaatttggagttagacacaggttctctacccactctggaagaattaaaatgtttcctgaaagacatagcaccagaggataattgggctcctctcaagagcatgtctgcgatatctattcttaaaaagacaatcagtcaaaggaagatcaaaagtaatgctacattaagcaccagcaatggagaaaacatagaggatatcaccatggattctggtgcatcaagaaagaggattataaactcaatgtttgcatcagaaaattcactggaagttaggggtggaacagatattactttggatgctttggctgcttacctaaaatacctggaaggcacagggaatgctagttggcaagagctgcatgataaagtgcgcttagctgaaaccagatatggtgcttcattctacgtcttatttggtcctgcaattcagcttggagtcatatctaggagg

SEQ ID NO: 21279 - DNA, 330 bp, Sorghum bicolor
  Clone ID: 13152183
gccacgaaggccccagttctctcctttaacgtcttcacgtggaccactacatacagctaattgctttatcgctctttattcctttcgttacgctcgctccttatcatttaatccggagtggcgtcgtcctccgtgaccttcaactgaaacctccgaacgggaatggacgattcagaaccgcagcgtaactgaagacagatcgcgcaaagaccaccgattcgcattcatcctcacttcttagagttggctggacgtccgaaaatccatacagagacgtacgatttgcgcttgtgatctgtacaacaattgaacccccgccgcttcgaagta

SEQ ID NO: 21280 - DNA, 613 bp, Sorghum bicolor
  unsure (1)..(613): unsure at all n locations
  Clone ID: 13152189
gcacgaggcttccctctgacaccccagaggaaaataaaaggaaaggaaaaataagtgttgaggtagtgaagggngaaaaaagatcaaatttacattacaaaggttgagtgttaggagaatttgtaattctctgaggttgagtgttaggagagtttgtgagggctgtggaatgtcgaaggcgaagaccaataatggttatcttggagtcactgagccaatctcgctgagtggaccgactgataaggaccttatgcagacaactgaggttgaaaagtacctttcagacgcaggactctatgagagccaagatgaggctgtcttgcgagaagaggttttaggaaagctggaccagactgtgaaagcttggattaagaaggccactaggatcagcgggtatggggagcaatttgtgcatgaagcaaatgcaaagatctttacatttggttcataccgtcttggggtacatggccctggtgccgacattgacaccctatgtgttggtccaagacatgcaactcgaaacgagtacttcttcagatggcttcacgatatgttagctgagatgccagaagtttccgagttacatccagtaccagatgctcatgtgcctgtt

SEQ ID NO: 21281 - DNA, 217 bp, Sorghum bicolor
  Clone ID: 13152205
gcacgaggcttaaaccctagcttccgtacgcctccggggccccacatggcctcctcgtcgcaatcgggcggcgccggaggcggcgggacgatcgcttccaatccccgcgtctggattgtcgcgggcatcgccgtcgcgggcgtcatcgtcctcgcggaggtggcgcggcgccgccgccggtggctgcggggcatgtctggcacgccacccgacgctg

SEQ ID NO: 21282 - DNA, 470 bp, Sorghum bicolor
  Clone ID: 13152211
gcacgaggcggcgaccgggcgacggaactcgggagctctgaccttcctcgtcccttctggcggctctcttctacggttggtcactcctgcttccttcccgttccagagccatccccacacctggaacggagctccagttcctctatcggcccgagggcattgggtttcttgatgggagacagcaccaggcacgaacgttgggatggctggctgcggagacctgcgttgggattgaacagcctgatgcagattcccgataagattcagagctctcttaaggtgcattttgggcgtttcttgaacaaggatggtcatggccgccgcatgagtgctgaggtatcgtcagagaaggcgaaacagtcgtgttctgctgctgcttcagcttctgcggagtttcgcttggataggcagctccaagcttggtgggacaatcctagctggaccgacgagccgccagaaataaaggtgac

SEQ ID NO: 21283 - DNA, 460 bp, Sorghum bicolor
  Clone ID: 13152213
gcacgaggcaagcctgtcctctcgagtcgaacaccctgaaacccaccgcccgccgatcaccaagcggcggcggcggcggcggcacagcaagatgctatcccgcgcgcggcgcctccatcccgccgtccgccgattcctcctcccaaacacgcctgcaccctcccgtcctgctccgctcccacctcaacacagcgcttccgcccaaacctctaaaaccttctcgatcctcttccgccgccacctctgctcctcaccacccgcgccgccgccgtcgacatcaccgcctccagcggtggtatcttctgacctcccggccgttcgcgtcaatgaagtctgcccgggatgcggaatctccatgcaatcctccgaccccgcgctcccgggcttcttcttgctcccctccgcaaaatcccccgactaccgcgcgcgcctcgcgcccgtcaccaccgacgacactcga

SEQ ID NO: 21284 - DNA, 561 bp, Sorghum bicolor
  Clone ID: 13152224
gcacgaggagacgttcacacaaaattcccgcttcctgtcttacccctccaaaaccctagtccgtcctcgcctcctcgccggcgacgaggatgcctggtatgccgacggacggtgtcggcgcaatcgtaccttttacaggggagcctggccaaggggcgccacccgtgcggccaatccgccacggcgtgccgccgcccatcttccgcatctacgtctcctggtccagcggcaaccttctgcaggtcgcgtgcctccgcccgccgaattcggaaggtggcggcggcacagaggaggtcgttgggagtgtggtggaggtgaatctcggcgacggtggctcggaggccgaggagaaaattgacgaggcggagatgcggcggatcgagtacgggtcggtgccggccttcgcgctgctgcagagcaggaagaacaccctcgcagatgctgctactatgtcgcacttgccctcagtccccgatcatgcagaatggtggcaatatgtgcttgaatacagcaaaaccattggcaatctccttgggaacccagaccctcctgttttcatga

SEQ ID NO: 21285 - DNA, 632 bp, Sorghum bicolor
  Clone ID: 13152226
gcacgaggggtaaatattgggtatggccctatggctgttggccccagatggttagcctatgccacaaatactcctttattgtcaaacacaggccgtctaagtccacagaacctcacaccttcgccaggagtgagcccatctacttctcctagcagtggaagtttagttgctagatatgcaatggagtctagcaagcaattagcttctggtattattgacatgggatataaaacattttcaaagtactgccaggaacttctgccagatggttctaactcccctttgtcatcaagcccaggcaggagatctggtaaaattccttccagtgtgcatccactggaagctgacaatgcaggaatggtagtcatcaaggatttcacttccaaagctgttgtctcacagtttagggctcacacaagtccgatatctgctctttgtttcgaccctagtggaacacttttggtgacaacctctgttcatggccataacataaatgttttcaggatcatgccaacctgcattgctaatggctcaggcgcaacgcgctatgattggacagcatctcatgttcatctttataaactgtatcgcggcatgacatcagctgtcatacaagacatctcgttcagtca

SEQ ID NO: 21286 - DNA, 497 bp, Sorghum bicolor
  Clone ID: 13152229
ctcgcccgctctcctgtctcctccccacccttcccctccctcgggcggcgtctcgtcgggagtaaagggggctgctttgggcgcggcgcggcgcagcccccctcagatctgggccggcggcggtggcggcgagcggcaggagcaggacggcggagggcgggatgaagtcgtcgctgaggacccggcaggagccgcggcgggtcagcaacggcgtcatcatcggcgccatgctgctgtccctctgcgtcctcagcatcgtcaaggccagatactgcgccacccccttcggcaaggccgaggaccagctccaggagcagatgaactccagcatcaggatggagccggaggagtcgtcgccggccaggacgcccggagaggaggaggacgagcaggaagaggaagaagaagaaaacggggcatcggcgacccccgccaccaccacggcgcctgcggtgacgaagacgacgccgacggccgtcccggccaccgccggcaac

SEQ ID NO: 21287 - DNA, 567 bp, Sorghum bicolor
  Clone ID: 13152236
gcacgaggcaaagatctggaagcaaaacataccgcagagaaggggcatgcactcaactggtccatgagactattgcaggcaatgacaacaggggcaggaggcagttgattggcctcgatgttatgggttcagagaggagacaagagcagacaacaaatgatgccactcaagaggtgcaaagggaacattctgaatctgtgattcgcagggaaatgggtaatcaagtaactcacgtggaatcggaacagccaggaagccacagagttcatgcagggaaacaaaaaggcttggttgctgcttcaaattcagttcttcaacttaggcgtagcaaacgtttggcaaaagattcatctgctgccacagacagacaacttgtcatggacactgaagtaattcataggcaaaatgttggatgtcaagctgtttctccaaatggcctcatgccaatgaccattatagatgctgaacaaacagaaagtgagcctgatgagcagctggttgtatctccagaacgttcgtctgatctgtcagatactaatagaatcatcaacaatttatgtaacagtt

SEQ ID NO: 21288 - DNA, 486 bp, Sorghum bicolor
  Clone ID: 13152241
gcacgaggatcgctttggatggttgctctttttagccctaagaatccaaacattcagcagattcaaggatcttgtgacatccacgaatgaactggtttctgtgttggctgtacttatcattcatgttcctgtgcggctaaggaactttgatataaaggattcatcctactttgctaagaagtcagataggggagtcagtcttattgcttctctgtgtgaaaaatatcatacctcagaagatgagttgagcaaagcactggagaagacaaatactctcataatggatgttctgaaaaagaagccatgcccagctacttcagcatgccaacaggataatttgtctttcattgatccagggagactcattaaaatcaagtctgctaatcctggaaaaagaatatgaaaatgcaattaacacaaaaggcgagctagatgagcgcatgtttgctaatgatgaggacagtttacttggcagtggaagccttt

SEQ ID NO: 21289 - DNA, 291 bp, Sorghum bicolor
  Clone ID: 13152250
ctgcggtagacctcaaagcctcgatcgcaccgcatcttctctctctgctgctcgtccgctccgtcgccgccgaccccgccgccagcttccccttccacctaaaaggacggccgctggcggcctgccccgcccccgacgcgtcggtttccactggataggcgtggggcggcgatccgtccggacctagggttgcgagaccctatagggtactaccctaggagcagccgcctccacgtgggtgaggcggaggagggaggatgtcgtcgctcagccgggagctagttttcctca

SEQ ID NO: 21290 - DNA, 614 bp, Sorghum bicolor
  Clone ID: 13152256
cgcaggctggaggcggccagggcggagatgggcgaggtgagggaggagaacgagcgcctcaagtcgatgctgtcccgcatcgtcagccagtaccagtccctgcagatgcacttcctcgacgtcgtcaaggtgcaggagcaagcatcgtctgcagccaaggtggccgagaagaagctccccgtcgcgccggcgccggcgccgaatcccggcaccgacgacgacggccccgacgacctcgtctccctgagcctcggcaccagggcaaatagcggtggcgcaccccgccgcaaggggcacgagaggtcgtcgtcctcgtccggcaccgctgagacaaccaccgccgccgacgctgatgaccaaggccaccaccagctctccctcggtcttggtttcgcgcgcggaaacgggctgccgtcgtccaccacgacggccacggacgacgacaaggcgagccacgcgtccacggcgcccgtcctgaacctgacctccgacagcagcggcagtgccgacgacaacgacgacgccaagcctgccctggcggccgcgggcacagcccgtaagagcccgagcgccggtgccggtgccggagacagatcagctgacgatgaggtgca

SEQ ID NO: 21291 - DNA, 384 bp, Sorghum bicolor
  unsure (1)..(384): unsure at all n locations
  Clone ID: 13152263
gcacgagggcaacaacaacatgacattctagcacgaagcaccgggcgttgtacgcatcctcggcgtccaggaatcgcgggcccaccactgcccgcatttccttcccccgaagccgagccgtccgcgaagcgaaccacccggccaccccgcgctacctcctccgactccgagcgaattcttcacgagaccccggacttccttctagaacctcctccgcccccgcccaatcccttgaccgggccacgcccgagcgagactactagggggttccggcgccgccgtcgggggtgatggcgctggagctgcgcctggcctcggcttcgccgccggcgggcggcggcttggcgcagncggcgcccctcgccccgccagggaaggagcacc

SEQ ID NO: 21292 - DNA, 356 bp, Sorghum bicolor
  Clone ID: 13152273
gcacgagggcttattccaagtcaagctagccattgctgttgcttggattggctcctcttgcatgtgttaattgctgtgatctcattgcatagagagagcttgcattatgatctctacaaggctcgcgcgcatgggtgcgctggccccgaagtcccgcctttttctcggggctcgtcggggtttggccaccgttggtgacaaccctctcgacaagaaggtcgagatgacccattgggaaaagggtaactacatcaactacaagaagatgtccgagaacttggacattgtccgccaacggttgaaccgtccgctcacctacgcggagaaaatcctctactctcaccttgacgaccctc

SEQ ID NO: 21293 - DNA, 153 bp, Sorghum bicolor
  Clone ID: 13152278
tctccataatgatctctggtgaatgacaatctaaaaccagcaaagggaaaaaggaggacagcaaatgggtgcaggtgattgggctcgggaatgtctggtgctgggtgctggcatcttattaacaaggcatcggtcttctgctttggggaggat

SEQ ID NO: 21294 - DNA, 599 bp, Sorghum bicolor
  Clone ID: 13152280
gcacgagggggagtccagcgtcaaacaaaatcctgcttcgatcttttgacatcttcgctgggcctgtgccgccttccccatgcccgccgtccctgcctcgctgcgccgtcaagccgccagccaagaatccttttttattttctttatcaaaagtttgcgtttgatcggtttcgttcctaggagctgggcgagatgttcttgattcagaaagggaggaaaacgagaggctctgttcctatcgcgattgttggaggatctcgccgtagtttgaggcaatagagaagactagacaagaagccacgagctgagccccgccgccgtcttgctccaactcgaagcgatgtcttgcttccgctgcttcagcagcagcaggaccgagaggggcacgggcgagaagcgtcgagaggggtcggcgtcgccggcggccgcctcgttcccgtccaccgtctccacgggcgcgccctccaacctgaccttcttctccacggcgtcgtcggccgtcggcacgagccactccgaggactccagcgcggtcatgcggccggcggcgagcaagtcgtcgggctcgggctcggtctcggtctcgtcggcgcggagca

SEQ ID NO: 21295 - DNA, 147 bp, Sorghum bicolor
  Clone ID: 13152283
gcacgaggaccacttcctgatgctgcttacacgatgcagtctttgtatgctgatgtggaatgcttcacaggtttcagaaaaccctctgagaaggcatgtataaaactgtgggcaaaaggacatcttcctacccagcacatcttgcct

SEQ ID NO: 21296 - DNA, 565 bp, Sorghum bicolor
  Clone ID: 13152291
ctgaagttaagataccattagataaatgtgccaaaacaaatgatgagtacttagttacaaaaaggagaaacggtgggcatagctgtgatgatgatgatacaggttcaatagaagcaaggtattttggaaatcaagactctgcatggagcaagggtgccaagcatggttttggtaatgctaaacgattattaacgcaggagaagttgtcagaaaagaaaaatcatctctctaccacaacattgaagattagtggtgaaccaattgagaagctcttcctatggggccagtcctcttgtgtgtttactgttggagaagagcagcaggtcctaacttttggtggttttggaggaccaggaagacatgctaggagaaactattcccttctgctcgatcataaatctggttttttgatagaaatgatcttcaaagcatctccttcaccaaggatggggcatacagttactgcagttggtaatagcacttatctaattggaggtagaggtggcccttcagaaattcttgatgatgtctgggttttgctgaccactgggaatacatggtcaaa

SEQ ID NO: 21297 - DNA, 454 bp, Sorghum bicolor
  Clone ID: 13152304
gcacgaggagagcatcctgattacacgattgatggagaagaggtacttggggtccctgacaatactgcaaggtatcaggaccagaggaacatatatccaggcagctccagaattgttcctgcagaaaagagacatggagagcctatatctcaggtcaggcaccaggctcaaaatcttacttccagccatgttattcgtgcaaagcagccatatcaacagaatccggatcgagttattgaggcactgcaaaatcctgttaattttgcactttttagtgaatcagggcgtgttgcagatattaacgatactacctcaacggatataaatgggacagttgggcgatccatttgccccagaactgtaagtgtcgagaggggaatcatgcagactgcccaacagattacgcagaagtcacagaaacaacattcttgttatgtgacatctcttgagcttt

SEQ ID NO: 21298 - DNA, 584 bp, Sorghum bicolor
  Clone ID: 13152306
gcacgagggcccccttcaagataaactttgaacgtcttattgatgattttgtgtttatgtgtttctttgttggcaatgactttcttcctcacatgccaactttggaaattcgtgagggtgccattaatcttctcatgagtatctacaggtcggagttcacatcaatgggtggttacctaactgatgggggtgaggttatattggaccgagtggaacatttcatccagtctgttgcggtcaatgaagaacaaattttccagaaacgggcacgcattcaacaggcacgcgagaacaatgaagagaagcatagaatacagagggagaattctgaggagaatcaatatgtggataaggtgaagttaggagagccagggtacagggagcgttattatgctgagaagtttaaagaagaggcggagtcaaaacccattgatcaagttcggagagatgttgtccagaaatacgtggaaggtctctgttgggttatgagatactactatcaaggtgtttgttcatggcagtggttctatccctatcattatgcgccttttgcatctgatctaaaaggcttggctgaattggaa

SEQ ID NO: 21299 - DNA, 563 bp, Sorghum bicolor
  Clone ID: 13152318
gcacgaggcggcagaggaactgagcaacacagatcgagctcggataactcatcagccatggccgcctctcgccgctcctcggttgagctgcccgtcgccgacccggcggcggatcgagaccaagtccggctgcgccagctgggctacaagcaggagctcaagcgaggcctctccgttctttccaacttcgccttgtctttctccatcatctccgtgctcatgggcgtgaccatcacctacaacaccggcctgcgctacggcggcccggtgtccatgacgctggggtggttcctcgtctccgcgctcaatggctgcgtggcgctgtccatggcggagatctgctcggcgtacccaacctccggcggcctctactactggagcgccaagctcgccggcaaggactgggctccctttgcatcctggctcactggatggttcaacatcgtgggacagtgggcgggtaccacgagcgtggacttctcgttggcgcagcttgtgcaggtgatcgtgctgcttgccaccggagggctcaacggcggcggctacatggcatccaagtacgt

SEQ ID NO: 21300 - DNA, 256 bp, Sorghum bicolor
  Clone ID: 13152331
gcacgaggatccctttcctctctagcgcttgtaggagcatcaggagcttatgccttcttgcacgctgccgtctgtcaagtgagcaattcgtcgaacaccttatgggcatcggtcaacgccaaatctggggcagttgatccatgaccgtccctgtcgttgttctcacgatgaattcggttgttggtctcagcgattgaaccccgttcttttccttgcacactgaaacccgaaatcgcttcttgctaatcggacagcg

SEQ ID NO: 21301 - DNA, 449 bp, Sorghum bicolor
  Clone ID: 13152345
gcacgaggcacctggaaaagtgtctattcttaatgatgggtctattgctgttgaagttggaggcattgagttaggccaggggctttggacaaaagtgaagcagatggcagcgtttggtcttggacaactctgtcctgatcgaagtcaagagctgttggagagaataagagttattcaagcggatacattaagtaatgtacaaggagggtggaccacagggagtaccacatcagaatctagctgtgaagcagttcgtctcgcatgctatgtcttggtcgacaggctgaagccagtcaaggagcaatttcaagaaaagcaaggcaatgtttcatgggacgaacttatttccaaggccataatggttggtgtgaacttatcagcacgagaatactacattcctggtccttctggttcctacctaaactatggggctgctgctagtgaggtac

SEQ ID NO: 21302 - DNA, 309 bp, Sorghum bicolor
  Clone ID: 13152348
gcacgaggggagattctcctcgccccttccactaaagcagccgacggcccgaggcggcgagctcgtcggcgactgaccaccgccggagcagccgccgcctcctgctgggcctgtaccacagctcgcacgagcggctccggtggctgcgccagccgccactgtgctgtcggagggcggctcggaggacttgcgccccctcggcttctctgcgcccgccgcccctccgccggcgtgatcgaggatggagctacatcgtgaacttcctgaagctactctgaatgccataaaatttgatctcatgaccagcac

SEQ ID NO: 21303 - DNA, 542 bp, Sorghum bicolor
  Clone ID: 13152350
gcacgaggctgccgcagccgccgccctgcccgcttccccctcccgtcgtcctctggtcaaagccagcggctcccaagatttgccgctgcttcccttcctggaggaaaatcaagcctgagcggcgagaaatcaaggaggagggagggagtgagggaagcaagaggaaaggaagccaagcccttgcggccgtgccgtgcctgctccctcggggcattcaattggcgccaacagtgggcgggtgggcggctgctacagcacggcggcctccataaattagctccccccgcgtcggccccttccgtccccctgtcgtctcgccccgtgtcgccaccgatcggcccgtcgtcgatcacgcggacgcccgccggagcatgcgcctcgcgggcctcgtccgccggagaagaaccatcatcatcatcagccgcagcgccagcgcccgggaggagatgtagctctagctccgcggcccgcgaggaaaaggaacggggaatgaccgttacggcacgcgggaggagcggcggcggggtcgggatggaggagaa

SEQ ID NO: 21304 - DNA, 605 bp, Sorghum bicolor
  Clone ID: 13152354
gcacgaggcaactctaagaggtcctgtagtaggaatattgacaaatcagagggtgctaattgcttctgctgatcttgatatactatcaagcagctcaacaaagtttgatcacggtctcccatcatatcgatcaatgttgtgggttggaccagcacttatcttctcaagcgcaactgcaataagtatgcttgggtgggacaacaaagtccgatcaatcctctccactagcttccctcgttcagtattacttggtgcattgaatgaccgcctgctacttgtaaatccgacggatataaacccaagacagaaaaagggagtggaaataaggggctgtttagttgggcttcttgaacctcttctcattggatttgctaccatgcagcaacactttgagcaaaaacttgatctttcagaagttctgtaccaaataacctcgaggtttgatagcttacgcatcactccgaggtcattggacatattaactaaaggacctcctgtttgtggagaccttgctgtatcattatctcaagcaggacctcagtttacccaaatcatgcgctgcaattatgcaatcaaagctctccggttctctactgctctgtcaa

SEQ ID NO: 21305 - DNA, 451 bp, Sorghum bicolor
  Clone ID: 13152356
gcacgaggaatgtgcccttgcaatcccgagaagaagactcttgttcattaaggcagaaactgtcaaggtccagtcaccaggaaaatgctggaaaacgaggctgccctactcggattgttgtcttgaagccaaattttgacaaacctcatgatatcgaagaaacacttcctctacatcataaacccccccattctgattatagaagccacaaagaatgtccagaggttggtagatggactccgtatactgaagattacatgtgtcaggtgccccttggagattctgaaacattaaatcgtatggggaaggggtctagagaaattgctagggagatcaccaaacaaatgagagctgctaggggtgggagtaggaaacatgctgtcaaaccggagatcagaactcctgcttcagatgaaagatcacagttcctgccatctgttactaaactcaa

SEQ ID NO: 21306 - DNA, 522 bp, Sorghum bicolor
  Clone ID: 13152368
gcacgagggttcagtctccagtgtcctcgaaatctggagagatatcaagcagttcaatgggtggccagtttggttctgctgtgacatcagctgtaataggggcacagaaagataaatttgctgcaaattccagtgctgcagttggatttccttctgtagcttccagccctaatgattccatgcaccgaatacaacagccagctgttgcttcctcaaagaggaaaacaaattctgtccccaaaactcaaccgcctgtgagtgctgttgggtctccagccagtgtttcaaatatgcatgctccgctgaatgcgagcagcccatcgattgggaccacacctatgggagaccaagcaatccttgataaatttgcaaaaattgataatatttcccatcggtaccagcttctcaataagaagaacaaggttgataaaatatctcaaaagaaaaccattaccaatcaaagtcatccagatgtagctagatgtctcaatagttgtttccattctgaggattatatagata

SEQ ID NO: 21307 - DNA, 628 bp, Sorghum bicolor
  Clone ID: 13152369
gcacgaggcttcgcatcaagaggcccaggatcagcgctactagtgtcacagcaggtcgctctattgatcccaggtctcacgcctccgcggcgcaagcgctagatggacctataggtgtttcgtctgagctgaaccatccacagatcggggcctcaacccgatatcatcggcccaccgcagatggcgtgccttcactggggaatgctgcacaaaagagggcaatacagatgatggatgaagatttccaacatgccgtcttcttgagggagcctaaacctgaacctgatactgatgatctacaatgcactgcccctgcatccagctgtcagaatgcccaacctggctgcattacttcccatctgctcaatgccagcacctcagatactccacctgttcatgctccattacagatttcaggtgctaatggcaggacagcccagcattatagaagaagtgcggcgtctacttcctttgttgaacctataaatagcatgatgaagcaacctcaaagtctgggaaatgggttggactatgcaactgtgatgcacaattctgggacaggatctgcagctggaaaaactcaggaagcaccttgtttacacactattgtagcttcatccgctatggg

SEQ ID NO: 21308 - DNA, 138 bp, Sorghum bicolor
  Clone ID: 13152382
cactgaattttttcatactgattaaattgtcttcactcgtgggaaaaatcaagtggcaagggcttgatctggttggcgacccatggtgggaggaatggtaggcgccgtgccgaatggggtgaaagcggatggcgccct

SEQ ID NO: 21309 - DNA, 318 bp, Sorghum bicolor
  Clone ID: 13152383
ctactcttctccctccccccttccccggctctccctcttctctctctaaaaaagtagcgcccggagaaccgagaggctggacaaagaaaggcggaaagagggagcaaaatcttgctttgttgggagtttctttcctccggttccgactcctttgttctccatagggttcttgggttggtggaatggaagctcagcagctccatttgtgcccccgagatcttcgtcgtcgttcccctcgtgagtagtagccttttggtaaggttggcggaagcagggccaggcacacaagaacatcgataaagggagtcccccgttatt

SEQ ID NO: 21310 - DNA, 339 bp, Sorghum bicolor
  Clone ID: 13152385
gcacgaggcggcgaccagcctcaccgcctggccggtttcctggcggtctgcgccgtggccttcgtcgtcacttgcctcctccactggtgcttccctggaggtccggcgtggggaaggtggtggtggacgacgcaggcgcggcgggtcgcggcggccgccgttccggggccgaggggcctgcccgtggtcgggagcatgtggctcatgacgggcctggcgcaccgcaagctggcggcggcggcggacagcctccgcgccaggcgcctgatggcgttctccctcggcggcacgcgggtggtggtggccgcgcacccggacgtggcgcgggagatcctcaac

SEQ ID NO: 21311 - DNA, 551 bp, Sorghum bicolor
  Clone ID: 13152395
gcacgagggcgaggcggaggtgctgccctcggccgaggccatctctggtttccccgccgccaagcgccgcgtggtcaaccggccgcatccgtccgtcctcgcgctgctcgaggccgagcgatccgctcgttccggcgatgccccgaccgtggcaccgccggcgctggagaacatctcgcacgggcagctgcaggtgctgtccggggtgcttccggaccacccgtcccttgcgacagaccccgacaagccgtccttgtatgtgtgcacgccgcctcccctcatggaggggcatggggtgcccaagcagttccagggtcgcctccatgtggtgcccaagcactcagattggttctcaccggggacagttcataggctggaaaggcaggtagtgccacacttctttacgggcaagtctccagggcacactccggagaagtatgtcatgttaaggaataaagtcattgctaaatacttagagaacccaaacaagaggcttgcttttgccgagtgccaggggcttgttgggagcacagctgaactgtatgatctga

SEQ ID NO: 21312 - DNA, 512 bp, Sorghum bicolor
  Clone ID: 13152406
cagacctgaaaagtatgaagattactagtgacgctgagatctctgatatcaagaaggcgagactgttgctcaagtcggtgacgcagacaaaccctaagcacccacctggttggattgctgctgctaggctcgaagagattgctggcaagcttcaggttgctcggcagctcatccagcgtggatgtgaggagtgccccaagaacgaagatgtttggcttgaggcgtgcagtctggccagtccagatgaggcaaaggctgtaattgcccgtggtgtgatgtcaattccaaattctgtgaagctatggttgcaggcagcaaaattggagagtagtgatctgaataagagcagggttttgaggaaaggactggagcacattcctgattcagtccggctatggaaggctgtagttgagcttgcaaatgaggaggatgcaaggctgttgctccaccgggctgtggagtgttgcccgttgcatgttgagctttggcttgcccttgcgaggctggagacc

SEQ ID NO: 21313 - DNA, 460 bp, Sorghum bicolor
  Clone ID: 13152425
gcacgagggcctgcggaggatgtagctatgccaaagccacatatccttgttggtgttgtaaaggagagtgagagctttgacttctgtatgtgcaatcctccattctttgagagcatagaggaagctggtcttaacccaaaaacatcgtgcggtgggacagctgaagagatggtttgccctggtggcgagctggcatttgttacacaaatcattgaagatagtgtttcccttaagaactctttcagatggtttacatcgatgatcggcagaaaggcaaacttaaagttattgatctcaaaggttcgtgaggctggggcctcagtcgtgaaaactactgaatttgtacaagggcagacagctagatggggccttgcttggtcattcattgctccaagaccaagaaaaatggtcctcagctccactgctccagcaaaaaaccaccattcctttatgcttcagg

SEQ ID NO: 21314 - DNA, 512 bp, Sorghum bicolor
  Clone ID: 13152434
gacggactaagatggagaaaactgttagcctggaagaacttcggaagcattttgctggcagcctgaaagaagctgcaaagaatctaggagtgtgccccactacactgaagagaatatgcaggcagcatggaattaatcgttggccatcacggaagattaagaaagttgggcactccttgaagaaattgcaaatggtgattgattcagtacatggtaatgaaggaactgttcagctcagctcgctctatgaaaactttaccaagaccacatggtcagaaagagagttacagggggatgcctcttatccgttgtctgaggaaaaaggtctcttggaaccttctgttcctgatcagcactgcgagggcagattcacctcgcatacttctggttctaattccctctccccctcttgcagccaaagctcaaattccagccatggttgttccagtggttcgaaatcacaacaacatggcagtgcttctcaacttgcagtaaagaaagaagttttcatg

SEQ ID NO: 21315 - DNA, 425 bp, Sorghum bicolor
  Clone ID: 13152444
gcacgaggcttattccaggggtcatcagtactatgtatgagcatcagcgtgaagcatttgaatttatgtggacaaatttagttggtggtattaggcttgatgagctaaagcatggagcaaaacctgatgttgttggtggatgtgtgatctgccatgctccaggaacaggaaagacacgattagctattgtatttatccagacatacatgaaggtgtttccagactgccggccagtgattattgcaccacgtgggatgctctttgcttgggatgaggagtttaagaaatggaatgttgatgttccttttcatataatgaacacaactgattacactggaaaagaggaccgggaaatatgcaagttaataaagaaagaacacaggacggaaaagttgacaagactagtgaaactgctttcatggaac

SEQ ID NO: 21316 - DNA, 499 bp, Sorghum bicolor
  Clone ID: 13152445
gcacgaggccgccgccaccgccgcccccctctccggcgccgtcactgcgagcgcccccgacggggtcgaccgcatcagctccctccccggcggaatcctccgcgacatcgtctcccgcctccccgtcaaggacgccgcgcgcactaccgtcctctccacgcgatggcgccgcgtctggcacaccacgccgctcgtcctcgtcgacgcccacctcctctccagcgcctccatcgggaccggccgcagccgcctcggcgccgatccgcgcgacctcttcggcacctcgcgcagcctcgccgacgcggtgtccaccgtcctcgccgcgcacccaggtcccttccgctgcgtctacctcaccggcaccccgatggagacgcatcccgacgagctcgcgctctggctccagcacctagccgccaagggcgtccaagaactcatttttctcagccgcacaacaaagttggactctgccgtgcatctccctgccacgctctttaga

SEQ ID NO: 21317 - DNA, 556 bp, Sorghum bicolor
  Clone ID: 13152447
gcacgaggcagatacttcaggccaggataatttgaaatctactgctaatgtgcctccgccatcagttattgatcgtgttatgaaagatcttttcagtgatgagactggtaactatatggaagcagaaaacaagtatagtcgtgctatgagaggtgcacctgcagattcactttttggccagttctgtttgcatgcactgtggtttggcaactgcaatatacgtgcaattgctgtactgtggattgattttgtgcgggaaattcgttggtgttgggaggaatcagaaagattgcctaggatgaaaagcacttcaagcattgatctctcttcttgtcttatccaccaaaagttacaaatgctcacgatatgcattgagagaaagaaatcactgaaccatgagaaaggtgctggctacaaagatgagacttcaaatagtacggcagtggacaaatctaggaaaggatcagctggtgttgtgcctaaaatgatgctcctgaatacgtttcaggaaatgcatgctccatatactcaggatgcacctttgatgaccgaagat

SEQ ID NO: 21318 - DNA, 542 bp, Sorghum bicolor
  Clone ID: 13152452
gcacgaggcttcctcgcactcgctccggtcctactgcctcctcgtccacctcctctcccgcgccgcgctcttccgcaacgcctccgtcctcctcgagtcagccatctccaggcactcgtcgtcttcggcccccgcctcgtgcttcatcgacaccttcttcgccgcctacgaggacagcggcacggccgccacgacccgcggcttacacctcctggttcatgcctacgcgcggctgcgcctcccggcggaggccctcgaggcctgtcgctacctcgcgcggcgcggcgtgctgccctcactctccgccttcaacgccgcgctgcacgcggcgcagcgcgctgggtcgttcggtgtcgcatgggaagtgttcgagcttatgacgctgaagcgactgtatgccaacaagagcaccgtcgagcttgtcattggcgtcctgagccgggaaggcaagctcgccaggaccgcggcgctcgtggagaggatccatggtaagaagtgtgcgcctggcattgtggcgcacgtcgcactcacgttgaggatga

SEQ ID NO: 21319 - DNA, 460 bp, Sorghum bicolor
  Clone ID: 13152464
gcacgagggtcagaagtatatgggttaccgtcctacctctagctaccaggatagctccatcaagcccgagggtggccacaacgtcctggtcgacaacttcctgaacgctcaatatttctccgagattagcctgggtacgcctccccagacattcaaggttgtcctggatactggtagctccaacctgtgggtaccctcgtcccagtgcacctcgattgcctgcttcctccacagcaagtacgactcgtcctcgtcgagcacgtacaagaagaacggaaccgagttcgctatccgctatggatccggtagcctaagtggtttcgtgtcccaagacaccctgaagatcggcgacttggagatcaagcaccaggatttcgccgaggccacccaggaacctggtctcgcctttgcctttggccgctttgacggcattctgggtctcggcttcgacaccatctcc

SEQ ID NO: 21320 - DNA, 598 bp, Sorghum bicolor
  Clone ID: 13152474
gcacgaggcttcgccaccggcgaaccctgccttcccgtccttccgcgattcttccgcgtcgtgctacatggcggattcgcgaggaacagcttcgcgcccggcgcgcctccgcgtcatgcgcccggaagtcaaggaatttctgacgagtcctcgacgtagccgccccaagaagcagccgcctccacctccgcctcctcctcctcccccgccgccacggagggagaaggtgaaggagaggaagcagaaggaaaaggagaaggcagcgacgggggaagagaaattcgagcgcgcgcaatacaactgcgccttccaggacgaggacgagggcggccgcgacttcgcgccgccggagctggtctggggtaaggtgcggagccacccctggtggcccggacaggtgttcgacgccgctgatgcgtcggagatcgcgcttcagcaccggaaggccggcgccccgctcgtcgcctacttctgggacaggaccttcgcttggagcgacccttccgcgctgctccccttccgcactaactttaggcgactatccgcccagagcaatatgtccagcttcgtctccgccatcgactctgcgctgcaggag

SEQ ID NO: 21321 - DNA, 476 bp, Sorghum bicolor
  Clone ID: 13152479
gcacgaggatcgatccttatgacagttgcctttcttttctctctttgatctttgacgtcatttgtttatacttgccttgtattatcttttcgattctccacatataatataccattcgtgatcatgtcggacggactcaaccaagctcgtgcgatgcgcgttgccgaaatcatcaacgactaccgtactctgctgctacacatctcgcagcagaatgtcaatgcatcccaagaagaatactgggaagaaggcttcgtggtgctccgcgagtccctagcctccgcccagaccctaatgtccgccaactatcagccctgtccagtaacaggccaaggcaacgtcgagacagagaaggccgaactacagagggtcattctcgacagcagcgcacgccgttatcaagcgcacaaaatttatctgcgagccgcagcggcccggcgatgggccatggcccgcgccagcattttacaaggcca

SEQ ID NO: 21322 - DNA, 499 bp, Sorghum bicolor
  unsure (1)..(499): unsure at all n locations
  Clone ID: 13152480
atcttggctcaaaccatgttccaagttcttcagattgcgagcaactggtggatggcgtgggcaaacccacaaacagaaggagatgcccccaagacagatagtgtggtccttctggttgtttatatgtcccttgcttttgggagttcattatttgtgtttgtgagaagccttcttgtggctacgtttggtttagcagctgcccagaagctttttataaaaatgcttaggtgtgtctttcgagctccaatgtcattctttgacaccacaccatctggtcggattttgaaccgagtttctgtagatcaaagtgttgtggaccttgatatagcattcagacttggtggatttgcatcaacgacaattcaactccttggaattgttgctgtcatgagcaaagtcacatggcaagttctaattcttatagttcccatggctatcgcatgcatgtggatgcagaggtattatattgcttcatcaagggaactgactangattttga

SEQ ID NO: 21323 - DNA, 522 bp, Sorghum bicolor
  Clone ID: 13152483
gcacgagggaatgactcagttaacacttaaatttagccccgacaatattttgttagcactgactagtttggtgatttttggcatttatagcttctctgtttggtttacttggtttactttaattaacatgtgagcataatggatgcggcgatttccttctggaccaaaatgttcttttgtggcctgatcctttcaagccaaatgcagtgcagttataaattatgaatccaaaataagtaatgtttgagcgatcttgtttatgttccaggcatgcactgtgttcagcaaaatgcactgcagttctgtgaaatgcattacctgctatatattaagcccttgcaataagtgtgttgatcttgtgtgtgacgtgcttatttctgcaggggaagcgttttactgccaatgtgacggtcggtgtggagctaacagagacaaattctgtgtggtgcatatgcctctgcacgtcttaaccttgctgcaaagccaaatttggatggaagaggcgcggcacaatcaaattcg

SEQ ID NO: 21324 - DNA, 655 bp, Sorghum bicolor
  Clone ID: 13152488
cacaatctgagtcgtcacttctatcaaactttcggtctcagagaggagaaaggattctggaagttgatgggacattgacaacacaaccagtacttgaacatgtgggtatttcaacatggccaggaagattaatactcacagatcatgctctttacttcgaagctcttcgggttgttacctatgataagcccaaagtttatgagcttgcagaagatttgaagcaggtcgttaaacctgagctgactggtccatggggttcacgtctctttgacaaagctgttatgtacaaatcaacaaccttaacagagcctgtgatcatagaatttccggagttggctggccattcccgtcgagattattggctggccattatatcagaagtactttatgcccatagatttattaggaaatttgatataagtggagttgacaaagaggatacaattctgaaagcagtacttggtattctgcggttagaagccattgaagagttacattttgaagttccaaatcgatatgaatcgcttttgatgttcaatctatgtgacaaacttcctggaggtgatgtaatacttgaaacattagccagttctatatcatcaagaacttcagatcgaactaaccaacctggcacaagtagaagaatgcatgctgt

SEQ ID NO: 21325 - DNA, 524 bp, Sorghum bicolor
  Clone ID: 13152491
gcacgaggctttctcttctctctcccgtggcgccggctgggcgacctcgccgccggccgccggcctcgccaggtgcccaggtctccgtcgggcccttcgaaaggttccttcaggcccttatccggctgcaagcaccatcagagactgattaggagttcaaggagcaaatcaatttgtatcgaatataaccaagctttcatggctatggtgcgaagtgattcatcacatcatggagttgtggacaatagccccaatggatgtgcccaggctaggtgtgatgaagctaggaaacttggtccatcgtggtatttcagtagaaaagaattagaggaaaattctccatccaggagggatggtattgattttaagaaagagtctaaccttcgaaagttgtattgcaagtttctacaagatttgggcatgttgcttaaaatgcctcaagtgacgattgccacagcgatggtattctgtcatcgtttttaccttcgtcaatcccttgcaaaaaatgatagacgaataatcgc

SEQ ID NO: 21326 - DNA, 535 bp, Sorghum bicolor
  Clone ID: 13152496
cgacgacaaagatgatggtgatgggcagcagcaggttggccggagcagcgctgcaggtggcgctgacggcgctgctgccgctcatcctcccggcgtactacgtgtacaaggtgaccacgtacctcctcggcgccgtcttccccgagaacgtcgccggcaaggtcgtcctcatcaccggcgccgcctccggcatcggcgagcacctggcgtatgagtacgccaagcggggagcctacctggcgctggtggcgaggagggaggcgagcctccgcgaggtcggcgacgtcgcgctggggctcggctcgccgggcgtcctcgtcctgcccgctgacgtctccaagcctcaggactgcgagagcttcatcgacgacacgatccgctactatggtagactggaccacctggtgaacaacgcgtccgtctggaaagtgtgcaagttcgaagagatcgaggacgttagccatttcagagccctgatggacatcaacttttggggccatgtgtacccgactcgtctcgccatccctcacctcaa

SEQ ID NO: 21327 - DNA, 388 bp, Sorghum bicolor
  Clone ID: 13152500
tcattccacattggggttcagatgatgtcgcctttgagactttccgagcagcacctcgcccatttggaaatgctgtctcatatgtaaactccgctttcttagcaaggacatcaggcagtcatctaattgaggatatatgcctggcatttggtgcctacggagtcgaccatgccctcagagctaagaaggttgaggatttcttgaagggaaaatcactgagctcatttgtgatacttgaagcaattcagctactcaaagataccgtttcaccatcagaagacactacacatcgtgaatataggatcagcttggctgtcagtttcttgttcaatttcctatctgcccttgccaacagtttgaatgcaccatcaaatattgatactcccac

SEQ ID NO: 21328 - DNA, 558 bp, Sorghum bicolor
  Clone ID: 13152517
gcacgagggagggtgatgatatttgtaacaattcccctcctaaagctaatgttcgcaagtttgctgttattggaactcatagaccttcagtggaactcatctccttggaacctggagaagcattaagggtattgactattggtactatatcagtgaataatgcgtttggtgcgccaatgagtggttgtatacctgaaaatgtcaggtttgttgcggctgagaggttctacattcttgcaggcttgagaaatggaatgctactcagatttgagtcagaagcaagtgattatctccctggttttttctacaaggactcttctattccttctatcaatacattccttcagttgatttcgatacggcgtattggaattactcctgtactgttagtgccaatacatgattcagcaaatgctgacatcattgttctcagtgatagaccttggctattacatgcagcaagacatagcctggcatattcatccatttcatttctttctgcttctcatgtcacgcctgtttcatctgttgattgccccaatggtctactgtttgttg

SEQ ID NO: 21329 - DNA, 504 bp, Sorghum bicolor
  Clone ID: 13152535
gcacgaggcaaaacattcagtcatcaacaacagtagcatcgttttaccatgatccagtggatccagcttgcttgtttctcagttttctctactgttttgtgtatatacaaaacattcgtagtgattgatttgagacaccttttggtttcaaaatcgtacaggtgccggatcgggcagaacattcaatcgtttgcatcagcagcctagacagacagacatactatctgatcgtttgtatcgttgatgctgtggtaggctagcaacgtgcatctttctatctattactactatataatactactatataaatctgtaatcctgttcgttcgtcttgcatagcacattcgtttctcatatcttagagcgcggttggtatgatggggtacttgttcttgggcatccgcaccagcgtcggctgcaccgtgtcgtcgttctccagcggtttccagctgcaaccaaatcaaaaccaagcgagttcagctgctgctgatggatgggaaagca

SEQ ID NO: 21330 - DNA, 496 bp, Sorghum bicolor
  Clone ID: 13152539
gcacgagggtccttcctccgcaccaaggcgcgccagctcgaccgcgacctcgccaccgtccgccgccgcgaggagaccgtctggcgcgtcgtccgcgccgtcacgcaccacatccgcgactccatcgacgcccgcaccatcctccacaccaccatgctccagctcgccgccgcactcggactcagcaactgcgccgtctggatgccgcccctgcagcagcgagccgggaccggcaccggcggcggcgtgctccagctgacgcaccagctgctgccagacgaagacgacgacaaggtgcttcatcgcagtggcggcggcgccacagcacgcgccatctccgttcgtgaccctgacgtggccgccgtcttggccagcaaggacgccaaggtgcttagccggccaggctcggcgctcaaggcggcgagctgccggagcctgccgcgggcaggagccgccgccgccatacggatccctaatttccccatacggccggcat

SEQ ID NO: 21331 - DNA, 406 bp, Sorghum bicolor
  Clone ID: 13152553
ctcaaaccactgtctcgtcggctaacactatgagcgacaagcgtctggaagccacggagcgctatgttggcggtactgtcgccgaagagttgggtagccatgagatgaaaggttacaccgagaacgaccgaatcgacatgaggagaatgggcaagaagcaggagctcagacgcaattttcgttttatttcgaccgtcggatacgcaacttgtgtatacggcacatgggagatttatctcaccgccaatacgcaggggctgatagccggaggcctggcggggctattctggtcacttgtctggtgttatactggccaaactttcatagttttgtcgcttgcagagatggcttcgatggcgccgactgctggaggacaataccactgggtcagcgaatttgctccgag

SEQ ID NO: 21332 - DNA, 583 bp, Sorghum bicolor
  Clone ID: 13152557
gcacgaggctgtcttgagggaaataagccactgttggtttatgagtacctggagaatggaagccttgataaagcattatttggaagtgggaaactgaacctagactggccaacacgctttgagatatgcttaggcattgcaagaggccttgcttatctccatgaagagtctagcatccgtgttgtgcatagggacataaaggctagcaatgtcttacttgatgcaaatctcaaccctaagatctcagattttgggctcgccaaactttatgatgacaagaagactcatgtcagcacaaaagttgcgggtacatttggttaccttgcacctgagtacgccatgagaggtcatatgaccgagaaagttgatgtgtttgcatttggcgtggtcatattggagactttagctggaaggccaaatttcgacaatacgcttgatgaagacaaggtttatattttagaatgggtttggcaactgtacgaagaaaaccaccctctggacatggtcgaccccaagctcgcacaattcaacagcaaccaggtgctccgtgccatccacgtggccctcctctgcacccagggct

SEQ ID NO: 21333 - DNA, 480 bp, Sorghum bicolor
  Clone ID: 13152563
gcacgaggctcagtcgccggagattacatcgaaggaattggaggaccaaaacaatgtgaaggtgaaggtattgagtgagaggctatcatccgtggttctggatatccgtgcaaaggatgatctcgtgaagcagcattccaaagttgcagaggaggccgttctaggatgggaaaaggccgagaaggagatcgcgtcactgaaggcgcagctgaacgctgcaacggccaagaactctgcgctggaggaccggctcgttcacctcgacggcgccctcaaagaatgcgtccggcagctccggcgcgccaaggacgagcaggaccagacggtgcaggacgcgctggcacagcaagcgcggcagtgggagtcccataaggccgacctcgagctgcgcatcgtcgagctcacggcgaggctggaggctaagtccgagcgctcggcggtggccaccaccgatggcaacaccggttccaggctagccgc

SEQ ID NO: 21334 - DNA, 610 bp, Sorghum bicolor
  Clone ID: 13152564
gcacgaggattcccaccgccgcctcttccgcctccgccggcaaaatgccggtctaccgcatccgcggcgtcgacgtcgacttccccttcgacgcctacgactgccagatcacctacatggaccgcgtcatcgagtccctgcaacagggaaagaacgcgctgctagagagtcctacggggacggggaagacactgtgcctgctgtgtgcgtcgctcgcgtggcgccgcaccttcggcgagttcctgcgggtcgggcgcgggggcggcggcggcgggactcagcagttgccctacgggagccagccgtccgttagccagcagtcagaggattccacgtctcagcagcagcagtcgcggtacccagtcatcatctacgcctcacggacccacagccagcttcggcaggttatcaaggagctcaaggccaccagctacaggccgaagatggctgtgctgggttcccgtgaacagatgtgcatccacaacgaagtgagcaaactccgcggaagagcacagaacaatgcctgccacttcctctgcaagaaacgacggtgccctcataataaccatgtttctgagttcatgaaaaacaaacctgagcttgggaatga

SEQ ID NO: 21335 - DNA, 479 bp, Sorghum bicolor
  Clone ID: 13152576
gcacgagggagagagagaactagtctcgagtttttcattcatgggtggcaaaggtgggtccctgtggaagcaaatgacattccacttatctggtcaaagagccaattgtggaggaacgcttattacccaagatgcttatggatatactgctaaaaacttcatcaaagagggcttcttggagttccttaacaaggagatcgagtccattcaatacaacgagaaggattatgaagggctgccctttgaattccatggtggcttcgttggatatctggggtatggtcttaaagtggagtgtgatgcatcatccaacaatgccaaatcaagtactcctgatgcatgcttcgtctttgctgataacactgtggtggttgatcacagtaatggtgatgtgtatattttgtcactgcatgatgaattttattctagtaatggagatgggatatgcaaaaattcaacacatacttcatggttagttg

SEQ ID NO: 21336 - DNA, 598 bp, Sorghum bicolor
  unsure (1)..(598): unsure at all n locations
  Clone ID: 13152579
gcacgagggtggcatttgggcgactggatcactgatatagatctcgtacgcgagtttgatgctgtcggcattatgaagcctgaggggttcctctacaccagccagtactttgtgggactgatagcaagctccatttttatgggcgctgaaggacgcagacgcaatctctccaacaccactattgcatctttcgtgctgttgagctccatcggaagcctggggtattccctgagcttgttcttcattaccatcttgtatacgcctttgactctacaacgtggggacacgccgcgacatgatgccctattcacgccgtacgctgccgtctacgacgcgggcattgtcgcatcactcatcacactcaacctcttcccacaattagtctctgagtttggtgacaagagcatgatgcgagtgggctatctggctatgcctctcgctttcgcttttgcaccacagcttattcctttctcactcggatatgaacacatctccaaggcagcagcccatcgctcgtatgccaaggtcttctacgcactgtcgctggcttctattctactatactggcgggtctgggcgactntgctctatgtgaaca

SEQ ID NO: 21337 - DNA, 441 bp, Sorghum bicolor
  Clone ID: 13152586
ccaaagcaaaccaaccatcaagtcatccatcggccaagacgatggccgtcctcaccgccgcctccaccacgctcccgctgctgctcctcgtctggctatggctcccgctcctcgcgtccgcctgcgaccgctgcgtgcgccactccaaggccgcctactacacctcctcgctcaccctcgccggtggctcctgcgggtacggcaccgaggccgcctccttcagcgccggcttcctcgccgccgccagccccgcgctgtaccgcgccggcgtcggctgcggcgcctgcttccaggtgcggtgcaaggacaagaagctctgcgccgcggcgggcgccagggtggtggtcacggaccgcgccaggaccaaccgcaccgacctcgtgctcagcagcaccgcgttcgcggccatggcgcgccccggcgtggccaaacgtctcgccg

SEQ ID NO: 21338 - DNA, 558 bp, Sorghum bicolor
  Clone ID: 13152599
gcacgaggggtagctataacccggtgggtaattacccattgccatctttactccgaacaaacctcaatatcatcatctcgtccacttccactccgcggttccacatctcgcaaaaattcaaacaaattttgcgctctcaacactgcgtcaatccgctccaagccagccccgaccggagcaatggcttccgccaaggagacctatcgcgccgagctccgcgccgccgcccgccagcttggagagcgctgcctctactccgccgctaaatgggccgccgagctgctcgtcggtgtagagccggatgcggccccggtcccgtcggccgtgatggacaccccttcctcctcgtccgcgacctccgcggggcggctattgcacctgcaccgtagtgggggttccagcttccgccaccgcccccgccccgctggcggcggcactagctcggaggccgggacccctctcggtggcgtgtcgtacgtcagcacgcccatccccgacgacgatgcgttcgattcgggcggcgacaagtacctgctggccaagacctatttcgactgt

SEQ ID NO: 21339 - DNA, 604 bp, Sorghum bicolor
  Clone ID: 13152653
gtaccagcatatagtaacataggaaatcagcatggtcagtttggctctccacatggagaatcaaaatttagcaaccatccaccacaagttgggtatggtgcccagttgcctcagtcagggtatcgctttgagccccaacaagaacaggccggatttgggaatcgaggagcgctgcctgcatatgtggcttcaagccaaccctcatatggtacccgctggagctcaagtggttatggatcaacccaggggcaactgggatacagtggccctcaagcgcagtcacatgaatctcagttaccacatcaccaggcaagttttggcatgccacatgtccaacataacaatgacttctataaatacaaccctggatacaggccatctaatggtctgcagggatttgatgctacccatggtgattctgaaactgcttcatctaaagaccatcaagagactacccctcctgaagatgggcaacaagtagcatttatgaaagcatgaggactgcatacatattttggcttcaagacaaaaaggattttcaagacataaaatgaattagtctctttagatatgatgaagattttaatggatagatgtgaaacag

SEQ ID NO: 21340 - DNA, 460 bp, Sorghum bicolor
  Clone ID: 13152698
gtatgacagacaagcagaaaaggatcacttatccaagttggtcttctctacagaagacgagttcaataatgttaggaacatgctatctagagctgaaatggaccactgttctaagttgatttcagaagataaagttttggaggagatgacttcccacgatcaacttaaaggaatgtttttgaagatccattatccaccaaccgagtcaaacattgtctatacttacaatcaaattactcctgagtgaagttgctggtaattgtcagcaccagattgtttgagtctatatctatgacatgcacaggaggaccccccggcaggcttcattttctttattattgtctatacacaatgaatctgcaattgtatcttggagaggactaaaagcagaagttaataatgggtggtagagcctcaatgtatttggtggttcacaaggttgtgggcctatataccaaat

SEQ ID NO: 21341 - DNA, 554 bp, Sorghum bicolor
  Clone ID: 13152699
agtttcctcagatgctttcccaatgtcgagacactctacatccagtcagagaacgatgacttcaaattctggggacctcaagcaactggcactggcaaactaaatctcaagttctggaaggaggcaggtcccattcaatgtgttcagcggcacatcaagaaggtggttctccgtgagttccgagggacaagaagcgagcttgacttcctcaagttcattgccgagcatgcacgagttcttgagaagatggtgattgtgttgacccatggacattccccttcaggtcccgtcggtaccaacctgaggactagaatggcttctgcaaattgggccaatgcatgctgtgagctgatgatttttcagactccatttcctcaagaaggtacagcttggtgctacctatcagcatttaatctttctagcacagacccttttgatgtttcaaaatgtgtcgatgggacatgtcaaggtcattagtgggctgttcctgtatccatatgcaaggcactgtttcagaactgtttgcggtgtgtttttgaggattatgaagcatt

SEQ ID NO: 21342 - DNA, 439 bp, Sorghum bicolor
  Clone ID: 13152706
agagtcatcaaagtaaagaatgtgtgttcccctgatagctgaccatataattagatactggaggctggaggagaactgacgggcttgtaaaggttaaaagggatagaagaaaaagattttaaagctcccaagacacaaatctgctacctggaaggctggagcaccaccttcactacgattgcactatcacgagcgtatgggacataaatgcaggccactgtatgtggtctatgtcaagcacagattggatctcatctgtcaggtcaccaaatattgtttaaggcagcagtttgttgtggatagctaaaaataagataatgttgagaataataaaggatttttagtattacttgatcacatgcatgtctgtcctatttggaattctagatcccatttaccagctatgatttgcctgcatctattgccgctatcgtcttat

SEQ ID NO: 21343 - DNA, 644 bp, Sorghum bicolor
  unsure (1)..(644): unsure at all n locations
  Clone ID: 13152717
accggcgagatgatcaacatccccttncgccgcaaggcttactgggaggttgactttgatgccattaccctcggccacaacaccgccgagctggaggacactggtgtcattctggacaccggtacctcgctcattgctctgccctccaccatggctgagctcctgaacaaggagattggcgccaagaagggcttcacaggccagtacaccgtcgagtgcgacaagcgtgacagtctgcccgacctcaccttcaccctggccggccacaacttcaccatcggcccctatgattacatcctcgaggtgcagggatcctgcatcagcagcttcatgggcatggacttccccgagcccgttggtcctctggccattttgggtgatgcgttcctgcgccggtggtacagcgtgtacgaccacggcaagggctccgtgggcctggccaaggccaagtcctcgtaagcggactactttgaggagagcacgctctctagggacggtacttgatggagtcttttgtgattcttccaggagatcccgaggctagctatttaaggcactggtccgcacacattttcttgaactcacgctttgagagtcttgctccacgtgtgaccagggcatgtgtgtgtgtggagtgggggact

SEQ ID NO: 21344 - DNA, 662 bp, Sorghum bicolor
  Clone ID: 13152726
ttctataatgaggaatgtgaccgctttatgctttgcatggtgcacaaacttggatatggtaactgggatgaactgaaagctgccttccgtatgtctcccttgttccgatttgattggtttgtgaagtccagaactacccaagagttggctaggcgttgtgatacccttatccgactggttgagaaagaaaatcaagaatatgatgagcaagagaggcaggcaaggaaggagaaaaggcttgctaagaacatgactccaacaaagcgagcagcactaaggaattcagagggtgagaatactccattgagttcattcaagaggcgacggcagtcccttatggacgattatgtgggctcgggaaggcgaaagagagggtgaatgtgatgtttgctatcttgcttttggagctcgccggagatgcagtctctgcaatgctttaagcccctgccgtgcagtgtttagtttctcctgcacgcgagttaaatgcctcaagggcaggtgacttcgtagtataatttatgcaatgttgacataggttagttataaatcctaaatgaagtatgtatgagcacgctgtgttagtgtcgtagtcctgtgctttgcatttcaactgttgctatcccagctgacagaatattatgattacagctgcaagcctgcaa

SEQ ID NO: 21345 - DNA, 558 bp, Sorghum bicolor
  Clone ID: 13152732
ccatggcccgcgccagcattttacaaggccaacggccaacggcccaacacgccgcagctctcaaaagcgctaccaccacgcttcatcaagacttggctcgcatcacggacacttacgctgtctctgacctccgagccgcggatatgcgggcaggtcactgggttgacgacgacccgtctttggaagccatccgccgctgggttgggtcgcagtaatgacgaaacgaaacgggaacgaaagctacgtggggtcgttttgcatatgtatcagcgatgattttttctggcattggaccagagggtgggatgacatgcggggcgggaaagcgctggtcgcgactgttgccgtcttccgagatgaaaggaaacgaggacgaaacgaagtctggatttcttttgcgtgtgtgtttttggttatagctgatatccccctgtttcgtgttcgtgatcgcttttgtgcttttgcttttgcttttgcttttacgttgaggaattatttcccaacctgcggcgtaagggcattttgggtctcatcttcatagcatcacgcctactgcgt

SEQ ID NO: 21346 - DNA, 556 bp, Sorghum bicolor
  unsure (1)..(556): unsure at all n locations
  Clone ID: 13152742
ccccagttcttgtgaaaacccctgtgatggcaccattaaatggctcaggcctctttaataaacaaaataatccaaagccaggaacatcttcatcgctattcggacaaaaagaaagtccaggaactcctcgacaacgctccacattcaactccatacaagcaaagccagctacaatcgagcggtctagggtgtttaatacagacttattgggacaggtgccctctaccggactctttggtgaagctaaagattttggcaaggacagtaaatttgcaacagacaccagtaaagctgctcttggcgtccataagcaatcggctacggattcgagcaagcctaatgcagatcgcactatcccgaactttggaacagtcaaatccccatttgatacatttacattttcgggntatgaagggatagggtcggtagggtcaaaattctctcatattatcccaacgctaggcctgtgtattttcatcccagctactagcttgagatatttcggttccgcattttactatcatattagtgcacggggtttttttatcacctttac

SEQ ID NO: 21347 - DNA, 626 bp, Sorghum bicolor
  Clone ID: 13152745
aggataagaagcagaacttgtccgatggtagcaagcatccaccagaccttcaaaacactgaccaagtaatggagaatggtcaccatgtcaagcagagtctaccaacaacagctgaagacatgggctgtctgatggacagtaaagaacaacatccttcaccatttattaagcaaaatgatgttcctgagcacaagtcacagcagcttgatgacacattgaagcaccaaaagggctatgaccatcctcaacttgtaggaggccctgagctggatggaaaggactgcaagagacctaagctcgacgggtaggtttacatatgattttggatggttttttttggaaactgacatgaattcattgtatgatgaggagtacatgttgatgagcatgtgtcttcaatggtgcctgacgatgctgtgcccaaaattgctgtgctgcggaacatcaagatgatgtgtcctgcaactgattgcagtttacaaattgaggaaagtcgggcagcaatatttactaggttccaacaaacattggtatatatatgaacgaaacatgctctgatgctcatgcttctggtaacagttgcattcattttcttgtatgtgatgttccggttaaagcgatgcaaa

SEQ ID NO: 21348 - DNA, 172 bp, Sorghum bicolor
  Clone ID: 13152749
gcaagaagaagaagaagaagaagaagaagaaatggtcaaaacgcgcgggcagttgagtttgaacgtctgtgtattttggtgacctgtgtgtgtgtgtttttttttcttttctcgagggcttttggtccgcctgtaatttatccgggtttgtgacttgtgactttgtgagtga

SEQ ID NO: 21349 - DNA, 599 bp, Sorghum bicolor
  Clone ID: 13152750
aatgctagcaaggcggcagcgctcaacttctacgacacgctgaggatggagctgggcggcgacatccgcatcaccgaggtggtgcccggcgtggtggagtcggagatcaccaagggcaagatgctcaccaaggaaggcgagatgaaggtggaccaagacgagagagacgcgatcctggggccgacgccggcggagccagtgggcgacttcgccaggacggtggtgcgcgacgtgtgccgcggcgccaggtacgtgttcgagcccaggtggtacatgggggtctacctgctccgggcctgcatcccggaggtcctggcatggaactcccgcctgctcaccgtcgacagggtcggcgcgtccaccacggacacgctggggaagtggctgctcgacctgccgggcgtgcgccgcgtcgcgcagccgccgtcgctccggtcgccggagatcaaggaacaataaataagtgagctactataggccacgtgatgatcatctgacgcggtggtcgtgtgcgttcttctggatgtcgtgcaacgaatgaccctgtactactggctagcgctgtagcctgtactgtatgataccggctggagttacct

SEQ ID NO: 21350 - DNA, 529 bp, Sorghum bicolor
  Clone ID: 13152783
cgaggacaacgagatgattgacgttattgccgtcaccaagggtaagggcttcaacggtgtcacctcccgatggggcaccaagaagctcccgcgtaagacacacaagggtctgcgtaaggtcgcctgtatcggtgcctggcaccctgcccacgtccagtggactgttgcccgtgccggtcaggacggataccaccaccgtacctctgtcaaccacaagatctaccgcattggcaagggcgacgatgagggtaacgcctcgaccgacttcgatgtctccaagaagcgcatcactcccatgggtggctttgtccgctacggtgaggtcaagaacgactacattctcctcaagggtgcctgccctggtgtcaagaagcgcgtcatgactctgcgcaagtccatgttcacccacaccagcaggagggcgctggagaaggtcgagctcaaatggatcgacacctcttccaagttcggtcacggtgcttaccagacaccggccgagaagaggcagtacgagggtgtgctcaagaag

SEQ ID NO: 21351 - DNA, 320 bp, Sorghum bicolor
  Clone ID: 13152788
ctcaggatccccgcggggctcgagaagtcggagatgaaggagaaagtctcgccgatcaccggccaacccatcgtgcccgggatgtccctcatctccttggacgagctgatccgtgaccgaagccacaggaggcccgcgcatgccagggcgacggcgacgagcaccggagctccaaagacggccatggcagatactgatgtgatgatctggtgataccatcagtgtcagttgtcaggtgctcatatatatttgcgcttcgcggtggtgcatcgaaatctctgattcctcgggatcatctttgtctttggtattatctttta

SEQ ID NO: 21352 - DNA, 429 bp, Sorghum bicolor
  Clone ID: 13152792
cttgcttgccgacagcgacgccatgagcatggaggtgacgcggaagctcctggagcggctcggctgccaggtgctgccggtgtcgtcgggcgcccactgcctcagcttgctgggaggcggcgccgccgacccgtcgtttgagctcgtggttcttgatctccatgggcacggcggcgcagccgccatggatgggttcgaggtggccctcaggatccgggagctcagtagaagcacctgctggctgctggtcctcgtcgccgtggaggccggcggtgtcgatgacggcgtgcgtgacttgtgccggcgggcgggagtggacgggcttatccacaagcccatcacgctgccggcgctcggagctcagcttcggagagtccttcagaacaactgatccaagctttgtgttggtttgcagtgcaatgcgcagta

SEQ ID NO: 21353 - DNA, 590 bp, Sorghum bicolor
  Clone ID: 13152796
agttatgccagaaacatggcaaagttgcacagttcgagacatggcagaagggtgggatgaccatggtaaatgtatttgttggtggggagatggttggacttggctcctcggagcagaaggtaattgctaagctcaatgctgcacgggatgcattgggcaagcttatcggtggcgcaaagcagcaagtgttgatcaatggcattgccaatggattggttgatgagattgtagagctcagggagtgtaaacagaaacttactgagcagtgcatcggaaagcattggccaaaacctatctttaagttagaaaaagaaggtggccctgcacatgaaaggaactttgtgtgttctgttcaggtagataccaaaactggcacctttgtaaccattggtgatcctatgtcaagagtgaaggatgcagagaattcggctgcacagaagatggtcgaactattgttgaaattgtgagatatgttcatgtacatggctagatcttttgtataccactttcagaaacaatttgttcgggtatacctattatggtagctttgtcaaactgtggatcatgtcagctacttaaaaccgtttata

SEQ ID NO: 21354 - DNA, 510 bp, Sorghum bicolor
  Clone ID: 13152806
ttccagatggatcggaacggtcaacccacacttgcatgtcccagcgaacgcgatcattgctacggcaatctttacgtgcgtcgtatcgctcattaacattggaagcacggttgccttcaatgcagtgctttcgctcgcatcgaacgcgatgatgggaacgtacctcatctccattggctgcgtcacttaccgccgcgtttgccgtttgcccctacccaaatgccgctggagtttgggtcgagctggtctgcccatcaatatcattgccctcgcatatgcttgctggtgttttgtttggtcattcttcccgaacgcttaccacgtgacgccagtcaacttcaactgggcgtgcgtgctatttgttggcctgatgggatttgcatcgctcatgtatatcttccacgcaagacacgtttatgaggggccagttgtgagagtattgcagatggaaggtgatacggattgatgggtgaggcgaagagaggaagaactcggtcgtcctcctagaat

SEQ ID NO: 21355 - DNA, 664 bp, Sorghum bicolor
  Clone ID: 13152814
ggacaaggtggtgcgcccgcccgccgagctggtggacgacgccaacccgagggcgtacccggacttcacgtggcggacgctgctcgacttcaccatgaggcactacaggtccgacatgaggacgctcgaggcattctccaactggctcaaccatggcggacacctctcatcaccacctcctccatgatggatggatggatggatgcatcgtcgtccgtctccggcgtcaccaccgtactacttacgtgtagcaaggaatttacattacatatatatagtatatatatttgtattgggagtacgcgcgtatgtgtgtgtattagtaggttattaagctaagaatgaaggtgctgcatggcatggctgatatatgatccatccatggagccatgcatccaacaagttaattagtactagaagaagaatgaagatgatgaggaggaggataattggaggaggacggatcatcgatgcatcatgcggctgatccctcctccacacgctacggcagccgcaggcacaacaccattggaattgaaattaattacttaagctagctagctccatctattttactcgctccttttgatccatgcatttttcaaaccaagtactagtttattactgttaatcaacaaactaacgcaagtaagtagtagtacat

SEQ ID NO: 21356 - DNA, 512 bp, Sorghum bicolor
  Clone ID: 13152825
ccttagcaatgttcctgggctccggtcttcataaccgtggtgatccaaattcagcagaatttgaccagtgcttctctcagcctggtaaacgctgtgcttccaccattgttgcacgttcgtgctgggccatggagattagcatattgtttttgctgaagttcaggagttccttaagatgaactggattctatagtcatgacgtcaaccatgactgcttcattttatctgaagccgaacctgaccggtgcgttatccacaacagacattttcaaacatgcccagcgattagtattcggttctatcaagttttcaaatgggtacgaacccatattgattagtagaatatatttggggaaggaaaaaaaagatatatgtatttgctggcagcaccacatgtgacatgccagttgatattttacattgcaatgggtacactttgtcattgcaatgaaaatagtttttatattaacgttggagctatggatgagatctacaaatttcagttttgaggt

SEQ ID NO: 21357 - DNA, 312 bp, Sorghum bicolor
  Clone ID: 13152831
gacccccaagaagcgggggcgtccttccaagaaagccaatggctcgaccgggtcagcttctgccgctggggccgtcaggcggagcacaaggggaaaagtgcacagcccagagtcagacgacatgggctcgttcattagtgagcctgacactacctatcagccatcggaagagacgaagcgggccgtcgaggctatggagtcggacggtgtagcggcagatggtgacgtggtatctgctggagagtcgactgcgttggccttgttcctgacgtttcttggtggactagggcaattggcagctggcactttagg

SEQ ID NO: 21358 - DNA, 566 bp, Sorghum bicolor
  unsure (1)..(566): unsure at all n locations
  Clone ID: 13152837
tcgacgtcgcgcaggtgggttcgtccaactggaagttcatgacgcgcgacaacgggccggcgtggagcacgagccaggcgccgccggggccgctccagctcagggtggtggtgacgggcggctacgacggcaagtgggtgtgggccgaccgcgaggtgctgccgcggcggtggcgcgccggcgaggtctacgacacgggcgtccagatcactgacatcgcccaggagggctgcttcccctgcgacacgcacgagtgggagtgaacggcacaagccagaagcagaagctggaacgggaattggcccgaggtggccctgaattccactgtagaattgctctagctcctctgtgtcgctgcctttttggctgggccttggtcaccggaggacttgagagagagacgactaacagatgctgacagagtggcacacgagaggaggaatcccctctctctcccctgtacagtagtagcagtagtagggtcccggcggacgccagaaaaaataatgaaacgaaagaacggccgcttgagcgagcgtgaagcaacgagcaattcgccgccgggn

SEQ ID NO: 21359 - DNA, 628 bp, Sorghum bicolor
  Clone ID: 13237391
tgcagcctggggataatgctacagtcaccttcgttttcttgccaaagttgttgggctcttcatcagcacatctagttgtgcagacaaattttggtggatttattatacatgcaaagggcatggctgtcagttcgccctatcagatactgccattgactgggatagatgttgtgattggtggacagctagagaggaacttatcgatatacaacccctatgatgatactctctatgttgaggaagtggctgtttggatgtcttcattggagagcacaagatcattatatgaggaagagatctctgctaatgcaaggacgagaacattgggcagcatgctgcaagtagaagactcgcatgatgtgaagccaatggtcatgagagcagtcaaagctgatgatagaatacttagacaatggaaatctcatggaacaagtgacgggatttctgttcttatggatcctgaaatgttgtttcccgttgtgcaaattggttcacagttttctcaatggataaaggtccataacccaagcctggagcgtgcagccatgcagctgatagtgaactctgaggagatcattgaccaatgcaaaactgtaaccaatgtatgtgaactcacattctcaagcaa

SEQ ID NO: 21360 - DNA, 612 bp, Sorghum bicolor
  Clone ID: 13237392
gcacgaggctccatcaggcgttgcctcccgcagatccgaattggaatttgggccttcgtctccacaccaccaatccggtaaatacgcgggcaataactccccccgaatcctatttcctagctgcttcagagtttcttgcgctgttctctctcgcgcgcaaattattatgctgggaaagatgatattcttcccctttagctgctttgagcccaaaaggccgaagcttttgcgttcttccccacaagtatctggagccgccgtggcttttgtttggtatggccatgggttgaaataaatatagtaccaattggcacgctgcgctttccatccctgcagctgcaagaggccatcttcttttttagatctgtgctgtgccttcttccctcctcttcctggtaccctgtgattggagtcaggattagtgtttaaaattaatgaagctccttttcttgccaacttttggatgatgcttacttatatcttaccagttatcaccacccctctcgcgtgcttcttggatagcttgccttctttgggtttgctcacagcgcacacaaagtcattttactgctgtttggctgctgccacttttagcatctctggctcttgagt

SEQ ID NO: 21361 - DNA, 512 bp, Sorghum bicolor
  Clone ID: 13237395
gcacgaggctttgttatatttttttgtgttttatcctttgtattaaatttgaaaaattttaagcttttaaaactgactttaaaccagactgtccatatatagtttatatacatgctcttagactttttaggacttttatttcacgcgcaatggcaccttatactctctggttgaaaggagcctaataaacttttgaattataatttctagatttgattttgattttatatagattgtataaatttctatcaatttgtgcattgttcgtgaaaaagacaagaagctaacattatacttgttattggtaagccgaagtctatgtaaatcttgagattgatttttactatgcgttgcaacgggagaaaatatcaaatgccatagaaagttatgacataatgttacatatctatttatatttattttttataaaatttaaagtccataatttattttattgataaccatgacatctatggtattagatagttaatatttaaaataatatgtagctt

SEQ ID NO: 21362 - DNA, 311 bp, Sorghum bicolor
  Clone ID: 13237402
cagcaatcccaccaccatgcccccgcctctcccgccagatccgatcgagccgtgcgcgccggcgccggcgatggacgcggcgctacccgccgcagtcgtcgccaccatcctctcccgcctcgacgtccgctccctgctcctcgccgccgccgcctgccgcggcctccgcgcctgcgcctcccacgcgctcgccttcctcccctccttccacctcctcgaggtagccctgacgcacgaactactgcgcccgttgctgccgctgaacccgagcctgcggagcctgcgcctcgactgcgctcgcctcgaggatg

SEQ ID NO: 21363 - DNA, 429 bp, Sorghum bicolor
  Clone ID: 13237403
gcacgaggacaagcttaaatttgtttctgcattctgccagtcaaactgtggagatgttagtccaaatgtcttgggagcattttgtacagacaccaaccgtccttgtgactttaatcacagtacgtgtaacgggcagaatgaattatgctacggacgaggcccgggatatcctgacgaatttgaaagtacccgtatcattggcaataggcaattcctcaaggctgttgatcttttcaattcagcttctgaagaaatacaaggcaaagttgactacaggcatacctacctagatttctcgcaactcgaagtgaatgtttcttcaagcacaggaggtcagcatcagacggtgaaaacatgcccagcggccatggggtttgcctttgctgctggaaccacagatggtcctggagcttttgattttaaacaagg

SEQ ID NO: 21364 - DNA, 520 bp, Sorghum bicolor
  Clone ID: 13237414
gcacgaggcagccacacagtgacagtgctcgtggtggctcctctagaggtaggatcaagaagacaacggcacgcaagaaggtcggggcagggcccaggagacgtcttggtgctggtgtggagagtggcattgattctgagatgctcgggcaggaaggctgggctggggatgaggacggtggagatggaagggctgaggaagtgaggggaattaacataaatgaggcagcgcaggctacagatggcactggtagggttaatgttagcaatgctggcggagttgaagatatgggcaactttcatattgatgttgatgcaacagaggatatcttggggaatttgcacaacctgccattcctgagggtggacaatcttgggcggatgatttaactgttgttatggtttgctggagctagaaaagtattgtatgattagccaggccaaaacagatgtctcagggactggcccttgctgttcaagtgttcattttattgtaactgttccatcccctgttatgtcat

SEQ ID NO: 21365 - DNA, 518 bp, Sorghum bicolor
  Clone ID: 13237419
gcacgagggaacggcaacttcgaggaggcgccggcgaaatcggagctcaacggcacgcgggtgaaggggcgcgacgcgatcccgcactgggagatctccgggttcgtggagtacatcgggcccggccagaagcagggggacatgatcctcccggtgccggagggcgcctacgccgtgcggctggggaacgaggcctccatccagcagcggctcgccgtgacgcagggcgcgcgctactccgtcaccttcagcgcggcgcgcacctgcgcccaggccgagcagctcaacgtcacggtcgccaccgactccgacgtgctccccatccagacggtgtacacgagcagtggctgggactcctactcctgggccttcgaggctacgcgcagcgccgtgacgctcatcgtccataaccccggcgtcactgaagacccggcctgcggccctctcctcgacgcgtttgccatcaagactctccagcctcctcctgtgctcgccaaaaataacatgatccagaacgg

SEQ ID NO: 21366 - DNA, 512 bp, Sorghum bicolor
  Clone ID: 13237431
gcacgaggccgccgcaaggaagaaccccttctcatggcggcggcgacggcttcgacggccggggagggaggagtaggaggagacaacagcgcgggtgccctgttgcgcatcttcgtgggcgggcttgcggagagcgtgggcgcggccgacctagaggccctgttcgcctccgccgggcgcgttgccggcgtcgagttcgtgcgcacaaacggacgcagcttcgcctacgtcgacttccactgccccaacgataaggccctcgccaagctcttctccacctacaatgggtgcaaatggaaaggagggaagcttaggctggagaaggccaaagagcactacctcactcgccttaaacgagaatgggaggaggatgcggctgcagcagcgtcaaaggaagctgcgctgaaagataatgcagagaaccagaagccgaaactagaaaaggctgccttggagggcatgaagattaacatctacttcccaaagctgaggaagatgaaagctttgccact

SEQ ID NO: 21367 - DNA, 374 bp, Sorghum bicolor
  Clone ID: 13237435
gcacgaggctagatctcgcaccggcggcagccagccatgtcgaagccctggggaggcgtcggcgcgtgggcgctggacgccgagcgcgccgaggaggaggagcgcgagcaggccctgtccttcccggcgcccgagccgcccgcggccgcgggcggcgccgccagcttcccgagcctccgcgaggcggccgccgcgggcgccgggggcaagtcgaagaagaacaagaacaagggaaccacgctgtcgctctccgagttcaccacctacggcgccgccgccgcccagcgccgcgcggagcccgtcgagcccaggggcctgacccacgatgagatgatgatgctgcccacggggccccgggagcgctcggccgagga

SEQ ID NO: 21368 - DNA, 175 bp, Sorghum bicolor
  unsure (1)..(175): unsure at all n locations
  Clone ID: 13237446
gcacgaggtttcatgctaatcaaacaacggcgtcgacgctggcaaggccaactggatcagcangctcaggggaaaaacacatgatgaactcccccatgctgaccatgtagcaaacctagaagctcggcctgaagctatgcgagaacgcttttgcttactcactatctttagtttt

SEQ ID NO: 21369 - DNA, 524 bp, Sorghum bicolor
  Clone ID: 13237467
gtccccggccccggcgtcctctgattcggcgccactagcggccctcctggcctgcaacgccacccgcttccagccggcctgcgtctccacgctctccggcgccgcatccgatgcctccaccgccgacctcctcgccgcgacgctctccacgctccgcgcgcgcctcccgcccgccgtcaccacggccaagtccgtgctggcgtcctcctccaacgtgaacctcaccaccgccgccaccaactgcctcacgttcctcgcgctgtcctcgcaccgcctctcgccgtccccgtcgccgtcgctgatctcggcctccacggcgatgctccacctctacgactgctggtccgcgtacaagtacgtcaacttctcccggaccatctccgacgccatggcctacctcgacgccaccatcaccgtgaacagcaactacatctccatgctcgccgcgcggcagcggtacggcgacgacacgtccctctggcgccccccgcagacggagcgcgacgggtactggccgccccccg

SEQ ID NO: 21370 - DNA, 611 bp, Sorghum bicolor
  Clone ID: 13237471
gcacgagggataaaaattactcgagatggattgggatacatattctagaataatatagaaggagtattattttttcatctaagtagataaatctctaaatagagacacttctttttctttagggactcgggttattttctttatggtacagaaggaggtgagattaggttcccttttcttcattttttcatttcttattctgctattctgaatatttttatattcttgcttatcttactttcctagttgttctaagtaatgcgcgcggtacaaagttcgtggtagggaacttctttgagtcatcgtatttttctgtttatacgaaggaaatgaatatgtgattttccaaattggagaatcgaaatgaagcccttttttgctcagtctatctctccccctttgtataaatatttcacatttcgaatgcaagtttgaaagattgccctgctctttctttttctgcacaaaagagcccttcctaattcactaatttgtaggaagatactggacttttggatttgaaaaaagtttcagaagatatgtctaaagtagacggtgattgatagagcaattcttgctcgtaagttccagtatgagtactgcgccgaaca

SEQ ID NO: 21371 - DNA, 561 bp, Sorghum bicolor
  Clone ID: 13237478
ctggttcgcgtatcatcctccgtaagacatcatccgagtgccgactgcctgctgtccgccttgcagatattccagttaacctgccacaagaagaaagcatctctgtggcgaaagtagctattaagcagaggcctcaaaagaatttccatggcatgaacagctcaagtgctcactcatctagagaaaacctccagaaaagcgtcgaagaaaggaaagaggaatacaacaaggcacgagcgcggatatttaacaacagcaatagcagtagtgctactgatgggagatcagctgaggaagtgactttacccagtactcttcacaggtccacttccttggagttgaactcaagcagtagaatgggccaaggggctgaaattactctcgaaaggagcttgactaccacgtcagctagcagcaggtcaaatagaagcaagattgataaggagcctgcagtcaatagaagcaggcagaacaatagggttgcaattttcagagaccgtgagtcagagcgagaggatcctgattatgacagaagctatgacaggtatatgcaaagatttg

SEQ ID NO: 21372 - DNA, 552 bp, Sorghum bicolor
  Clone ID: 13237489
ctcgcgcagagctagcagacctcgccggcggcgaccgtgtgcccatggctgacggggccgagatggacgaggaggctatgcgagccttctttccgctctctttcggcaaggcgccggctcggcccggctctgcggcctcctccgcccactcctccacccttcgcaagcctcaaaaccctagtaaccccaagccccccgcctctaccgccacggacgacgatggagccgctatgattggtccccctcggccgccgccggcgcccgcggaggaggacgacgacgacaaggaccgcggcggcgtcatgatcgggccgcctcggccaccgccgccctcagctcgcggcgaggggaacgacgacgatggcgacggcatgattgggccgcctaggccgccgccagcggatgatgaagacgtcgatgatgatgatgatgacgaggaggacgacggcgaggagatggaggatgacggcgagggtggattcaatcggatccctctcagcaacgaaattgttctgcgggggcacactaaggttgtctcagcccttgctgttg

SEQ ID NO: 21373 - DNA, 433 bp, Sorghum bicolor
  Clone ID: 13237506
gcacgagggaaggaaggggataaggagatggcggcagccgcggatggggtcgcggaggacaaggaggaccccgctgacggtgcgacgaccaaggggggctccttgatcgaagagcttgaagatgcaatatataagaatcaaaaagcaccaatatcctactcagagttggcagctctaaaagaagggcgattcaatgcatccatccagcatcggctagctgaacttgaaggattaccttctactacgggtgaagacttgcaaatgaagtgtttgcttgaattgtatgggctaaagttgttagatttgcagaagaaagtgcgatccgatatcagtgcagaatattggctacacaagaaatgtgcatattcggagaggcaactttctgattgggggctgatgcggatacagtatcctttatccatgtatggaatac

SEQ ID NO: 21374 - DNA, 610 bp, Sorghum bicolor
  Clone ID: 13237514
gcacgagggctctccgtagaggtgaccggcagcgagcatcaatgcttctttcgaactttcatcacactaaagaagcactaaccaaggaagatttttcttatatattggagtattgtgcagaggcacctgatcctttgtttgttatggaaactttggaactcatggaggagaaggccattggcatgagtaaaagtatctacagatatgtcattagagctctgagcagagggggatatgcgagggaggcacttcactggctggctgttctcggggagaaagaaagcactcatgccactataccaatttttaatatctttctaaacgcctttggaagtagagcagatctgaaggatgctgaatgctgtcttgagatactggaaagtctttttcttgggaagtctgaaataacatactgtgagcttttgaagcttgcagtgttacagggaaatttgcctgcagcttatgatatctggaaggactgctctaggtattatagcccaagcattatcacacaaaggagatttataagggctttaactgcactaggtgaccttcaatctgcatatcacatcttgcagcatatggtagtccttgccgcacgaagctctga

SEQ ID NO: 21375 - DNA, 519 bp, Sorghum bicolor
  Clone ID: 13237517
gcacgagggacaaccggaaagataagatgctggccatgctggttgaagacgagccgaggcgtaagaagaagtcgctactgccggctcgagatcctaagaagatgtcggcgccgagactgaaaacaatgagttataatgatgatgaagactttgatgcagtgcttgatggggcttctgtaggatttatggaaacagaaagggaagaactaatcaggaagggcttactgacaccatttcacaagttgaagggctttgagaagcgtgttgagctacctggaccttctcattggcaaaatgatccctctgaacaagctgaagaaacaattgaagcttccaggattgctagagtcgctcagtcaatgcagcagattgcacaaagccgcccaacgaccaaattgcttgatccagaatctttacctaggctggacgcacctactgctccatttcaaaggcttggaaggcctctaaagcgtcctgtatctcctggttcagaacaggaaaggaagagacaaaggaata

SEQ ID NO: 21376 - DNA, 332 bp, Sorghum bicolor
  Clone ID: 13237520
gcacgaggcgcctgcgagatgacgtacggcttcctgccctgcaccgacaccgcgccggggaacctcttcctcgtcctcgcctacggcttcctcatgttcaaggccgccacctacctctccgccggcagcgagctgctgctccagatcctcggcccaggcatcgccggcggactcttcctccccatcctcggcgcgctacccgacgcaatgctcatcctcgtctctgggctctccggcactaaagaggttgcgcaaagccaggttttgattgggatgggcctgcttgcacgttcaacagtcatgcttttgacccttctctggggatcttgcgt

SEQ ID NO: 21377 - DNA, 517 bp, Sorghum bicolor
  Clone ID: 13237524
gcacgagggcaagaactccgtggaggttgcgcacgacaggcgcctgcttggagtgatatacactgggctagagcagcatgagcaggctctggagcagaatgagatttcacagaaggtaatgaagagctggggtgcggctggctctgacctcctgcatgctgagattgatgctgcaaacatcaagatcgcattgggaaagttcgatgaggctgttagtgtgttgaagaatgtcgctaagcaggtggagaaagataacgagatgcgagctctagttttcatatcaatggcgaaggcactcgctaatcaggagaaggttggggacacaaagaggtgcttggagattgcttgtgacatcctcgagaagaaggaatttgccacacccgacaaagtggcagagatgtatacagaggtatcctcactatatgagatggtgaatgagtttgaaaaggcaatatctttgctcaagaggggcctgggaatgcttgagaggatccctcaggcacagcacttggagggc

SEQ ID NO: 21378 - DNA, 550 bp, Sorghum bicolor
  Clone ID: 13237533
ccccagtaaagcccgccgctccctccacccagcgcaacggcagcgccgcccccggctccaagagccggcctaagcaggcttcggaggaggccgcagccgccagcgccaaggcgcagtcggcctccaaacctcgcaaaatcaccaaggagaagccggcggccgcgaagaagaagcgcgacaagccggagccccaagtgggcggcaagcgtaagaagcagcaggcgtccgccgacgcggccacgcccgcaaagaagaggaagaagggcggcgaaggcccggaacccaaaccccagaaggaagcaacgcccgcgaagaagcacaagccatccggcaagccggagaagcctgcgacgcccgggaagaagcagaaaccagccgtgaagcccgcgacgcccgcaaagaagcagcagccagccgggaagtccccgacgcccgcgaagaagcagaagccagcaggcaaacccgcgacgccctcgaagaagcagcagtcaaccggcaagcccgcgacgcccgcgaagaagcagcagtcaaccggcaagcccgccacgcc

SEQ ID NO: 21379 - DNA, 579 bp, Sorghum bicolor
  Clone ID: 13237534
gcacgagggttctcccgttcagcccgagtgcgccgcgcgacgactgccgaccgccgaccgccgcccgcaccctacgccaggtgccgagggcttcgccgggcccttcgccgggcccttcgccgctcgccagcgacgagcacccaccagtggaggatcggcccctgcctcaagtgaatccgcaatggttctgcctcatcgaaccgcggaactgctggaggctgatgaagcccaaagctttgtgcataagcttcagctcagtgtctcgaagggccttcctcatgctgtgccagtgccaggcttgagaacagaagaacatgagctggttaaggctgttttccaggtgctgcaaggcttcgagacgtcctggctctattgggacagtaatgtgcctcggtaccgtgagaaagcggggatatatgtggctcacttgtcactgacgggcctcaggtccttgttgagtccgttcctgttcacggcaacatgcttaaagcaagtggagctttttgttgggaaggttaggatgcgacgtcacgagattcctacgttggacgcgtttgctagctcggttgattcttggct

SEQ ID NO: 21380 - DNA, 237 bp, Sorghum bicolor
  Clone ID: 13237542
gcacgaggaacccctcgaggaaacccttctctccccatggcaaccgccgccgccgccgccgtggcggcaccagagcagccgcggcgccggaagccggcgccggggcgcgggggcgtggccctccctgcggggatctccgaggaggaggctagggtgcgggccatcgccgaaatcgtctccgcgatgggggaactctcgcggcgcggggaggatgcggacctcaacgcgctcaagtcc

SEQ ID NO: 21381 - DNA, 527 bp, Sorghum bicolor
  Clone ID: 13237543
gcacgagggaactatgcatcagaatcaattcttggtgtggtgacgatcagggcatttgcagcaactgagaggtttatccacagcaacatgcagctcatcgacactgatgcgacactgttcttccatactgttgcagcacaagagtgggtgctcataagagtagaggcactgcagtccttgacaataattacagcagcattgttccttgttctggttcctccaggagcaatttcaccaggctttgcaggactttgtctctcctatgctttgacgttgactgcagcacaagttttcttgacaaggttctattcctacttggaaaactacatcatctctgttgaacgaatcaaacagtatatgcacctcccagtggagccaccagccattataccagaaaatagacctccaacttcatggccacaggagggaaggatagacctgcaagatttaaagataagataccgtccaaacgcaccgctcgtcctcaaaggaatcacttgcaccttttctgctgggaacaagattgg

SEQ ID NO: 21382 - DNA, 694 bp, Sorghum bicolor
  Clone ID: 13237715
gatctgggacaactattcatgttgaaccagaaattgttgaaatagagggtcctagtcctgtattgccccaaatttcagaacaggagtccaatttgataagaagtccgagcccacatgggcctggtgccatgacaagaaaaggtgctactactgttgacagacaaaattctgagatttcttattatgctgatgatgaagatggaaatcgcaaaaagtatactaaaaggggtacatttcgtcacaaatttctaaggatgctactgcctttctggtctagtgcactgccaacgctaccagtcacagcaccatcaaaaaaagatagtgatgctccagaggggagtcgaccacgccatcagagatcatcaagaatggaccccactaagatcttacttgcaatggctatcctggcatgtatactaacgatgggaatactctattaccggttgtcgcagcgaggtctttctgaaaacttccttgaggatgctcagtaatcttgccttcctgtattgcgttgttgctgattcaaagggttttaccctccctgtatttttttttcgtttacccgttctgggacttttggtggtttgaaggtggggtagtggttagttacataagagttatatagtagactgtttctatgttctgatttttgcgcatgtttatggactactataatggtatacaatattgtact

SEQ ID NO: 21383 - DNA, 484 bp, Sorghum bicolor
  Clone ID: 13237717
gctccggcgggtgatgcacccgatcgacctggtggacaaggtgtgccagcacgacgaggcgcacgccatcgcgtgcagcatgcccaagctccggcacctggagatggggtacatgctgatcgcgacggaggcggtgctggagatcctggggcagtgccgcgacctcaagttcctggacctgcgcggctgctggaccgtggacgacaagttcctgcgggagcgccacccggggctccgcgtcctgggcccgcgcgtcgacgactgctacgagaacagctactgggaggagtgctccgactactcggacgactcctccatctactcgtgggagttcatggacgacgactactacgccgtcggaagcgacgacgaggccatctgggacgacgggcagggactggagaacctcgaggtgaggttctacggcggcggattcagcgagagcttcgccggcttcgactggccaccgtcgccgtgagacctt

SEQ ID NO: 21384 - DNA, 663 bp, Sorghum bicolor
  Clone ID: 13237726
gacctcaacagattcagcgtctgctcatactgagctatcatctgttgctgctgcaccagaaatcaactcaaatggtggtcgggcgatttctagtgaaaccgacgatcatggatctagcctggaatcattttgggcagatctattggagtcatctatgaaaaatgacactcctattggtgcttcttcttgtggtggatctttggcatccaatcagcagactaataatgggacaagagattctggaaataatatcttgcatgccaatgccacaagcaatgctatctttgctccaacaactaatgtagtttcagaagcttatgctaatcctggccataatcaagcatcagagaattactttggatctctgaaacatcaagcaaacaattctccatctcttttaacatcagatctggattctcaatcaaagcaacatgcaaattctttgatgaaagctccagtgtatggtaacatgcctaatgatgtacctgccaggcagaacagtcttggtttgtggaagtacttggatgatgatattagtttagagaataatccaagttctggcatactccccactgaacaagtgaccgacgaaagaccctttcacatcactgatatatcctcagaatgggcttattgtccccccccctttttttgttatgccag

SEQ ID NO: 21385 - DNA, 452 bp, Sorghum bicolor
  Clone ID: 13237728
attgcggtggctgggaattacaggtagcttgaatagggttatggtggatgcactgtctcgaagccggcctttcttacatatggcttgtcgtggtgaagaattagggtctatgctctgggacacctcctctgactggtatcggcacaatgacgatgatcttgatgagctcgaacagtggctcttggagggtgagccggtttcagatgatgacaccatcatggaagaatgaggaaactgtttggtaagctgttgccatgtgccatagttgcttaaccaaatatgatatcaccaagcttgaatcagcgatgtattgatctgttgtactagtagtgaagatattctcgtttgatatacctttccttgggttgccattccgtgtgcatatggcaacctcatgttatgtatgttcgattcagattctggacgttgcgtatggacacatatttttctct

SEQ ID NO: 21386 - DNA, 595 bp, Sorghum bicolor
  Clone ID: 13237740
tagaccttttatccccatgtttgggagaaaaatctatgaaaaactctgctataagtttgcctagaaacgctaactgtagttatgttttcagctatttcaggttcagaagattttaactgacttatgcttatgtatatttaagtcgaatgaaacttgaaggtcaaatcgtgaccggtaggggtgactatctagctcggttactcacattctgaatgggacatggtagccactggatttcgttatagtacgggcccgtttggatcgttggagctaacatttagttgctagccgcgaaaaattagctaagatcctgcttggatccccagttaatattttgcctactcctctgtttttttctagatacactccctctgttctaaactataagatgttttgtttttttagatacacttgtttttgctatgtatgatatagtgtatatctagacgtatagcaaaagctttgtattaaaaaaggcacaatagccattttggtccttcaactattactcaaggcttaatttcgtccctaagtttttaaaacggccattctagtcctcaaactttagttttagattcagttttagcctacagct

SEQ ID NO: 21387 - DNA, 631 bp, Sorghum bicolor
  Clone ID: 13237745
tcgccaaaaataacatgatccagaacggggacttcgaggagggtccgtacatcttccccgacgcgccgtggggggtgctggtgccgccaatggacgaggacgactactcgccgttgtcgccatggatgatcctgtcgacgaccaagtccgtcaagtacctggacgcggcgcactacgccgtgccgcacggcgcgcgcgccgtggagctgctgtccggcgtggagaccgcactggcgcaggacgtggccaccgtggccgggcggccgtacaggctcgagttctccaccggggacgccggggacgggtgctccggctcgttgtccctgcgggcatatgcggcgagcggtagcgtgacggtgccgcacgagtcacagggcaggggtgggcacaagcgcggcgtgctggacttcacggcgaccgcggaccggacgcgggtggcgttcgtcagtatggcctacaccatgaagagcgacgggacgctctgtgggcccgtcctcgacgatgtctcgctcgtcggcttgcacagccgtgctgctcgccggttccttctgtagttctgtgacagtagttagttatgaagtggtgacgtgttcaaacttcagaatagcttgggctgttgggactcgactaa

SEQ ID NO: 21388 - DNA, 628 bp, Sorghum bicolor
  Clone ID: 13237757
tatggctctagcaagttcttctaccaaaaatgaaagtgcacaaaatattggttctactgaacctagaaaaggttattcatggactcagaaatcagcctggagagatcttgtaggtggcatggggagcacatctttcagcatatcacaggtgttgccgaacaacaatccagcaccagcattacatttaaatgttactgaaagtgagagatcttcaaaatccttggaagctacaacacagctctcatctgagcagaggttgccgagttccatgggaatgctgtctactggtactacagatgagtcaacagaccatgccattggtggtgaacctaaggagagcaataagccacaaaaagttcgggtggtcccaaagatcaccattagtgaagtctgccctttcatgagaaacacagagtcacaaaagcaatggtcaaaggcaaagaaagttataactgggttcacgaagaagagaaacgagagcagtgccggaaaggggaagccatcgaataagcaataaaactgttgttttctgggctgtaactcatagatcaacatttcaatactatcagaatcatgatcgtagctgttgtattaagatgactattacataccaaggcgtttttttttg

SEQ ID NO: 21389 - DNA, 532 bp, Sorghum bicolor
  Clone ID: 13237761
tctcagttggaaagccagcttgagcagctttcaagggagttggatgacaagattcgatttgggcaaaggccacgttctggtgcaggcagggttacaacacatgcaccaactagtttaggggaggaaccacaggctacagtggtggacagaccgcgttctcgcggtggtatggaaccacccccaaggcaggaagaaagatggggatttcaaggaagcagagaaaggggctcttttggtggaagcagaaattcggacaggccaatggcaagacagagatggtgaaattgggacaacaagcatctcatagggactcttctggttccagtcccttttttgtttgaaaagatgggcaaaataagtctgttttctatttgtcgtgtttgtttggtctagaagattgttgaggatggagataactccacatgaagttattggttgtcaagtctgtatgccgtaggatgttttacatttccctttttgccatcttccatgttaaaacaatatccggcacctccgatactaactgttattt

SEQ ID NO: 21390 - DNA, 687 bp, Sorghum bicolor
  Clone ID: 13237765
tacgatatcaatatgggatatacgtacagggaagaaaccttgtatttctgtcaaagctcataaagccgatgtgaatgttatctcatggaacaggcttgctagctgcatgatagcttctgggtgtgatgatggcagtttctcagttcgtgatcttagatcaattcaggaggactcattggtagcacattttgagtaccacaagaaagcaattacatctatcgagtggagtccacacgaagcatcatcattagctgtaacatctgaagatcatcaactaacaatctgggacctttcattggaaagagatgcagaagaggaggctgagttcagagcaaagatgaaagagcaggcaaatgcacctgaggatttgcccccacaacttctctttgctcatcagggccagaaagacttgaaagaactgcactggcacccacagataccgtcgatgatcatatcaacggcaattgatggattcaacgtgctgatgcctagcaacattgatacaaccattcctggcaacactgatacagcaatggcatctgctgagccataaggcgtttctggtagcacggctcccagtttgtaattccaggtttatgcagtggtgtatcctgagtgtagttcgtatttgtgttaagtgttatgctgttgtgttcaagcataagagaaaatttggttggctgacat

SEQ ID NO: 21391 - DNA, 618 bp, Sorghum bicolor
  Clone ID: 13237767
tcatgatcacggtgtttctcagaattcagtgcccaaagctgcaaatcatgcgaatcaaactggatcccaaaacaacagcaaccattcagcgttggtccctgtaaagcccgcaccgaaacgtcgtggtaggaaacctaaacgcgttctgcccaagcagctggatattccagatatttgcgaccggcttacatcatctttggcgtgtgaagaaatactgtattgtgaggaagtgaagaatcaggctgtttctgaaatcgacgccctgtatgacgagataaggcctgcggttgaagagcatgagagggatagccaagacagcgtctccacaagcctcgcggagaagtggatcgaggccagctgctgcaagtacaaagccgaattcgacctatatgctgcaataatcaagaacattgcctccacaccgctaagatcgaaggatgacgtggccccgagagagcagaacggattgaagtacttggagaacggttcatgattttagctacaagcgtgaaatatacaccttcaatctttaggagtttgattttttttttaaactgtgattggtcttgtatttaggtagataggcatggtaaggttacagacttataaataataacc

SEQ ID NO: 21392 - DNA, 425 bp, Sorghum bicolor
  Clone ID: 13237834
gaacaagaagaaaatggtcacatgattcacatggagtgggtgttgaagactaccatcagccttccaccgctgtttgcaaatacacgtcatcttcttcacaatcacaacgactttgctgatgataatgatgtatggagggtcatccgcaactataataacaatgaggaagtaccacctgctgatgcacatggcgacgatgatgaatgggactttgacaatgctgacattgtcctcgatgaagccaaagataataagctcactgaagcagacgggcactaccctgttgattttgtcggatttcatccttaaagagattgtcttcttctccttacgatatgggacaatatcttataatttgaatacctcaaagtttcaacagttaggctcacgtataaatataccagtgggcgtcagaacctatttcc

SEQ ID NO: 21393 - DNA, 617 bp, Sorghum bicolor
  Clone ID: 13237843
gtattggaaagcttactgaaacagcagattcattggtctctgtctagtggctcacaggatgaaggcaaatctccctgttgtctatgataacattgttgtgttctgttttgctggttaacatgattgcagtgcgatcgggcctccctacctatcgtgaagcttgatcatgaaacatgcagcggtttatcatttccttcccttccgcaaggggctgacctaatggccttgttgtaccgttttcaggcttctaggccaacagctctatgatccaattcttttatattacttgataggttgctcacttgattgtacgggctgttaggagcattagctttgcaaaatttgtaggaatgtatatgatggtggcgaaggtcaagtcacatggcagtgacagaagaattagaggtgttacaagttacaatagctggaacccaaaacttgttgtggttaatttgatggtgtttggattttggaacgatgatgttataattgcaatttattgtgacaaaggtagattgtagaaggatggcgatgcatctggtatcactgattgacctgttacacgcgtggtactgggttggtctttgttgtactctggcaggtcgtttcgttgaatt

SEQ ID NO: 21394 - DNA, 652 bp, Sorghum bicolor
  Clone ID: 13237861
ggggaagtttgcagaggatgcttatcgcaatgcggtgaaggatcgtaagaagtccattatttacgacaatctttcaacagctgtttgcagccagaagggtttaaagttcctttcagaatttgtaccgcagagagttgccgccgaagatgctttgaaggcgatggcgggcaacaacttgtaaccgattatgctagactagattcttagtcctctgttgaggcatgctaagtgtttttccccagcatgtacaaggaaacctgttttactgactgattactggatgctagtgttcacaccctccatttgggaacgttgcgatgagcttttgtcaactgtatgtataatttcgggttagggttcaaaatctccaggggaattgtcgggtgcgggtgcatcgctcgctcgccccagaccatgcttccttcgatcacgcccatccaaatcacgtctcctcccctgcaagtgaagtggattggatttttgcagaggcatgtcatcatgttggcatggaatcacatagacttgccaatacctacatgagcatgtcttgcttctcaggtgtactgtaatgacatcctccagtgggcaaccgtatataagtcccttttgtaatttagcaattcgaactcagaaagatatagtgcatacaaaa

SEQ ID NO: 21395 - DNA, 478 bp, Sorghum bicolor
  Clone ID: 13238063
gcacgaggctctcaagtccttcatgaaccatttcttcccctccgtcgacaaggtcctctctttggattcgagacaagagtgctccaacgttattcgatctctttgcaccgcaacacccaagggaatccgctggcgtgacgagcgcagctggatgcttatcgaaaacatccagtggcccgagaccgccgcggacgtcgtcgacgatgttgtggtcaccggtgttgttcgcggaaagggtctgaaggcagaccgtatcgcacatgtccccggctggggtgacttccagatcgattcgattaccgcagcaccgctgccaacaggccgcgctaagcgggacgatgccatgaatattgacgacaacgagtcgacccaggtcctggacacaccaaccgcggagcaggacgacatggcggtcgtggcacccgaagaaatcgagatggaagatgagatgcttcccgagcccgaagctgagcagaag

SEQ ID NO: 21396 - DNA, 611 bp, Sorghum bicolor
  Clone ID: 13238064
gcacgaggcgctggacctcggcgacatcccgctcatcgccgacgaggacaccgcgcaccacacgtcgcagaagttcgccgaggactggagccgccacgtgggtgacaaggccaggagccgccggagagtagtaggcagcaacagcctcgccctcgtcctgctcaagtgcttcctcggcgagatcctgctcaccggcttctacgccttgctgagaacgctgtccatagcggttgctccattgctgctcttcgcgttcgtgtggtacagcaaccaggaggagcgagacctccgggtcggcctggtccttgtcggctgcctgctgatcaccaagctcatcgagtcgctctcgcagcggcattggttctttacctcgaggaggaccgggatgcgtatccggtcagcgctgatggcggtcatcttccagaagcagctcaggctgtccagtcaagggaggaagaaccactccactggcgagatcgtcaactacattgcggtcgatgcgtaccggctgggcgacgccatcagctggctgcacatggggtggagctcgccacttcagctggtcttctcagtcgccacgctcttctgggcactcaagcttggggctcttc

SEQ ID NO: 21397 - DNA, 520 bp, Sorghum bicolor
  Clone ID: 13238072
gcacgaggatacatcactggacgttttttgccggacaaagccattgatctagttgatgaagcagctgctaagctcaaaatggagataacatcaaagcctattgaattggatgaggtagacagagaaatcataaggcttgaaatggaaaagctctcattgaagaatgatacagataaagcctccaaagaacgactgagcaagcttgaagctgaactagaatctctcaaacagaagcagaaaaatctttcagaacattgggagtatgagaaatctttgatgactcgtataagatcaattaaagaagagattgacagagtgaacctggagattgaagctgctgagagagaatatgatttgaatcgtgctgctgaactgaagtatggaacgcttttgtcacttcagaaacagctggaagaggctgagaataaacttgttgaattccagcaatcagggaagtcaatgcttcgagaagaggtgactgacgtggacattgctgagattgtgagcaagtggactggta

SEQ ID NO: 21398 - DNA, 603 bp, Sorghum bicolor
  unsure (1)..(603): unsure at all n locations
  Clone ID: 13238075
gcacgaggagtggcttctagttcttcccagaaaaaggacaagatccaccagcgcaccattaatgtcacacaagatagttccaataattcagcatcaactgagctgcgtgcatctgattcggctgccccattgagcgacgaacagcttgcattattgctgcatcaacaattgaacagctcccccagagtaccgagggtgccacgttgccatcaagcagctggtgcacagatgcttcatccaactggagcttctgttttttcgaagcggtattcatcacatggaggaagggatcatgcagcggttataaaaaagagaaacagagaggattcattaaaagatagcgaggacaccaagaggacagaaaaaagacatagagtttctagcacagagcatgctcctgtgaaagactcatgcagatcagctgaaaatatagcatcagaacagaaaaatcgtggcatatgttcaactggagccaacactggtttagcaaaggatgatttgatggatactgttgtttcacacaatttacctggattgattgatgaaattatcagtanagacaggaatataacatatggggagctctgtgacgctatccatcag

SEQ ID NO: 21399 - DNA, 579 bp, Sorghum bicolor
  Clone ID: 13238078
gcacgaggccatgatcctttgactgttgtaattggtgaaagtgatccttatgttagcataggtggacgggagataaatcaccttcatgctgcttctgtcttgatgacagtgataatgatacttgctttcctgacttcaatagctattgctcggcgcattatgatagcaacatctgtcttgaaggttgctgcaaaggtcattggcgaagtccaggcacttatcatttttccagttgtgccatacttcatcctcgctatcttttacatgttctggttttcagcgacacttcatcttttcagcgccggtcaagttatacgaaatgattgtaataatgattgttgttcatatgatctcaaacttggcaaagtaaattgtgacagctgttgtggctacagtatccattacaccccacatattggcatcgccattcttttccatttctttggctgttactgggcaacacaatttttcatcgggtgttcttcgactataattgctggatcagttgcttcatattactgggcacgtggtgaaatatcgcgtgatatccctttccatactgtggtatcttccctgaag

SEQ ID NO: 21400 - DNA, 215 bp, Sorghum bicolor
  Clone ID: 13238080
atgatgtcaaggtttcggtgcaacagcaaaggctatatcggtgccaatgtaatatgcatcaacggttcttcatgcattggcaagactgaactggcattggagtttgcttacaggtactcacagaggtacaatatggtactgtggattggaggtgaagctcggtatttgaggcaaaacatactcaatatatccatgaatatgggactggatatcat

SEQ ID NO: 21401 - DNA, 559 bp, Sorghum bicolor
  Clone ID: 13238089
gcacgagggtaaaatcacccccacctccaacaccggtgagtgcaccacctccaccagtgaaatcacctccgccaccaccggtgccggtgaaatcacctccaccgccagtgaaatcaccacctcctccaccacctgtaagttcgccaccgccacctgtaaattcacctcccccaccggctccattaagctcaccaccgcctccagtgaaatcccctccaccacctgctccagtcagctcaccaccaccacctataaaatcacctcctccaatgagatcaccaccgcccccgatgaaatcccctccaccacctgctccagttagctcaccaccaccaccaccagtaaaatcacctcctccaccggctctagtgagctcaccaccacctccggtgaaatctcctccaccacctaaacaattaccgcctccaccggctcctgtgatttcaccaccgcctcccatgaaatcccctccaccaccggcacctattagctcaccaccaccaccacctgtaaaatcacctcctccaccggctcctgtgatttcaccaccacctccagt

SEQ ID NO: 21402 - DNA, 594 bp, Sorghum bicolor
  Clone ID: 13238097
gcacgaggattggtacttgtgccaacacgagagctatgcttacaggtttacgggattgcacagcagctggttcatcgttttcactggattgtccctgggtatatcatgggtggggagaacagagcaaaagagaaagcaagactgcggaaaggaatatcaattctcattgctacccctgggcgccttcttgaccatttacagcatactgcttcatttgtctattcaaatctgcagtggatagtttttgatgaagctgacagcattcttgaacttggttttggaaaagcagttgaggatattctagagcacttgggttcaaggaatggcgcccctggccaaattaaaagcaaaggggagcatatccgaaggcaaaaccttctcttatccgcaactcttaatgagaaggtgaatcggttggcaaaaattagtttgagaaacccagtgatgatcggccttgatgatcaaaacaagccttcggggaaatcaaacaatgtagggaacaatcatacttctctattatctgatgatgaggaggatgaaatgatgggaaagcagaatgatttagtggaacatgcgggtgatgatttcaagctt

SEQ ID NO: 21403 - DNA, 541 bp, Sorghum bicolor
  Clone ID: 13238099
gcacgaggctttgatttaaaaaatctagcacctttaccaggaatcatagatgcctatagatatcaactaggaatgaaacaactgcaatgtagtgccgttgccatacacaagacaataccatggcttcctcgatcatactgatcgatttcctatatatcttgagaacaatggaagtgtgctttgcaagcaaagggtcaaggaaatgccaaaaaaatccaatctgaattctacctagcaaattctaattcttgaatttagcagagttagtgagccatatgatggctctagagatctatggctgttgaaattgtagtgatgattgtgttaccatttctgtttcatacttccatgatatacattcatacaaccagcaatttgaattgaacacggaagaatctcaattaattaatgttaggacctctatcctcgtcatttatgtaatctgttctacattgagtcctatagtattttaagcatcagatcatagcaggtaagcatctatgtaggtaagcatctatctgctttctccactttactctgc

SEQ ID NO: 21404 - DNA, 456 bp, Sorghum bicolor
  unsure (1)..(456): unsure at all n locations
  Clone ID: 13238106
gcacgaggatcgcaattcgcaacccgaaccaactcttcactcccttctctaccgagctccgagttccgaccccgaggcgagggggaaaaaccagactcctcgcttccctccctcctctctcgtcaccccgtcgccatcctgttgctcgattcgagggcgcgagccttcccatcgccctttcctcgcctagccagcggcgccaatccccgcgctcgcacctagagcgccaaacttctccacggtggcccttcctccgcggcgcccgcaggtgggcgatgcgatcggatgagttggcggcggcggcggcggaggaggagcttcgtggagaggagaggaggggggccttgtgctttcccgcggcggtgctgtccccgccgcatccgcccctaggagccggtgatggccccgaccgcggagccgtcttcgccgccgncgcagcggcgcccccgcacgggc

SEQ ID NO: 21405 - DNA, 560 bp, Sorghum bicolor
  Clone ID: 13238109
gcacgagggctcgacgcagtggagggccctgacggctcagctcggccctccggcgccttctcggcctccggaggcggggctgcggcgcgcaggcccaacgcacacggcggtgtgctttcccgcccgctccagccgctctctaaccgcacccagaagctggcctcgcacattcgtgctacccccttggaggaatgggaaggtaggatgaatgtggggatgtcaaattccgtcacaactgcaatcagggatagcataagggacacagcgattggaaaaataaggaacactgagaaggctgatcgtgctacagtggaacaggctattgacccaagaacgcgcatggttctatttaagatgttaaaccgtggtgtctttaataacataaatggctgcatttctacagggaaagaggcaaatgtctatcatgcaacaaagacggatggtcaggagcttgcaatcaaagtctacaaaacctctgtccttgtttttaaggatagagaccgatatgttcaaggagattaccgttttagacatggttactgcaagcataatcctcggaa

SEQ ID NO: 21406 - DNA, 593 bp, Sorghum bicolor
  Clone ID: 13238112
gcacgaggctcgctatttcgcccttcccttctcccccgatgcgatctcgccaaaccctaatcccaccgcccgccgccgcccggccgtcgtcgccggagccctagccccgaatgcggcggcggtgacgcgcggcgtgtcaccaccaactcagcgtgcccgcccgccaccgcccgtcctgccaccaagcaaacaaagcagccatgggcgccgccgacaagtggctgctcccgctcgtctccgtctccttcgtctcgctcctgctcttcctctccgcgctctcgggcttctccgcctcgtccgcgctcttcgcgcgcctcccgccgccctcctacgtgcgccggggcgccgccgcgccgccttccttcgcgtacctgctcgcgggggggcgaggcgacggcaggaagctcctgcggctgctcctcgccgtctaccaccccaggaaccgctacctgctccacctctccgccgacgcgccggcctccgagcgcgccgagctcgccgcggccgtcgcgcgcgccgcacccgccgtgcgcgccttcggaaatgtcgatgtcgtgggcaggcccaccgcgggcaccccaatgggctcctcc

SEQ ID NO: 21407 - DNA, 631 bp, Sorghum bicolor
  Clone ID: 13238114
gcacgaggccgcctcatcaaatcacaagccccagcccgtcccgtcagccaacccgagcccaaccccaagttggcggcggcggcgcggcgccatggagtccccctacgctctccacctcgccctcgccgcgctcgtcggcgcctccttcgccgctgcctccgcctactacatgcaccgcaagaccctcgaccagcttctccgcttcgcccgcgaccaacagcgccgccgcaaccgcctcctccccgacgccgacgaactcgagggcggcgaagacgacgaggactatcctccggcgcacagggaccacgatcgccgcaccctgcccatcccgccgggcctaccgccgctccacaccggccgagagggtggtaggccagtcatttctccaggttcgactaaaagagttggacctattgttagaccgactacacccaaatcctctgtccccactgtcagtgcatttgatagaattgaagattcagatgacgaggaggatcttgtcccagatgccaagaatgatactgcttacttggccccaaatggtgctgttggatcagatctcacagataaagcgagccaaaatggggaattaaaatcagcaccatcaacgcagatgattagatcccatagt

SEQ ID NO: 21408 - DNA, 419 bp, Sorghum bicolor
  Clone ID: 13238116
gcacgaggccggattagttaggcttggctagctaaccccggaagtagaagaaaagcctccgattccttccctcccatcctctccctcctcgccgaaagggagaaggagaaggatggacagctcagggctgcgggctcaggcgccggttcacatggccgcgggatgctgcagcgaggactgaggactctggatgggtgttcgtcccgccggccgagagagacagagaaagagagagagggagaaggggatagagacgagtggagtcagaaagggccggccggtgaagaagctccattccgtgtttgctcagtgtgatcatcaggtccaactggtgctgatctctctcatgaactgagcaatcaatagaagaaacaaaagggtcatttccgctacagaaaaataaatcatcaggaatggga

SEQ ID NO: 21409 - DNA, 554 bp, Sorghum bicolor
  Clone ID: 13238118
gcacgagggtcggctctttttggattgccagactcattgtatgccaggcctaatacatttggtgaacttatgcgagctatcatatctccatccagcaaagtccaagaagcagttgactgggttttgaagggtgcaaatccagatattgttttgcacacacgcatgatggcgaataggccagtccgagcaagaaaagctgcagttctttgtattaagagagccctacagattagccatatcaagggtacacctctggtggcattggtctcagacacaccagcatttgtgaaggagttaaagtcagacatcagtgagtttgcagaggtactttattttgattacaagttgtttgccaagacttctggtctggagatagttggaaatgataagcctttggattttcgttcaagagactggggatcagctccaaggtgggtggcgtttgttgatttctttgtagctgcacaggccagatatgcagttgtcactggagcacatcgtcgtgtggggaccacctatgcacagctcattgcagcattggctgcggcaaacag

SEQ ID NO: 21410 - DNA, 602 bp, Sorghum bicolor
  Clone ID: 13238132
gcacgagggtagattagggtaagttgttgattcactattttttctagctgatggataagtaagaagagatgaaaatgcaacaccttttctggaaagtgagaagggaatgagtctctatcacacatgcttcagcacacggtcctccataaagctgaacgggtgatgagaggatgatatgctgctgatgaactggtgacctatactactacaaccacatcaaatatttttgtggtgtttcagatgttttctttcttactggtgtaagggtcaaataatgcctcttttaattttgatgtattgttccgatcatcagaacaatggttaaatttgtattctgttggtacagcagggctagcatgcctggagccttcaaaaatcactacacaattcaaagtatgtttgtggctagaataacagtgtcaaatatatcacatgattcagtataaaatgtttcccatatataatctatgtttttgcagacgcatatattatcttttggttggttcaattgtgtttctagatcacactgtagtgttccaatatgctccaaccttgatttattttttcttggatttcatgtattacttaatgaaacaataaac

SEQ ID NO: 21411 - DNA, 548 bp, Sorghum bicolor
  Clone ID: 13238133
gcacgaggcagaaggaaaaaaaaagagaaaatttgagtgggcaagcgaaatggctgtgtattacaagttcaagagtgctagagactatgactcaattccgatcgaggggcaattcatctctgttgccaacttgaaggagcggatttttgagtccaagcatcttggcaggggcacagattttgaccttatgatctcaaatgctcagactgatgaagagtacgctgatgaggccactatgataccaaaaaatacgtcagtattgattcggcggataccaggacggccaaggaagcctattgtcacagaacctgacgagtcaaaagctgcagaagatggtgtagaacaagtcatgcccactgcaagtgcttttcttggtgattcatctatgaaatatcatgaagaatctgagtgggatgatgagtttggcaacgaattatatgtttctgattcggttccttcgcagcctgcttgccaggcggttgatgattctgaaaacaaagttgatgaggatagtaaaataaaagcacttattgatacatccgcccttg

SEQ ID NO: 21412 - DNA, 321 bp, Sorghum bicolor
  Clone ID: 13238135
gcacgagggaaacccccgccgcggggggcaccgagccgccgcgatgctgcacgagctcctcctcgcgctgctcggattcaccggcgacttcgtcctcgacgcctccccgccgcgccgccgcgccgcgtcccaggaagccggcggggatggagacggcgacggagacggcgaggtgggccccgccttccggctcgcgccggacctcaccttgctccagccgtcggagaggactgctattgagaggctcatatctctgggattttactacagagaactgaaccgctttgcaactgagtctcgtgacctgagctggattcagtc

SEQ ID NO: 21413 - DNA, 590 bp, Sorghum bicolor
  unsure (1)..(590): unsure at all n locations
  Clone ID: 13238152
gcacgaggcaagaaagggttggttcttccagtgtggtctccanatggagaaaaaagggcctcaggtcctcacaggaactgagctgaatgctgccgtgtacagatacctccaggaatcaggtttcagaaccatattctaacctctcacatctcggtcagatattagcattacatgtttgtcagttctttcttgggtaaattctgaccattgtgttgttagggatctatgtaatggccggaattagtgttgatttgtttagtttgaatgaaaatctggaagatttatgtctagagagaacaaaaggaaaaaaaatagggaggtgaagggagggagcaggaacagattttatgaaatcatctgttactgctgttccataaatttcggttggttcttggctggggtcagggtcatccattgtcattttggtttcatcaaattgcttagtgcatctgaatttctttataaatctgaaccaggagagagtgtacttctaatttaaataaaactttaacggtgcttcattcctttcagaaatatttttaagacaacagtactacatccttgtatagctntttcttgcttagccaaat

SEQ ID NO: 21414 - DNA, 469 bp, Sorghum bicolor
  Clone ID: 13238171
gcacgaggcagtaatgtgctgaatttctctgctgcgcaaattgtcaaagatttgatgtcaaactcgttcctgcataagacaacagtgtacaagcgtattaaaacatttttgacagagggattccacatgtgtggtaggaagtactcatttcttgcattctcatcgaaccagctgagggacaggtcagcttggttcttcgcagaggacagaatgagaacagtggaaaccattaggaaatggatggggcggttcacaagtaagaatgtagcaaagcacgctgctcggatggggcagtgcttctcatctacatatgctacagtggtgatgcagccgcatgaggtcaatgagtgtctcgaggaagttgaacgcaatgggtacattttctctgatggaattggcaagattacgtgtgaccttgcacttgaagttgctcaaaagctgcgattgacagataatcccccatccgctt

SEQ ID NO: 21415 - DNA, 513 bp, Sorghum bicolor
  Clone ID: 13238172
cggcacgagggtgaggccaacagcagggggcaacaagtacatctgctacaccacgatggtcagggacgtgcgggagggagtgcgactggtacgcacgaacagtccacatggagactgcagggcggatcagcataggcctcctggaggccaggaaggagcaggccacactaggagagcaggctgctggttgcataattcttgtctttgtgttcctgattcctaattcctaaagtgtgaagaaccagagcgcaactctggagcattagcacgagattttgttggcagcaacagtgataaatcgggaacatctaaggtaacatagacataaaaaaatgaaggaacaccttagttcaccacagagcaaaagcgttggagagtcgggcaacaacatgatgtcaaccttgtgtgatgccatcctccgacatggctcgtgcatggtcatgtgatctggtatcatcagcaccttggacaacctcggcctcggacaagcctcgtgcacggtcgtgtgatccg

SEQ ID NO: 21416 - DNA, 548 bp, Sorghum bicolor
  Clone ID: 13238183
gcacgagggaaggatgcagcctttgattattaccacatcaacagcgtcgacaaagatacacaaggcaactacctcatatcagctcgacatgcccattccgtaagctatgtcgatgggagcactggcgcagtcctctggacgcttggtgggaaaacgaacgactttaaagacttgtctgacgggaccgcgacggatttccactggcaacacgatgcgcgctggcgtgataacaacaccataaccctctttgataacacggcgcattccaacgaggatcctgaagcgtcgagtcgggggatgcgcatccatcttgatttcgaatcccgaaccgcggagttggaagttgcgtaccatcacccccaaattctgaagtcaacgtcgcagggcaatatgcaggttctggatgataccgggaacgtccttattggatggggtcacagtgcggcctacacggagttcacaccggacggaaatgcgatatgcgacgtgcattttggcgcatcgctgtattacacctttgggcgcgtggtttcctaccgtgccttcaa

SEQ ID NO: 21417 - DNA, 454 bp, Sorghum bicolor
  Clone ID: 13238188
gcacgaggcacaaggcaactagcactggcctgcttgatgctggtggattagaagaagttctcaaagtccacgtgacctggtgcagctatcttcgccgacgtgcgttcctgtctgactcgaccgacgaagacatcgatgttgccgaagtgggtattcgttccgcgatcgagagcgtgcaggaattgggggaaaagaagtacggaccggcctaccagggcgaccctatgttccgcctcgagcggatctatattcgattcctcagtgaaagcggcagctgggacagcgcccgagaaaccttcagggggcttgtcgcccgccgtggtggaagctacgagttctggcttgcccactattcatgggaactgatttgctggagcaagttcgtccagggtgaagcaactgtcgatgcggcccggcgcacgccgaaccccagctatgccaccgcagtgctgaa

SEQ ID NO: 21418 - DNA, 518 bp, Sorghum bicolor
  Clone ID: 13238190
gcacgaggatcttagactagctatagcactagcgactagcagcagctagtagccgtccgtccgatccgtcagcatgtggaggctgaaggtggcgcggggcgggccatggctgcggtcgaccaacggcttcattggacgggcagtgtgggagttcgacccggaccttggcacgccggaggagcgcgccgaggtggacagggtccgccgggagttctccgaccgccgcttccacaggagggagtccgccgacctcctcatgcgcatgcagtgcgcaaagcagaagagatatcaacgtgatctgccgtgcctcaaacttgaggaggatgagaatgtcactgaagaaattgtagtgagctccttgaggcgggctctggatcagttctcttcgctgcaagcaagtgatggtcactggcctggtgatttcagtgggatcatgttcatcatgcctggtttgatatttgccttgtatgtcactggatcaatgaatgttgtcatatcaccggaacatcggcgtgaga

SEQ ID NO: 21419 - DNA, 542 bp, Sorghum bicolor
  unsure (1)..(542): unsure at all n locations
  Clone ID: 13238193
gcacgaggccctcttctaaccgtcgcccacccacctgactgacctgcttcgctctcttcaaccactcaccccttgtcccttctgcttcgtttccattctcgagtactactactacgacgacgactacttcttgccactaggctcggcatccagtatcctggaaccccactcgttagcattgctctagttagtccctatcgcacatgccgtcatgaagttgttcagccctgcgcaagcactagctgccctctctctgctgtcgacagatgtcgtgcgaccacttacccaggctctgacgctggatcctaattccccagattctatcaaggatgtttctagcaaaattgccaaacagcttgtcgcgcaatatgccacgattgatgacaagggagttcatgtcctgngaggctatccaggtattctatacccgccgtactactggtggcaggcaggcgccatgtttggcacactactagactactggcactacactggcgatgaccagtacaatgacatggtccgcgaaagcctggtccaccagt

SEQ ID NO: 21420 - DNA, 330 bp, Sorghum bicolor
  Clone ID: 13238199
gcacgaggcaccatggaatggagtcaagcagcagcagtttgttccaaaggattggtgggttgaagatctgacagatctcgacattgatgcctacaagcaagtcataacagcaatcaaaaccaagggtatggtgcccaaggatgtgatcggtgaggcaattaaagcctacacttacaagaagctcccgtcactaagcaaggtctcaatgatccatggcgatgcaaaagttcgggctatgctagttaccatcacatgcctgttgccatctgagaaaggttcagtttcatgcagcttcctgttaaagctactgaacgcaacaaatttgctgaa

SEQ ID NO: 21421 - DNA, 450 bp, Sorghum bicolor
  Clone ID: 13238200
gcacgagggaggaccccaagaaccccttgaactggccgtcgtctaccaagtggctgcatgtggccatcatctccattggcaccttcaccattccgttggcctcgtccatcttcgcccccggagtcgtccaggtcggccaggaattccacgtcgacaaccaattgctgcagaccgtcgtggtctcgatcttcgtactgggcctcgcctttggccctctcctggctgcccccttgtcggaaatgtacggtcgatggatctgctacacggtcttcaacatcctgtacacggttttcaccgtggcctgcgccgtctcgaccaacatgtcaatgctcatcgtctttcgcttcttcgccggcgcgacaggctcggcgccactcaccatcgggggaggcagcattatggatctgttccccatggagagacgcggcctggctctctcgttcgtgaccc

SEQ ID NO: 21422 - DNA, 569 bp, Sorghum bicolor
  Clone ID: 13238207
ctcttcgccatggacccgagcttccggttcgacccggacagctccgacgacgaggcggcgggtgccccagcgcggggcggcccggcgcagtcgccgtgggagttctcgtcgtacgcggagtccgtggcggcggagcacgcgcgccgccgcaccacctccatcgacgagaagatctcgcacctgcgccagggacgcgggaagcccgtcctctccgatgactcggagagcgacgtgagcggcagcggggaggatgacagcagcgacgacgaggcgatagagggggagagcggtgacgaggaggacgagctggaggagagcgaggacgaggagggggtcgacgggggctccgatgtcgaggaggacatcgaggggagtggcgatgaggaggccagcggcgatagggagggggatgaggacgggagcgacgaggagggaggaagcgagctgggagaagaggaggatgcccatgaggaagaagatatggccgagcagaatgacacgagtggaccagttgatccttctaaattcttcgcttcttcagagggggcatcgtttcatgcaaattcgtt

SEQ ID NO: 21423 - DNA, 527 bp, Sorghum bicolor
  Clone ID: 13238216
gcacgaggggcgtcgcctatttctcggacagtcgctcaccaccatggcggcagcatccgccgccgcagccgccgaagccaacggcgagagcaaagacgaattcctcatacgcgacgacgcgccggggctgctcgccgctctcaaggagatgaaggacggattggacctcgtcaggggcaaggtcgaggccatcacccggaaggtcaaggagaaccagttgccgacggccaacgggatcgggtacctagatgcgaagaaccagctgctccttggctactgccaggacatcgtctactacctgctccgcaaggccaaggggctctcggtggatggacaccccgttgtacggagccttgtcgagattaggctgtttctagagaagattcgtccaattgacaagaaggcagagtaccaaattcagaagctcaccaacgctgctgacaatgcaattgcacgagagaagacaggaaatgcagaggcgaaggggaagggcgagcattcagatgaggatgaccccctgaagtata

SEQ ID NO: 21424 - DNA, 586 bp, Sorghum bicolor
  Clone ID: 13238229
gcacgaggcattttctcaaatgcgtctgtccgaggcttctgcacatttggcatcgttttcagcaagaataagagatgaagcctctcatactcaactaaactcttccaaagaagtgtcagttatagcagaatgggtggccgttacagctgtaaaagctgcagatgctgtcctctcaacctgtccatcaatttatgagaagaggtgtttactgcagcttctttcagaagtggattttgctgatggtggcacttcgtcatctaactttagccgaagatattggaagattaatttgtctgaaccttctttgtgtaaagatggtgatatctacaactggaatgatttgatggatgatgcttctcttttgacatcattagaaaaggacggtcaatgggagcaagctcgaacttgggcaagacaactggagtcaagtggcatagcttgggagtctactcttgaccatgtcactgaatcacaggcagaagccatggttgctgaatggaaggagtttctttgggatatcccacaagaacgtgcagccttgtggggtcactgccaatctctctttatgagatattcttttcctcct

SEQ ID NO: 21425 - DNA, 532 bp, Sorghum bicolor
  Clone ID: 13238245
gcacgaggtcaatgcatgggaatggtcccaggtttatgccaggtttgatgcctcatcaattgcaacgtcccaatggactgatgccacctcaaatgcagccacctcgtcaacatggaatgctgccaatacaacagtcctcaccacagttctcacaactacatgcacagatgattggtccccatcattccccaccacaaagcatgcagatgtttggtcctcagcatcctccttcacaagtgatgagtagatttgatgtaaactttgctatgcctgacttgagtgatccaagagcaagatcaatgttgcaacatggaaggctgggacagcgatatcctcaccaaggttatgagctcaataatatcaggatggataatggatggccacggttcagatccaagtacatgtctaccgaagaaattgagaacattgcaaggatgcagcaggctgccacacagatcaatgacccatatattgatgattactaccatcaagcttgtttagcaaaaaaatcagcaagtgctcaactaaagca

SEQ ID NO: 21426 - DNA, 356 bp, Sorghum bicolor
  Clone ID: 13238257
gcacgaggatctcgccgccatggcgtcccagcttgccgtcctcctcatcctgctcctgccactcgccggcgcgtccaccgacgacgggttcatccggcaggtgacggatggtcgtcgttcccgcgctggcgcgggcgccctagggctgctcccggaggcgcagttcgcggcgttcgtgaggcggcacgggcggcggtactccgggcccgaggagtacgcgcgtcggctgcgcgtgttcgcggccaacctggcccgcgcggcggcgcaccaggcgctggacccgaccgcgcgccacggggtcacgcccttctccgacctcacgcgggaggagttcgaggcccgcctcacgggcgtgc

SEQ ID NO: 21427 - DNA, 490 bp, Sorghum bicolor
  Clone ID: 13238260
cgcaggtgtgcagcccggaggccgtcatcttcggcgccgacttcgcgcagtcgctctactgccacctcctgtgcggcctgctgtacgccgacgaggtccgcatcgtgtccgccaccttcgcgcacagcctcgtcctcgccttccagaccttcgagcgcgtctgggaggacctgtgcgccgacatccgcgcaggctccctctcccagacgcgcgtcaccgcccccgccgtccgcagggccgtcgaggcgttgctcacgggccccaacccggcgctcgccgacgaggtggtgcgcaggtgcgccgggctcagcaactggtacggcgtcatcccggcgctgttccccaacgccaggtacgtgcacggcatcatgacgggatccatggagcactacgtcaagaagctccgccactacgcgggcgggctgccactcgtcgccgccgagtacggcgcgtccgagggatgggtcggcgctaacgtcgagcccgagac

SEQ ID NO: 21428 - DNA, 520 bp, Sorghum bicolor
  Clone ID: 13238261
gcacgaggctcaaattttcagtctggttttccccaatgcattttctgtgaagtcacttctgatcaatggtcataccagttcaaaaaccattgttagcaaagccatatggactgacatggcaactgttttgttgcagctaccaaaattatctaactaaagagacttctgaccttttgctaagcttgttgaagccggtccttgtgctctcaggccatgatcatgaccaatgcacagtcgtccactccactccttttggtccagttacagagcatacattggggacaataagttggcagcaaggaaatctctatccatcttttatgctgctatctgctggacccaaggtgtcacaaaattcaactgatccggagcatgaggttgttacaaacctttgttttctgcctaaacaaacccatatttatgtctggtatatctgccagtttgtagtgaccatccttcttctagtcttctggccaacaaatggtctcagttctcttccttgcatgaacacattggtgag

SEQ ID NO: 21429 - DNA, 499 bp, Sorghum bicolor
  Clone ID: 13238272
cttgattttgaagaacaacaatctggtgggggtgattccatcgacactctctcaacttccaaatttgaagatattggacttggctcaaaacaagctaagtggtgaaattccaaatctaatatattggaatgaggttcttcaatacttgggattgcgaagcaatagtttagaaggaagcctatcttccgatatgtgccagttaactggtctgtggtactttgatgtgaagaacaatagcttgacgggtacaataccagaaaccatagggaactgtacaagctttcagggatttgtcaaacaatcaccttactggagaaatcccattcaatattggtttcctgcaagtggctactttgtctttgcaagggaacaaattctctggccctataccatcagtgattggccttatgcaggcgcttgcagtgctggatctgagtttcaatgagctatcgggcccaataccgtctatactgggcaacttgacatacactgagaaatt

SEQ ID NO: 21430 - DNA, 562 bp, Sorghum bicolor
  Clone ID: 13238273
gcacgaggggcgctgctcctctccctgctctccctctgcctcctcctcctctccgcgctcctctccatccacctcgtccgccgcctccgccaccgcggcggcggccgctccggcgccacggcgtcctccgcctccgccgcccaccgccgcgccgcaagcaaccacgacgacgacgatgacggggacgaggagggacgcagcctcaagccgccgccaatgcccacctcctccaccaaccccagcaccgagtttctctacctcggcaccctcgccaccccgccgccgtcgggaccgcagcaccccgggaccagctccaatctacgccctggctcgccggagctccgccctctgccgccgcttccgcgcgtcggaccgccgtccggcgagttcgcatcccgcagctccgcctccgaccccagcaccgtgcctcccgccgccgctgccgatgcctcgtcctcctcgctctctccctcctcgccgtcggcttcctcacccacgctcggctccagccccgtccatttccgcccgccgtccatcccgcagccgcgtggccgagctccca

SEQ ID NO: 21431 - DNA, 431 bp, Sorghum bicolor
  Clone ID: 13238285
gttttagccattgcactgcctatagttgctgctgcaatactagctactatagtactttgttcatgcctctggaggaggaagaggaaaccagggaagtcaacactaccagatacaactaacccagaggacatacaaagtattgattctctcattattgatatatcaactttgcgagctgcaacagaaaactttgatgaagccaataagctcggtgaaggaggttttggttcagtatataagggaatcctccctgatgaccaggaaatagcagtgaaaaggctctcacagacttctagacaagggatggaggagctcaaaaatgagcttgtattggttgctaagctgcaacacaagaatttagtgaggcttgttggggtttgcttggaggaccatgaaaaattgcttgtctatgaatacatgcccaacaaaag

SEQ ID NO: 21432 - DNA, 133 bp, Sorghum bicolor
  Clone ID: 13238295
ataattcaccctgctcgttaccttaaagagaatagccagcctagttaaggggaagacaaatatcgtcaggatgggggagcccgcccaacgccagtcctagggactgggatcggtttggaaacatctgacttgg

SEQ ID NO: 21433 - DNA, 578 bp, Sorghum bicolor
  Clone ID: 13238297
acgccgtggcgcgcgccttcgggcaatgccgctcatccaactacctgcgcatccaggtgagccaattcgtgcatttgattcctgtttcttgtctttattatcgctctgttcgtatcaactctgctaaaaaaaaaactgggcgcgtgatcaggcgaagcgggagagcatgccgccgtgcggtccggacggggagtacgatccgagcccagggaacgtgcgcgcgcttctcgcggcggcggacgagatgctcaagcagcggaacgtggagtcggtgctgttcgaggggaggcgagtcggggagcagacgaacgcggagaagctggactggttcgcggccgagctcgtcgcggagcaccgctgcagaggctcccggatcgcacccaccgttgcgttcaagcaggcgccgcagaagccgtagaccctggcgttaaggacgtgcagacctctctttcttcttgcttgggctggcggcggctggaatcctgctgcatatttttgacgcggcagcatggcatagcaatatggcattgctcccggaagcatttgccgctgtgaattcttttaagggaggatggaat

SEQ ID NO: 21434 - DNA, 587 bp, Sorghum bicolor
  Clone ID: 13238308
cctcgtcttcaaaacccggcaatcccagaacgacgaccccgaagtcctcgacgccgcagactctgagcccctcgacatcaacaacctcgacctcatcggcacaggcacagtcgtcgcaccggaccaagcccgcgtcgtagccaagcgcgccatcctcacaggtcacccgtttaaaatccacaagaaggtcgttacgatccggtacatgttcttcaacgccgaggacgtcaactggttcaaggcgttgcagttgtggacaagacgtggacggagtgggttcatcaaggagagtctgggtacgcatggataccttaaggcgacatttgatgccaagcttaatccgcaggattcggttgggattagtttgtataagcgggttttcccgaggaaggcgagggctttggaggatgttgtctattagacaaagtgaatttggattggcggttttttcggttttattttctttgttggttctgtgatggatgatatgataccagtgtgacatgatttgatgatcaatctagatgtcctggatagtttagggcaaaaaagcatttgagtatataaatgaatggtttacgagcagg

SEQ ID NO: 21435 - DNA, 449 bp, Sorghum bicolor
  Clone ID: 13238310
catcgactctgcaacggatgcaatcctgcagaaagtaatcaggcaacagttctcaagttgcacggttataaccatagctcacagggtaccaactgtgacagacagcgacagggtcatggtcctgtcctacgggaagctcctagaatatgaaacgccagccaagctgttggaagacaaacaatcagcatttgctaaacttgtggctgagtattgggcaaataccaagcgaaattcaacatgatctaccattgttgcaggacatgataaaagatatgatcagttcaatcaagatatcgaaagattcaagggttctcaaatcgaatctgtaacaatacaaggaatgcccgcatgattatttgattgatgtggttactggaagtaaataagaaatcaacagcaattcaattttggtagtggaagcaatttttggagtcagggtttgataacat

SEQ ID NO: 21436 - DNA, 624 bp, Sorghum bicolor
  unsure (1)..(624): unsure at all n locations
  Clone ID: 13238318
aggaggccgtttatgagataatgaagaagcaggtgattgagatggcccgacaaacattccgaccagagttcttgaacaggatagatgagtacatagtgtttcaaccactggatacaagcgagatcaaccacattgtggagatccagttgaatcgggttaagaaccggctgaaacaacagaagattcatctccaatacactacagcagccgtcgagcttctggggtctcttggctttgacccgaagtatggtgcgaggcctgtcaagagagtgattcagcagatggtggagaatgagattgcccttggtgtgctgaagggcgatttcaaagaagatgacactgtcctcgtggatgtaagttctgcggcgatcgcaaaaggacttgccccgcagaagaaacttgtccttcagagggtagaaaatagaaacgaagagttagttgccaatgactaggtcaggggttcaccttttagctagaaaatgctccagtgagaagatacgcagctgttagctctgcattttcgcgtctgagaaacttagcttggccttttaagttcgtaccttatgaagtgtcgtgtccagtctccggtggcaaaactcaacttgcaatttnctgtgaatataa

SEQ ID NO: 21437 - DNA, 552 bp, Sorghum bicolor
  Clone ID: 13238321
actggaagcagagaacatgagaaccagacctgaaagggattcagagggaagtgctgatttgcatcaggatgacctgcctaggggcaaacggaagggtcggaaacgcagacgacttgagctcaaaggtaggagagtcagggatacaaggaagagatccagcattgattcttcctcagaagatgctgctgccaccttgtcggattccagtagtgacagaaataataaccccatggatgacgagaacaaagaagataattctgttgccccagaaattggtggttgcatagacgctaagggtgcagattcaagttcataggattcaactggtggtatatgcatctgactggaactgaatcttgtggctaatgttcattttggttagtgtttgatggatttcttttatccatcttggaccaaaaagaaaaatgggtactgcagtctgcatcactatcccttgagagcaggaactgaatcgacctggagttcgtctctaacaaatatgttgttatatgttcagcaaatagtgtatatattattagtcagaatttagcc

SEQ ID NO: 21438 - DNA, 476 bp, Sorghum bicolor
  Clone ID: 13238322
tctgcgtaacttggatgagattgagaggaaggttgccagccatcgaaggcggcttcagtcagaatacggtttatccacttcagctgatggtgctaacaggcgatcttctgaaagaacatcatcagagcggaaagagaggcgtgacgatgcacatgattatcctaggaaacggcgtcggagccagagtagaagccgcagccctccaaggaagtcacaggagagggatcgagagcacaatcgaagtagagaccgatcgcatggcaacgatgccgggagggatagggtgcgcgagaaaagtgcaagccgagggcgagacgaccactacgacagaagccgagacagagagaaggacaggagaaaggggaggtgaccgacctgaaaccatcttcaccactcaccatttgcctggactgaagggcccaggagcaatgcgatatttgagctgggctacacgcccaccagcagcaacatcagta

SEQ ID NO: 21439 - DNA, 443 bp, Sorghum bicolor
  Clone ID: 13238328
gacgccggtgctggcgccgccgccgaacctgtcgtccatcagcagctactcgtctcgtcgtagccgatcgatcgccggatcggtcgagactgatgatgatgatgcatatatactcgtcgatggagtagacagcctaatcaagcaaccctgaaactatgaatgcatgcgtgcgcttcgtgcttgcttgcgcatgcagctagcaggcttcattccgttccgcagctgctctgctccaacctgctctgctggattgatgtatatggtagaagaattaagagatcgatggatgacggaggaagaagaagacgaagacgacgatgaggaaaaggacacgctgtacgtagctggttcttctagtctagtttacagcaggccgggcggccggctgctgcttccaatcgagtttgtcgttactgacgattgttagtggatcgattaactat

SEQ ID NO: 21440 - DNA, 363 bp, Sorghum bicolor
  Clone ID: 13238334
gagtggatggaaaccagttcctcttgttgatataattgaaggagcagcagtcaagaaggcttaccagaaagcattattatgccttcatccagataagttgcagcaacgaggcgctgccatgcatcagaagtatatagcagagaaggtttttgatattttacaggaatcatggaaggaattcaattcaatcacttttggatagtattaggagtttactttgttattgcaatggcataatgatatctatcgcacagacatattgcgtcccggtgtctgcaacagttggtcgaaacaacctagaaaaacatagcaaatgggcaaagagagtacggtttatgaatttaggcacactggcaatgcctc

SEQ ID NO: 21441 - DNA, 466 bp, Sorghum bicolor
  Clone ID: 13238342
ggctaatagtctatgcttttattgccttgtaaggacatgatgcaggtaatggtatgttgaggtttggtagggctgcaccaaacaattgagtggatgctggtaacatctatcctgttgtaatccctcctgataacatctagaattaaatttcttgatggtttcccctacttaggtgtagatttcccttgcagttcagtacctcaacagtatagttgcttccaccaagtttttagctaggttattttggttaatgcttgcccatgttttttagaatgacttttattcttgtgcgtgaattttggttctagaaacaacatcatcattccgtaagtgaattttgagatagcactttgagataacaatgtcattttagttatttattgtccccttgcagttcttgattcctgggctaccgttgcatgtcttgattcctgggttgccgacaaaaggagaggggttcaggatg

SEQ ID NO: 21442 - DNA, 604 bp, Sorghum bicolor
  Clone ID: 13238352
aatgttacacattatgatgagctagtagggagtggggttccttttgcccggaagtttaaggagaatgaaccactattggacaagattgatgataaagtgctacgacgttggcgccacagacctgttcctggtgcatggtgcacaggtaggaggaggtggttcagtgatccttgctcccagtggagcaatgtcaacattgtaagacctggtcctcaagctgagaagttccgaacatatatgaaccggattctggaagaatcaaagtcaagcaacaactcttgcaagcaatagcagtagcatccaagcatgaggctttacttcccgcagttgaagcgttgagcttgtctcattttgcacagaggagctcgcatgtctcgagaacttcctgccatcgcttcaggagcaagcatttttgcacctgttgtatgaacacacggccaaggtgagagatgggtttattctttcttgattttttttggtgtcatggcttcaagggtttagtgcacactagcattattggaagccaagagagcttactgtgggaatacggaagactaatagacattgtaattagtagcaatgagttgaatggcatgtgcctttg

SEQ ID NO: 21443 - DNA, 576 bp, Sorghum bicolor
  Clone ID: 13238359
gcttggtgggacggtcagtggcaaagccccattcctagggatgtcaggaggctactggagtacggcgtccggttatcaaacactggcgaggtcgacaagaggcacctcgtgtcgcactgcaggtcaaggaaagatcatgtaaagaggtaccatgtccttccaccatacaagaacccggcacgatcataggctttggaggtcagcgagggacactgtctaacatcatgctcttcgagagcccagttttgtattaaccacttatgacgggtctaggttagagtggccaggcttttaaattggccatgctggtaattttcttgtcgtgccccaaacggtgccagttttgatgatctgcagcacaggtgttcgtatatcgctgttgttgatccgtgataagatcggaatgcagatagcaaatagagatggggtgatgtattaaggcataggcgcatagccttgcattgcccaatgagttctgagctagtggtctaatctgtcattaaactggatagcagaacacccaccctgaatgtagagtgatgtcgatctgtctactgatgcgattttgatgttttt

SEQ ID NO: 21444 - DNA, 543 bp, Sorghum bicolor
  Clone ID: 13238374
ccatctatggaaatatcaagaagcttgaagtcaggttgtacaccacgggagaagatcaagcatgcaatgaaaatattgagtttggaagtgtgtgtttttttaccaatagtgggaacagtacatcatactggagggagtaggcgagtagcaatactttctgttggccagggtgaaaatggagttgttatattgcctcagattctttctagattctcattaggttttggtctcagaaacttttagagaatcttttgtaattggattgccttatattaattcttgtcatcactctccgtttatatttttgccttaatttgaactaaaccttggtacactgtagtattgtacaaccaaacatataaccttggacaagtagcttttgcggctgagacttagaactgcccagttactgtataactccaaagttatctttggtaatcttatttttgctggtagtttccttgtacaatcatggacttacattaaagtgcttttcattgaacagataaataccgtgaagactggcagtacacaccgaaatga

SEQ ID NO: 21445 - DNA, 428 bp, Sorghum bicolor
  Clone ID: 13238392
gagcctccatggtggttgtgcagtcataaggggcgagaaatggtcagctacgaagtggatccgtgtggcctcgttcgataaggtccattacccacaaggcaactgcaccgacgagaacgagagctgctcgaaatgggcggccctaggggagtgcataaagaacccagagtacatggtgggaaccacagcattgcccggttactgtcgaaggagctgcaatgtgtgctagggtcaggatgtgagaggacaactggcgtgttggaaccattgatcttgacacaggaacaggttacaccaagttgtttcgcaagggtttggcctggattctgctggttttgttgctccttgctcctgattagatattgggttttttggtttcccctagcggttttgagcggtaaccaggcaggagcttggaagagtactct

SEQ ID NO: 21446 - DNA, 649 bp, Sorghum bicolor
  Clone ID: 13238432
atcaactggtagatatgagcgaaaacgaaggagatcgatcggtttagcttgcttcgttccataatctcctgtcacaggttacacagcttcttcatgtaaattgtatcgttcatgcatactgtttcgggtcttctatcgaagccatttatcgtctaccagatacccagtcgcaaaagcatacatgctcttatggacaaggtcgatgatctgctcgttgacaggccacgtcctgcgcggtgatcctcgtcggtcctatccactttgtttgagattgccaacttaccatggagacgcgcccacttccgtcagattctcgagcgactggtcaatcatgagccgaacgcatatcaacataaaactggaaaccggtcctcgcagcccattcacactcaccagcgctctaatgatcccggcaactgcatcttgcccgtagtgcattaccatgttgagtctgaatatttcgctgtccgggcgcggtgtcaggccgagtagtcgttccaatgtgtggcccggtatgcaggagctgggtttttcggtaaagagttgttctatttttctcggctatggtcattctagtagtagttagatttgttgagtatcagcatgggtcaggtaacacacgatgccaccccgagtagcctgctccgga

SEQ ID NO: 21447 - DNA, 514 bp, Sorghum bicolor
  unsure (1)..(514): unsure at all n locations
  Clone ID: 13238438
cgccgagtggagaaacgaccgcgtcacatcggtgaagcgggacgacaaacccaagaaggttgctctccaacccaccgccccaatcaagcgacctcagcaaccgggccggaagggtggcctcggactgaaacgacacacccccgcccacgcaccgaaacagaccccagctgaccatatggacaccacggccgacggcgagaagcccaaaaagagcaacgatgacttccgcgccatgctgcagaagtgaccggcatgaagtccaagtgcaatgacagtgttcctggcgcaaattcttttacggcatgtattgggttggcgtttgctttgcttttgtttatgtttctacttcggtggttctctttatgcctttttcttttctagatccccatctactcattcgggtccttcgcgccacgacctgttctggcacatgccgtcgtgtatattatgacttcgttctgctcttagttctaatgatgatgtctgttnccgaagggntgtcttgtcaagacga

SEQ ID NO: 21448 - DNA, 609 bp, Sorghum bicolor
  Clone ID: 13238444
cccccatcaatgcggcatgaagtggtggagcacaggcttcgatggtatcggtatcggcggcgtgggcccccaaatgacggccctcaatgtcatctccgtgctaaacgctcagcgtgtgcccgcgccctactcgcattcgacgggtggaacgagtaaaggcgacccaggcctggggtctggcagcgacgacgatcgcctgccgaaattcgagaaggaaatcacgacggcggacaaggcgggcgcggcgattcttaccatcttggcggcggccatgttcattggtgggtcgtattggatgttaatctgagagggaaccgggttcattctaaccattctttttctttctgctgtgtctgggccgatgcaaaagaacttcttttttctttcacccttcttcttcttatcacacggattatttttgtttgtttctctcggcttatactcgtcccgaagaaggggggagaatcaacggatggatgggggcatcaaaggtgcggataaaattgagcacccgtggcgttttttttttggcgaggcttgtttgtctggactttttggggggttgggctttcgtcgagtgttatctgtatacatatatatacatacgcc

SEQ ID NO: 21449 - DNA, 537 bp, Sorghum bicolor
  unsure (1)..(537): unsure at all n locations
  Clone ID: 13238450
gcatctctgggctcggctacctaggcctagggaccgggaatctcattggcctcgtcgtcttctccgcaaccagcgaccggtacatggtgctgcaagcccagcggttcggatcggccaagcccgagcatcgccttatgctgatgatcatctcgggccccatcatcgccgtgggtctcttctggtacgggtggagcgcacaggccaagatccactggatgatgccgattgtgggctccggcatcgtcggcctggggaacatgctcttcttcctgcccatggtcggttatctggtcgagtcgttcacggtgtatgcggcgtcggccatcgcggccaatgcggtcctgcgctcgattggcggggcgctgttgccgttggctgggtatcgcatgtatgacacgttggggtacggctgggggaattccatcctggcattcatggcgttggtctttacgccggtgctggtggccatctatcgctatggggagtatatccgcacccgatggccggttcggttgtagtacatatgtacataccttn

SEQ ID NO: 21450 - DNA, 273 bp, Sorghum bicolor
  Clone ID: 13238469
ccgggaccaggacgccgtggactgctgcaacaagtacggtgtggccctcgtcttcaccggcatccggcacttcaaacactgatcgatggtcgctgaagaagccgccgacgatggcgaggatgcagaagagactatcactgatggaaggaacctagctacctcgacctgggctgatgatggctgcacgctggctggaaggaagaatctgttgtttcccagtgctgatgcctgatggcattgcttggctatatatagggaaattaattatgatgt

SEQ ID NO: 21451 - DNA, 383 bp, Sorghum bicolor
  Clone ID: 13238479
tggttttcaccatgattccttgattctttttgtcatcccactctgaaacttccctagctgcatttggatttggtcgaagctaaagatctacggagagacttatcatctacagagagtaccatcattgtttcatctgtttcctcccaactttccatttgtggggatgagagttttgatactctttttcttgagaggatagcactgaagttaaatgaaagtatgtgcactgtcccaaagccactcctcagtcctcgctcgtcactgtctcccttgggatttctaatcattttgccatcgatacggtggctaactctccaattgacaagtttagcgcagcaactacaaaattacctcgaaaaacagtaactcagctacattttgac

SEQ ID NO: 21452 - DNA, 434 bp, Sorghum bicolor
  Clone ID: 13238486
tgttcgacctggagctgatgaaggacaagggcatcgaggaggagatggtggcgatgctgcagctggcgctgagctgcgccgcggcggcgcccgagcagcggcccaagatcgggtacgtggtgaagatgatcgacgaggtccgcgcgtgcggggtggcggtggaggggtccgcgtcgccgtcgcacgagtccatgtccatggacgagtcctccggcgtctccgactcccccgccgtgtccgagggcggcggcggcggcggcgcgctcagccagtgacgggcgacctggtggtgttggtggtggtccttcggaattgccttgtgatgcgtgccttcgatttaattgctcttgttttcattgttgcttttttgggggtgacgtggattagccagggccgttggatccggtgatcggacgtgtatatgggttagctgg

SEQ ID NO: 21453 - DNA, 480 bp, Sorghum bicolor
  Clone ID: 13238508
ccaacttcaccgcggtgccggccggcgacgaggcccagatccgcgcggcgctggtccggcgcggtcccctcgcggtggggctcaacgcggcgttcatgcagacgtacgtgggcggggtgtcgtgcccgctcctctgcccgcgcgcgtgggtcaaccacggcgtgctcctcgtcggctacggcgcgcgcggcttcgcggcgctgcggctgggctaccgcccctactggatcatcaagaactcgtggggagagcggtggggggagcaagggtactaccgcctctgccgcggcagcaacgtatgcggcgtcgacagcatggtctccgccgtcgccgtggcgccggtgccgtgaaccaactcaaaccaccggggccgggccggtggccagggtgtattagtggaacggtagttccggacgtggcatggtattgttgatgcagtatatatgtacaagcgaataacaacactgatacgtaccgttt

SEQ ID NO: 21454 - DNA, 228 bp, Sorghum bicolor
  Clone ID: 13238513
ggcgtggaagcgttgttgcaagggcaacagcaggaaaacaccgtttggagcctgattcatcatcaattcttgtggacgtgggttctgagatgacatcagaagatggagggaagttggcccgcggtagcaaatcgagagtaaggaaggtgctccaacggctgttccgtgtgattcagtcgattgttgtcattgccgctctgaatgtccccctgtacatgatgctcctgt

SEQ ID NO: 21455 - DNA, 442 bp, Sorghum bicolor
  Clone ID: 13238524
ccagtctcaggagagcatctgcttgtcgtcagtgaaggagatggcagagtggttcattggcgtggagtcaggtaacgatgaagctcacatgttcagaattttcgctggagtgagggagttcctagctatgctcgaccggatctgcaaggaggctggggaggtgaacagcaacaactgggtcggcgcgacaacggcgagctggatggctgcgcccatggggatgacgccttaagctgcaggagctgccttggcaaaatctgtagctgtcctttttgtagaatatcatatccaatcgagctatttggacaagtatggttcctagtattagcagtagatgagaacaatgttatgctatgttaagcctatgcctctctctatataaatatcttgataatgtatgctggacaccctggctattgtaaagtttactgttactggtaat

SEQ ID NO: 21456 - DNA, 599 bp, Sorghum bicolor
  Clone ID: 13238568
tctttttttgcaggggggtatcaggaaatatggaggaaaggcccacacgttaggtttacatagagatattaacttgtgcgtcaattttccttggactagaagagtccagaagccacacgaacgagcgggaggccgagcgggcccacaggtagggcgcccgccctcctctgctggccaatcagcatgcgtcacgtggattatgctccaccacctctaaggatcaaggaaaaccattcaatcaaggtcggtttgatccgacggcttagattcatttgagagggctatataagcagggcccctggcccctagagagagcaatccccattattcataagcatattttccagagaggattcagagagagaggttcctttagggttccaatctcctagggcttagcatccaatgtgagattagaattagttcttctagattgagagagatagagtggaggtgtaagcatcctctgtggtgtttaggttctgtaagcctctccaatagaacagtagaccatccttaccaaggttagaacgagggtgcagtcgtaatcttctctatacatcgctcacatcaaatcacagtggttgtagcctaaaggt

SEQ ID NO: 21457 - DNA, 367 bp, Sorghum bicolor
  Clone ID: 13238591
ctgaagtgatgctgtgccgggtgctcatcaccaatcaataagaacttacaatctgctggggaatggagcgcttcatctgctgtgaataaacttttgctagcagccatttatttgcttcgtatgtactgcattgtttgtttaagctaatctgagacccgaaatgatgttacagagttctgatttgagatcatacaagaaaaaagacgttatctaaatgcaagctgttgttctacttttagaatctttgtttaagtttaaaatatagcggtgctacactattacccctttggcctaggagtactatttacatgtttgtattgagcgtcgctcctttggtcgagggttatcggtcaatgatgttgtaaat

SEQ ID NO: 21458 - DNA, 693 bp, Sorghum bicolor
  unsure (1)..(693): unsure at all n locations
  Clone ID: 13238609
tgagnatgcattcatcatgccttgtaagggaatattaagattctgtgccatgtcacttccggatttgtggagaagccgtcgtgaccttaaagatgttgagggttttgaccactcagtagttaatgatactttaggagcctgcggtgacctgcctggagagcagcaaggcccttgcctaccttattatgtgtggcaatgtggttataccaagaaattaagtgaagtgtactctctcatggacttcaacttttctgagcctattcactcttgttttggtgaaacaaagattgagtttgcccacgatggaacatgccatggtttcgctatttggatcgactgggtacttgacaaggaaaatgccatcgtgataagcaccggaccagagagcagatactggaagcaaggagtgcagctgcttagcaagcctgtacaagtgaatcgagcgaattcggtgatgcatgtggaggcccatttcgatgctgaaatgggggagctcgcgtttaaatccaccacgctttcatgatgtgatcatgtgatgcaaactgtaatgtgagaacaaccaagctcatgagtgtgtttcctagcgtgttcttcttaaagttagcatttgtcgttgcgttttgtttgtcggagctcctaatgtgagtcaagctcatgattacgcagaccttgataagtnctactataaagaca

SEQ ID NO: 21459 - DNA, 101 bp, Sorghum bicolor
  Clone ID: 13238635
cctgggcaagaccatggcggacatggtcgcgcaccccggcaagaagtctccggcccaccccaagaagtcggtgctgtccatcgagaaggaggtcaccactt

SEQ ID NO: 21460 - DNA, 318 bp, Sorghum bicolor
  Clone ID: 13238657
taaagaaatcaatagagaaacgtggtgtggagcttgtgcttgtcaatccaactggagaggtcatggagaaaatacagcgagcaaacgaggctcaaaactattttaggccagattgcttgtatttgaccactgctgaagcagtcgcttcactttctgcacttgccaagatgacaaaaccctaaatggattgctgaattgtcattgtgttcatccattgcactgttaaaactttcggtgcaggattttctgtcatgggaacttgggaagtgcatccaaggagtacatcacagctatgtctgtatctagtagaattcttca

SEQ ID NO: 21461 - DNA, 351 bp, Sorghum bicolor
  Clone ID: 13238667
acgagcgtcgccaccatgtctggaatcgcgctctccgccggcagatgagatgacacggacaggtacgagtccgccctttggagtggaggctgcgattgggggaccgatgctaattgtgatgttccactgcgatttggcgtgatgctaattttgatcatatatggataatcttatcgagtagtatttgtttgttcttaacacaaaatttgttgatcacaaattgtggtatcccactggatgaggacaaacaaccctaatcttaatccgttctctaggtatgctcttaccaaacttctcagtcagagtacatgtgcgtcagagttctatattgtaattactagtatcttgaaa

SEQ ID NO: 21462 - DNA, 533 bp, Sorghum bicolor
  unsure (1)..(533): unsure at all n locations
  Clone ID: 13238680
cggaggacggcggcggntacgcgagccagtgcaagccaccaccagctgccgatgtcgtgccacaacaggaaggcgccatggcgcggagcctgatcccggcggtgtttcttgaacccaacaagtgtgccgctggcgatttcatgcccgaaccggctatggctccagtgatggacttcatggaagccatcctggcggggtcgtcgtcgacgtcggctgccagtgcttcctctctcgacagcttctcggcgaacgccggcatgcagtctcattgttggattccctgaattcttcaattcgtcttagcacttcaattcgattcgatagatggacgattcaattcatcatcaagcactaagtatcagatataattaagtatagaatttatgaaataatcaatagagttttaggtttctctcagggtagtaacaacatatataagttacatgtgaatatgtttacgtatataacgttaatgtgtagtcaaggtaagtatatatataagtgggtgtcagtcacgtgcaaagaaggaaata

SEQ ID NO: 21463 - DNA, 574 bp, Sorghum bicolor
  Clone ID: 13238683
ataagagggcagttgcagtgatgcatgagatactgagcttcatgttggaaaagaggctggtgaccgatcaccttacgcatttccgtcgtgagtttgtaatgccacagaagcttatgaggttactcttgaagcattatggcatcttttatgtttctgaagggggaaagaggttgagtgtgttcttaactgaggcatatgatgggacagaactgatagagaagtgtccgttggtgcggtggagggaaaagctccttcaacttactggttacagagggagatttaagaatcttggtaaatttgacgtgtcttctgattcagatgattacttattaggccgtgatgatgatgatgtattggatgttgaaagtgaaaattcagattacatcttagatggctgttctctttcagatgattctgagatggatttaggggatgcagatgaattttgcaaagactgagttggtggcaagcgtgtgcaacacaaaagaataaatattgtttttagtttgttaaaaacaaagtttagaaatgactgtttgtcactttaagctcagcatataattgtagactggta

SEQ ID NO: 21464 - DNA, 591 bp, Sorghum bicolor
  Clone ID: 13238709
cccccgccgctgcccgtgctccccatgcagcccgcgccgccgtaccttcacggccgcgtcccgtccccgtccccgtctccggcgccggcgccgaccgcgatcgcggtggcagcgcctccgccctgacgtcggcgtcgacggcgacggcatccgcttccgcctccgaggagtcggagggcctggagagcggcaactgcaacggcgaggagcaggaggcgcccgcgctgccgttctatgacttcttcggtctccagtccggcggccgctgatgagatcgatcaggcggagcgagcgagtgaggaaagctgaacgcgccagacgttcatgcgatctcacttgagtcgatggacccgttggcggttgccttttgctgagtcattggtgtgcttcatcaactcgaagcctatgccgaaccaatgcaaaactgtttacattgttaagttttcgcaccgatctgtagcaacaatgtagtggttctttaaaatgctactagtaggtgccttttcattccatccttgttgatcatttttcttcgcaatgttcggttctactcatggatgattgttagtaatagccagagtaattaagttg

SEQ ID NO: 21465 - DNA, 687 bp, Sorghum bicolor
  Clone ID: 13238719
ctgagggacaagcttgttgcacagcagagcttgtttgaatcgagcattttggttagccgtgaagattttgggagagtggtcgagaggatgccgcaagccattagtcttggacgagctgcggttcagaagcatgttaatttcctcacagcttgtggatttatgctctctcaagtgagcaaaatggttgtggcttgcccccaactgcttgcactaaatatggatataatgaggatgaatttcgaatacttcaagaatgagatggagagggatttggaggagctggttgagttccctgcgttcttcacatatggcctcgagtcgactgtgaggcctcggcatgagatggtgtcccagaagggcttcacatgctctcttgcatggcttcttaactgttctgatgccaaatttgatgagcgcatgaagtatgacacaattggggttgaggaaatggagcgtgaggattcttctgacatgaatgcatctatggaggaggtagagagtgaggagtatgaagacagtgattatgatgactctgatgatgagtttgttcgataattcatttcatcagtcattagattgtcaattttgaagtattatgtggttggtacacgaatcaaactgtagcttagagctcctgtcctgtatgttcagatatccttcaacattgtatgttataactgtggaagg

SEQ ID NO: 21466 - DNA, 678 bp, Sorghum bicolor
  unsure (1)..(678): unsure at all n locations
  Clone ID: 13238727
actccagccaagaggcatcagcagagcacagatgatgaagtgatggatgcaaactggattctacgcaagttgggcaaggatgcgattggaaagaggattgaggtccatctaacttctgatggcaaatggcatcaagggatggtgtcgaatgtcatcggtggcacactgtgtattcagttagacaatggcaggtctgagaacgtggagctaggaaagcaggccatccgcctgattgcttcaagatcaaagggcgggaagcgatgaaaccttttccccatatgcagcttagaacctgttctgactctacccattgccatgattatggcaggtagagtcctctcctttgaggtttgacaccctctgaagcacagcggtgaccacctgctgttcatgggagggaatgccctgcctctcgggcttttgctgactggacgagacactgagcgcaacatcatctgttgtgccatgtttcgctagcctagcgtgtgacagacttttgttttggtgttgatgctgtcgatcggaagcccattggctttccattagattcgtcgatctgttagggtagggaaactgaggaggttttaggttaccttggtatgatgtaaaagaagcagcaggtagcgccgtcatatctggagtgtattgtacatgtagtttttggatgagttttctgan

SEQ ID NO: 21467 - DNA, 697 bp, Sorghum bicolor
  Clone ID: 13238731
cattgaaggccttgtcaagagcaataacagaagatgagcttatctacatcagggcacaatacaacttgttagaaccagacagtggagatggtcgaatatgtatcgataacttcagtacggctcttttacagaactgcactgatgctatgaaagaatctagaacacttgagatcttgaatgcgctggagccactcgcatataggagaatggactttgaggagttctgtgcagctacaataagcccttaccagcttgaggctgtgccgcggtgggaagaaatcgccagtactgcattcgaatactttgagcaggaaggcaaccgtgctatcacaatcgaggagcttgctcaggagatgaatctttccgcagcggcttattccattgtccgtgactggattaggccatcagatggcaagcttagctttctaggctacaccaagtttttgcatggactgacaatgcgaagcggcaacacaaggcggcaccattgattctcttgctgccctggtagttgcctgaattggttccattggttttgttgatggggagctggagagatggtgttttgtctctcttcttttgttgccttagattcttgtagaatgcttgtagagagaaagggaaaaagggaaaaaggaaacagaaagtgatagctcaaaattgagttgtagaagaacaaggtcatgttttgcgcttg

SEQ ID NO: 21468 - DNA, 535 bp, Sorghum bicolor
  unsure (1)..(535): unsure at all n locations
  Clone ID: 13238733
ctgattacttctttgaactcaggatactatgaaagaatcaggaacatgtattgggaacatccaacagagagtggtgagataattagcttccaccagccaagtcacgaggagcatcaggattcagacaagaaaatgcataacatgaaagcattggcagagatttatctgttgagcttatctgatgttatggtaacaagtgcatggtcaacttttgggtatgtagctcaaggtctgagtggttcgaagacgtggctaatgttcaagccggaaaaccgcactgcgcctaatccaccttgccgtcaagttatgtctatagagccgtgctttcatgctccacctttctacgattgcaaaactaggaagggaactgatacaggaaagcttgttccacatgtaagacactgtgaagatatgagctgggggctcaagctagttgatacgggtgagctgtagatgacaagatgtggtgtttttcctttgtttaattcatatatgtacagtacaaccgagtgctttgtgctatgaagtttncagg

SEQ ID NO: 21469 - DNA, 470 bp, Sorghum bicolor
  unsure (1)..(470): unsure at all n locations
  Clone ID: 13238743
cccccaggatgcagtcctaccagtacctcctcgggtgtctgcagatgcccgccgtcaacatcctcgccgtcctacaagcgcggcaggaggcactggcggcggaggccgacaagccgcccgccgagggagaggcggcggcgccggcgccggctgaggagaagtgacccgtccacgaggtttcttggcgttcgtttcactctccctctgccttcttgtatgttgcagctgcggcttggcttaaaggaagcttctttttttcgttcctcttgcgcaaatttgtgctcgtcagatttcttcagttcggaatacatgtcgtagaaaaactgatatgtatcataacggcacgttgctacaatgtccatgaactccattttggaagttgaagtgatcctaaattgctttttctagtcagaaaccagactctagaagaaattgccagtcgagagctctcagctgtgcactagncaagt

SEQ ID NO: 21470 - DNA, 575 bp, Sorghum bicolor
  unsure (1)..(575): unsure at all n locations
  Clone ID: 13238758
tctctgagacacagcagctgagattcttggttgctgaagcagaggttttgaaagagaattgtgacagaaagttaatacatgccaaagatacaatagatgagttgaattctaggatatctgtcatggaagtccatatgaaaaatgacgctgcagctaataacaaagagaagacaaagcttcgcatggagattcgatgtctgcgcccacaacttgacgcccatcgtggtcggctcaaagaagcaatggatgagatgaagaccatggatgccaaataccaagaagcatccaccatgctgaagagggagctttctcagaatgctcgcgaagtcctgaggttgagagggatgcttaaagaattacagagcgcatcaaactgagcttataaatttctcatatctaatttttcaaaaaaaaaactcatgtcttttgcatagctgatagctcacgtagcagaaatgcaaatatgtttgtaggtccattagtccaatgtgcgcttgtacgcttcgggccttcctagtactgtggtaccagtaccacactggctttctttcaggtcgggnntgcggttgcanncg

SEQ ID NO: 21471 - DNA, 702 bp, Sorghum bicolor
  Clone ID: 13238788
gcaagaagtagagcatcaggggttaaagggacttatccagtttcatttaccagttcctgtgaacaatctggactgcgaaatgcattgtgtgcctctaatcagcctggtgagtttcaagatactgatggcatggagcctgcatacatggaagccctgaactgtggtgattatgatggtctgattgacctaatggatagaactggaccagttcttgagaagttatcgtgtgagacagcaaatgagcttttgagggttatagctgaccagtttcttaacaaaaagttctttgacttggcactgccttggcttgaacagatagcagatttaagcacgatttataagccaagtcaactatttgcatctgtgagagcacaaaaggagttcctttgtgcattggaggaagctgcaacaggtgtatccacggaaccagccttgaggattgcacttgcacagctcgcatttaaactgaccaaagcttttgaggttggcccatgcaggaaaatttcaaccagagtgtgcagagaaaatgaaactatcctggccactgcaatgtgaaatgttacttacactgatagataatctggtgcatgctcaggccatgaaatcagtgctttagtgagcttaagttcttttcttgtagctgtacaacctttgtaacgttgtatgatctgtttaaggccctctgtttaattagtgtgtgaa

SEQ ID NO: 21472 - DNA, 573 bp, Sorghum bicolor
  Clone ID: 13238854
cgccgtacggagtcatcaccatcgacgcaccggagctgatagagttcgaaattgactgtggagctggagccaccacagactacaaatcattctcgctgcgtgcgccgaggctgcgtctcttgggatggcgcaaccagtacgctgagcgcatcgtcatcgacgtcggcaggccgggcagcgtcaagttgggtggaatcaggttgatgtcgatctactcacgcgggatgatgtattacagggagcagatgatgcgaatgctgcaggggctactccccaacatcccaccggaaaaccttgacgacgttgcagagccttatttgacgctgggagactggtctgacgatgacgatgacgaacccaagcacgagaatgagaagcagctcacctgcaacctcagaggcctcatcatgtcacatggtatatgattcctagaatggagtcaagtttcgaccatacacatcgctagcgctatcatcttattattagtttgtttggatcaacatttgtgtcatgatctgtgattgaatgaacaaacctttacgcgttcgtctgtgatgaatgaacgttatcctt

SEQ ID NO: 21473 - DNA, 516 bp, Sorghum bicolor
  Clone ID: 13238882
tgttgcatcagggcaggtgtatggtggaaacaacagaatggcacccttgaggaatatgttccccaatctggttagcaaagaagatcttgcaagcaaggaagagatggagcctttcaagaagcatgtaaccagccttgctgcgttggacttcctggtatgcttgaagtcagatgtgttcgtcatgacccacggtggcaatttcgccaagctgatcattggctaccgtcgctacatgggccgccacaggctcaagtcaatcaagccagacaagggtctcatgtccaagttctttggtgacccttacatgccgtgggcgactttcgtggaggacgtgatgatcacccatcagacacgaacgggcctccccgaacccaccttcccgcactatgacctatgggagaaccctctcaccccttgcatgtgtagggcttaaattatagactacgagtgatggtgcatagttattctttgttgataggatgatatgcaaaactgcaattttttgtgtttttttac

SEQ ID NO: 21474 - DNA, 605 bp, Sorghum bicolor
  Clone ID: 13238893
gaacaaggagacgaggcacattgtggacaaggatgttctggaagccctagggaaggatgggatcgtcataaacatcggccgaggcgccaacatcgacgaggccgccttagtcagtgcactgaaagatggaaggattgcaggagctggcctcgatgtctttgagaatgaacccaaggtgcctgtagagctcttgtccatggacaatgtggtgctgacgcctcattcagcagttttcacggcagagtcgaggtcggacctgtgcgagcacctgatttgcaacctcgaagctttctttgccgggaagccattgatcacgcccgtgctgctgccttgacagagtaggtcgtgttgcagtgcaggctagttcagtccagctattgggacttgggaggtaacaatatttttatcacgagctagaggagtacaggtattgaaattgttgtttgtattgcattgctgcaaagtgcagggttgtgtttcttataaaatacatcaattatattactcaaaaaaaaatacatcaattatattcattcactgtaaagggagtgtctcatcatcagaactttaagttctgtatgtaaaagaccactctaatcatcaag

SEQ ID NO: 21475 - DNA, 637 bp, Sorghum bicolor
  unsure (1)..(637): unsure at all n locations
  Clone ID: 13238916
ctcgagcttgccgctgacgctgaatctcttcactgatggagcgggaaggcaatcggtggtgtgcgtatgtgtgaggcaggtggtggcacagaggaatgagagaagacagcacgtgaagagggccagttgcaagatgtcagtcagaacagattggggaagggaaataagcacaagggaaaaaatctgtgttggagaagaaatagggaggaaagcaactcatttcgttgtagatggttgtcaatggctcaccactggtcagacactagagcagaggcaacagggtggcggcacagctgtcatgcgcctacgcagaagaacctgacatagtgactttgcctaatgtacagctgctctgggttgggatgtatcaagcacatgtgctggtacttgagcctaagtatccgatattagagttttttttattacagatactttatggctacatatccaccgcatattgaccatgtatttgtatcggatacatatctggtatgggatacggcccctatctggagtcctggagtaccagggtagcataagttagtacactaggcaaatgctctgtaacagctacttcatgtaggaaataaacttgcccctnccagttaagggccaaataatattgacccctggtaca

SEQ ID NO: 21476 - DNA, 665 bp, Sorghum bicolor
  Clone ID: 13238944
taaagagtaagggattctgtgtggtttgtgttgcagaagctgcaggacaagatctactgcaaaagtcaggtgcaactgatgcatcaggaaatgtgatatttagcgacattggtgttcacatgcaacagaagattaagacccatttcaaggacattggtgttccagctgacgtgaaatacattgacccaacttacatggttcgtgcatgccgtgccaatgcatctgatgcaattttgtgtaccgtgcttggacaaaatgctgtccatggagcatttgctggtttcagtggcatcacttcttgcatctgcaacacacattacgtgtaccttcccatcacagaggtcatcacggcatcgaagcgtgtgaaccccaacagcaggatgtggcatcggtgcctcacgtccactggtcagcctgatttccactgacctgccatcgtcactgcttaaccaaatttgcatactttcaggcactagatgatttatgatttttttgctgatgtgctccattcacatcacgaggttccaagattagataataatgctaaactgagagtagacttggctggtttgtttgccagggtgtcgttgtccatggttctgaagccctgaaatttgagaaatttgcatatttaacactgaagatgtgacttcacactttgccat

SEQ ID NO: 21477 - DNA, 106 bp, Sorghum bicolor
  Clone ID: 13238951
gctccttgtcccttcgtgtcctgcattatgctttgagcttgaagccttgatgaggctgcaataacagtgtccatgtgcttatatgtagtttggcacggtggttatg

SEQ ID NO: 21478 - DNA, 449 bp, Sorghum bicolor
  Clone ID: 13238963
gtagagcggatgcgtgcccgtgcgcaagacaagctgatgacccagctcgcatcggcaaggcacaatgcagatgagaagcgtgccgccgcagagctgaaaaggaaccgtgcagccgcaaggacggctgaacaggcagagcacatcaggagaaccggccgggtgccgccttcgtttggctgctggaactggtgctcgtagggagggaaaaaaagcatggcaagtgacctctcttccctgcagtgaagcgcctcccacccatgaaagatgaagcatgtctataagcactagctaatgatatgaatcatggcgtcgtagaaccttccttctggattggttgagtagatacgtgacacaagaacgagtctcttgtaagttgttactatatatacatatgtaagatgcgagctaccatgtgtcctgtgctgtgtagttactttaagtgtcacaga

SEQ ID NO: 21479 - DNA, 499 bp, Sorghum bicolor
  Clone ID: 13238969
ggctacatgagcagacaacaattgaatcacttcaccgtcctattaagcgattgatagaccaggtgactgagaacaagggatttatagaaaggaaaagagaggtggtatccttctcaccaaatgacaaggcatcagttgatagctttcttcaggaggagaaagtcagcagaaacgcttcattcactcgattttatgcatcagtagctgaaaactgtcaaccaaaagggagaaaaacactttaaaatgccaagggaattttgtgagacatctggaattggtcagcctcaagtgagggccaagaagaatcacttcaatgtagaacatgtgattattgaccgtggcattttagtgcagatatatgctgatgcggctaatgcataacctccggtgatcctatgaggccttgtgcattgcgtgctcagcaattttgtggttgggttgtacactacattaattcgaagtgaggtgtcaagtgatgaatggaatttgctgctgcttg

SEQ ID NO: 21480 - DNA, 515 bp, Sorghum bicolor
  Clone ID: 13238984
caagtacgggtggcatcagttctgcgtcgacaacggtctcaaggtcggcgacgtctgcttcttccgggtgatccgcgagggcagccgttgcggcgacgacgacgaagatgaagagtgggagccggaggaggaggacgatgagcacgtgctcaaggtggaggtacgcaagaagaacggcacgttcgtctcctgatctcatcgcaaccaataagtcgatgagagcagttcctgccacactgtcagtaggaaatcattagttattaggagtactgtgcttctgatggattagattgttcgtctgaacctgtcattggcgtgattgtctctgttctagaattactctattctagtgttattatatatgctggtgggtttgatgggaattgtaatcagacgaacagcgtccaaaataagttagcaactcgtactactctgatggtggtcatggaatccctataaaagcatttgttcataaaaagcttagattgtgttgctcgtacttgatgtacagtaac

SEQ ID NO: 21481 - DNA, 697 bp, Sorghum bicolor
  unsure (1)..(697): unsure at all n locations
  Clone ID: 13238993
gcaatcttcaagatgaacccagacacgactcagatggagatgctgttctgctccactgttgttggccttccattcctagcagtgccaatggtgttaacaggtgagctcatgacggcatggacttcctgctcccagcatctgtacgtgtacgcggtgctggtgtttgaggcgatggccacgttcgtcggccaggtctccgtgctctccctcatcgcgcttttcggcgccgcaaccacagccatggtgacgacggcgaggaaagcagtgacgctgctgctgtcgtacctgatattcaccaagcctctgacggagcagcacgcgacggggctcctcctgataaccatgggcatcgtcatcaagctcctgccggagaacaaggagggacgtctgcgccggctgccgaagaagacggaggagcgctctggcgatgatgacgacaagccccttgagagcagagaagcggacgcggaaaaggcaagtttggtgtagtgtgatagtgacccaagcagagcaaaacagacgccaggtcgaccaacaatcccaaatgaaattcagtcatccaaaacaacagtcccaaaggaggataggatacatagaggatagagcactacaggagtcaataacgtctttcttcatcccctcgcttttctcnatgtgctgtggttaatgttaaaccgttaaagtacagatttgtgtt

SEQ ID NO: 21482 - DNA, 416 bp, Sorghum bicolor
  Clone ID: 13239010
gcacgaggattttctgactgaggagaagctgcttgaagctgtggaagctgggcaggtggcaattagagaaatctgcaaagcaattgatgttctcgtccagagttgtgggaagaagaaaatggtcgatgctatcagcctaccgcctcctgaactctacaggcatgttgaagatatttctggagatgagttggtgaaggcattacaaataaaaggaaagattcccagaagaaaagctctttcagcattggaggacaaagttataagtatactttctgaacagggttatgtttccaaagatgcctcatctggagtcactgaaagtttggctgatattgttgaggatgaggatgaggatgaaattatagttgatggagaagtagatgaaggtgatgttcacatcaagccggtttcaagga

SEQ ID NO: 21483 - DNA, 292 bp, Sorghum bicolor
  Clone ID: 13239019
gcacgaggggggcgtgcgtgtcgcggcccagcgcgtgcgtgggcaagccccacacgccgcggtccggcgacgccagcggccgctcgggcggcgccggcggggcgcggcggaggcgcagccgccgcgtagggaagggtcggaggacggcgccatcgcgcgccgcgtccatggagacaatccaggaggccgacgtgcccggctcgccgtccgccgccgatcaccggacgtacagcaaccccgcgttccaagtgtccgggagcattgaggaggcatggtacgattccttggcgat

SEQ ID NO: 21484 - DNA, 423 bp, Sorghum bicolor
  Clone ID: 13239024
gcacgaggcccaagagccggcaggcacaggcacgccgagagagacacagatcgagccatggagatgccaccgcagcaagccgccgccgccgccgccaacgccaacgccaacgccaacggcgccgcccacgggcaggacgagggcgggtcgtcgtcgccgccgctgtccccggcgtccgccgcgctggcgaacgcgcggtggaacccgaccaaggagcaggtggcggtgctggaggggctgtacgagcacggcctgcgcaacccgagcgcggagcagatacagcagatcacgggcaggctgcgggagcacggcgccatcgagggcaagaacgtcttctactggttccagaaccacaaggcacggcagcgccatcgccagaagcaggacagcttcgcctacttcaccacgctcctccgccggccc

SEQ ID NO: 21485 - DNA, 580 bp, Sorghum bicolor
  Clone ID: 13239047
gcacgaggcccagttccaattctcctcgatcccaccagtagaaccctccgcttgtttcttgctcctggttcttggatcgcggaaccgctccgaacctcttattggaattgcggaaccgctccaaagctgcaaaagtttgatctttgccaaccgcttcgggttctaagtgctgccgagtggttctaggctcgaaagaaggctccgcctgtagtagccgttcttgtgatgggttccgggatttgggattttattagcgcctaaacgagtccccaggagcgtctgcggcgagctggttgcgaaaggagttgggcgctgttacaggaatctacagcaccggcctcccacaattggtggacaggtacccattactatggtgcaaagcgggagagtggcctacagtgagaggagttgaggatcaagtgggaacaaaggcataaagctggaaagttatcttcaccaaggttaaggtgtttcctataagagagctcagaaaggagcttgttgctgaagctaaagatacaagggaggagccatggtgaagaagaagctgaagaaactgtatggcagggatgctcgggag

SEQ ID NO: 21486 - DNA, 557 bp, Sorghum bicolor
  Clone ID: 13239048
gcacgaggcctgcctcgtgcgcgcccgcaagggagacatgagaggccaggtcctggcggtcaaggtcatctccaaagccaagatgacgacagcaatatctattgaggatgtgcgtagagaggtgaaaattttgaaggcgttatctggacattccaatcttgtcaagttttatgatgcttgtgaggatgcccttaatgtctatataatcatggagctttgtgaaggtggagaattattggatagaatcttgtccagaggtggaagatacaacgaaggggatgcgaaaattattgttgaacagatattaaaagtagttgccttttgccatcttcagggtgttgttcaccgtgatctgaagccagagaatttcctattcagcactagggaagagcgttctcctatgaagataattgattttggtctctcagattttataagaccagatgaaaggcttaatgacattgttggaagcgcatactatgttgctccagaagttttgcataggtcatatagcacagaagcggacatgtggagtattggtgttatcacttatatat

SEQ ID NO: 21487 - DNA, 529 bp, Sorghum bicolor
  Clone ID: 13239050
cggcgctcgtggcgtgcggggtcacgctgctgctgctcgcgggcggctccgcggcgaggaggggcggccaattctccggcgcggatcgtaccactctctccggcgccggcaacaacgaccgtggcggccttgaccaggccggaccgcgcgatggagagcatgaaactatggtgtcttccaaagttcaaagggacagactaattggtggcttgttagctcctggttttgatgaacagtcatgtctaagtagataccaatcagcattgtaccgtaaagaatcgccccatttgatatcatcataccttctggaaagactgagagaacatgaggttctccagaagaaatgtggcccgtatacagagtcatacaagaaagctattgagcaactaaaatctggtcaggatgttatggttggagattgcaactttttggtatgggtatcttatagtggtcttgggaacaggatcttgactattgcctcagcatttctctatgccatccttacaaacagagttttacttgtagatgg

SEQ ID NO: 21488 - DNA, 363 bp, Sorghum bicolor
  Clone ID: 13239061
gcacgaggagatcacacgcgcaagcacacactcgcatcccaggcagaacagaaccctcgccgccgccgatgacgtccgtgcgcagctccgcggcgtcgctagccccgtcgatccgcggggcggcggagctggtccgccgggaggctctccggcgcgagctggacgggtgccagctgctggcgggcatctggtgccacgggttcacggtggcgcagctgcggagcatccgcgcgtcgcttccccccacggcgcggctggtggtgaccaagaactcggacatggcggcggccgtggcgggcacacggtgggaggcgctcaagccctgcgcgcggggcatgaacgcgtggctcttcgtgcgctccg

SEQ ID NO: 21489 - DNA, 611 bp, Sorghum bicolor
  unsure (1)..(611): unsure at all n locations
  Clone ID: 13239076
gcacgaggagaaaatctcaaagtgatcattgggaggaagaaattctgaatctgcggagcacactactgcagagtgaattggaaaaggaaagaatagctttagagttggaggaggaaaagaaagctaaagagcagcgtgacagatgcttgattcaacaggcaaagaaaattgaaaatcttagttcactggttttaaattcagacagagatgacaggagtactgcttttagtaagaacaaaagaagggtaacatggtgttctggaccaaatgcaaaacaatttggtgttgaggatttaggaactgtccaggaaggctctacaagcagcacaattagaaatagacgggatatgggaatgccaccactttttgaagagttaatgcaagaaagtaatgatgagccttgtgctaatgcttactcatctggtgacgtgtccaaagacagtgaagatgtctctcttcctgactcgcatgctttgctgcatgttaccaaccgaagaaagccaaatgcagtgaaaaaatcagatcaagagcaattcttggggagagctggtgaactattaataccccnagacccctgtgatgggaatgatgctctacatcacaaaaacact

SEQ ID NO: 21490 - DNA, 526 bp, Sorghum bicolor
  Clone ID: 13239078
gcacgagggtcaacagtcggcgaggcaagggaaccgcccgtcgtcgtccaccgtcttccacgtaccgtccttgctcccagacgacccgatctcatcctcctcagagggaaagcggtcctcccatgctcgacgctcccggaggaaccctggggcgatcccgtccatgccgtagattgtcctcttgatctcggactcggggtcggtgggggtgcgcatcatgcaggcgagcgccaccactccgtccgctcgccccgactctgcccggatcgcggcaggcgcccccgggaggagccacgctggggtgggaggtccgtacaccggcaaatttccctcttgatcgccgggctcttgcgacgccagtggcgccggttcggccaaaacttgaggcgggggctcgagtggctcgtcctcttggccccccagctgctgttgctgccccagctgctgctgctgctcctcctgctggtgctgcagctgctcctccggctggggtcgctgctgctgctgctccagtgacggctgcgtc

SEQ ID NO: 21491 - DNA, 590 bp, Sorghum bicolor
  Clone ID: 13239111
gcacgaggggcggataccctgccccctgaaatgattggccccttcttgtcatgtgtcattgacactgatgctgagcagaagagtgcggtgcggaaggagtgcatcaaggtgattggcacactggcacgactacatggaaacctattggcaccacacatggcgaaaatggtgtccagtgtggttaagcgcctgaaggacaccgattcagttgttagagatgcatgtgttgacacttgcggtacccttgcaatgtgcgccagaagttatggggatggtggtgcagcgttggtgacattggtgcgccccttgtttgaatcattgggtgaacagaatagatatattcaggctggggcagcactgtgcctggccaaggttatagatgagagcaattacttccctgggcctgtgctcccgcagatgcttgcccgtgttgttaagctgctcaagaatccccatttcatggcgaagcctgctgcgattgacttgataagaagcattattcaggctgaaggcgcttctacagagcaggcgttatcatcagctctaacaagtattatggatgccctgaagagtactgactggaatacaag

SEQ ID NO: 21492 - DNA, 547 bp, Sorghum bicolor
  Clone ID: 13239112
gcacgaggcgtgcacgtgcacacgcacgcgacgcatggtcacgcgcacggccaagcccacgatcacggaggacacggccacgccggcccgccctcgcctcaggatgcctcctccgtcgccgtgtccatcaggcacagggtgatctctcaggttctggagctgggaatcctggtgcactcggtgatcatcggagtgtccctgggcgcctcgttgaggccgtccactatcaggcccctggttggagctcttagcttccaccagttcttcgagggcatcggccttggtggctgcattgttcaggtatgcatgtaaccttctctgaaaatttacactttatactcaagtgaagagtgaccatcattcagggaaagaaatttagatgtttattaaatcagatactgaaggacgcataggtggcatgacagccataggaggggatgccccactaacgaaaatgagcaaaaggtgacaaatagaccgagatatttgtagtgaagaggttggccttatcttatcactacattgcacaaaatgaggagaggaccaa

SEQ ID NO: 21493 - DNA, 384 bp, Sorghum bicolor
  Clone ID: 13239115
ggcacgaggccctctaaagtggattcaacatgtaaatcattacaggaagaactcaactccatatcacatccaagttctcatatacatgctccagaaaatccaaaattcatgaaactgatgaaattagctaaatactcatatatgaagaattgggaatttcttcaggattgtgcaatccgcttcctttgtgtactttcactggaccgctttggtgattatgtatccgatcaagttgttgccccagttcgtgaaacttgtgctcaagctcttggtgctgtgctgaagtacatgcacccttctttagtatgccatacattcaaaatcttgctgcagatgcagcgcagacaagagtgggaggttcgtcatgggagccttcttggcatt

SEQ ID NO: 21494 - DNA, 450 bp, Sorghum bicolor
  Clone ID: 13239130
gcacgaggggtcgtcgctctggaggtgctctctccttcacggcgctctggacacggccgggagcttgccggcgagctgcctgcggcggttgggctcctcgccgagctgaaagaggtctcctttccgctccatggcctccggggcgagatccccggtgagatctggcggttggagaagctcgaggtggtcaacctccccgggaactctctccggggcgtccttccttccgccttcccgccgcggctgagggtgctctccctcgcttccaacctgcttcacggtgagatcccctcctccctttccacctgcgaagacttggagaggttggatctttcaggcaaccggttcactggatcggtgccgagagcgcttggcggcctgaccaagctgaagtggcttgacttgtctggaaaccttcttgccgggggcatcccctctagtctggggaat

SEQ ID NO: 21495 - DNA, 609 bp, Sorghum bicolor
  Clone ID: 13239136
gcacgagggttccttctgctctgcgactgcgaagcctccgcgctcgtatcgtagcctgttcgtcgccgctgctgccttccggtgcttgccgccgctcttatcttgttccggcaccgcgtcaaagggccgttcctctctacactaggcgcctggtagatctccccaactcaaccgggcaagccttaccgcccacttcactatggcggagccctcgccgccgccggcgtcgaacgctggcctccgtatcctcctgtcgaaggaccgaccggctccttccccgccacccaccgccgccgtttccagccacgccgaccgcgaccgcatcatcggagttttccggagcgcgttgtctaggaatgaacccccagaaacattttctcttcagacagttcaggaagcaattaaacctcagaaggaaaccgtgttggttctagaggagaaccaatccttggaaaatgctcttcgaacattgctgcaggagcttgtgtcatctgcagtccaatcgggtaaaaagatcatgcaatatgggaattccttggatagtggagaaagtaactgcccaataactcgccttcttgatattgtgctttatctttgtgaaagaaggca

SEQ ID NO: 21496 - DNA, 430 bp, Sorghum bicolor
  Clone ID: 13239162
gacgaggatgcgctcagctcacctttgatcagaggagtgcctgcgttcgccggccacccatggctatgccgggtggcggcgtggtggcggccaagaggtgcatgaacccggcctgcggtgggccggcgtcgtccgtggtcggggcgggaggggactggaggaagggctggccgctgcgatccggaggcttcgccttgctctgcgacaagtgcgggttggcatatgaacagtttgtgttttgtgatatatttcaccaaaaggaatcaggatggagagactgctcattttgtgggaagcgcctccattgtggatgtgttgcctcaaagaactcatatgatctacttgacagtggaggagttcaatgtgtcacttgcatgaaaaattcagcacctcagtctgcttctggccaagtggttccaaagcttttcca

SEQ ID NO: 21497 - DNA, 380 bp, Sorghum bicolor
  Clone ID: 13239183
gcacgagggaagacaggcagcccaggcggcgccggttgagaagaagatggatcggcgcagcgggagcaagcgcaagaaggcacggactgccgctggctctggctccagcggcggcgaccgcatcaccgcgctgccgctcgagctccgcgcgcagatcgcctccctcctctcgttcgacgaggccgtgcggctgacggtgctgtcccgggcgtggcgccacatccacctctacacgcccgtcgtcgagatctacctcaacgcattcctctccttccgggacatctacttcgacgaggcgcagtccgcccgcggcctcctggacgaggactcgatcctggccgtccgcgtcgcgctcggccgccgcgcgctcgaggcgtcct

SEQ ID NO: 21498 - DNA, 425 bp, Sorghum bicolor
  Clone ID: 13239200
gcacgaggggcaccaacattccggccaattctgctcaagctaatacaggaacatattccagcggccctggtatgctgggatcttctgctgctccaaggccagtgcaagatgctaacaatgtaccatatggatcttctgctgctccaaggccagtgcaagatgctaacaatgtaccatacggatcttctgctgctccaaggccagtgcaagatgctaataataatgtaccatatggtggatcctatggtggttatcagggtacggtggtccctccagttggtcgtgcagtagaatctgttcccaatgtggcatctggtgtatcttatggtacgactttggcacataataatacaatgaatgtgggcatggtgcagtcaaacttgcagcagccttcactggattctcatcagaaccaaaggtttgca

SEQ ID NO: 21499 - DNA, 246 bp, Sorghum bicolor
  Clone ID: 13239206
gagtttagttaatgaaatttctgcatcaacccattcttcaccagttggtgatttgcagcaaattggcaaacaaatgagaggaagtgttagtggcaaaatggatatattgaagcaagatgctgattccagccaacatgaacctatggtccatgagattatgaccactcctaataaacgaacaattgagaaagactctcgggttggtcaggcgtcaaaaataactccgaagactgtcaagatgacttc

SEQ ID NO: 21500 - DNA, 191 bp, Sorghum bicolor
  Clone ID: 13239210
gcacgagggccgccaccgctgccgccggggacgagcgccgccactgcttgcgccaatccagggcttggggaagacactactgctgcaaccatgagcaccatgaagttttgccgtgagtgcaacaacatcctgtaccccaaggaggacagggacaggcgcaccctatacttcgcatgtcgcaactgcgacca

SEQ ID NO: 21501 - DNA, 392 bp, Sorghum bicolor
  Clone ID: 13239211
gcacgaggcccaggtcccccgccgcctccgcctcctaccggatcctcgtcgccgcaatcgcctgcttcgcgctcgctgcgctcttctccgcaccttccgtctgggcacgcctcaacgcgccgtacctgtgccgcaaggaggggattcggctccattgccccagggtcagccagcgggactctctgtgggagaatcctcatgcagcagcaacttcgtggaagccgtgtgctgagcgtcagagccatgaggtctcagacctcgtgtcagagaatgaaacttctgggtttatatttattcacgctgagggtggattaaaccagcaacgtatagctatatgtaatgctgttgcaattgctaagataatgaatgctacacttattctaccagtgcta

SEQ ID NO: 21502 - DNA, 486 bp, Sorghum bicolor
  Clone ID: 13239222
cgcttccgcgtgctggagctggccacgcgggcctcgaccgagcaggcagccgctttcctcgcggcggcggcggccgagccagacccgcctcgcgccgcggtggtcatgggaggccgctccgtccgcgcggacgccgcgttcctcgacgccgtgccctccgtccgctgcctcctcagcacggccgcgggcgttgaccacatcgacctcgccgagtgcgcgcgccgcggcgtcgccgtcgccaactcagggacggtctactccgccgacgtcgcggaccacgccgtcggcatgctcgtcgacgtgcttcggcgcgtctcggcggcggagcggttcgtccggcgccggctctggccgctgcaggagggcggctaccctctcggctccaagcttggcggcaagcgtgtgggcatcatcggattgggcaacattggctctttgattgcaaagaggcttgaagcttttggctgtgtcatctactacaattcc

SEQ ID NO: 21503 - DNA, 556 bp, Sorghum bicolor
  Clone ID: 13239237
agaacctgcacattcttctagtgttccaggtggaagtacatcaggatcaggaaatcatagtacactcaaattagttggatatattcttattggggtggtattagcagtagttcttgtgctaattgcaatgtactgtttgtccaagtacaaagaaaaaaagtcgagaggtgatatttatatgaaaaacaagataggaagggtacctcagaagcttggagagcctaaaatcaaggaagcggtagaaatgaaggagtcaccattaaaactcaagaataatgctgagaaagcagcttcaaatgttgtttctgatggaagagaggagcagaagttaaaaatgccaacgtcagaaacttcaaatgtggtttatgatccaagtcgaagggatgggcataacttagattcgtcgctggcagctgtacctggggttgtaacagtgaataaaaaagagcatgtgattgatatggaaaaggctgataattttgttgaggaccaactgcatcccccgcagccgattgcaccgcggactgagaaagtcattgtcaaaccaagtgttcgt

SEQ ID NO: 21504 - DNA, 531 bp, Sorghum bicolor
  Clone ID: 13239245
gcacgaggagacgatacgtggagtagttagaatattcacagtggctgtcaccattgtggtcgtggctgttccagaaggactaccattagctgtcacactgacgcttgctttctcaatgcgcaaaatgatgaaggacaaggctctggtgaggaggctttctgcatgtgaaacgatgggttccgccacaacaatctgcagtgacaagactggcaccttgactttaaatcagatgactgttgttgaggcatattttggtggaaagaagatggactcacctgataatgctcagatgttatctgctgatgtcacatcgctgattgttgaaggaattgcacagaacacttctggaagcatatttgagcccgagcatggtggtcaagaaccggaggtgactggatcacctacagaaaaggctatactgtcttgggggctaaagctgggtatgaaattcaatgaaacaagatcgaaatcatctattcttcatgtatttcctttcaactcagagaaaaagcgaggcggggttgcggtgca

SEQ ID NO: 21505 - DNA, 494 bp, Sorghum bicolor
  Clone ID: 13239270
gcacgaggatgccacttttgcagggatgaatgcccggtctatatcagcgccaaaaagtaagcttgcaattcagagagaactgttggctctgaagaagaaggcactagctttgaggagggaagggaaggtggatgagtctgaggaagagctgaaaaaaggtagtgttcttggaaagcagcttgaagagcttgagaattcctccaaaccacctgtaccaaaggaaaccaggagcttgccatctaatcccccgtacaaggttgaacccccaaatatcagtcttgctgatgaggtatatgaacctgaggttacagacaatgatatgcaggatccagcattgctatcggtgctaaaaaatatgggatgggaagatgctggttcagattcggtggaaacaactgacaaaccatcaatttcttcacatgtagttcctcataaatcatcaaaaactaagggccagcttcagaaggaattgcttggtataaaaaggaaggctc

SEQ ID NO: 21506 - DNA, 585 bp, Sorghum bicolor
  Clone ID: 13239279
gcacgagggcgagctgtgagcatcgaaaccaaacggaaacggggcaaaaaggctcgccagaaaggagaggagctccttttctccctcgtgctctcgccattcgcccgaaccgaaccccggagagctggaaggttactagaggacaccgctttgaacttgtgaaatatctattgatggcttctgctttaaaaacaaatggcagtttttgtagcacacaacagcagcagtttctgcaatcaacaacggatcagtttttacatggttcttctcatttaaatttcaaacattgcaaaagcaagaagacaataaagcctgctccactgtgtgttagagctacttcctcgaaagtggaattagactttcatgatccatcttggaagcagaagtttcaggaagactgggaaagacggtttaatttgccaagtattactgatatatatgatttgaaaccaaggccaactacattctcactcaagaaaaacagaactcttacaggtgatgaaaacgtggatatgtggaatggttatgttaacaatgatgatcgggcacttttgaaggtgataaagtattcctcgcctacttctg

SEQ ID NO: 21507 - DNA, 401 bp, Sorghum bicolor
  Clone ID: 13239298
gcacgagggcgccgccgccgccaccaacgcgccacgcagccgccgccgcgccgccgcagatctccgccgccgacgcgccggcgccgctgccatggagtacgagcgcattgagaagccgttccccgtccagggcggcgggttctcgcccaagcggctgcgcgcgatgctgctcggggtggacaagcgccgcaaggggcaggacgacgccgaggaggaggaggacggcggcgactacggcgccgtgcccagggcccacgccagatccgacgccggcgacggtggtggaggcgccatgtgcgaagaatacaaggacgtcgacgtggtgagcaccatctcagagtcctcatcctcgctggagacagggggcgggcaccggtcccgagacgcccaccccatccccg

SEQ ID NO: 21508 - DNA, 480 bp, Sorghum bicolor
  Clone ID: 13239299
gcacgagggagaagctcgttcgttccttgaagccaggtgccagccatgatcccccagacgtcctcggtctcttcgtcggcgtcggcgtcggcggcgcccacgccgccggtgtggcccagccccagcggcagcggcggcgacgggatgttccctggctcggtcagcaactcggggggccagcagcagctggccatcagcaacggggtgctcctggccgcggtcatcttcctcttcatggtcgtcgtcttcgtcttcctgctctacctctacgccaagcgctacctgggtgcgaacccgctgctggcgccgacctcgccgtcgtcgcggttcctcttcgtcgccgcgtcgccgctcccgcagcgcggcctgccggcctccgtcctgcgctccctccccgtcaccgtctacgccgccgccggtgccggctcccccagggacaaggagaaggcggacgcgctggagtgcgcggtgtgcctgtcg

SEQ ID NO: 21509 - DNA, 550 bp, Sorghum bicolor
  Clone ID: 13239305
gaacgaggaaaccccacccgccgcttctccccatcgctgcgatatcgtcggggagacgccgaggcggcgatggcgaagaagctggggaagaaggcgcgcaagttcgcgcgcaagaacctgcagtccgccgccaagcgtaaccgcaagatccgcaaccagttcaaccaccgccgcggaccccgcagaggtgggagtgccggtcgggaggatggagacgaggatgtgccgcagcaggtccacgattccaccatggtcactaacgatgctgctgctgctactttgatccatggcttggagtttccggaggacgatgctgaactagatgctgatctgtctgacagtgatggttatctttcggaggatcctgggtgtccatactattctgacagcgaggatgagaaagctgccaaagattgtatcatggaagatggtttggacagacagaacgatgacatgaatcgggatatcaaaaagcaaaagaaaaagttgaagaagttgctggataaggaccctgaatttgcaaattttctcgaaaaatggcagtcggagt

SEQ ID NO: 21510 - DNA, 579 bp, Sorghum bicolor
  Clone ID: 13239307
gcacgaggctcaggccctcctactcgcggtcgcgggcgagccccccgtgccatgggcgtagcaccagcagtggcttcgtctgagcttagccgttagccctcgcttccagcttccgcttctccgttgtagctgcctacgcgcccgcttccagtggaagggccgcaatggacgaggaggtcggcgccgccgggcggcagcaggttcagtggaaaagttactgcagaactctctccctcctagcgttccagagcttcggtgtggtgtatggagacttgagtacatcgcctttgtatgtctacagaaactcattgtctgggagactgaacgattaccttgatgagacaaccatctttgggttgttttctctggtgttttggacctttacacttattccgttgctgaagtacgtcataattgtcttgagtgcggatgataatggggaaggtggaacctttgctttgtactcacttctttgcaggcatgcaaaattcagtctgctgccaaaccagcaagccgcagatgaagagctgtcaacttattatcacccaggcactgatcgaactgtggtttcctctccat

SEQ ID NO: 21511 - DNA, 541 bp, Sorghum bicolor
  Clone ID: 13239329
gcacgagggcgagcccaggactcgtccacatctgttcctttccgctctgcttcgttcgtcgtccccttacacccttacacttctccttgtcgcgcccggcggccgggcggccattgacgactggatccttcattcttgttcttgggaaggaaggacccagagagacgaggaggaggaagcgccgccatgaccggaggaggggaggagcaggggagatcgctgttcggcatgtctctgacggaccggcccaggtggcagcagttcttgatctgctcctcgggcttcttcttcggctacctcgtcaatggcatctgcgaggagtacgtgtacaacaggcttcagttcagctacgggtggtacttcacgtttgtgcaggggttcgtgtacctggcactgatacggctgcaggggttcacggtgaagcagatggtgaacccgtggcggacctacgtgcgcctctcggctgtgctcatgggctccaatggcctcaccaagggctccctcgccttcctcaattaccctgcacaaatcatgtttaagt

SEQ ID NO: 21512 - DNA, 589 bp, Sorghum bicolor
  Clone ID: 13239349
gcacgaggagtttgagttttggagagtggcgccaatggaagtttgagttttgaaatttggatgctaattttttgttgaaagtcatctgtagggcttgtagaaataagcgcgggaaagaatagtgggagcgcgcgaggagacgagcggccgtaccagacgcgcgaggagaccagcgtagggcttgtagaaataagcgcgggaaagaatagtgggagcgcgcgaggagacgagcggccgtaccagacgcgcgaggagaccagcgaccacggagatttagcggcgttggttaagtttaccgcctcattactcttggaacagcgatttaatgaaaaaggccatgggcctacgttgctccttggtctctgggctgagggtttagatgagggagactgatggacggagagagtaatatctatatgccctaagaaaaaacacgccctatgagtagagataaaaacagatggaatacggacggatattatcgatatcatatttgtttttatatttctggttgaattcaaattcgaatacagataatgttaaccacgttggataagatacgattgaatatcaacatcataaatatacg

SEQ ID NO: 21513 - DNA, 667 bp, Sorghum bicolor
  Clone ID: 13239383
caagtacaacatgcaattgcgccaaatgtcatggattcaagtaccatcgatatggccttttggtcgcctgtctgctctcacaacaacagaggatgggggactgcggttcgctgttgaacaagactgcaaactctacatctggtcaacgaaggatgctgatgaagtagatactagatgggaacaaaacggaatcattgagcttaacactttgctccctcttgatgccgacttaaccaaactagatacggttggcttcatggatgatctctgtaccattttcgtgagcgtggatgatgcagcctacgcaattgatctgaagacctataaggcgaagaaggtgtacaagggcgcagtcgacaccattgttccgtacgtgagcttctacacgccagcactggaagcagatggtacagctgaaggaccaagtgctggtggctcaagtgcatgaaaagcttaaggtgctcatgtgaggttctcaagcaagtaggtctatggcaggacaacacttttcgcatcattgagattggttctgtccttgggcttttgtgtttttcaagtagttgtttattttgaaccttttagctgtgactatgtgctccagaattccagaattcctgcttgtgatgaaatcccgacttcatatgttccatgtaaatttatttccctt

SEQ ID NO: 21514 - DNA, 603 bp, Sorghum bicolor
  Clone ID: 13239416
catggtgttcctggtggacgccgccgccgtcgccgccggctacagcctgctgcagctggctgcgcgctgctgcggcggcggcgccatgtccagcggccgcggcgacggcggcggacgcggccgggccctgtcctggtgcgtgttctcgtgcgaccaggcgctggcgtacgtgctcctggccgccgtcgccgccgcgctgcaggcctccgtcgtcgccaagcgtggccagcccgagttgcagtggatggggatctgcgcactctacggcgccttctgtaggcaggccggcgccggcctcgctaccgccgtcgtggctgggctcgccgccgtcctgctcgccttcctctccgcgttcaacctcttcaggctctacggcagcggcggcaccaagagctagtagctttgtgatgagcagaggccgttcttccatctgaccaccatctcttgcaaacaccgtagcgtagggctttgcttgatttggttgctactggtaattatatataggctggttcatgcatgtgaaagcaagatcgagtggtgctaataagatagccgtacgcactgctcaacgtcgaattgaaacaacttaaagaataaacagaa

SEQ ID NO: 21515 - DNA, 119 bp, Sorghum bicolor
  Clone ID: 13239437
tgcaggtacgtgcgcggtgccgcgctcggggtgcacccgtcgccgtgcaccgagctcgccaccagcttcgcgtccgcaggctcgtcttgcagctaattattagggacgcctagctaagt

SEQ ID NO: 21516 - DNA, 615 bp, Sorghum bicolor
  Clone ID: 13239457
tcctggacagcgactgggaggcacgcgtcagcgacttcggcacggcgaggatgctgggcgtccatctgacggacgccgccgcgcagtcggcgacgtcgtcggcgttccggggcaccgtcgggtacatggcgccagaatttgcgtacatgaggacggtgtcgccgaaggcagacgtgttcagcttcggcgtcctgatgatggagctcttcaccaagcgacgcccgaccgggacgatcgaggagaatggcgtgccactgacactgcagcagtacgtggacaacgcgatctccaggggcctcgacggggtgctcgacgtcctggacccggacatgaaggtggtcaccgagggcgaactgtccacggcggtggacgtgctgagcttggccctgtcgtgcgccgcgttcgagccggcggaccggcctgacatggacagcgtgctttcaaccttgctgaagatgagcaaggtgtgtggaggagattagatgcctgctgcaaaacacgaactgaaattcgtgcagcagcatctaatcaagcaaatagggagaaaccctgccgcacggacgggacgccaaaatgtcacagatttggctgctcatgtttgcacgtgtaatgcta

SEQ ID NO: 21517 - DNA, 683 bp, Sorghum bicolor
  unsure (1)..(683): unsure at all n locations
  Clone ID: 13239476
ctcttcaatgaatactgcagttcagtggatcagccaaatgggcgtgtgccaaaaagcgaagtttttgatatagacgatagcgactcatttgaagattgggatcagcacctcaatgagcaagcgtgcaggcagaaatccacggaactcgacaactaccttgaggaaggtttggttccaaggaaggatgattttgatattctgaactggtggatgtgtcacgccacaaagtacccgacgctagcagctattgtgcaggacatcctggcgatgccagcatctgctgttcaatctgaagcagcattcacaagcagtggaccagtaattccaaagcaccacagcatgttaagcatcaagaccatcgaggcacttgtttgcactcgagattggacgagataaagagattgtgcacccttgctggagtgaactcagaacaaccagtgacgggatgcagttctgttcaggggatggtcccaaccagtgggtgaacatgtcgatagtgccgttgaccaaagtttaccgtgccggtgatccagtcccctgccagggtttgggtggtgaatcagagatttggtaggtgtagctgacttggttccatgtgtatataccagcccatgacatttgctcgatgtagtcagattcggattagaatgactgttttgtatgaggggtnctatgtgtggcct

SEQ ID NO: 21518 - DNA, 125 bp, Sorghum bicolor
  Clone ID: 13239493
ggaccagtgttatgtacacccatgaggagtactccaagttgatcctgcaagaagatatcgagccatccagcttctgggaagatgacgcgaaaacagttgtccatgctgtcaatgggaccttggtt

SEQ ID NO: 21519 - DNA, 256 bp, Sorghum bicolor
  Clone ID: 13239502
cgaagccatggtctccttaattagtataagacgattccatcatggtgtcgatcctcggtactcttcttcatcaggagagcttaattatccgcacgggccggccacgcgtccttcactcgtatcttattatatatccatggtaaaaagcaaaatgtaaagtttatggatgcctatatatggatgcctatgtgtcatatggcatacatataagttaaagttatctatgtaaatatgcacaacctcatatagccactac

SEQ ID NO: 21520 - DNA, 552 bp, Sorghum bicolor
  unsure (1)..(552): unsure at all n locations
  Clone ID: 13239511
cgtggggctgttcctgagccacagcgggtggaactcggtgacggaggcggcggcgtgcggggtgccgctgctggcgtggccgcggggcggcgaccagcgcgtgaacgccatggcgctggagagcggcggcgtcggggtgtggatggagcgctggagctgggacggggaggacgggattgtgagcggcagggagatcggggagaaggtgaaggcggcgatggctgacgccgcggtcagggcaagggcggctagggctagccaggaggccgccatggccgtcgccgagggaggcaccagccaccggagcatgcaggagttcatcggcaagctcaaggctactacctaagcagctacctcatctcgatcggtacatgcatgatcgtcgtgcaatataatggagtaatgctctgcagtatacagccggagcgtatagtcgtgattatgtgtgcttatttagctcatatttcattgttccactacctctcgtaagtgtcgctataacaatatctgtattcncaaaataagtttactaattatattatataaatatta

SEQ ID NO: 21521 - DNA, 522 bp, Sorghum bicolor
  Clone ID: 13239526
ggcggagcccgaccttgcgcgcgcgctggcgcgcaatgcggagctcggcgagagggtccgcgagatgggcgcggaggggcaagcgtggcagggcatcgccagcggccacgaggctgccgccgccggtttgcgcgccacgctcgagcagctcctcctccagcaggcgccgtgcgcgggcgcggctgacgaggagggccagggagagggagaggcggtggtggaggacgcgcggtcgtgctgcttcgagccggagcgggagcggcggcacgaaggcggcccgcacgacgacgccgacgacaagcaggcccgtggcagtggctgcacgagggcggcgtgccgggcgtgcggcgcggcggatgcgtgcgtgctgctgctgccgtgccggcacctgtgcctttgcggttggtgcgaggcggttgtcgaggcgtgccccgtgtgcgccgccaccaagaacgcctcgctccacgtcctcctctcctgacctcatcggcgccggcaatttgggttggtttgctcgtgcat

SEQ ID NO: 21522 - DNA, 545 bp, Sorghum bicolor
  Clone ID: 13239540
aatgagaaagaagaaagaagcaagtgtgttactgcagtcgagtgctatgtaagggagcatggtgtcactgttcaagaagcaaaacaagcattgacctgccttgtagatgagcaatggaggtgcatcaatcaggaattatacaaaagcgatcaagcagtaccaattgcattgctagatccagtgttagaccttgtgcgtgtgatggaggaggtgtacaaaggagttgacatgtacaccaagtgctctggagtggtagacccaatacataagctgctcaacgagtgtgtcgaacattgaggatgattcctggcgatgggaaaaatgcatgtactagcatgctttctgtctattgctgtgtggtctatcctacatgtgtaatgcatattgtgtatgtatgcaaactctgtctattcagcatatacatgacaaagcatggcatgctatatacataatgctttcgtgtggagtgctatatacaagactccttgtaatcacaaacctttgtgtatgtcatgtattcttcatgctagtgtttgataataaat

SEQ ID NO: 21523 - DNA, 165 bp, Sorghum bicolor
  Clone ID: 13239548
tggaagagaggtggcccagacacccctggctcctaatgttccagctaccgtgaagctcagcattatgtgatctagtgtgctaataataacaaaaccatggttgttgttgatcaccagtgaagaagtgtaattcatgcatgcataccctaagtaacgttcggaaaa

SEQ ID NO: 21524 - DNA, 664 bp, Sorghum bicolor
  Clone ID: 13239559
cacgctggaccagctgctgctgcagcagcagcagcccgccgccggcgccgactgtggcggcggcgaggcggaggacgcgcagtcgtgctgcttcgagacgtccccgtcgggccttgtcgccgacgacgcggcgtccaggggtggtgcctcgtcgccgccgtcgccgtcgtgcaagtcctgcggcggcggcgacgcgtgcgtgctgctgctcccgtgccggcacctgtgcctgtgccgcgcgtgcgagcccgccgccgaggtgtgccccgtctgcgccgcggccaagaacgcctcgctccaggtcctgctgtgacgaacgaggcgggcggcagccctgccggcgtccgttcccgcggcggcgggtactcgtcgtcttcgttccccggttctcgtcgagtcgcggttgctgccccacgcatgcgccggcacgtgagtcatgtgaccggaggggtctggtagcggcaatcttttgttggtttgggtactactagttgtaggagtacatcttgtagaaactagaaatgctccaagttgcagcataggctaatgtttagacccagttactagttgtactgctaattactctcatcccctctaaatcgctaacttggttcaccgctccaattcttgggctattggcttattgttattaatgaagaaatag

SEQ ID NO: 21525 - DNA, 572 bp, Sorghum bicolor
  Clone ID: 13239563
tcctttggaactttctaattttggcgcctatttgtcagtaaggctccgagagattggttctggggactggaggaagaatatgccatggctcatgaggcattaagggttgagtggcaggctggcagctcggaccccataagtcagaagcacatgaagcactgacaaaggatggtctaagcctagagcggcagcggcaggactatgactaaagcctgagagctgttacttcagtttggtagagtgcaggtctccaaaaacttccatagattgatgcttgtttcagaatggtaagctgatgcttcaagaatttgcacagctgatacagttgatgtaggccaaacaagttactgtcatgctgtcattcattttcaggaaaggaaggataacaatcctcttaactgtacatatcctgatcttggtttatctgccatgggaagtaatcttatgcttatgccttgaaatcttccctgcctggttattgtttgctgagaagctgtagaatctgatcagtgctattctgaaagaaatttctagacaccatctgcttttgtatcgtgaataatgtgattttg

SEQ ID NO: 21526 - DNA, 579 bp, Sorghum bicolor
  unsure (1)..(579): unsure at all n locations
  Clone ID: 13239564
acttcaccgcccccaacccgtcgaaggagctccaactcacaaagcagggcaccaaggtgaaggtggtggagtacggcaccgtggtggaggtggtgttccaggacacggccatcctcggtgccgagagccaccccatgcacctccacggcttcagcttctttgtggtgggccgagggttcggtaacttcgacaaggataaggacccaaccatgtacaacctggtggacccaccgtaccagagcaccgtctctgtgccctcaggtgggtgggttgcaatgcgcttccgtgcggcaaatcctggtgtgtggtttatgcattgccatttcaatcgtcacatgatgtggggcatggatactgtgtttatcgtgaaaaatggcaagaccccaaagactcaaatgatgccacgtcctcctaatatgcccaagtgctaataaggaaacaagggcatgagccatgccggcggtttgcatgcaagacaattgagcaaaaataactaatcttactagtagattgataattggtttggctgttcgtttgtcttataagccgtattttctgtcagccagcaatgttttntnc

SEQ ID NO: 21527 - DNA, 555 bp, Sorghum bicolor
  Clone ID: 13239573
aaccccatatgagaggcgctccaatccaatggacaaggtcacagaagcaatcatgtcgcacctcaaacttcattttgatagcccaggtgccccgcaatctgaatccttaagtcatctagctcatgggatgaccaaagccagggcagcccgactattctatcaaacaaccgttttggcaacttttgattacatcaacgttactcagctgagtcctcacggagaggaactgtacggagacatcttgatctccagaggatcaaagatttgacttggtgatgttggaaacagttttggtgcggtggttctcggtgcacatcacgtgtttatattacagaatgctcatgtattgcataggaggtcttgtaggtcacacataatatttggtgatttggtgaaggaaaggaagcgagatatgctgcagtagttttgtgttatatgtcaagggaaaattctaagctgttttttcgaggtttgataggtggggtatagttatagccgtatagtaggactaagttatagccatagatattaattatcttcttactgtgttatagc

SEQ ID NO: 21528 - DNA, 537 bp, Sorghum bicolor
  Clone ID: 13239587
ctagccatgcaggccggcccggccggtcaagcacaacacatgctttacaggacgacacacaggcaaccatgacgaacgaacgaacgaacgaacgaacgaacgaagacgagcgagttttaatgatggcgaagaagaaggaggaggtaaagacgatgatgacatgatgtgtacagctggggaacggcgactactccggtagctagatttttgtggtgggtgcagggtttccgcaagttgctctaatggcctgttttggggcgtgcggtggggctccttgcctatttcggtatgctggagctggaccggcgaccgctgagccgccgccgccgccgccgccggtagttagcgttaaccaaaatagcatggcagcgaagggacgatccttcctctctggctcgctagcttcccacgttagcttgcttctgctttgctttcctagttttctttttgtgtgtgtgttttttaacgcatcaattcgcgtgtatgtattgtcgtgtaaaaggagagaggtttgtgtgtgtgcgcgcgcctatggga

SEQ ID NO: 21529 - DNA, 604 bp, Sorghum bicolor
  Clone ID: 13239588
caccccctcatacaccagagggaggaaatgccagtgcagtatgctgccggttgcatcgtcacagcatcagcaactccaaagatgccagcagcaaggcacaatgttctccaaagagcgcttcaaagacgggatcagctactaaatccagggtcaccaaatccagggaagacctgaaggcttccatgaagaaagtgggacagccaagcgccgcaaacttcactgtacaaacctaactcatgaggcattcacacccatgccatttttcattttaatttatacctcacatcaccaaaaagatggcctcatgcccctacaacagtgtgtttgttgatggattatttttgcattgtccttgtaagaacctggctaccagagagaccatgcactgttccgtcttgtaaatttgttgaaggttttgtatggggtaaccgagtcagtcctgtgagaaccagcaggcagccgatgagctgttggagtgacatattgtcattgtgtggcggcattcgcagatcctatgtattgtatctgagctgtaacttattgtgggcattggcaaagcgattctgattgttgtcgcaaaatttggtcaggtcatgtttcaata

SEQ ID NO: 21530 - DNA, 590 bp, Sorghum bicolor
  Clone ID: 13239601
gacgccgccaagctcggcaggctgaagcaagccgcgagcgacgaaaccaagagctccatcttcgtcgcgctcacggcgttcgtctgggtaacaaggacgcgagccctgcggatgctcccggagcagaagagcaagctgctgttcgccgtggacggccgcctgcgcgtcgatccgccattgccgccggggttctggggcaacgccatcacctttgcctgctgcatctccacggccagtgatctcctcagcaaaccactgtccgtggctgcccgttccatcagagatgccatcgtgcgcaccgacgatgcgttcatccgttccgccgttgactacatcgagttgaacagcggtgctcgcccgtcgctaacagcgacgacactggtcactgcttggaatcgcctcgggtttcgcgcggccaactttggatggggtgaagcaatgtactctgggccgtcggagctgccgcagaaggaggtggcaatgtttttgctcggcatgcgtgacagccagagcatagtggtggttattgggatgcctgtgtcatgtatgcaggcattccaagaaacggtagatctggtgtgaaatgtgtc

SEQ ID NO: 21531 - DNA, 421 bp, Sorghum bicolor
  Clone ID: 13239606
ttatggcaaccagataccttcaggtggcatcctgaccgcgctgtaccagttccacagccgcgacgtgtcgaggctagtgctggggacgaccacgctgctggtgatcatcaactgcctgacgacgtaccagatctacgccatgccggtgtccgacaacatggaggccgggtacgtgcacaagaagaaccggccgtgcccctggtggctgcgctcgggcttccgcgccttcttcggcggcatcaacttcctcatcgccgtcgcgctgccgttcctgtcgcagctcgcgggcctcatggggggcatctcgctgcccatcacagtggcgtacccgtgcttcatgtgggtggccatcaagaagccccggaagggcaccgcgacgtggaacgtcaactgggcgctgggaatcctcggcatggccatc

SEQ ID NO: 21532 - DNA, 701 bp, Sorghum bicolor
  Clone ID: 13239636
tctgcatgagattttgagcctgacaatggagaggcggttggcatctgataagctagatatatttcacaacgagtacaggcttccatgcaaattacttctttgtctggtgaaaaatcatggcatcttctacatcactaacaagggagcaagaagcacagtcttcctcaaggaggcttacgaaaacagtaaccttattgataagtgtcctttactgaaattccatgatcggtttgcatctttgattggccgaccgtgctccaactcagacaacatgctggcagtataattggagtgtggatttactgatcaggagataaactatagttggtgcatctgttttgttgaaactcaggtcagctcattgcacatgcaactacaatttaaatcctgtgtacagttgctgtttctctcagctcagtagctaaagataactaaagaattgaaaaagccagtgtctcatcttcaaatgtgaagccatctgagaagtggagtggcagctctgcaaattaggcaaaataatgcttgtaccagaagtcacatctttattctcagtttcccacaattgtaggtttgaatcctagggcaccatatgattgacttaggaatgttctagaattagctcctttatgtagcttatatcccaaaacaatgttatagcatttgtagctcttactatcataacatttggtttgctttttttg

SEQ ID NO: 21533 - DNA, 538 bp, Sorghum bicolor
  Clone ID: 13239707
gcacgaggcaattgcacaatatttgcatatggtcagactggaactggcaaaacatacaccatggaaggaggagggggcaaagcactgaacggtgacctcccatctgatgctggtgtcattccaagggctgttaagcgcatatttgacatcctcgaggcacagagttcagagtacagcatgaaggtttcttttcttgagctgtacaatgaggagctcactgatcttctagccccagaggaatctaagttccctgatgacaagtccaagaagcctatggcactcatggaggatggcaagggaggagtctttgttagggggctcgaggaagaactagtttcttcagctgctgagatctacaggatactggagagaggctctgcaaagagaaaaactgctgagactcttctcaacaagcaaagcagtcgctcacactctattttctccatcaccatccatattaaggaatgcacacctgagggtgaggacatgatcaagtgtggaaagcttaatctcgttgaccttgctggctctgaaacat

SEQ ID NO: 21534 - DNA, 532 bp, Sorghum bicolor
  Clone ID: 13239728
gcacgaggctgccaatggcttatctttatggcaagaaatttgttggaccaattacaccaactatattggcactgagagaggagatctatgacactccatatggcgagattggttggagcgatgctgctaataaatgtgcaaaggaggacctcgtctgtccacgtacactgttgcaaaatgttttttggacttcactttacaggtgtgtggaaccagtattgagcagctgtcctgtcaacaagctgagagagagagctctgggaaacctcatggatcatatccattatgaagatgagaacacacagtacctatgcatatgttctgtgaacaaggctctaaacatggtctgctgttgggtagaagatccaaattcagatgcattcaagcgtcatcttgcaaggataccagatttcttgtggctttcagaagatggcatgaaggcacagatatatgatggctgccagagctgggagacatcattcataattcaagcattttgcgctacagatcttgtcaatgagtatgctccaac

SEQ ID NO: 21535 - DNA, 574 bp, Sorghum bicolor
  Clone ID: 13239734
gcacgaggggaaagatctacacctacgatggactttacaaggttgtacatgactgggtgcagactggagtgcaaggccatgttgttttcaaatataaattgaagcggcttgagggtcagccatcattgactacttctgaggtgcgatttactcgtgcagaagctcccacaactatttctgaattacctggactggtttgtgacgacatctctggagggcaagaaaatattccaattcctgctactaacttggttgatgatccgcctgttcctccatctggtttcacatacttgaagtctctaaaaattccaaaggacatcaagattccatctagtattattggctgtgattgtgaaggagattgtgctaccaacaaaaattgttcatgtgctcagcgcaatggttctgatctgccttatgtatcacataagaacattggcaggttggtggagcccaaagcagttgtatttgaatgtggggctaactgcagttgcaaccatgattgtgtaaacagaacatctcaacagggtttgcagtatcggttagaggtatttaagacagcttcaaaaggttg

SEQ ID NO: 21536 - DNA, 624 bp, Sorghum bicolor
  Clone ID: 13239756
gcacgagggaagaacgacggcagcatcgatgctctccgcatgaagatcatcgcccagctcaaggccaacgtacgtgcaggcttcccttccgctcccgattcccctcctattcctttcgatgaggccttttattttggttcctcctgttactattatgttaagttgtttgttgtatgataaaaggaaaacattatacagttcctctaaaactatatacagttaagaaatcacttccagcttaagttggtaggcctgcttaggagatatgctcatagtatgcaaccctgggacggtctgaattaactgaacttctatccaggttgtgcgctttctgtaatcgatggaatcaggaagctctgtgactaaattgttaaaattaagttaagagttcagtaggttatttaaatgatgctgcagttcagaggcgattgtgcatatcccaaaaggacctttaaacagggaattggtttgcatgagagttagggtatttagttgttctttgctgtcacttggcactcgtttcatcgtcagtttcaatctgtacttctcttgtatcaacatgatggttcggaattgttttgcacgagaatttgggtatttagttgtcctttggtgtcacatgcc

SEQ ID NO: 21537 - DNA, 573 bp, Sorghum bicolor
  Clone ID: 13239766
ccgcctcaaggctctcctctcggaggtccgatagggcaaaccaataatggcagaagttctatcaggatctcatgagcaccatctgagctctgccttagatggacactatgacgagaagaggaaatccaatgtggaatactcagaggatgaaaagaaagccaagatcgcatctctgaaaaagaaggctatgagcgcctcacagaagtttaggcattccatgaagagggggaggaagagcagcaaggtcatgtccatctcaatattggatgaccgtgaacctgaggaggtgcaggctgtggatgccttccgccagcttcttgtacttgaagagctcctaccatcacagcatgatgactaccacatgatgctaaggtttctgaaggcaaggaagtttgatatcgagaaggcaaagcaaatgtggtctgatatgctcaagtggagaaaggagtttggtgcagataccattctcgaggaattcgaattcgaagaagctgataaggtggcagaatgctaccctcaaggttaccatggggttgataaggaaagcaggcctgtctactttgaacggcttgg

SEQ ID NO: 21538 - DNA, 600 bp, Sorghum bicolor
  Clone ID: 13239776
gcacgaggcaacttcttgtccttgggggacaacaagctgtccggtgacataccggaagaccttttcgactgcagcacaacagcctagaaggcacgctgcccgacgagatctttgggctccggcagctcactatcctcagcgtcgcgtcgaacaggttcgtaggcccgatccccgacgccgtgtccaacctccggtctctctccttcctcgacatgtcgaacaatgcgctgaacggcacggtccctgcggcggtgggaaacctcggccaactcctcatgctggacctgtcccacaaccgcctcgccggcgccatccccggcgcggtgatcgcgaaattaagcaccctgcagatgtacctcaacctgtcgaacaacatgttcacgggcccgataccggccgagatcggcggcctcgcgatggtccagtccatcgatctgtccaacaaccggttatccggtggtttcccggcgacgctagccaggtgcaagaacctctactcgctcgacctctccgccaacaacctcaccgttgccctgcctgccgacctcttccctcagctcgacgtcctcacaagcctgaacatctccggcaacgagctag

SEQ ID NO: 21539 - DNA, 593 bp, Sorghum bicolor
  Clone ID: 13239787
gcacgagggcacgcccagatcgattcgacgccctagctttgacccttctcgtctttgcacagtgaccgcagccctactccctctccctctccctccccacaccgcaccgcgcaccggcagccgcaggagcaggaggaggaaggaggagcatgccgcccccactttatttaatctgctgcctttcgccatccccaacatgaccaccaccaccaccaccaccaccactctgcagacaaatcctgtataggagtcgctcgcgcatcagcggacgcagaggctgagaggcaggccggccgcccacccgccgcgcaggaccgcatcccgttctgccgccatggccgcctagcagagatgcctgggaactcagttgacaagtgagcagtcttgttagattttggataaagtgaagtgaaaattggatcttcactcgtctgattgatctgcactgctggaactccttgtgaccagaccaccatgtccgtggaggctgctaagcacaacgtgcctgggcaccaggctactaaaccagtggctgatcacgcggcagatccagttactgcaaaggaggacaagaaagcaatggatggagaagg

SEQ ID NO: 21540 - DNA, 605 bp, Sorghum bicolor
  Clone ID: 13239797
ggcacgaggccggagtctcgatcccctcccagcgaggacccaaccttctccatctccagtgtgtgcaggtatggagcaccatataatccagcaagccggagagcatgaggaggaggaggaggatggcatgagagcggaagtggcattcgaggggttgcacagtcacaacacgttcaggtacaagcacaagaagaggtccaaggtgtgggaggagtacaagcccgtcttcctgaacgggaaggttcagtttgcagagtgcctgtactgccacagccgcatgagctgcaaggactccaacgggacgagccatctctggcggcaccagaagatctgtccgggcaaggaggacgcggcgtttcggcggctcaaggattcctacttcccatgtgttttggtaaatcagggtgaaccggttacaccaagtgatccggtgaatcagattatttcagagacactcgacgacgtaaactcagtaattcccaacagattcaagtccaaggtgtggagagagttttcacctatctatgtcgagggtaagctccaggctgctgactgcgtgcattgccgcaaacgccctcagtgcaaataagtttgggggaagaagc

SEQ ID NO: 21541 - DNA, 496 bp, Sorghum bicolor
  Clone ID: 13239810
gagacgttgacatgatatcaagtggacagaggcacagtttccttgggaaatataaggtgggatttaccaatgaagggaagatactggccctagacctggaaatttataacaacggtggccattcacttgatctatcccttgcagtactggagcgtgctatgtttcattcagaaaatgtctatgacatagcaaacatcagaatcaatgggcaagtatgctttacaaacttcccaagtaacactgctttccgaggttttggtggtccacaaggcttgctgatcgcagagaattggattcaccatatagctacagaactccaacgaagtcctgaggagataaaagaacttaattttcacaatgatggagttgtgctgcattatggccagttgctccagaattgtacaataggttcagtttgggatgaactaaaatcgtcttgtaattttgtggaagctcgcaaagctgtgaatagttttaacagtaatagccgctggag

SEQ ID NO: 21542 - DNA, 490 bp, Sorghum bicolor
  Clone ID: 13239818
ctctcgccctcctacgacgcccccgcgtcctcccccgaccccgcctcctggccgccctacgacgacccagtctacctctccgacctgctccgctccccgccgtacccttctcctgacatgggggttggcctcgacgacttcgctggactcttgtcgccggcggcacaaggacaggatgccgcccccgcggcacgattcgacttccaacagagtccgccgttctcggatggcggagaaggaggaggaggagaagaagaccaacggcagcaaccctccttcgccgcccagagaactggcggagcccaacatcagcgtggcagccagagctccgccgcgttctccagtgacaaggatgaagaggaggagacgaagacagagtccaccacctttcctgctgccgacgccgaccacgccgcgctggcctcggccttcttcggcgcccagaatgagggaaacatggacatgctcaacatggcgttcctcaaaggca

SEQ ID NO: 21543 - DNA, 626 bp, Sorghum bicolor
  Clone ID: 13239819
cgccggaacatcgatcgcatggcctgcgccggcgccgcgcggaaggtctcggcggtgctctaccactacccgtgcccggacggcgcgttcgccgcgctcgctgctcacctctatttttccgccgccgcccacccggtccgcttcttccccaataccgtctacgaccccatcaggagtgattcacttccgttggaagaaataaaagaggtctaccttcttgactttgtgggacctcccggttttgttgaagatatatccactaaagtcgaaagagtaacgatcctggaccatcataagactgcttttgaaagtttgtgtgggaatgccacacttgggcaaaatgtgaccaaggtgctagacatgcagcgtagtggtgcgacaattgcatttgacttctttagaaacaagctcttgacagaagttagcaccttacggggtaataaaagtggtaaagatgtagccgaggtcaaatatgtacctgacaacaaggtcgaaacagtgcacaagcttttcaagtttattgaagatggggacttatggagatggaaaattccaaatagcaaggcctttagcagtggacttaaagatttggacattgaattcaatgtcaatgcaaacagtaaatt

SEQ ID NO: 21544 - DNA, 563 bp, Sorghum bicolor
  Clone ID: 13239823
gcacgaggatttcatctcatgttaaaaaaaaagaacaatccaacggaaacatcacagagcccagcccctcattgtattgtatatgaggcagaaaaaaagaaagaaaacaaaaacacgcctcctactacagccaaaccaatcacccaattgaataagttacacaaagggaagaagaagaagaagaagaagaagaatacatacagacggctcccaacactaacctttcctgttattactatccatatcctttcctttaattctcttcagctcccagaggttgctgtcactttgaagcagtcgatattgcacagcctcaccgacttcatcatgcctccaaaccggtcgatgcttttcctcggccgatccgactgatcgacgctagcccgcggcttgtcgggatggtccacgctcttcctcgtcttgtcccgcctatccgtgctgcccctcggcttctcccgccggtccgtgctgtgtctctggtcgatgctcggccgtgttttgtccctgcagtccgtgctcttccttgatgagtcctccgatgaattacattcgggctccgtcgt

SEQ ID NO: 21545 - DNA, 526 bp, Sorghum bicolor
  Clone ID: 13239829
gcacgagggaaagatgaggatcaagcttgcctgtttgcttctcatctttgtgcaagtgcaacgagtggtccttggaacgcatgatgtgtacattgtcaccatggaaggggatccggttgtgagctaccgaggcggcgttgatggatttccagcaactgctgtggatttggacgaggaaatggatgttaccagtgaggctgtcacatcgtacgccctccacctccgagggcaccatgataagctcctagactcgcttttagtagaaggaacttacgagaagctttatagctaccaccatcttatcaatggcttcgcagttcacatgtcgtccctgcaggctgagttcttgaggaaagccccaggagttaagcatgttgagagagacatgaaggtacagaaattgactacacacacgcctcagtttctaggattgccaactggggtgtggccaacaggaggtggacttgatagagctggtgaagatgttgtgatcggtttcgtggattctggaatttaccctgaacat

SEQ ID NO: 21546 - DNA, 475 bp, Sorghum bicolor
  Clone ID: 13239832
gcacgagggtagtttctccagtaggcgagactggaatgctggttgttgattcagtggtacctgaaggccctgcgcataaacatttggaacctggtgatgttctagtacgcatcgatgaggaggttgtaactcagtttcttagattggagactttacttgatgatagtgttggcagggaaattgatttgcagatagagaggggtggagttcctttaacagtaaaattgcaggttgaggatttgcactctataactccaaatcatttcttggaagttagtggtgctgtcatccatccactgtcatatcagcaggctagaaacttccgattcaaatgtggtctcgtatatgttgctgaagcagggtacatgctctctcgggcatctgttccacgtcatgccattattaaaaagcttgcaggagaggatattgcacatttagatgaccttattgcagttctttcaaaattgtctagggg

SEQ ID NO: 21547 - DNA, 422 bp, Sorghum bicolor
  Clone ID: 13239862
gaaggagaactgccgagaagaaaaggtgtcatgggagacctggacccgaaacgaccatcaataaggacactggaggaaagcaaatggactagatacttcatgcagcctagccctttaccttgctctagccagcccaaccaaaggattatggataggcgggatgaacttgtgtggaaggttcgatgcatgatccaagggtttataaggaacacagaagatttgcttctaggaatgaagactgttgatgccttgcaacgccttggccttggctaccattttgaggaggacatttccaaattcatgcatattcttagtagaacttcaatggggggagatgacttgtttgcactcgccctccagttccgtctgctaagacagcatcactacaatgttgcttctgaaattttcaacaacttcatgga

SEQ ID NO: 21548 - DNA, 152 bp, Sorghum bicolor
  Clone ID: 13239871
gcacgaggacgaggtccgctagggccgcaccggcgaccactccccaacccctgcgcgcgtcggatagctccgcgcggccgccgtcggtgaggtctacccatctgggcgggctgggacgccggtaagcaatgagctcgcagatccacctttgc

SEQ ID NO: 21549 - DNA, 442 bp, Sorghum bicolor
  Clone ID: 13239873
gcacgagggttatcgagatggcgaagatgcaagtgtgaaccaagaagggggtggtattcaatttgatatagcattgaaccaagagtttgacagttttgcacataactttggtcagacatacaatacagaggatagacaacagccacaacataatgctgcagatgtcattgttcttagtgattctgatgaagaaaatgacccgattgttcgcccgccagctgtctatgcaaatgcaactacaaatggtgacagttttcctttcgtcactgatgctgctggaactggatatcctgaaaggtaccaggaggatgctggcgttggtacaagtggccttggtttattgaacaacaatactggtgattttgaaataaataactggcaaatgcattcttatccacaaccggagcaagggttccagttttttgggactgatactgatgtt

SEQ ID NO: 21550 - DNA, 264 bp, Sorghum bicolor
  Clone ID: 13239880
gcacgaggccgaccccgaccgacgcctaggccgtaccaaaggggagggagcagagcacgcgcgcgagctacagcgtcgaggcggcggcggcggcgaaaggagggaggcaggatgtcgtcggtgtacgtgcttgagcccccgacgaaggggaaggtggtggtgcagactactgctggtccgctcgacatctgagctgtggcccaaggaggcccccaaggcggtgcgcatcttggtgcagctctgcctccagggctactacgacgg

SEQ ID NO: 21551 - DNA, 597 bp, Sorghum bicolor
  Clone ID: 13239883
gcacgagggccgtttcccgtttcttcttccaagcatgccgtcgctgccgacctaggtacgccgggtgccgactgcccaggtcttcttggggccttcaccggggacggccaccaccagaatgtatatgtagcatatgcttcaagcgaacaaggacaaaatgagttcatctgaggatgacttcaccgcactgtctgagggttcatctgaggatgacttcaccgctctgtctgagggttcatctgaggataacttaacctcactgtctgagcattcatctgaggatgacttcacccgactgtctgagttgaccgtcggaaagaacaaatgtagagtccgggtgcgcgtctcacggctgtgggaatccttcaatccgaaaaatgacatatcatttggccttgactgtcttctgattgatgatgagggtgaaactatgcaggcacgtgtacttcctgacgatatagaccagtttgaagagcagctaactgaagggaaggtctatgccctgtcggattttacagttggtgatactagggaaagctacatgacctgtagcaatgagttcactatatactttggaaggcagacagtggtcaatga

SEQ ID NO: 21552 - DNA, 450 bp, Sorghum bicolor
  Clone ID: 13239886
gcacgaggggcttgcggaatccaagcatttccctcaacgggcgactttattctgctgattgtcgtgatggctgtaagcttcgagtttataatagagagctgggatcgtggacaaggttcattgacaccagacaccatatgggaagctcacggtctcttgaagccgcagcctttgtctcccttaatggaaagctatgcatcatccgtaacaatatgagtatcaccattattgatatgtcagacccaacaagagtaactgaggttgacagtgcgcgcatgtgggaggcttttgctcgaaaggggcagcacaggtctttcatggcaaacctatggtcagccatcacaggtcgtaatctgaagacagacattatgcattgtcaggtgctccaagtttgagtttgtccatatatgaagtggaaacatacttagatttgtaaacaacctcagagcc

SEQ ID NO: 21553 - DNA, 533 bp, Sorghum bicolor
  Clone ID: 13239887
gttaagagaagttctacgattagatttgaaacaacaagctggtggcggcacgacgaactattgcatcctcctcgttgcattggcagctctctcggctcgctctataaatactttgcggtatcccgtatccgctgcagatgagcatcgcagcaacgcacggagccgagctcacattgcacaagctagctagcctttgcattgcatattctccatcgctcgcacgctgctaaacacacgtttccaattcgctcaaattaaactagctaacagagcacacacacgtcatcgtcatacacgaagaccagagagctatcttggtgatctagctctgctgcattgcatgctccttcattcggcaaccaacgtccgatcgacgatgggcggtgtagctaagatgccggcggcagggctctgctggttactgctaggcgtggtgttggcctttggagttgcagctagcccggcccgggcctccaggaatactcactacgacttcgttataaaggagacgaaggtcacccggctctgccacg

SEQ ID NO: 21554 - DNA, 258 bp, Sorghum bicolor
  Clone ID: 13239889
gcacgagggaaacagggcccgtctctcctccctccactccgaagctgcgtctcatcctctagctgagctcagtctcacgatccagcagtgacttgtcatcgcaagtccaacgccatgggtgaggatgacgacgaccagcggaaccagatgctgggcgcgggcctggaccatgagccggagcggcgcccaggggaggcggagccggaggagggcaagaaacctgcggccagcgaggcggaggccggcggcgacggcgcc

SEQ ID NO: 21555 - DNA, 394 bp, Sorghum bicolor
  Clone ID: 13239896
gcacgaggccatgtttttctcagagactgacggtgccaggttccgtggaatgcgattggaagatctggatgaacagtattttaatgtcaatcttggtgatgatgacttctctcatgctgatcatcgtcatcaagctgaagcagtgaatataactctggtcgataattttgagtctgggtttgcagaaactgatgtgttcaatcgctttgagagatttgacatagcagatgatgagaccacagtcaatatctctcctgatgagcacccaaaagttccaagtacactggttccctcaccacctaggcaggaagaccctcctcagcaagaagaacagtatgctgctcccttccttgttcgtgaagaacctcaacaagggggaccagaggagcataag

SEQ ID NO: 21556 - DNA, 396 bp, Sorghum bicolor
  Clone ID: 13239903
ctgaatttcagcaagagggaaggaagtgtactgcaccatcagcactaccatggctggcagctggaagatggttgccggggttctgctcctactttcactccttccgttggcctcgtcgtccatggtgttcaagcttgacggcagcgtctatcctgtaggccacttctatgtgaccatgaacattggggagcccgcggagccctacttcctggacatcgacaccggcagcagcttcacctggctcgagtgccacgcaaaggatggtccctgcaaaacgtgcaacaaggtgccacacccactgtaccgactgacacggaagaagctagttccatgcgcagatcctctctgcgacgcactgcacaaagacctgggtacaaccaaaaagtgcaccgatgt

SEQ ID NO: 21557 - DNA, 446 bp, Sorghum bicolor
  Clone ID: 13239909
gcacgaggagtacacaagcacacaccacctcgtctccacctcccctgttctcagcgtgcttgccctgtttcgacctcctctgctcatccgcctccctcgcccgccacgccccaccgtagtacaggccggcagacagccatggtggtgctcgccaacccgcctgtcgtcgaccagatcccgctgctgcggtccccggggcccagggacaccttctcgggcgtgccggtcgtcgacctgtccagccccgccgcggcgcgcgcgatcgtcgacgcctgcgagcgcttcggcttcttcaaggtcgtcaaccacggcgtgcccgcggccaccatgggcagggccgagtccgaggccgtcaggttcttcgcgcaggcgcaggccgacaaggaccgcgccggcccggcgtacccgttcggctacggcagcaagcggatcgggctcaatggcga

SEQ ID NO: 21558 - DNA, 204 bp, Sorghum bicolor
  Clone ID: 13239925
caagcacccaaccagaaactcccataatacaccaaacaggtgcggtgcccggcagcagcagcagcagagcgccagagcgggcgcgcgtgcagcgtgcagcggccgaccaccaccaccacccatgtcgtccagcaagcaggacgcgatcagcgaggtggagtcggcgccgccgactccgagcccgccgacgacgccggcggtggt

SEQ ID NO: 21559 - DNA, 625 bp, Sorghum bicolor
  Clone ID: 13239956
ctcccctcaacctagcaggcagcagcagccgccggtcggcaactcaggcccctgccgctagaggccgtccgtggctctgctccgcggtcggaggcgccgggcgcgcttggctgggcggttgtccgcctggccgcagccgcactggccgcctggctgtggcctgcgacactgcatttccgtagcggcgtgggcagggtgccagcggccagccaccagggccgcgcggccgcgcggtactcatcgcctactcctaatcgtctgaggcctgaatttaaattgcaacgtgctgcttctttatatgcacttctgaatgcttggaactggtgtgactacatagtttggtattcatttcataaatgatggaaagaagattgggacgccatgtatatttgattcccagaactcttccctttatgcaactgaatgctatgtcctcattctcagctggccatggacgccggcccaagaagaagctatatcaccgtgaacctggtcttgacaaggccatggatcttcaaaagaagcctgctcttctccttcgtctgcgtgacctcattctggcacaaaagacagggtcactacttgtacgtgaccttgaaaaggaggttggctttgtccaaaaatg

SEQ ID NO: 21560 - DNA, 293 bp, Sorghum bicolor
  Clone ID: 13239969
aagatggcaaagtggacaaattacaaacttccaatatctcatgcatctaaatacacttgccggtcgagggtacagtgatctcacacagtacccattatttccatgggttcttgcagattatgagagcgatgctttagatctgatgaatccacacacatttcacaggcttgataaacccatgggatgccaaacggaggaaggagaagaggaattccgcaagagatatgatacttgggatgaccctgatgtaccaaagttccattatggctctcattattcaaatgctgggattg

SEQ ID NO: 21561 - DNA, 605 bp, Sorghum bicolor
  Clone ID: 13239976
gcacgagggtctgtttctatcaagttaatggatgtaaacttcttctgaactgcaattgttacattttttacaagatatagatttgactataatgaaactaatatagccaatatccacaaaacacacattatcttgttgagcttgtaattcaaatcttctcagacttgactttgcgacaacaacagaggcaattattgcaaaactccaggcaagtacagggcaaaaaaaaaagtttaacacaacccatcaaaatatagtctgacctgcttggcccagcctaatggagcaaagggaaactgatgacgttgggtgtgttatacatgaaaaataatgaactaatacacagatggttaggtaaccatgtgcttatcctgtactactaaatgactagaagtgtcttctgagtacttgcatctctatttctaatctacacatagagataagtagacatgcggtccttgaatcaactatatatgtaaaagaaacgaaatgccatatactatttttggaatttggtgtctttcttttacccaacaaatatgataatctatagtttaattttttttattatttatgcaattttaaaaaatgatgcaaataaagtg

SEQ ID NO: 21562 - DNA, 545 bp, Sorghum bicolor
  Clone ID: 13239984
gcacgaggcacgcatacacatgcatgcgcacggcaccgcctgcagctttagataaattagtttgtctgttcgtctgttcttcattctccattattccatcgtttccaataatcaaattattagctatagaagaagatcaacaagatgagcaaaggtgctatcatcggcgcttcgaccgtccttgttgtggctgtggttgccgcggtgtgcgtggtgtcgttcaagggcaacaactcgagcaagggcgatggcgatgagaacatgtccatgtcggtgaagtcggtgaaggccttctgccagccgacggactacaagcagacgtgcgaggcggagctgtccaaggcggctggcaacgcgagcacgccgtcggacctggccaaggtcatcttcggcgtcacctccgacaagatccacaaggccatcagcgagtcggagacgctcaaggagctcaagaacgaccagcgcacgtccggcgcgctcaaggactgcaacgagctgctggagtacgccatcgacgacctcaagtcgtccttcgacaagctggg

SEQ ID NO: 21563 - DNA, 637 bp, Sorghum bicolor
  Clone ID: 13239986
gttcaatgatttggaatatgtccgccaagaagatgaaagaaggaccttggaggacctttatgcatttccaactcttcttccttgtgcaaaagaaaatgcgctgctgtcagaaattttacctatgcagaaagatagtgcactagcatcaagagttttgaagtttattcagaatatgagcgtgaaagatcctcttcagccagtgggtatcatccaagaatgcctttccaaatgcataaagagacaggtcgatcacataggcaatcaaatcctgtccaagctaatgggcgaatggagattaatggatgaactgcttgttttacgtgctatttatttgctaggatcaggtgacatgctgcagcagtttctgataacaatttttgataagcttgatagagggaattcctgggatgatgactttgagttgaataatttgttgcaggaatccataagaaactcagctgacaaaatgctcctgacagcaccagattctttggttgtttcgttagcaaaacatgacacacacaatggtgaggaaggtccatcaacttctaaaaaaggtcgtgcacttggttttggcattgatgcgcttgacatgcttaattttacatataaggtgtcttggcctcttgatctaatt

SEQ ID NO: 21564 - DNA, 560 bp, Sorghum bicolor
  Clone ID: 13239987
gcacgaggatcacctactacaaaatcttgcatcagcatggctacccaacaaggtttcagttctaccgacctgaaaacccataggaagaacctaccatccctccttgcagttgctcaaccattccttcgcggtgagctagagaaaatcgacccagagatcccatcctttctctccatcctacgctcagccggtgccggtgagcgtcaccacaagaacggagcattcctagctcacctgctcaatttccatcgcattgtccgactgtggggtgcgccctctgacattgctcgatgtggccttttccactcatcgtatgccaattcatacgtcaacgtctccatcttcgaatcaagcacgacccgcgaggacgtgcagcgtctcatcggtgcaccagttgaacgactagctttcctattctgcgctgtcccgcgccacaagctcatccacgaagagctccacttccagtacaccgacacggagctgagggatcacctagctgcctctgacctgtccatcaaggcagctagggagactggcacatttgacgcctctgaggcatg

SEQ ID NO: 21565 - DNA, 570 bp, Sorghum bicolor
  Clone ID: 13316260
caccaacgatgcttccccagtacaatgtttatccccaatgccatggtttacctatgatatcatcatttcagtttaatcctgcgggcatgaatatgcactcaagtcatttaccgacacaaaatgtgtggtcatcggcatcaagcacaccaatgcctgaggaaacatgcaatcgctctgaaaggagggctgcagcacttgccaaattcaggcagaaaaggaaagagcgctgctttgacaagaaggtgaggtatgtgaaccggaagaaacttgctgaaacaaggcctagggtgcgaggtcaatttgttagacaggcaagcaatacagatatcaccagcactggagatgatatctctgaagacgaagatgacgatccatcgtccagggaggtagatatcgtttcctctccagagtagtggagaggtcctctatgttaaaaaaaatagagtgcagatgattactgctcactttgttacaactacagtagacctaggcaatacattcttctactggcaacaaggcagcacaccttttttgctcacacacagtataacctttttgtcccccaaaaca

SEQ ID NO: 21566 - DNA, 703 bp, Sorghum bicolor
  Clone ID: 13316291
gctctgatgtcgatgattgaccccacaatccctctggtcgttggtggctccggctcttccagcagtggaagcggcacgtccaacggcggtggttcgaacggcagcaatgacagcgatgacgattccaactccaacgacgacaacgccgacggcggtgctagcggctcttcgtccactcgcgccagctctgttggaattggtgttggtgttgtgggtggtgctgccgcctatggtgccggtatgttctgggtggcccgtcgctaccgcaagagacgtcaacttcaccagcgtaccaactcgactgtcgagcagcaaagcgagggccgtgggggtggttctccatttgctgccggtggtcgtctgtctccacacagtcttaggagcaaccggacccagatgatcagtgcgcctgtcatggccgagaactctctgggatggaactagatggtttcataaggtaacagaccgcttaaaagatttttcgaccttgtcatattccggaaaatgtgtgtattatgttgacattattttgatattctacgtgtatcaattttctccaagggtctcacccgcggagatcctttttcttcttattttctcttcttttactttattccccatatgtttgtgtggcttttcttcttattcttcttttcttactatcctttggtgaccagggcagctttcctctcaccaaaatttt

SEQ ID NO: 21567 - DNA, 586 bp, Sorghum bicolor
  Clone ID: 13316309
tggccagtcatcagagaagactgatgtgtttggatttggggttctgttagttgagttgatcactggtcagaaggcgttggattttggaagagtagcgaatcagaagggcggagtgctcgactgggttaagaaacttcatcaagaaaagcagctaaacatgatggtggacaaagacttgggtagcaactacgatagggttgagttggaggaaatggttcaggtggctttgctatgcacacaataccatccatctcaccgacccagaatgtctgaggtaatcaggatgctggaaggtgatgggctcgcagagaaatgggaagcgtcgcagaacgtggacacaccaaagtccgtctcatcggagatcctacctccaaagtacatggatttcgctgcggatgaatcctcacttggcctagaagccatggagctctccgggccaagatgaccatccaatcgaccagatcggtcgccgcagagatgcatagatgttttgccatataaagcctattgttgtattacatgggagttggttaggtgtagtcgtgtagagccccccaacacaagggaaggcgaaaaattttaccgg

SEQ ID NO: 21568 - DNA, 229 bp, Sorghum bicolor
  Clone ID: 13316310
acaccggacttctctgtgtacagtagtgtagtaagtagactgcggagtgctgggaaggatactcaagccaataatgtcattaagtacatgacagataagggtcattatcttcatctgctgtcaaggtttggagggtttagaagatgctgagatgagatgctccatagttagatgcaaaggttcatttcttttggctgtttgcatttctgacagatggattatgaaggat

SEQ ID NO: 21569 - DNA, 538 bp, Sorghum bicolor
  Clone ID: 13316343
tcatcgcaaagatgattcacgacacaggtatgaactgtcgtctcccgcagacccctcgctcgcccgccgcagccgcgtcccactacttcgacgacgttttcacccgccaacgccgtgcctcactctcgggcactcgccgcaatagcgttgcacgcagcttgacccgcacgcgctccatcggtgcccgcagcgactggaccaacggtggtgccacttcaggcgcgccctccaatgctggtgatgaagacgacgacggtgacgatgagggtgcgtcaaaggacggacagaggagccgccagtggagcatctacaaggaagacccagcggaggccaagacggacaaggacgaccccatcaacaagtatgtgcaagagcaattgcagcgcctgaagacgaacgaaagcgcagagtacagtgaggagattgcggcgtctggtgatggcgctgatgagaagagggacttttgagacttgtcaggctagaggaaaggccgaggtgatgaagacctagaggcatagagagaagttgggagagaaag

SEQ ID NO: 21570 - DNA, 401 bp, Sorghum bicolor
  Clone ID: 13316359
ggctcttgggctgtgtgtttcacttatgcaacattcttcggtataaaaggattagctgatgcaggaagaacataccagaacagtttgcctatcaggaaagcatgcaacttcttgttgtcaaagcagctagcaaccggtggatggggagagagctacctcagctgtcaaactgaggagtatgttgatagtggcaggccacatgcagtgcagactgcacaggcgatgctagctttactttacgctggacaggttgaacaagatccagcgccactataccgtgctgcaaaagaattaatcaacatgcagatggagaacggagaatttccccaacaagaaattgttggcaacttcaactcctcacttttctttaattaccccaacttccggaacttatttcccat

SEQ ID NO: 21571 - DNA, 351 bp, Sorghum bicolor
  Clone ID: 13316394
agtggatcacaggggtaccaataacacataaggctgatgtctatagctatggaatggttctcctagaaatcatatcagggcgaaggaattctgagaaaattaaggaggggaggtttacttactttccgatctatgccgcagttaaggtgaatgaaggaggtatcatgtgcctgctggatagtggtttgaagggcaatgctgatgccgagaagctagagagagcctgtagagttgcaagctggtgtattcaggatgctgaagatcacaggccgatgatggggcaggttgttcgcatgctggaaggtgtcatggatgttcaagtccctcctgttcccaggtcactccaaaaac

SEQ ID NO: 21572 - DNA, 577 bp, Sorghum bicolor
  Clone ID: 13316402
tgttatcaaatacacttgcatcagcaggagaatgggatgaagtctcaaaggttaggaaactgatgagaattcgggggctgaaaaaggatcctgcagtgagctcgtttgaaggccgtgatggtttggtgcatcagttctttgctggtgataatacacacccatggatgcatgaaataaagaaaacattattggagctacgggcaagattgaagcttgcaggttatgtgccagttcttagttcagtcgtttataatgtaagtgacgaagagaaagagaggttgttaatgggtcatagtgagaagcttgctctgtcatttggattgctcacacttgagtctagatcctcaattaggatagtaaagaatctaaggatatgtgaggactgccatttgtttataagattagtgtcaaaagttgagcccatcgagattatagtcagggacaatatgaggtttcatcacttcagagatggagaatgctcatgtggtggattctggtgaatgcaggatatgtattattttactgagaaaaaaagtaaacataggagaataaacctccatctattaatagtatcttg

SEQ ID NO: 21573 - DNA, 537 bp, Sorghum bicolor
  Clone ID: 13316419
gagatatttgagctcgcagtcgggagactgttgcaaaggataaaatgcttggaggtatgcacgcaagcacaacaagggccagcatccagcctctaatgaatccaatgataaagccaccgatgaaagtcgtcaaaagctgtatgtacttccctaccttaacatgaaaagtcagttttttagtgttgtacataaggcctttttccttatgttctagaaatgaaagaccctttactggaaatttgttagacatatatttttgtttcttttgccaaagcaataatgaattgttaccttctcaccgagggcgtcttggataagtacagtgtccgcagacattcttgaagctgcttctgcagttgtcatctccacgtcaaagaatgcaatgtcttgcctcagaacagcttcaaggtataatgatcgcagccgtgttgactgcctttctccagccaccgtccagcatgacacctctggagcaagtaaatgtttcagccaaatcgtttggaattaatgataatccaacataaacagagttatcat

SEQ ID NO: 21574 - DNA, 272 bp, Sorghum bicolor
  Clone ID: 13316434
gattgatgttagagaggaatgcatcaagttcggtccagtggataatgtcaaggtttgtgaaaatcatccgcaaggtgttgtattggtgcaattcaaagataggaaagatgctgccaaatgcatagagaagatgaatggcagatggtttgctgggcggcaaatccatgcgagcgaagatgatggctctgttagccatactcttatccgtgaatacgatgcagaggtgtcaagactggatcggtttgtagaagagttagaagagtcaacataga

SEQ ID NO: 21575 - DNA, 286 bp, Sorghum bicolor
  Clone ID: 13316450
acacataatgaactggaaatcaaggtatctcgattagaagaggagaatgagaagctaaagaagcaaaaggagttggaaaagatacttttctctgcgcctcttccggaacccaagtaccaactcaggagaacaggctcggcgactttctgattgtatccagaatatcttgtttcgtagtttttaagtcctgtggattgtaagtttttgcctcgtcggtttagaatcatttgctagcttgggagtttttgcttatcctagctagatggtttgctctctccctcagtct

SEQ ID NO: 21576 - DNA, 365 bp, Sorghum bicolor
  Clone ID: 13316454
cttctattagatgcatttgccagtgtaagccagccattgttctagtggtacacacattctgtaattctttgaacaggagtaagcagccattcttctagtggtacacacattctataattctttgaacaggttggatatgggagaagggaaggatgtcaatttcgatgagcattgttgtagatcgaagttgcacaagtaatgtttcaagttccttggccctctaagttccactgtctgttgcacaagtaatgtttcaagttccttggccctataagttccactgtctgttcctcctcagattcaaagtttacaaacattcaatcaattggcatctttttgtgatttgtgatagcacacaacaacat

SEQ ID NO: 21577 - DNA, 474 bp, Sorghum bicolor
  Clone ID: 13316473
gggtgtgcaccacaggctaatgacaagccccacactgatgaacctggctcaagcgttagcgtatcataaaacgtgctacgaggacatgcctctacaagattcacaagcgacgcaagagcagcagacgatacaaaatctttgtgatacacttcgaaccatactgaggttgtagatttgcaagagtgaaggttacaacctttggagttctgaagcgctgcatggagccaagggtgaacatggcttctcatggtggacactgaacctgctcggggtggagccccaaggatcgaaggaaggcatgacatctgtgtaccttggagcaggcctaatgacaactgcgtttgagcttgtggacggctggacgctttggtgactggaagctgattgacacagggatttctgtggggagtggaaatttctgtctctgttaatagcctctaggggtttcagcggtcggtgtatgtagagactgca

SEQ ID NO: 21578 - DNA, 549 bp, Sorghum bicolor
  Clone ID: 13316474
gtatcttgttgatgggagatggacccttgcttttagtgacgagcagtcctgtaaggttgcagagagtatggtcatcgaagagatgaaactccaacgagatgctgttagagaacaattgaagccattggttgaatttgatatgcctgaggatggattgcagcatccccagccttcacatgaaaccccttctgatgatggataatgactaagttttcatctagtgcagtgttgtgcttctcaattacggagacatggcaacagatcgccacaaaagtgcagcattgaacatctcaaccatggctgcaggaaaacccaccatggtaagccatcgaaaattctgtttggaagattagaggtgtctccttgttaacacacaactgtagagttccgggccatcttcagttgaactagctggataggattctttgtacaatagtttgtttctctccttgtaaccttatatatacaatcaaaacccattctttgataagtttcagggcatagttgtgttgtgtacactaaatgtttaaagaaatttgcagttagtaa

SEQ ID NO: 21579 - DNA, 665 bp, Sorghum bicolor
  Clone ID: 13316475
atctgaccatcattcccagcagaagtcctacagaaacattatgcctgtcatgcatcatccgacctacatgatgaaagaagtgattgtgataaatgattctcctgaacgcagaagtgagccacaagctagcatgcttttcccccctgctacacctccaacactcccggtaccaaacaatatgccaccccatccattttaccgccttccaccgcaaagcccagtttttccaagggagagggctgttggatccatgcctgtatacgcaaatgttggctcagtggttggtgtcaattcaagtcaaggaagccaaacggaagtagccaattcttacatgccaaatccgttcttcgtccagtctcgaactggttacataaacccgccagtgtactattcacagaatttgcggtgacaatttctcagtaactcaaatgaccaggagaactccatttaacttgccggtcatcactgtcaaagtggggggaatgagagtttcgtgatgggtctaaaatgctgagattagtgaacctgcatgagatgtctgactttcatgaggattttcacataggttgctttagttttttttccccttaaatgtacaacatgtttgccgtcaaaagtatttaattacttctgcaaagttgcagtaaattatagtatgcaatacc

SEQ ID NO: 21580 - DNA, 660 bp, Sorghum bicolor
  Clone ID: 13316479
tgatcctgctgctgttgccatgatggaggttggtttactgtatcaacaaagagaaccatcctttatgcgaccaatcacttgtgggattgagcgttgtcttgccagatggcttgctcaacagagactacaattgaacattcaagaaatgctagcattcttttggcaacgtttgatacgggggcgaagctaccgccacttgatgaaagaaattggctacaagtaaagaagcatatgagaagtgctgtttaaccattcagtgattttgatggactaacagtctgacatgatatctgtataagaatgtttcaagggtatattaattttttggcccctcatatttacattgtagtctggaagcttggaatcagtttcaggtagaggtggatggccagttttacattttctgctgctgatgacaaaaagaatcaagcattttcttaactaataagctgggaatgcgaacgttgccatttggactataagtagcaacagaagttgatgttgaaggcactcatagaatttacatgctctcaatgcagctgcacttctacctgtatgtcaatttctggcatggaatgtttagattgccatcccacgtaatcttttctcatgtatgtgagatgattcaccttgtcaatgagaatgtttttcacgtactac

SEQ ID NO: 21581 - DNA, 543 bp, Sorghum bicolor
  Clone ID: 13316494
ctgccggttcgtggcgatcacgaacggctccatcaccgcgtgcgtgttcagcctacgaacaaaacgaaggcacacacgtattacagaacgtcagtgttaatttcagtagcactagcggtagtagcagggtatcgatcagacacaagatggctggtctctgtactatgcgtaccagtggctgatgagctgatgccagcccgagtcattgacgcaggcgtaggctttggcgagctgccagatgtggtgctgcacgcctgtgtgggcaggagtatacaccttgctcaccgcgccatgccgctggccttttgggttgggcaagctgagctcgatggcgatgggcttcagcgtgtcatcgtctttcaggaacagcagcgtcctggtggcgtagatgaagttgccttccagcttgttgatccggtccaggtacggcatgaagtggtcgtggtggtctaggatgaagagcctgttcttcctcagtgcctgcacataatggtttgtgatcagaatgtttcagttatgtatgctgtatgcatgcaaatggtg

SEQ ID NO: 21582 - DNA, 599 bp, Sorghum bicolor
  Clone ID: 13316497
ttaaatttaagagacgaagcttctagagttatggttgccgctcctattctggcttttgtaacaacccacattctgtacctcaacttctacgaacttgacaaaggcctgaacatgaaggtttgtactgtgataagcattgctcagtgtctcctatgggcactgtgggctgtcatgactcggcatccttcaaggctgaagatcatatttgtttccattggaggtgcggttgcagtacttctggaagcttatgacattcctccgcgatggggatatgtagatggccgtgcaatctgccttgctgtggctatacccctgtcgtacctttggtggagctttgccaaggaagatgctgagatgcgaacatcagcaatcctgaagaagacacgataacgagcaaatatgacatcacctgtgtgataattttatctctgcacccagccattgtaaagataaaaagtttcacttgtaatcttaggtaacttagtatgtgaattatcgtcttatttttgttccacgatgtttcctgtctcagttcagaaggccatattgtttaaggggccacttctattctttaatttatacagcaactgaacacttgg

SEQ ID NO: 21583 - DNA, 382 bp, Sorghum bicolor
  Clone ID: 13316519
tagtctgcaaaggcatccaagatttacagcagaaagcttggagaagaacaagcagatttacctgaaaatagaagacctgtccaagaagtaccagtgcagcccagctcagctagctctagcttgggttatgcatcaaggggatgatgtggttcccataccagggacaacaaaatcaaagaacctagatgccaacgttgagtccttgaaggtgaagctcacagctgaggacctggaagaaattgccagccatatacgtgcagaagatgtggctggtggaagacaatacaattcctatgcacatacctcctggaagtatgcagatacaccaaagaagtgaagttgtggaaaacatgtaccgataagaagcatatgcaaatgttga

SEQ ID NO: 21584 - DNA, 616 bp, Sorghum bicolor
  Clone ID: 13316526
aaacaattcatcattaccttcaaatttcaaacagaaagacaaccttgagaagcagcttacgtttactgctcttcatttgcttagttttgtgtcaccaaatgatgatccaagcctgaaagattttcttacaaagaaagcgtcatttctagaagactggctgaaatcattatgtacatcattcaataattctgagcaccagcccttgccaacggaggccataaatgacgaggatggtttcagcccaaacgtgactcagaaagttatgctctcttctgccctgcagtccttggttggcatatactcgggcagaaaccagcaagttattacccagagatttgagcaactagctagaagcatcttgtgaataatgaacagtggacagtcgctctgtggtctccacccccaattaacaagcagcaagatattggtctgtctaccacctcaggatggacaacccatcacgcagtgggatcctaaaattctgccaaatccagaagccgccagtcggcagttgtttcggatcttggccatcgcgggtcgctttcatgcacgaacgcattgaagctccggtttgatcggtgaaatattgcacccagcaaaattgtatttttatgta

SEQ ID NO: 21585 - DNA, 616 bp, Sorghum bicolor
  Clone ID: 13316533
tctctcagtttactcagaaaagctgccacaacatatgatggggcaccaactaatgaagcagaggtacaatgcagtgagttaggctctgctatcatattgctcgtgagcttggcttgtgaatatgacaacagtaagaagctgctgttgtttgtgacatcagatacaggattttttttctgttcatgcctctggcacaaggaatatgggagtttttgttttttgagaagctggatgtcaatagctggatctttcttcaagcatccagcaaaatagggtcattcgggcgacttattcctgttgtgaggtttgtgcaggtacatgcatattcatgtacacagcatagcaattggtatacaagtcagagggaggtaacatatagctgtatgtaaactgtaggtgtaatgtttgtacccagcggcaaaaaatgtgtaaattgctcctgttagtgctgctgctgggcacagatactgaggtctatgtggaggaggttgtgaatggtaactatagaatccaggccagtatgaaagtgttttggatcgatgcgatcaaattttgcttttgtaggccagcaaaaacttttgtgtgtccaatctaaggatttttatggtaactggta

SEQ ID NO: 21586 - DNA, 534 bp, Sorghum bicolor
  Clone ID: 13316534
gcccattggtgtgcggaccgcgcgatgaagaaagggcacagcagcggcaggatctgggtgccgccacccgcggtgacggagaccctgatgagctacttcgaggagaacaaggatgttgatggggccgagcagtatgtggagtctctgaagaaggtgcagaaggatctgggcacgccggtgttcgagccgctgttgcggacgtacgctgctgccgggaagaagttccctgggatgcggcagcggctgaagatcgaaaacgtggaggtcggggaggaaacggaccagctgcttgactctatctgcgccgatcaataggtgtttttttttccttgcccgttatgttcgtctcaataacagcaggattgtttcaggtgctcggctatttgttctgcaagagctgtgtgatgcctgtatgtactctgaaattgagccaacgtttctgttcttttcgccatcaggttctgctggcgcggggatggcattgaactgcacccccataccattccagttgttggatcagtttaggagtgttca

SEQ ID NO: 21587 - DNA, 631 bp, Sorghum bicolor
  Clone ID: 13316535
ttatttgaaatgtcactcatgttcctcattgctttcaaatatatactttgacttttctttcaatctctgcccttgtcacgcattcctacaaaatgggatatttcaaaataacagagaatttgagtgccatcttcccaggtagagtattgagtattgttttcctccaaaatctgtttgtttggagtggcacagccgcacagatctactcttggctctctggcttttctggaaacaatcctttaggatacacccatctttgctaactgatgaactttgctgcagacaacacgtgtggtgttcccaaaatgtcatacaaatgtcctgccaacacttactccagctacacataattctcagacctatggttcacccagatatgttgcgggtagtctaagcaacagaatgtcctcagatgttgagactctgaggtctgtctcatgattttagcagtgtttcctttcgttgcagtttaggagattttaggcagatccaaaaaatatgacgagcctacagaatgatatggtgtatgcagggtttagatccatctgatcgaatgggtatggaagaattatcttctcaaatttattctcaccaccgtgttgtcctttaattgatgttggtgattgacctt

SEQ ID NO: 21588 - DNA, 549 bp, Sorghum bicolor
  Clone ID: 13316567
ctgctactcataatgtgtatgtctcaccacttcgatcgtcaaagatggatactttgctctccccaagctcaaagagctactacgcatgtgtcggcgagagtacctatgcgtttcaaagcccctccaaggacctgaaggctatcaataaccgcctaaatagtgtgtccagtgggaagaaagttaacggacgactgaactttgatgttgtcagtgatctggttgtcgccagtagcctcagcagcgatcaaaatgccaagccggcagccacggaagtggttcccatcaagacaccggtgaaatgcgagccatctgactcgtgattgactgtcacgctgcatcgccaatccagtacaacctattataaattgttaggtttcagatgctctgatctagatattagatggcccttatttttgtttgtgttttttacatgggaaacatctctgtgagcagctctaccttctgtaaaatataagaaagctgccctgagagctcccttaacccaactcgctttgtaagagagaatataagtaccatagccatgtaact

SEQ ID NO: 21589 - DNA, 618 bp, Sorghum bicolor
  Clone ID: 13316576
cccggctctccaaaaaccccgcgaccagaatggcaacagcaaccccatgctacaattcaaccccagcccccaccaccaccccgctcgcctccaatccaaccggcaccgccaacatcacaaccagcgccccaactcatctaagcacatccttccccgaccccaccgaccgcagcgtcattgcaccctccccaatcaccggcctcggccccgacgcagcagacatgaacgccgccgtcagcgcagcagacgtgtacttcaacggtgtcggcagccagcaaatggcagccatggatctaggcggacgcagcggcgacgacggcgacggtgtcgcaggcggcggtggcgcattggggtcgcagtatgtggtgaatcagaatcagcagtctgtttatcagccgcagttggcgggtggtgcggcgacgggggagttgttgttgttgtagattgccccggcctggcggctttgcatttgcatgaatttgtttcttcttggtgcttttgacattaacaagtatgagtgttttgtaatgtgttggatagtttggagattgcgtttgttatttgttgtgatacctcgacgtactagtatactatactacctatgtacgtataaataat

SEQ ID NO: 21590 - DNA, 334 bp, Sorghum bicolor
  Clone ID: 13316588
gcacgagggcaaggtgaggattcttctctgcgacggtgatgccaccagctccagggaggtgctgcggctcctctgcaactgctcgtaccatgtaacttgcgccaagtctccgcggcaggtgatcaatattctcaactatgagggtggcgagatcgacatcatcctggctgaggttgatctgccggtctccaagtgcttcaagatgctcaagtacattgccaggaacaaggacctgcgccacatcccaatcatcatgatgtccaacagagatgaggtgtctgttgttgtcaagtgcttgcggcttggtgcggctgagtacctggtgaagccgctg

SEQ ID NO: 21591 - DNA, 179 bp, Sorghum bicolor
  Clone ID: 13316589
ccctccccctcttcgaacgaactcctcgttcgaacgaactcgggtccgattcggcaggtgcgtgcggatttctcgtccctcccggtgcatacggtctgtatttgatccgggccgcctgggttggctaccggtgttgatttggcgcggcaaccgcggggggaggaaggggtttctgatta

SEQ ID NO: 21592 - DNA, 449 bp, Sorghum bicolor
  Clone ID: 13316602
gcacgaggaccagacggagctgaaaaacaaccaacccaccccgactcccgagaccccagtgatgagaaactaaaaaagcccaaatggcggggggaggtcgtcgtctcccctcccagcgatcccctccctccgcgacgccatctccgccacttcatgatcactagggtttcgctcttctacccataagccctcgtcccgatgcgctggtggaagcgctcctcctccccttcccgctccgcctcctcatcctcagcatccacgcccgcttcccccgcccgcgccgccaccccccgtctcatcggcggttggggcagcggcgctagctcccgccgcgatggaagcgggggcagcagcgaaccgcagccgcggctgagcagagcgcggcggatgcgcttcgttgtcgaggaccccgaggttggggtctccgcgctcggcgtggactctccggc

SEQ ID NO: 21593 - DNA, 509 bp, Sorghum bicolor
  Clone ID: 13316607
gcacgaggatcgagcatgaccatgacactcaagcagaagattggcatatcgcaattgaagcactttgtgaggtactgccatctttacaaccagccattgtttactttccagacagttcccagtggctgtctaaggcagttccaagatcaaatcgcagagaatttgttgaaaaggttgagaaaatgtttgaccagcttactggatctttagtattgatatgtgggcagaacatagtggaggcatcaacagcagcacctaaggataaagaacctaagacactgctgttccataatctatctcgcctgtctccactgtcatcgtccttgaaacagctggtagggagccttaaaggacggaagccttcaaggtccagtgatataacaaagcttttcaaaaacagaatctttattcctcttccaaaggatgatgagcaactgagagttttcaataaccagatcgagaaggacagaaaaataatcatttcaagacataaccttgtagagttgcac

SEQ ID NO: 21594 - DNA, 543 bp, Sorghum bicolor
  Clone ID: 13316608
cacggcggccccgtccccgcggccggccggttcgtggcctcccatttctcggcgaggccgtcgccctccagcatccggaccacctcggacatcttgggccggtgcgacggctggaactgcgtgcagaggagcgccacttgcaccacctcggccacctcgatcctgtcgtagtgcgggcccaggtcgtggtccaccagcaggtcaagcatcttctcttggtgcaccttcctcaccttttgtttgggcaatcatcaaataaaagagttaagcaaatactttacgggtaagaaagaatgtactttatcagcaatcttcagttgtacagcagcatctggaatccatgttttgatgcacaattaattacaggaatagtggcagctggaaggttaatggtgatcgatcagcattcagggcgtatcagatgtagcagctgatcaggacctctgagtacgcatggtttattgctagtgtgtcaagcttggtacttgccatttcttcctagtacatgctacagcagaggagggtacatacacgcagggcagg

SEQ ID NO: 21595 - DNA, 515 bp, Sorghum bicolor
  Clone ID: 13316613
gcacgaggcttgttggtcgcatctgtcaactgtacccaaatgcatcaccgagcatgttgatatctcgttttttccgagtctacagcaaatggaagtggcctaatcctgttatgctttgccatattgaggagggttatcttggtctccctgtgtgggatccaagaagaaattacagagacaggggccaccaaatgcctattattacacctgcttacccatgcatgaattccagctacaatgtatctgttagtactaggtatgtgatgacccaagaattcacgcgagcgtttgagatttgtcaggccatagatgaaggaaaagcagactgggatgcattgtttgagccatatccattttttgaatcatataaaaactatctagaagttaatatcacagcaagaaatgaagatgaactcaggagttggaaaggctgggtggaatctcgccttcgcactcttgtattaaagattgagcgatattcacatgagatgattcttgcacacccttatcccaaa

SEQ ID NO: 21596 - DNA, 537 bp, Sorghum bicolor
  Clone ID: 13316619
gcacgagggccagctccagcaaagaaaaggggttgcttggtggtctcctgggaggtgatgactccagccctacgcccacggccaagggatccgactctactgtcgcctctccttctgcctcgagcaccagcgaggggttggttggcggtcttgttggcggtctgctcggagatgataagccgaccccgtcatccagtggatccgcctctccctctcctactagcaaggatctggtcggcggccttgttggtggcctccttggaggtgattcaacttctagcaagcccctctttcgccccagtggatcgggttcttcgttcagagtcggctcgcctactcccactcccagcgaaggtcttcttggcggtcttctgggtggcttgttgggtgaaccttcttcgtctggtctgcaatccatctccgtcaatgtgcctacatcgacacctgcctccgctacttcatcggagggtcttttgggtggactgttgggctcccttctgggccccgagtcttctaccagcggctccccaagcgcac

SEQ ID NO: 21597 - DNA, 377 bp, Sorghum bicolor
  Clone ID: 13316639
gcacgaggcaataagcaggtaacaaagattctgccctggcaagagttcatttcgtggcggaacaacgcacggcggcagcaggcagcaggcagcaggcagctaagactcctttcccttagcgccggcgagccgccgtgccgccccacccttcgaaccatagctcggcgccatcaccttcccgcgtagccactcacacgccatgtgcttgagcgcgcgtactctatgatcccgggcgctcaactacctccgctccgagcagcccgggcgatctcggcccggctctgcccgtcgcggcgtctctgcagcgacggttccagaaacggcggtgagagttttacagacactgtaaagtgcaatggtgacggagtccgtgaggg

SEQ ID NO: 21598 - DNA, 498 bp, Sorghum bicolor
  Clone ID: 13316649
gcacgaggcccgagctcccactcgtcgcggagcccccgaccgagctcgtcgcgggcgatggcttcggcggtggcggcttcgaccgccacgcggtttctcccgcggcgaacggacccgtggtggccgccgcgtcgtgcgcgcgcggcgctcccgccgctcacgtggcggcctccagcggtcacggtggtcgccgcgtcgttccgccctggggaagcggaaggtgggaggcgcgggaggacgcggaggcgccgcgccaggagggcggaacaggaggaaggcgtctcgctaagctctgaaaaggagacggtaaattctactccacgtgctcaaaccaacaagggtgtggagcccgtaccggtgtccagcacgaacaggaaaggtgccattagaagggtgacactggtggttctcgctgcggtggtttttggagttagcattgccttgagggatggggctgagaaggcatcagagtattttgcggggtatttgttggaacag

SEQ ID NO: 21599 - DNA, 494 bp, Sorghum bicolor
  Clone ID: 13316665
gcaaaaggcagtggagcacacccacgaccacgaatgatggccgggtaccgccgcgccatctcgttcccggccccgaagcccgcggccgacggcgccttcgcgctggcgaccgcgagcgacaagctggccgcgtaccgcatccggtcgtccagcctcccctgccgcttccacccgctgctgctgcagctggacgacgacgtggccgcgctgcgcctcgtgatcggccagtcgtcatcccccccgccctgcggcacgcccacggcgtcgtccgtgtccgcggcggcgtcgcaggtgtgccgtgtcctcgtctcgctctcggacctgctgcaccacccgcaggcgcaggagccgctgcgccgcctgggccgctcgtcgcgcctcgcggagcgcctcctcgacgacttcctccgcctcgccgacgcgcacggcagcttccgccaggcgctcgtcgcgctcgccgggctccaggccgagacgcgcgccgcgctgcgccg

SEQ ID NO: 21600 - DNA, 546 bp, Sorghum bicolor
  Clone ID: 13316666
gcacgaggcgcaagggcacaatcgtccacctcaacgagttcatatgcgacaccatccgagataaaaggatcatcattattgtgaaaattgaaattctacaaactgcatgtgccctaatcgggaaccccaaaaactacatggcacaaattcaagggaaggtacaagatcccaacttatcggccattgctgctcaaaattctggtgccccaggcatgccggagtcttctgttgctctaagagcagatcaagcttctaacaatctttcatatggtggaccctttattgatgctcaaggcatggtaggtttttccattggccggacagtagaacgtgatcatagcaacgtgtttactggaggctcttatggtacattgtcagcacaaaacacagtaaatgcaaatatggtggagccaagatttcagcagccttctctgatctctcatcaaaaccaagggtttgcagttactggcacaggtgaggccttgacccctccaggcaatgctcaccggcgccatgagcattcatatcagcagctaccttcagggt

SEQ ID NO: 21601 - DNA, 323 bp, Sorghum bicolor
  Clone ID: 13316673
gcacgaggcgagaccgtgctcgagttcctcaccgccgcgcgggaccgcaacgccgcctcgctcgtctgccgttcctggtaccgcgcagaggcgcagacgcgccgcgagctcttcatcggcaactgctacgccgtctcgccgcgacgcgccgtcgagcgcttcggcggcctgcgcgccgtcgtgctcaagggcaagccccgcttcgcggacttcagcctcgtgccatacggctggggcgcctacgtctccccctgggtggcagcgctcgggcccgcgtacccgcgcctcgagcgcatctgcctcaagcggatgaccgtttccga

SEQ ID NO: 21602 - DNA, 428 bp, Sorghum bicolor
  Clone ID: 13316676
ctcgctcctcttcgagatccgcgcggagggccaccgcgaccactccggtcggttccggcgaggtgccgcgcggctgtagcagcacaaagcagacaaaggtgcgatttttttgggggttcttggtccagcagtagttggtggagataaatcgcgtgaaggtcggtgctctggtacatgttcgccaggcactaatggcatttggccgaggtgggaagatggacggccgccggccgtcctcgacgtcgtcgtcgttctgcacgaccaccacggtcgtcgtctttgtggcgctctgcctggtcggcgcgtggatgatgacctcgtccactgtcttcccgctggagatctcctcgaataagaagccggtggtgaagcagcagcctgcgcctgtcaattttggggcctcacaggacaatgctggtgaaggttct

SEQ ID NO: 21603 - DNA, 547 bp, Sorghum bicolor
  Clone ID: 13316677
gcacgaggctcctcccccatcctcttctcgtaaacactcctccaaacactaccttaccttacctcaccctttgcttctccatatacatcaccccaccgcattgctttcgcggcagtcttacttgttcagcattctgttgttcgctccgccgggagcatagcatactgcattcgctgctaacccacttccccacctacttctctcgttgacatcacatcgctactcgaccctcttcctaccacccgaaagtgccaacgcgcaccgctgcaccatctaatcccgagcacatcagaccggaaacggcccagctgccaacatggtcatcatcgacaagcacgaggttaagagcgccgaggaggccaggctgaaggaggataccaaccggaccaagtactggaagaagtatggtccttacgttgccgagaggcagtgggctactgtccgtgaggattactccgacgatggcgacgcctggagccacttcacctacgacatggcccgctcaagggctttccgctggggtgaggacggcattgctggtgtctct

SEQ ID NO: 21604 - DNA, 492 bp, Sorghum bicolor
  Clone ID: 13316687
gcacgagggccaagagcatccttttttgagaggcagcatgagagtattgatgcacttataaactgtgttagtgataatattggctttagtgaaggaaagccagttgctgcaataaccatatataagtgtcttgttcattggaagatatttgaaacagagaaaacaagtgtttttgatcggcttattcaaatttttggttccgccatgcagaaacacgacagcaatgaggatcttgcatactggctatcaaattcatcaactttattgatcatgcttcaaaagagcctaaaagctgctggctcaacaggaactagtccacagaaaaggccacagactcaatcatcattccttgggaggatggtattccgctcttcaaacatcacggttgatatggaccttgtacgccaaatcgaggcgaagtatcctgcttttctttttaagcagcaacttacagcatttgtggaaggcttatatggtatgatacgagacaat

SEQ ID NO: 21605 - DNA, 554 bp, Sorghum bicolor
  Clone ID: 13316694
gcacgaggatgcactggagacgttcaactatgaggcacgccgcacactgcttgcttcctccattttgtaatatttccctgcttgcttcctccattttgtgtgggggtgaaaccaggaatgtttgaagcccatccacttctactggttctgatctttagatttgaagattcaatcagaatcttttttctgttacacgtgagcggcggctgccaaggatccgattcagaacaagtcgtataggtgtgttcatctattttttattttctacttttttcctttacctttttattttatttcttattttcgtttttcatctatttttattcagaacaagtccacttctatgtgttttttagtattatttttattttttattcttctttcacataacttatatgcacacaaatatatcaaaaaacggtgattatggttaaaatttcaccatattcgcatccacagagtaaaatcctacgcactcacaaggcaagtgcaccctccctctagctccgccactgtatgcacaagttgtatagaataatttatgtatacaaatt

SEQ ID NO: 21606 - DNA, 465 bp, Sorghum bicolor
  Clone ID: 13316698
gcacgagggcctgcctgcctgcctttgacgcgcacccaccagccaccaccagcacgggaggagaccgatcgactcggcccggccgacgcctcagcttcagcttcagctctgcctctgcttgcgttgcgttgcgttgcgttgcgtgtggagtggccgcccgcaagataggtaggagacgtgtgtgtatatgagatccccatccaacggccggcctccaagcgcagggggcggagcaccaccagcagcagcagcagacgacgacgacttcgccttctactgctcgttcctccaggacgccgccccggcctcagcgacgtcgccgctcgccctcgccctcgacctcgacctagacgaccccaaccccaccgccgccgggatgaccaacggccggcgccggaggcagcgcggggcagcagacgaatccggagccgccgctggggaagaggtggaggcggaggtcaagaa

SEQ ID NO: 21607 - DNA, 273 bp, Sorghum bicolor
  Clone ID: 13316713
gcacgaggctcaaaactttcttccattttctgtcaaaaaccaaaacgaaatttataattcaagggacgctaaccctgactccgtttgacgcggctccgatggtcaccgccggcaccctcgccgccgctgccgtcgccgccgcagtcaactcctgagacctcgtcgtgcctaggcagcagggcgtgagcttgccgctgccgcgatccgggtaccagcccccgcggatgcagtaccagcatgccggcagccgcagcggcatgccgccgttcgcac

SEQ ID NO: 21608 - DNA, 615 bp, Sorghum bicolor
  Clone ID: 13316724
gcacgaggctacgtgatgctgctgttaatcagaaactaaaccctcttaggattattgttcaattgaagggcagcaatgttggggcagctcggacaaaacagcacaccacagattccatatctcctaggtcaacatctctcgaagatcaactagctcaggtgaaatcagctattgatgaagctttaaagttcgtgccagagcaaattcctgctgtcattgcaaaactatctcacgacttgcgctctagagctgcattatctgcaccatcattggctgaattgttggaccgttttgctaaactgatggcacgaagcagcagcatgcagccttctggtggctctggagttagttcacaaaacttgggaaattcaaaggcgaagcttgaatctgcacctatgacaatttcagctcctgagccctcagacatgcaaaattctgggacacttgaaaatggtcttaagagtgtactattggagaatcccactgctaaaattgatcaggtgtcattatgtccttcagttgaggattcactggtttttactagcttaggtggaatgaaatctgaactcaagcggagcgctgataatgaaataaagacaaaatctaatgcttaca

SEQ ID NO: 21609 - DNA, 500 bp, Sorghum bicolor
  unsure (1)..(500): unsure at all n locations
  Clone ID: 13316730
gcacgaggctgaattgtgaaaatggggaagtgacatgttatccaatagatggcatccatagatatccccagaaagctttcacgttggaagttacaaacatgagtgagtgtgaatccgcttgcttaagagactgtacctgtactgcctttgcttacaatgcaagttgcttactatggtttcgggagctgcggagtacaatagtacttgattctgatctaaatggcaaccgtttgtacatatgtagatcaaccaaacaacagtcaggttctagaattgttccttggaatggttcttcgaaagaaagaattgttccttggaaaagattggttcttgaatcgatgatcggagtgatagccgtcattgttatgagtctgattcttttgttgagatgcagacaaaagcttttgaaggctanaacagtgggtggcagtggaagtcttatggtattctcttttgtacaaataaagaactcaagcaaacaattctctgaaaaacttgga

SEQ ID NO: 21610 - DNA, 358 bp, Sorghum bicolor
  unsure (1)..(358): unsure at all n locations
  Clone ID: 13316740
gcacgaggggccgcgctgctccgcttcgcgcacctcacgcagccgccgctcgagaccttccgcgtcttctccggcctccgccgcgcgcacggccgcgacctcccgttcctcccgttcgccttctccccgctggcaaagtctgccgcggccgcgcgctcgctgcccgccgcggccggcgcgcacgcggtgtcgctcctgctcggagggttcgataagcaccggtttgttgagaactcgctgatcggtgcctatgttgcgtgcggcgacgttggtgccgcgcgtaaggtgcttgatgaaatggtggtgaaggatgtcatttcgtggacgagtattgtggcggcgtattctanaagccgtg

SEQ ID NO: 21611 - DNA, 609 bp, Sorghum bicolor
  Clone ID: 13316756
gcacgaggcttaccctaaaaacgtctttaaaagttgattttccttcatgtacgaacagtgcaccaacatagaaacaaagagcatatgtgagatacatcattaagtttgagaaactgaaaccaaggcctccaaccattccacttctaatgccctgtttcattgaagcttggcatttttcaatgtatgatgtaattaccctcttctctgcacagaaagatgctacagttcgaatgctactaattgcctcagttacgacttgacttgcatcttcatacatcacctgttccaattagttgttaggtgaaacttttgataggacattaaatcttacttaattcttgttaatttaaacttcaaaatatatctagaattattaatattatatgaaaaactgtatgctgtctaaaaatattgcacatattcatctattttgaaaagtatcaggtatgctttgctttttaaaacataaagatgattaactgccatgaaattcaatattttcaccttagcatcttcactgaaccctttcaagaatttcacttgaatataattttgtgagcccattacaggaatcacacatatgacgatcagcgtgagcttccagtcaga

SEQ ID NO: 21612 - DNA, 287 bp, Sorghum bicolor
  Clone ID: 13316765
gcacgagggtctgtcctacccatctttagccgtgcgcatgcaagaagagaagtagccgatcgatcagcaacagcactcggctggtccgtaacgaaccaccgccagtcccttcttctaatctcgctctgcggcggccgttggttgcggctgccagtgccaggagaggcgaacccacggcctcgctgttcggagcgcctttttgctttgtttggcgcctctgcttggtcttgatggtgtataaatacttctccctcttggacggtctcctctgtgcctgcgcattcggg

SEQ ID NO: 21613 - DNA, 236 bp, Sorghum bicolor
  Clone ID: 13316771
cccgccggatggggaggaagaatttactgatgatgatggcaccatttacaaatgggaccgtactttgagggcatgggttcctcaaaatgatgcatctggtagcaaggaaaattatgctgttgaagagatgacttttgcacttgatgaagaagtatttcaagctccagatatcctgggtccttctgcactagaagaaatcagcactctatctgaaagctaaaacaagggatcagatc

SEQ ID NO: 21614 - DNA, 422 bp, Sorghum bicolor
  Clone ID: 13316799
gcacgagggtagtatatgggatcgaggcaaaaacacgggctgtgctgtctcgtcgccttcctcgcctcctgccgccgccagccgccgcacgcacgcccgcccgcccgcctctccacttgtccgtatccatccactcaccagtcactccccgtcacctagctcactccatcaccaattcaccaccctaaaccctaaaccccattccgtacctcaccgccgccgccgccgccgcgatgcagtccatggcgctcacctccccctccctcccggcggcgggccccgtcaccggccgccgcctccagcgcgtccgcgccaccgcggtctccgacgagcccaagctcaacaagtacagcgcgcgcatcacggagcccaagtcgcagggcgcctcacaggcggtgctgtacggggtcggcctcaccgac

SEQ ID NO: 21615 - DNA, 142 bp, Sorghum bicolor
  Clone ID: 13316808
gggggacttcgcgccggctgcactggcacaagataactgcagctatgtccactacaacactgatcccgagccatggctttacccatatactatgaatgttgtggatggggcattcccagactgctccaacgggccgctgaaa

SEQ ID NO: 21616 - DNA, 494 bp, Sorghum bicolor
  Clone ID: 13316812
gggaaaaacaaagaaaagaaaaagaaaagaaaaggagaatcgaaaaggcaaaaggcgagccgcctcgacccgcgatccctgcgcaccggccgccggcgatcgccgccgccgcggatgcgatgcgctccccctccggcggcggcagcgtggtggcccgcgcacgttcgtgacgggccttccgccacgcgccccggttcctgtggctccgagtccgagcttgctccccgcgcccgcgccgtcgctgcgtggcggagcggattcaccaacatgtggcttttctggcgcactaggaaccgcttctcccttgaggagctccggtatttaacagaccagctacaaaaggttcatgttgtcaatgaagctaacaaggatttcgtgattgaagcattgagatcaattgcagaacttatgatatatggtgaccagcatgatccttcgttttttgaatattttatggagaaacagatcatgggtgaattcgctcgtgtcctaag

SEQ ID NO: 21617 - DNA, 542 bp, Sorghum bicolor
  Clone ID: 13316813
gttgaggatccagactccagtgagcaattagcacatggccatgaatccaacagtgctgccaataatgaagtggaagaatggcagatggatccgacctcaacaaaggaatctagtccctgcttgactagtaacagggacatgggccctggaggtcctcaggataactcatcaataacatcaaatggagaaaactctaatcaagagcatgatctgccactcggacaggactcactagattctcctatttcgactgcctcaactatgtcccctccagctgctttgaaggattcaaggactaacgaggaagaacctggcccatctactggtagaactgttgaagagcaaatcactgggtgcttgaatcaagaaaccaagacaatacctgtggccacagaaggtgaacaactgcccaatgagaaacctttccgttgttcttgcaaggagaacatttccagagagtctcatcaaagtgctgttgccagaccaatgctgaattttactggaaagcaggttccgcagttgcacattggttcgagggcatc

SEQ ID NO: 21618 - DNA, 564 bp, Sorghum bicolor
  unsure (1)..(564): unsure at all n locations
  Clone ID: 13316814
gcacgagggatgaattctacattgggttaaagcaaagaagagcaactggccaggaatactctgagcttctggatgagtttatggctgcagttaggcagaactatggacaaaaagttcttgtccagtttgaggacttcgcaaaccacaatgcatttacacttcttgagaagtacaggacaaaccatcttgtatttaatgatgatatccagggcacagctgctgtagtacttgcagggcttattgctgctctgaagtctgttggtgggactctagctgatcatacattcttgttctttggtgcaggagaggctggtacgggcattgctgaactagttgctctggagatatccagacaggcaaaggtttctgtagaagaggctcgcaaaaagatctggctggttgattcaaagggactgattgtgacctcacgtaaagagacactccagccgtttaagaagcgatatgcacatgagcatgaacctgtcaaagatctcttgggtgctgttaaggctatcanaccgactgcactaataggatcagctggtgtgggtcaaagtttcacga

SEQ ID NO: 21619 - DNA, 556 bp, Sorghum bicolor
  Clone ID: 13316817
gcacgaggcacacactcccattccagccatgtggcctactccccgcccgctcgtgctcaccattccgcttccgctcccctgattcgtctgctctcccccaaaccccacagaaccctaccgtccccgccgcgccgccatggccgccggcggccggccgtggcgcgtgatcccgcggcctgtcctcgagaccgtcctccacaaccacgcgcttcgcccgcgcgtgccacagccgctcctcttccacggaccccgcggcgtcggcaagtccacgctactcttccaccgcctcctcccgcggtggtccgacccgccccacgccaccgcattcgtcgacttcctccaccccacgccgagttctcccgccgccgccccgtggtccctacttcccgccgacccagcgtctcccccctcgctgcacgacctccgcctccgcctcgagaccgcgcttgagggcctcgcccgcgccgctgtcctctgcggcgctgtgggctctaaggacgtgctcgccgcgctctcccgcaaccacggtctcagcaccgcgctctcccgcctctca

SEQ ID NO: 21620 - DNA, 550 bp, Sorghum bicolor
  Clone ID: 13316818
ctgcaatcctgctgatgacggtgtcatgccttttcctcatgagcactgtgtcttgcctacttaagggacggtctctgagtcaagttgatcaacattcagagtcatatttggatcaacgctgccaccttgatgaggttcttgttcttgctgggatgtttctctatgtcatcagtcttggttcaagttcttttgtggaagaagagcagtatacatggcactttctcacttctactctgtatttaatatttctgaccaaggcaatccattcaatgctaaaaggatcaaatccaacacttggtcataaagcagaagagagctttgacaaaagtaacttttcctatgctacaagctttgaattaaccccgggcaagagaaatgtttacaagttatgtactatccttattgttcttgttgctgggagagttataagagcttggcatcaaggtgggatcaactgggttcactttcctgatatttcaaagttactggcgcaagctgactcttctgttgtgaagtctctgcagattatctcatttcttgcagttgtggt

SEQ ID NO: 21621 - DNA, 310 bp, Sorghum bicolor
  Clone ID: 13316824
cttcgctgcgccgtgtcgcttatacctctactaccgttcgccctgttcgcgcttcattcggtgctatccaaaccatctcccccttcgcctaccgcacaatggcttcctctacccaaaagatcaaggtcaagaaccccgtcgtcgagctcgacggtgatgagatgacccgcatcatctggcaggtcatcaaggacaagttcatccacccctacctcgacatcgacctgaagtactatgatctcggtcttgagtaccgtgatgagaccaacgatcaggtcaccattgatgccgccgaggccatcaagaagta

SEQ ID NO: 21622 - DNA, 537 bp, Sorghum bicolor
  Clone ID: 13316836
cttccctgcgtcccggagagagaaaagtctcctcctcctcccctctccgcctcgccccctctcaaacatcccccgcgccgatggatctccgcctcgcccactaggccgccagcgcgaccgcgtgtgggtagggggatggggttcctcgggcggaggccgtggctgctgttcctcgccctcgccctcgcttccgcggccgtcgccgtcgccgtggaagcctccgagggagacgctgatccgctctacagagcttgtgtggaaggatgccaaaagacaggctccctgaaggagacttctattaaacactgtttggtgccaaccgatggccaacctgctgacaaatcatggtacacgcacgagccactgtacttgcaatggaaggactggaactgcaagagtgaatgcagataccactgtatgatggaaagggagagtgaaagggcaaagcttggccttcagcctgttaagtatcatggaaagtggcctctgaagcgtgcctctgtgtttcaggaacctttatctgcatctctgtctgct

SEQ ID NO: 21623 - DNA, 515 bp, Sorghum bicolor
  Clone ID: 13316855
gcacgaggcaagagtcatcatatcctttccatgagaaaataccaactgattcctcggtagaagtagagggtacagcagatactactgcaacaggtcaagtttcaaaagcaaggtcttcaaaaattctcgagcattcacctgatgatgaattagaaggagagatggtatacttacaatctaggctgcttgacaatgctgttgttctaaagcacagatatgaaaaattgatagcaaaggttgtccaaaatctttctcgcgagctgaatgccttcagtaaaagaaaatgggatcttatttttgtgaatcagtttcttcatgatgttagagaagctaacaaacgtgggagaaaagaaaagagacataaggaagcccaagctgtactagctgcagctgcagctgctattgcatcctcctcacggaactcaactgtgagaaaagatgcaaaggaggatgcaccagagagttctccaaaacttgttgctggatcttcaagggttgggcaacggacttcttca

SEQ ID NO: 21624 - DNA, 131 bp, Sorghum bicolor
  Clone ID: 13316884
gcacgaggcgcaatcgcaaggataactcactttttcgtggtacaaccaagctgacgcgtggtcaccatatgcgacaccgacacgtcgccgccgccatgatgaacgtcgtggccatcgggctcgtcctctcc

SEQ ID NO: 21625 - DNA, 591 bp, Sorghum bicolor
  Clone ID: 13316892
gcacgagggggagatgaatcgttccatctttagctcaccaccaaacccaccgggtcaatccactgaggaaataaggtctactagcaacctgcaaaaaatcaagttgtagtgcagcagaggccaagttttgttaaagataataaacaggtaatgatttcttgtagtaagctgtgaatggcagaagcagccaatgcaaggggcatatgcgtccatggcagtgacctctgcaagctgcattgcgtcgcttctcatctgaatgatgatgatggtggtggtggaggaccgctgtgtgatgtggtgtgtgggattccgccgggttttgctgttgtctgctgctgccggatgctgaaggtgaagccatgcacctgcacctttctgccagcaaaagaaaacttgctgtatcctgttctactgctgcaatgagaaccttgcacgcctccaatgctgcaagtggtgggttgatttcagcagatatatacacaatacgatacgtactcctacttgtgtgagcttgttctggagctttcgccgggtgtttctttctcgcctgtcaatcatcatgtgctgcatgcttgcagcaattacaggggg

SEQ ID NO: 21626 - DNA, 349 bp, Sorghum bicolor
  Clone ID: 13316908
gcacgaggccttcctctcctgcggctctgggcagcgagcagtggtggccgcgggatcccccgcctcctcctcccggatccggcgacgaaggtgcgtgcccttcgccaaatctggccccgtgccttggcccgctcccgacacccattcccctttgccgccattcgggcgatccggtagaaatttgtcccgaatttctaggcccggagttcggcagttcggggtctactaaactaggacggcctgcttgatgtggcagctcagtgcgcgtgttctcgccgttgtgggtcgggctaattggggcacgatcttcgcctgaattttgctgctcgaggtctacggaatgtgtcgg

SEQ ID NO: 21627 - DNA, 583 bp, Sorghum bicolor
  Clone ID: 13316915
gcacgaggcccagctgctgcggcagcgacggcggcggcgacggtgaggtcgccaccaagcgtgccaagctctcctctgacgcctccgccggcgccggtagcgaggaccgcctcagcgcgcttcccgacgacatcctggtactcatcgtccgctatctcggcacccgcgccgccacgcggaccagcgtcctctcccaccgctggcgccgcgtctgggccctcctcccggcgctccacttcggctacgctgaagatccccgccagatcggccccgccctcgaggctcacgaggcagccctcttggtcctctccgtcttgacccgagatgcggaccccgactccgtgtcggcctggctccccgtcgccgcgcgccgcctctccggcagcctcttatttcataatactgagccggagaggaacgttcaggaaggcgatgacgaggaggccgcgcagaggggcgcctttgagctcccctgcctggagcgcgccacggaggtcttgcttcacctagatttcctcggcctcgccgtgccgcctgccggcgtcttcgctcggctcaccgagctgtggctggatcgcgttcg

SEQ ID NO: 21628 - DNA, 588 bp, Sorghum bicolor
  Clone ID: 13316941
aaccagaggcagaggactggtgctgaagaactgggcgccacagacacaggtgctgcggcacgaggccgtgggagccttcgtcactcactgcgggtggaactcggtgctggaggctgtcatgtccggcgtgccgatgatctgctggccgctgtacgcggagcagagcctgaacaaggtgcacgtggtggaggacatgaagcttggggtggtgatggaaggctatgaggaggagccggtgacggccgacgaggtggaggccaaggtccggctggtgatggagtcggaggaagggaagaagctcagagagaggacggcgatggccaaggaaatggctgccgatgccatgaaagaaagcgggtcgtctcacgtcgaacttggtgagtttctaaggggtttaggatccaagtgatggatctatgtatacttatttcatccgttctaaattatatgatgttttgagttttttatatatattatttttattatgtatttagatatagtatgtagaaacgtatcaaaagtaatgtatctagaaaaacaggaaaaaaaaggtcttatagtttaggcattaaagtaattactagtaat

SEQ ID NO: 21629 - DNA, 370 bp, Sorghum bicolor
  Clone ID: 13316948
cccgtcctcaaatgcgagccatattccgctgcataggggacaaactaattccccttctcagtcacgcttaccgtttaatgaccaatttatattggacgcccaggaattggagacggacatgttgcaatggccctttattgatgaaacttggtcatctgggtttgatacggggtttgacgctgcgtggcctagttttggctaacacaagtacaaggaccgcataataatgtggtttaaaacatgaggacaactaactaatgttctttatgacttgaaattacatacaattgccgagcccgctcgagtacagaattatgagaactcacacactcatttgacaatcatggaccttcaatagcataggaatatt

SEQ ID NO: 21630 - DNA, 332 bp, Sorghum bicolor
  Clone ID: 13316969
agtggcgaggactgctgtaactccaaccggccatctcgaggaacaaaagaatcgatggcagcagcagctcatcagttgagagaatgccggaatctttgcaccctttcagcctttctttacgctgctgctgtgcagccttgactcctgctgcagcgacgcagcgtacactccgtagaacgaacatccctgtagctgtacgccttctttttgcagctttggctaatggtggatatctttgtttagtaccccagtccatgtaaatagtactcctattactatcactgatagcgtgctagtgctactattatatacgcatcagtatagattaatta

SEQ ID NO: 21631 - DNA, 634 bp, Sorghum bicolor
  Clone ID: 13316973
tactttcgcggttatcacactagtatgtatacttcagattcagaacacaagtgaattttattgccatgtattggtttctcgttaacagcaaacatctgaaacctgtacttaggtgggcaactactaactctagatgaggtaaaagagggacttccttctcactcacaaaaagtattaagtgaatcgaagtggacgtttattactcaagaggagcacccccatctaagcaagccatggttgaccctgcacccttgtgcaaccagtgattggatgaagctactcctcgaagaaactaaagcgacagataaggagcgctcgctgcaatatttaccggcatggttatctgtggttggccaggcagtaggactgaaaatccctcttgagcttcattccaactcatagtttcttcagccttttatccgtcattggccaggcagtgggattgaaaagccttaatgaagcttcattgcaacttaactttctccacccttttcactttcagtatgtatggcgattgaaagagagtcctcaacctgtgtttggtgataataggtcaccaatatttctgacactggctagacctgccattgtgtaattgttatgctttcattcaatttactagcgtttttttctg

SEQ ID NO: 21632 - DNA, 173 bp, Sorghum bicolor
  Clone ID: 13316981
aagttcaagcatggtcacgacggccacggcaagttcaagcacggtcacggcaagttcaagcatggcaagcacgggcacggcatgttcggcggcaagttcaataagtggaagtgatgcgctctccatggttgatcatatctgaacttgtatgcaagcttccagcacatctgttg

SEQ ID NO: 21633 - DNA, 488 bp, Sorghum bicolor
  Clone ID: 13316984
caggataacgcgcgccgggcaccgtgtggccgacggccgcgcgccgatcggcgtcccctggaccacacgggcggtcaggcgcgcgcgcggccgggtcggggtgcgtgggtgcagaaacgcgcggcggcgtcgtcgtcgagaaacgacgctggatcggatcaccaccgccgtatctggtggatgtgcagtttgtgtggacgcgatgctgctgcggcgagggagccgtttggaccgttgtgcgcggtggcacgagagatggagacttggaagaagaacgcaggcagaagaaaacgagggagctttgctgtcagttgtttgcttgccggagtgccgagacaagagcggcggaatcaagctagtgactgttgttcttggctatgagagagacgggctagcttgaattactctactgcgcgtgaattgatggtaagaaaatgaagaagcacgaatgtacatttctggctgataagtcacgagagaaggtacta

SEQ ID NO: 21634 - DNA, 129 bp, Sorghum bicolor
  Clone ID: 13316994
tccctcgtcacatgcatctcataccccaaggcggattgcgtcatccatacccacaaggaggagtagctgtagtacaggctttgaattgcttatgcatctgtggttgcttgctccaatggtgccgcgttg

SEQ ID NO: 21635 - DNA, 568 bp, Sorghum bicolor
  Clone ID: 13316996
tggggcacaaggagggaccgtacaagggccacgccgccaccggcgacaaggtcgagttccacggcgtcgccgtcctcaaggtggatgagcagctgcgggcggaggacgtggaggtatactacgacccaggagagcttctgggaggccttctcaagggccccaaggtggcggcggcttcctccgaggaggaccgcggcgcggtggcgctcgcagagaggctcggcgaggccgctgccgtgtcggcgtcaggtgctgtcccgccaccgcaagcttgcccctttctcaaccccgggaagccacagtgatcgacctgcagcacccaagatagcggcttaatttggtgaatgaataaatgagtaaaaagcttattaaaagacgtgtccgtgcgtagtccatgggcttgtgaggggtacttgttactacattaattgatgtttcatgatcagaagaaaatgttggccggccgtcgtggaaaaactgtcacgagaacttggaggtcgtcgatctcaacaagaagaaaaacaaagcatgtgaaagtgaagttgatcgtgtagttgtgtgaattgtt

SEQ ID NO: 21636 - DNA, 203 bp, Sorghum bicolor
  Clone ID: 13317002
cgatggagacgccgcacgtgactggcatcgtggcgtacgccatggcgaacgcgactctggcgggcgacacgggcttgatgaaagagtgggtgcgcatgcagggtctgcagaggggcgatggcactgtgctagcgaacaatggcgtgtgggagacgggcgagggcgtcaaggcttcgactgtctcgccgaatgggatcaaatct

SEQ ID NO: 21637 - DNA, 249 bp, Sorghum bicolor
  Clone ID: 13317007
cataggaacggagtactagcaacatacacatagcagtatatataccagttgtgtatagtagtggatattcacgcactagtatttcagagaagaagatcgagcaggcgagacggcagatgatgcaaatgaagcgagatgcagatggatatggatggagaaatcgatgaggtggtacttactgtagataggtacgtacatatatatgcttgtatcattgccgcaactatatatgattgtaggtttccccca

SEQ ID NO: 21638 - DNA, 160 bp, Sorghum bicolor
  Clone ID: 13317008
ttcttactgatggtgcatgctacatgttacaccaaaaaggaaccattagcgatgatcggtacatgttacaacaactgtatgtatggctgtgttcctttgtattccgcctgtggaattcatgtctgcttaggcgatcctaccgcaaaaatgagatctgtaa

SEQ ID NO: 21639 - DNA, 284 bp, Sorghum bicolor
  Clone ID: 13317009
ccatctggtgtatttcggcctcccgctgaagaaaaggatgtacctcgcaaaaagatcaccatcaagcagcctaaaggcatagaccagcaaatacatgttgaacctaggagtggtcaggagcccaccagaaagataagaaaaattgtagaattatcgagttttgaggataaaagtagagaggatgatcattggtttggtggggaacccagccagatgaattcgtcacatgagaggaggcttggtctggatggaaaaagaagcaaagccatagtgcaaatatgaca

SEQ ID NO: 21640 - DNA, 287 bp, Sorghum bicolor
  Clone ID: 13317031
ggagaccaaggcacgggtggagcggcggcaccggagcgcgccgcgggaacagggcaagcgatggagctggcgtctgcggcggtctgatcctcctactcgcaatcgcaaagtgaaggcatgctagcgatgtagcgtcacatgcataacgtctgaacgatcggcaaaatgaataaaggcagcattcggagctttagaaggcgaccgactagccagccatgtaaaattgtatacaagctctgtttagctgtaagcgatgagatgtagaaaaccttttgtaaaggcgaagc

SEQ ID NO: 21641 - DNA, 569 bp, Sorghum bicolor
  Clone ID: 13317033
acaatctgatgtttgatgtccactggtggcaagtttgacagtgagctaaaatgttgataatcagcactgtaccttgtgctgaaaatgctggacgagcattttgtgctcgataaaattgttaaccatcaacagcctactcagaaattaatgggtgatagcttttgtatggttatttataggaatctggaacttgattggctcattcaaaattattacaaaccgcactctgggatatccgagtgtggtctctctctctctctctctctctcacacacacacacacacttttgtttgtttattattaagcataattaatgaatcaaggatgatcaacaccccttttaaattttcaggcaataattgagcgaatgggtgaactggagaagctggaatgagaacgaccaggaagatgctgccgcctgccgcgtgccttgtgttccaacttgtactattcgtttcaggtgtttttgtgtttgctttcatggttcttggttccggttgacagtcagcgtgaggccatgctgtcattctctcgaagaatggtatgtaacatgagattagtgccaatt

SEQ ID NO: 21642 - DNA, 246 bp, Sorghum bicolor
  unsure (1)..(246): unsure at all n locations
  Clone ID: 13317038
gtcagcaaggtcatgcagcacccttgggtgcgtgcgcaacatcatcctgaagagatggagagcctgctcgaggagtcgtcgatggtcagtttggagatgacaggcacaggaaatttcagcatggagaagaggattgtgcttccatctgggcgttagagttgtcagcacaataccacatattcatagtgatggtcttgcgtgtgtgtgtacatacttctgttcgtttacagggtaantacatactcc

SEQ ID NO: 21643 - DNA, 582 bp, Sorghum bicolor
  Clone ID: 13317040
cttgatattggtattgaaagagcaactggaattgtatggaatatcactggagggaatgatctaaccttgacagaggtgaatgctgcagctgaagtaatctatgatcttgttgaccctggtgcaaatctgatttttggctctgttatagatccgtcatacactggtcaagtgagcataactctaattgcaactggtttccagcgccaggaggaaagtgagagccggtcttcacaggctggaggagacagcaaccgtggtcgctcgggttggttttctcccacttcccaggaggatggccatgcattgcaaatcccagagttctttcagaggaaagggcggtcagggtttccacgagtctgcacgctttagtttattgtttttcatgtcatggtttttttcccccttggctctttatggtagtttggtatgatgcaggtttggtttataggtctttgagtttagcaaggtagagcaaatgtttgaatcgtaactgtagttcgtggactgtatcatatatctgtgtgcaaactacgccaagtgagtagattggcctggtggctgtgcttctcaggaacgtgcagt

SEQ ID NO: 21644 - DNA, 478 bp, Sorghum bicolor
  Clone ID: 13317045
tgctaaagaaaatggcgcaaagagaccctcaaattcatatccagtttcacccaactctgattctaagattgaatcaaagaggcgcaagagataaaatgctgtggcagaagcatccctggcaaaggagatgcgatatttatggtgtcagctcctcattactggtgcatattgagatgttgagatgtacactgcgagagaagagccaagccaattgtaggacaaaacttgtttttatcattcttctgtgtattctggggacgtttcctgcagcttagacattagtgtgatgagtaggtcagttcccgtcgctgcgcgtgcatgatcagctgctcgaggcgggataagaagtcgagaagtgctagaatgctgctgactctgtcgatgtaactttatcggtgtgtgtgttaacatatgcactggctggaaacgttcccatgtgtgaatggacgatgctgatgatagctttgcactgttgttt

SEQ ID NO: 21645 - DNA, 150 bp, Sorghum bicolor
  Clone ID: 13317061
aagagcaccagcaacagcacagcaacagcaagcaggtcgcagcaatacacctattacagcagcggcagcaataatcctggtgggttctgtggatttgcagcaggaaggagcagtaacatgatttctccagctgggtatgtaaagccaaca

SEQ ID NO: 21646 - DNA, 111 bp, Sorghum bicolor
  Clone ID: 13317066
gacgaggtctccatgtcgctattggccatgttcagaaggaacctgctggtgatcctcatagcaggagttcaggctactccatttgatggcaagatgtggatggtcctaagg

SEQ ID NO: 21647 - DNA, 104 bp, Sorghum bicolor
  Clone ID: 13317071
tcatgttgggttaacggccggcgtagtcgctctcagtggcgcagcagtgatggtttacttgaaacgatctcaggtgtgatctgcaaaaccacaggatggccttc

SEQ ID NO: 21648 - DNA, 174 bp, Sorghum bicolor
  Clone ID: 13317097
gcacgaggggccagtcggctgttgcctgtcgacgctggtgagcgggatcattctatttcgcctcgtcctgtccaatccactggtcgtgagttgtgagaaaccagcaagccatgacggagaagacggtggtgctgtacccctccctgggcgtgggccatctgaaccccatggcgc

SEQ ID NO: 21649 - DNA, 209 bp, Sorghum bicolor
  Clone ID: 13317101
tacaagtttgaatcatggccaatgggtaatgctgctgggagccctgccgcagaagaagggcggggaaaggttgcagctttattgaagcaacaaggtgttgatctcaagggagctgcaaaaagcgccactccagtgaatgaagaagctcctcctttgcttgaaggcggtgggaaacttgatgcatggcgcattgatggcaatgataggac

SEQ ID NO: 21650 - DNA, 421 bp, Sorghum bicolor
  Clone ID: 13317103
gcacgaggtatcctgcgattcttgtcggaaagcgaaagtcaagtgttttcatgagggccatcctccatgtcgtcgatgtcaacgggggaaatcgacacggttgtgtgctcacagatccgcgagcgtcatcgttacggccaaggggagactcatcgagagtccagcacaaggcaatatctgcttccaaggctgtggttgacaatgttacaatcaatcccgtggactccagcgatatcccccaccttacgggttccaacccggttgcttctctgtctccgtccaccctcatcagcgcctgtgacacctaccgtaagaagttccctgtagcgaactttcttcactacccttcgcttattgccaacatctcggccaatccctcttatgtggactcggtgttcgttgcctcattgctctccctctg

SEQ ID NO: 21651 - DNA, 138 bp, Sorghum bicolor
  Clone ID: 13317112
cctacgactgatccaccaagcctcacgttcatttgtctgatttggggcaccaagatgctcaaatgcacaagtttgccgtaaacatagtatgcacttataccattcaccatcaagacctgttctgcacacaaccgtgac

SEQ ID NO: 21652 - DNA, 468 bp, Sorghum bicolor
  Clone ID: 13317122
gcacgaggggtatctagccctggaaagagtgtacagcagttgtggaagaagccaggagcagattgaggagatggaaaagttcgatgatgcaggggatgtggcttgggtaaatgtttctgtgacctgtttattgataaattagcaaagtctgatcttctgctgttgtcatatcttcgtctcacccctgcacaagaattagagtttatataaaggcagcagctctagttgggtgatgattctgggacatagggccttgtactgaattctggggacaagactcgacccctattgatctagtattagcacacttttttttgacaataagtattagcacacttactccacacaacttgagctctggagtcatgctcatgattcattctctttgcaggtagagagctctagtgacaatgttcatgtttatgatttccatgttgtctacagcttctcctacaaagttccagtgct

SEQ ID NO: 21653 - DNA, 181 bp, Sorghum bicolor
  unsure (1)..(181): unsure at all n locations
  Clone ID: 13317132
gcacgaggctgattcttccgcttttgtgcgngaaacgngaaaacgaagtgaaagcgaggctgctgctgtctcacggctgccgcggcggcggcggttcggactccaggctccagggatggccggcgcgggaggcagcgggggcggcggcgtggtccgcgacgtggaggcgctggacggcgtg

SEQ ID NO: 21654 - DNA, 105 bp, Sorghum bicolor
  Clone ID: 13317140
agcaggcgccgcacgcatcacggatactactacggctgtccacctccagcaggttcgtggccgcgtccgcagcggccgtgcacaaggtgaggctggtggggccgg

SEQ ID NO: 21655 - DNA, 295 bp, Sorghum bicolor
  Clone ID: 13317142
gcacgaggcaccagacagccccaataaacgcctggccgtgcaaaccgccggacgctgtgactgtgagttgtgaccttgcgcgtggcccagatcgatcagatggaggcgacggcgacggcggcagcggactcctccggcggcgaccgctacaggtctcacctggctggcgatggcgagaagcacaccgtgtggcggcacggcgcgccgccctcgtacgacgccgtgaacgccctcttcgaggccgagcgcacgcaggagtggccggcggggtcgctggaggaggtggtgcagaacg

SEQ ID NO: 21656 - DNA, 501 bp, Sorghum bicolor
  Clone ID: 13317145
aactcaagaactacatggtttcaaaggcaagaaggcgggctaggtacaccttacggcctaagcgacaaggcgtaactagacccccaaggctagctgggtccacctggatgcctaggtgacgcctttgaagcagagacgctactattaacttgatcctcacaaccaagcactgccactaacccttacacaccatacacaagcttcttcattttctatatcgcatagctccaactttgattcccccttttgtagtcccattatcccgttaatcagcttggtatggtaaccatgatgctacaataactgaccgaaacagcacacctcaccatctgctgtactacttttacaggccatcttcatgacaaactttgctgctaaatgctagctaactattagctcatgcaagaagccaattttctcttggacatgaacaacttgtattaaaaatttgtttcatagtgtgttccctttgtggttactataaattttgattttgcagct

SEQ ID NO: 21657 - DNA, 461 bp, Sorghum bicolor
  Clone ID: 13317148
gcacgagggcaaaaactccatacaactgcgtcaacagccatggccaggataatattcaaactcgctctcaccctcgccctcaccctcggagtggcaacccaggcagtggaaccccacgagtctggtggcgtaagagcacatcgtcatcttcgacagcaacaaacccatccccgccgaaatcaaagaagtcctcaaacgcctggatctcgacgaagaccaccccgacgttcaccgcgtcttcaacaactccgcattccgcggcttcgccgcctcgatgaaaagccactgcctcgacctgctggccaacatgaccgacgtgtcgatcgttgagaaaaccgcctccgtgcaaagcatgtacgccatccccaagcaccaacatccccagcagcaggaccaacccaaacaactcccccgccgcgccaccgactccatcaacacccgcggctactccccctgcggcc

SEQ ID NO: 21658 - DNA, 151 bp, Sorghum bicolor
  Clone ID: 13317151
atgttgaaggacatgtgaggccaaactttctacccagaattgcccttgctaatatatgggaacctgcaagcagagaatcttgcaataacaatatctgggagatagtgaaagcttcttttggtattctgcttgggagggctactcttcagga

SEQ ID NO: 21659 - DNA, 270 bp, Sorghum bicolor
  Clone ID: 13317152
gcacgaggatcatcagcatatgatgccacaaactcagcatcagcaacagcagcagcagcctgcagtgaagttggagaacggaggcgtccttggcggggtcaaactggaacaacagatggggcagcctgatcagagtgtttccacacagatgctgcgcagttcaagtggcggcgtgaagctcgagccgcaggtgcaagcgtggaggagcttgggtgctgacaagatggagcaccaaagctcagacccatctgtgttcctacagcgacagca

SEQ ID NO: 21660 - DNA, 444 bp, Sorghum bicolor
  Clone ID: 13317156
gcacgaggcaccactccactcgcgaataatctccgccaccgccggcaccgggtctctgccgcttgccgagctttctttctttctttctttgcatgtcaacgcagacaaaaagagcagcgccgcctcctcctcctcgccggtcgccgagtctccgcctcctccccatcgccttcgcggccggcgctccgatataaacacacgaggttcctccgggtcactgctcacaggagcgagcgcagcaacgaacagcacgccgccgactccccaagagatctcgctcgcagccagccatcgccacatggaaccgccgcgggccaacaacaacggcggcaggaagcgcaagcccacgccgcctcccgccgccgccggcggcctgggggacctccacgacgacatgctcgagggcgtcctcgcgcgcctcccgccggccgcctacttacgcct

SEQ ID NO: 21661 - DNA, 467 bp, Sorghum bicolor
  Clone ID: 13317161
gcacgaggccagccgcggcggcgcgggacgagcgccctcccccgacacagcggtgtggagccgtcgcggcggcgctagggcgagcgcgccccccggcggcggcgcggggcgagcgcctccccttccccggcgcggtgacgcagcggcgccccacaggcgagtgcgccctggccccaggttttgtatattcatgcttatttattctacccaaatctggagatggagctcaaggcacaagcacagcctatgccatatcaacgagcgtcagtaagatttttggcaacgggactacaaaatttgatgatgcttgcatgctacgatctgcaggatgagcaaagtctgtagttggcgcttgtattgcagattcaggtctctggacttctccaatcaagagcaacaggtcactccatacttggatagcttggagccaggaattctcagctaaaatggtgtgtaatgcttgagtg

SEQ ID NO: 21662 - DNA, 135 bp, Sorghum bicolor
  Clone ID: 13317162
gtatactcatctcatgggtctgcaaacaccaacttccccatcagtttattcagctaatggaatatctgggtatgatgggagctatggagctggccttaggtatggatcacacatgtatacttctgggttatatgg

SEQ ID NO: 21663 - DNA, 213 bp, Sorghum bicolor
  Clone ID: 13317163
gcacgaggccgccttttcccctttctctctcatgtgagagcagagaagccgagacggctctcgatcggaggatgttgctgaggagctcgtccacgccattcctgcaccaccccttcctctcctcttccccgtcgtgccgctcccgctcctccctgcacctccggcgtgccttctgcgacggccacctcccatccctccacccgtgctccaccc

SEQ ID NO: 21664 - DNA, 437 bp, Sorghum bicolor
  Clone ID: 13317174
gcacgaggccacctttcacgccaacagctgcaacgtttgataagcatggggacctgatatatgtgggcaactccaaaggagaaattttaatcatagattcaaaaagcatccaggtacatgcagtagttcccatccctggcggaagtgttgttaaggatattgttttaagccgggatggtcaatatctgctgacaaattctaatgatcgggtcattagagtcttccgaaacattctgcctgttaaaggttctggagaggagattagaaacataagcaacaacagtaatgaatatggaagtcactacgataaattaaaagcaaatggtacaagctgtcttgttctttcctgtgaacttttggatgccatcacaaagatacagtggaaggcaccttgtttcagtggtaatggtgagtggatagttggtgcttctgcaaac

SEQ ID NO: 21665 - DNA, 329 bp, Sorghum bicolor
  Clone ID: 13317175
gcacgaggttggtgctggtgggaacccagaaattggcatgaatgcaggcaaggaaagccaggagttggtagaacaggcagttgctggtgctgatatggttttcgtgacagctggaatgggaggtgggacaggcactggtggcgcacctattattgcagggattgcaaagtccatgggtatattgactgttggaattggcacaaccccattttcattcgagggaataaggcgggctctccaggcacaagaaggaattgcatcgttgagaagcaatgttgatacactgattgtagttccaaatgatgagttactgactgctgtatccccaa

SEQ ID NO: 21666 - DNA, 498 bp, Sorghum bicolor
  Clone ID: 13317176
gcacgaggggaagaatggcatgatcaaagagatggaatctgtgttgctgcggatgaaaagcaagcaatgccgtccagatgtgatcacattcaatatactcatagattcatatgggcgaaagcagatatttgataagatggagcaggtgttcaagagcctactgcgatcaaaggagaggcctacacacccgacgtttaattccatgataacaaattatgggaaagcaaggctcagagagaaagcagagtatgtggttaagaagatggaagaattgggatacaaaccaaactatgtgacacaagaatgcctcatcatgatgtatgctcattgtgattgtgtctcaaaggcccggcaagtgtttgatgagcttgtgagctcacaaaacaaagtgcaactttcttcgttgaactcgatgcttgatgcctactgcatgaacggcttgcacacagaagcagatcagctgctggatactgcactgcagaaatgtgttgtgcccaa

SEQ ID NO: 21667 - DNA, 246 bp, Sorghum bicolor
  Clone ID: 13317179
gcacgaggggccattccccagcccacctcttgctgcaccctcgcgctgctagggtttgctcgcaatccagccgcctccgccatggccaagacgaagcaagggaagcgggacgtcgacgcctacaccatcaagggcaccaacaaggtggtccgagtcggggactgcgtgctgatgcggccggcggacacggacaagccgccgtacgtggcgcgggtggagcggatggagtcggacgggcgcggcggg

SEQ ID NO: 21668 - DNA, 107 bp, Sorghum bicolor
  Clone ID: 13317193
tctcaacctgaccttggttgaccttcctggtctgacaaaagtgccaattggagatcaaccgtctgatattgacaaacaaacccgaacattgattctggactacattg

SEQ ID NO: 21669 - DNA, 521 bp, Sorghum bicolor
  Clone ID: 13317198
gcacgaggcttccacttgctttcttcttatcaaacaactcccaatatcttccaaaatggccaccgagcgtgaaagcaagaccttcctggcccgcctctgcgagcaggccgagcgctacgatgagatggtcacctacatgaaggaggtggctaagctgggcggagagctcactgttgacgagcgtaacctcctcagcgtcgcctacaagaacgttgtcggcacccgacgtgcctcgtggcgcatcatctcctcgatcgagcagaaggaggaatctaagggctccgacaagcacgtctctaccatcaaggattaccgcaacaagatcgagaccgagctcgagaaggtctgccaggatgttctcgatgtcctcgacgacttcctcatccctaacgctgccaccggcgagtccaaggtcttctaccacaagatgaagggtgactaccaccgttacctcgctgaatttgcctctggtgagaagcgcaagggtgctgctaccgctgcccacgatgcttacaagagcg

SEQ ID NO: 21670 - DNA, 230 bp, Sorghum bicolor
  Clone ID: 13317200
gcacgaggcactcttcctcctccgtccactgttctaactcttgcgctgctctgctgcatctccggccgaagctctctgcgcgcacagagaactctggtgagcaggcctccagaactgttgtccgtcaagcgtacctgctcgggtaggcgggcaatcaagtttttggagagcgtcattaggcgcgactgctctgtccgtgcttccctgctgctgctgttcgaggtgccgcc

SEQ ID NO: 21671 - DNA, 132 bp, Sorghum bicolor
  Clone ID: 13317208
gcacgagggttcggttaattttctgtatatttacattttcatgagatgacattattgcttgatcttttcgtatcaagcaaggtttgacatttgtgattgtatattagctttttcaatcaaattaacaccaac

SEQ ID NO: 21672 - DNA, 575 bp, Sorghum bicolor
  Clone ID: 13317211
gcacgaggcctcttcctgttcctccgaaaatgcagggattgcggaaagcaggtgtacttaggtgagcaaacagatttttcaactctaatttgtactagtaatcttgtattaaatttttttagagttggattcttgtattaatttcccgttaattatttcctgatcgatctcgaatggtctaaccgattcagtgatctggctctggctaatacaggtggattcgacactgctcatgctgctgcaagggcgtacgatcgagcggcgatcaagttccgcggcgtcgacgccgacataaacttcaatctcagtgactacgaggacgacatgaagcagatgaagagcctatccaaggaggagttcgtgcacgtcctgcggcggcagagcaccggcttctccagaggcagctccaagtacagaggagtcaccctgcacaagtgcggccgctgggaggcgcgcatggggcagttcctcggcaagaagtaagaacactttatttgcagactgaattatcttaccagatttaattttctcgacatcgctatatacttcctgcaaatgcatgctttgcctttcct

SEQ ID NO: 21673 - DNA, 312 bp, Sorghum bicolor
  Clone ID: 13317221
gcacgaggctagggttttagagcaagggggttggttctccgcggcggcgacggcgagccatggagaatacgaagctctcgtcgtcgctctttgccgggacccactttgaccgcaagcgtttcgccgccgacttcgctcggttccgtaaaggcccggctctcccatccgccgccgccaccgccaccgccgctccctccgcgccgtccccggagaagaagcggaagcgcaagagcggcaaggcaaaggcgaagaagaataagaagaagcgagccgaagatgcggccgccgcctcgtcgaatgttgtggaggggt

SEQ ID NO: 21674 - DNA, 440 bp, Sorghum bicolor
  unsure (1)..(440): unsure at all n locations
  Clone ID: 13317228
gcacgaggcacaattggtcctttccaaccctccaaagtgagaaggccaaactgaaagttaaagtgcgtctcaacatccatgggattgtcacagttgattcagcaacgatgctggaggaggatgtggaagttcccgtctcatctgcaaacgaagctccaaaggatactacaaagatggacacagatgatgcaccaagtgatcctgtttctggaactgatgtgaatatgcatgagcctaaaagtgctgatactactgaggctgctcctgcagctgaaaatggagcacaagatcctgaggaaaaatctgttccaatggaaactgatgcaaaggttgagccatcgaaaaggaaagttaagaaaacttcagttccggtccatgagttggtctacggggccttggctgcagttgacctgcanaaggctgtagagaaagaatatgag

SEQ ID NO: 21675 - DNA, 355 bp, Sorghum bicolor
  Clone ID: 13317239
gcacgaggctttaggtagaattggaaacctatgtgtacttgatatagagtactgttcatctctgcaacaactaccatcatacatcattggggagttcaaaaacttgcgaactatcaactttaatggttgtacgggtttgcaagacctgccaagcacattatcctgtcctacattgcgtactctgaacctttctagaaccaaagttaccatgctacctcaatgggttacatcaattgatactctggaatgtattgaccttcaggaatgcaaggagctacgggagttgcctaaggaaatagcaaacttgaaaaggctcgcagttttggacatagagcattgtagtgaactgtgttgc

SEQ ID NO: 21676 - DNA, 119 bp, Sorghum bicolor
  Clone ID: 13317243
gcacgagggtggcatagtcactaggcgcccactgattatacaacttataaacatacccagtgaacgccatgacagacctggtattgatgaggttcacgtgccgcatacagctgctagtg

SEQ ID NO: 21677 - DNA, 268 bp, Sorghum bicolor
  Clone ID: 13317249
accttgcacacggcgctgacatcacctacgccgtgcagcagctctgcctctacatgcatgctccgcgggagccccaccttgctgctatgaagcggctcctccggtacctacgtggcactctaggctatgggctgctcctcagccggtcctcctctgccgagctggttgtctacaccgacgctgattgggcgggctgccccgacacccgcaggtccacctccggctacgctgtcttcctgggcggcaaccttgtctcgtggtcgtccaa

SEQ ID NO: 21678 - DNA, 182 bp, Sorghum bicolor
  Clone ID: 13317257
gcacgaggcaccggtccgacaattctatcttcttcttctcctacaactattccgcaaaggaattctgccttgcatctcatcttcttgctgaacatcgtcagcagcagctgtagctgtagcaacggcacggcatggccgccgagttgcacaagcccctgggcgcgatcaccgccgacgacctc

SEQ ID NO: 21679 - DNA, 467 bp, Sorghum bicolor
  Clone ID: 13317323
ctcccccgcagctagcgtggcaagacgggggcggcatgttgtcccatgaccctccacagccagaacatttcttccaggctctggagagcaacccatctctgcaacctacataccatacgatggacatgaaccagcagccagtgccatcgccgggcagctgctaccctcctgattggatggcttagccagtgcttgattccattgccttgagaagtgccgtgtccttcagagatcactacgagttctgttgctgcttttccctgccccttcgctgctatgcaatgcttaccgaactgtccaaatgaccacatggtcatatataggttattgtcgtctttatcttctgttgatcacgtcctgctcagctgctttggcgccgtgcaaaatggcttggcgatgcacgctggaatgggctgaattgattatgtttcgggagtataaatcgcttaacaataagcattggcatg

SEQ ID NO: 21680 - DNA, 457 bp, Sorghum bicolor
  Clone ID: 13317335
aagggaacagcaacatatgaaatgaactcctcttagtatgaagagccagaaccacaacactacaggatgagcagcagaccatacaaagatcctgcacctgacccactgctctcccagttcatctgcagagtcgcacaggccgacgacacggtcccgagtgatggcaacgccgaaaagggtatctcatcagatgatcagaggttgaagttgaacaagggagcaacagctagcgatgatgcatcatccaagctgggactggaggagaggctgcagaggatcgactttctgacggagatcctcatgtccaccattctttaatgtgttgctgctatctagggtttcttgagcagctctaggcatggctattaggatgtgttttctgggcgcagacgtgtaccactgtcacgtaagcaaaagcaattccctgcacacatgtacacctatactataaccttgg

SEQ ID NO: 21681 - DNA, 573 bp, Sorghum bicolor
  unsure (1)..(573): unsure at all n locations
  Clone ID: 13317356
agatccaagcgatggaacagaagaggcactacttaatgagcttacttcatttgatagtcatctaaaagacaatggtccgtttattaatggcggaacaatttctgctgctgatctctctctgggccctaaactatatcacatggagatagctctgggccactataagaattggtctgttccagattcactttctcatgtaaaaacatacatgaagtcgattttctcaacggattcttttgtcaaaactcaagctctgccagaggatgtaattgctggatggcgcccaaaagtcatgggttaaattcatttctaaagtaagatgttaaggtaaactgcatatatccccttaatagaaggaagaaatattgcatgcttagatttccttggtttgctattttgtgtctatgggagtgatgatgacagtatgcacacctcataattatttagagaactggaaacattggggctttcttaagcttgttggctaataagattcaaaaatatatgtgtgtatgtatttccnattgtatgtataataactgtatttgtataaaaatacaaatacattagaat

SEQ ID NO: 21682 - DNA, 659 bp, Sorghum bicolor
  Clone ID: 13317360
attcttgaggtttttaagcaacaaacttgagatttacctgtaaattccagtcttgctagcgagcaaactgctttctagtagaaagctatttgctggtagagaactttaattgtgtactgttgaaattgtcacagcccacatcaatgcaatagtgaataggggtaacagggtagttgtataggactatatccaatattccaatttgccttaggtatcaattttgtcaccaatgagaatgggaacatactagtgtaactacgagacattgaggcaatcgccaagtggaaacttcatttctgctggagggattcatgctggacaaaactgatccatcacgcattcatgctggagggattcatgcaactattgtctggcctccccatttctgaggcaccatgagttttggagtccatggattttggttgaataggttggaaacaattgctttcttggttcttatcagtattatgattgaaagcaaaacaatatcttgtttctggcatgccataatcatttgacgattttgggataaaagccaaggagattgaggcgtactatttatttgtttgttttgtatattgatgtacaatattgtaggctagactgatccttattgttggccttggatcttttttttactgttggtgttttgttcatgc

SEQ ID NO: 21683 - DNA, 577 bp, Sorghum bicolor
  Clone ID: 13317363
attgaagaaatatgatgctgctttgaactttaccatgtgttgaattgcgcactatggatcaacatgaggtataccctgaggcatttgcagatccagagggccaagtatggcaggtgctaaatgctgcttgggatgctggtatacaagtggctagtgagaacgctctaccttgctatgatagggatggattcaacaagattttggagaatgccaaaccactgaatgacccagatggacggcatctgtttggtttcacctatctaaggcttagcaatgttctgtttgaaagacccaacttttttgaatttgagcgcttcgtcaagagaatgcatggtgaggcggttcttgatctgcaagtatagattggtagcatattacatacacatatacaagtgactgattggctccggccttacaagtgactgattggctccggccttatggcttacattttttctctccttttcctttttattttagggagtagtatcagctgatttttgagctgttaaatatagaactcgctggttgctgctcaatttgtaaagcctatttgcatatactctagtcttcaaga

SEQ ID NO: 21684 - DNA, 611 bp, Sorghum bicolor
  Clone ID: 13317387
cccgccctctgaaaagcttttgttcgcagcatccttcgccgcacggaaactgctcaatgggcgggtcaagctatatatccctgacttcctctctgtgttccagcacttgtgcattcatgcaggcgggcgtgcagtaattgatggtgtccaacgtaacttcggcctgtcggacgagaaggttgagccatcaaggatgacgctacatcgatttggtaacacatctagcagctcactttggtatgaactggcgtatgtggaggctaagggccgcatgtacaagggcaatcaagtgtggatgattgggtttggctctgggtttaagtgcaacagtgcagtatgggagtgcattcgacctgtccacgatgcacatggaccatgggctaactgcatcgatcgttatccagtgcatattccctgatacgcaccaagcataccaaaataaataaatggtggatatgcaacagctaacatgctgttccatccacacttagcagacatgatggacatgcacgtaacagcgctataccttgagattacaaagttaccataatgatgtaatgcataaaaaggtttgttactaacaacaaacctgatgtaaaccgggaattaga

SEQ ID NO: 21685 - DNA, 408 bp, Sorghum bicolor
  Clone ID: 13317391
tttgtggattaatgtgatggcggatagaagattcaatctacaaaaggcgatttgttgtgaatttatgggtgagatgcgagcagtgggcatcttttgcaatttcatgggggcgaggattagtgtcttctaagctacttaagctgtcgatcctgctaatccatttgagctagtatttgacttgagcatgtgtacttaatggggtgctaaattcttggaatttccttttattgagttttaacttgaagtatctatgttagatccagcactccagttagtgatgcaagtagttttgttctgttactgttcactagtagaattttctgtttttagtgcagttttggatcagttatctgggtactgtggtttgtggctggagtcacaactgagaactgaatatgcgtcaggagt

SEQ ID NO: 21686 - DNA, 235 bp, Sorghum bicolor
  Clone ID: 13317393
atcagcatcttcccggtggcagcaggcgggagagtggtggaagctgcagcagcgccgccgcaggctcgcgttggactgccaccctggatgcttagccacctaagcggctgaaggtcgcggatgctttcggcactcccaatgtaaggctctatcatagagtcgaagacaattaattatatattatttatgatattttgctgatgtggcaccgtatttattgaagaaagaggttaaa

SEQ ID NO: 21687 - DNA, 592 bp, Sorghum bicolor
  Clone ID: 13317402
cagctggaagcagaagaacgggcggaccttttagccgtgaaggttatggtggctttggagaccatcgttccagcagttttggtgattttggtggttcctctgaccgcagtggtggattccgtgactcaggttcaaggtaccgcggtggatctggaggtttgagacgatcgtccagtgagttaggcaggcctagtttcagtcgttctgatagatttggcgactttggagacagtgacttcagcagacgtggtaacactgactttggtcgttcccggagctctgatgattcaggctcctcacgttatggcagaggttctagtgggttcggcacttcaggttccggcaaccttggtggcttcaaggattccaagcgatgaatgggataggggtttcttgtacagctctgagccttttctaacacccgttgtttcttccttgcctgagcaaaccagcagcagcacttcattgtgctttagcccctgatcaggagtagtttggtcgtgtagtgtagggttgtttcagaacttttgttctttgaagcaaggttgtttcgtaacctgtatcactgtatgttgatatgttctgattttgt

SEQ ID NO: 21688 - DNA, 607 bp, Sorghum bicolor
  unsure (1)..(607): unsure at all n locations
  Clone ID: 13317406
gtctcccaagtattttccgggatttttgggttcctgggcatgctgatttacatagtcgcaatcctataccttgtcttccggaggaacaggaagtccacccagccattgctggagagcgatgcggagcttgcagtgtccggtagcagtgcaggtgctggagcagaatgctctctgggccatttgccccgagaggacatctccagcatgcaacttccgcagcagcgttcagcttctgatctagattagataacagtggtcaggaaaataaatatgttttttttgttttttatatactagtatagtaattacacagtagggtacatcaggttttgactttgatcatcttactgatgattttatgggcagtaagctagggaatgtatacaagaggatggatatctatgccgccgaacaaacaaaagaggcaaaaaaaaagtttagtacttgtttggaaagtgatgaaactgaactgtggaaggggcaaaaaaaaacccatgttggtatcgaatcaaatgtgagaagttcttcattttaaacatagcggcattggtaacaaaatgcctagatgatgtaacatactnatttttattattacaatagtatatac

SEQ ID NO: 21689 - DNA, 460 bp, Sorghum bicolor
  Clone ID: 13317409
cttcttcttcggttgcatccagatggtgctctactgctgctaccggaagccctcggcgtccgtggtcctgccgacgacgacggacgccgccgccacggagatggagctgcccctcgccgcccaccaggccgtggccccggtgctggccgagctgcagaagctggaggaggccatggggtcgccgcgcaagcatggcggcgtcgtcaaggtcgtctgaccatgaatgatatcctttggaagctcatcgcaggcatgcatatggcctgcttcctgaactgcgcgatgcatgccctgctagctggatcaatgttgcttgtttaattattattattaatgcatggcttggtagattcgattaactgattgccgccggtagagagagagagagagagacatactaagtgtgtgtcttcttttattaatcgttcgtttgtgtgttcttatatctcccttaatgcaa

SEQ ID NO: 21690 - DNA, 598 bp, Sorghum bicolor
  Clone ID: 13317445
gcgtggtggcgctgcttgtcgaggccgaggaggcgctcgatgcggcgtcgccagcggttacaagcgcaaggtctgcgctgcgagtggtggacgcgttcctcgtgccgcggttccactacgacccaatcaagaaagtgttttacgagcacacaggcagattagctgtccatggagaagctggcgataaagcttccctttatagggataggtatcaagtgttgcttcagaggctggctcgtgataaatatttctctaagccagcttttgacacagttgcgaccgaagatagtagttgcgagataacttctatacagtcgctaattgggtgcactggacggagatggattatgggggtcatttcgcagttggaggagcgacagttctacttggaggatcttactggagcagttccaattgacttgtcaaatgccatatcctaagaaagcagtgttaatttttagccctgatggctagttactatttcttgtgaataatgcataacaaagtttctacatcttttctttgtcaaataaaataatcaacattaaacttcctcccttcacttgtgaaggaatggtgtaccaaggaatttcctttt

SEQ ID NO: 21691 - DNA, 449 bp, Sorghum bicolor
  unsure (1)..(449): unsure at all n locations
  Clone ID: 13317452
ttctctgtcaaggtttggttggtctttctggcatcgatatccggtacttcagacatctcaaggaggtcacaatttgtgccgaggccactgcacaaacaagacaagattgggaacgtgcagcacaaaaccacccaaataggcctagagtaatgttggtcaaaacagccaattcaatggagagcgaggaactgggaccatgtgccatgagggagaagagaaaaagatttctggaccaaccaagtttggatgatagtcttaagaagatgagactttcagagtcttcttcttggactcaggcagttggccgtcaggtgatgacaacagctacaattgcatcatccagtgtatctattcatctgcatgctgaggaatccggtagttggatgcagaagacaagccatccttaattttcaaatcttatatgctccttaatttttttttcntgtgct

SEQ ID NO: 21692 - DNA, 617 bp, Sorghum bicolor
  Clone ID: 13317494
aaatgctagcatgtgttgcattctagcagctggaaaaaaatggtatatactatatagtactctttttactatttataaggtcttaggttttctcagtattatttggctactctacatggagtattggattaccctccctctttgacaagggtaatgatgtgtttctttgaatcttgtcagtgtagtggcttcagatagatgttttgaaagctatacacttaaacgctagttatgcttctggattggtggcttataacatccgtaagtcaatatgcatttggtttgttggttgacggattctctgtctataagtttgtttcaagctcttctttttcttctttttgcaaattctctgtaaatgtgtatttttccttgactatcaatagatcagaacgccagtgtgataggaggtgaagaaggtggtgatcgtaagaaacctccagtagctcgtgcagccaagcagcctggtgttcaagagcccgccgcaaacggaggggaagcagaacctgagaggagcgacactgatgagtcagagaactgaagtggacctcaactttggaatctaaataaatcacagtgtatatatttgtaacaaacaagatgttcgccgttcgctc

SEQ ID NO: 21693 - DNA, 663 bp, Sorghum bicolor
  Clone ID: 13317504
atgcatgtcttttttactaccaaaactctctattttcatacacagtaatggtttccttttagttgtatgtttgagaagcactgtctcatacacttctaaaaatgtttctcctcttgatcaatccagagaaggtccctggattggtgataaataacaaagtcttgatcagtaatgtgcaggttcattttgaggtgttaatttaaattcctattttgtttataggaaaataacatggccacagggtacagctcacatgcaaggaatatcaaggtatgttggtgccctccatcttggcgtcagtcacaacaggtgtttgatccagtggtccatgccattcatcgaaaaaacagttttcgagtcgcatgaggtattgagtttggtggccatgagctccaaaatgcatctttagagctccgctactatagtgatggcattggtacttcactgaaaacattgttgtgtgtggatttttggcaatacaaagtctgggcctgcaaatatgttgacttttgatcgatcaagttgtttcaataaatgtatccatcttattggtggcctgtacaactttattttttagtcattatttattttgtgtacttgagaattgtttttttcattaattacttggatagattttttttcatatcatgtaaggcttagcca

SEQ ID NO: 21694 - DNA, 635 bp, Sorghum bicolor
  Clone ID: 13317529
ggaaggcgcagtaatgctacacacttttccaaagaccactgttgatgtttttgccttggttcttgagtctggcggcagtgatcttcccatcattatatcatgcgctagtcttgcactggcagatgctggaatcatgatgtatgaccttgttacatctgtatccgtgtcctgttttggtaagaacatcatcatcgacccaacctcagacgaggaagcatggcaagatggaagccttgtggttgctttcatgccagcccgcaaggagatcacacaactcacgctcaccggagagtggagtgatggcagaataaccaatgcagtagagctctgtatggatgcttgcagtaagctcggtgacatattgcgtgaccacttgaaagataccgccaccttgacgagtgaatgatgtggcagagacaacacttgcaacaacagatatccttagctgtacaaaatctgtaggcaagggaggcttgttggcctgatgtttgagtaagcatgcatggttgtctccttcatggcaaaagggtgaactgtcaagctggggagaaattgcagggcagtgtgtatttgccatgtaacatctcctgacttctgacctttagcttcatgtagcatctgtatcttgctttttt

SEQ ID NO: 21695 - DNA, 649 bp, Sorghum bicolor
  Clone ID: 13317540
gaaggtacgaaaagttctagtccatccctacagttaagacctggtgttggatctgggagccaatccactatgatggtaaaccttgaggattcttcagctgtttgtggtgaaggtatagatgcaaccattgaagttacgaaaagttctagtccagaccggcttgagcgtaagagaaaacacagttcagaaagatgccatgatcaaggatccaaaaggtccaggtcaacctgtaaaatcgcaaaaagtgagatttcttctttggccattcgcgaattgaaactactcaagatagacaaaacacatggttctgacagattcaaggaagttgctcggaccgcaacacattccatcttggctgcctgcagatttgagcattcgccatcgcaatcccttgcactctcaagacctgtctgcaagcacagccccaaagtcaaacaactgaagtcgtcagcaattacggatttttgcaaagaatgcttgcgtaactttgttaaagaagccgtcagtttggcgttgtctggcaagcagatggatcaaactggtacctcctattagattgtagacaagtttgggattattttttgtctggtcattgtgaatacctcagcacaaactagggacaagttgtacttttagggatgttaatgcg

SEQ ID NO: 21696 - DNA, 386 bp, Sorghum bicolor
  Clone ID: 13317544
tgcttcttcaggtggcacattggtcccaatcagttggactgagatgcaatgtgacttgactggtcaaattgagcaaaggaaagttgcgaaggtggaatagatgtgctggccttcctgacaaatggtggtgatggtgtacaaaatgtggaccagtgacaccaggtccttgggcgtactactgattcttcgatgtccaacttcattacagctgattgagcatgattttaaaaacccgggctgaatttaactagacagttcacaatgaatcatagacatggatcctgtaatccaacaaccttgtgatctgaatcatcgccttgggtcctgtaatccaacaacttgtgatttgtaactcgtgagctaatgacattacagttttgccccct

SEQ ID NO: 21697 - DNA, 645 bp, Sorghum bicolor
  Clone ID: 13317549
gttctctgctcaaactgccaaatttctcaagcgcgaaaccaccgagaccgtccaaacctcgcagtgtgaactcccgttcgtctgcttcgaaagctactgcaacagtacagccttgtaaatcgtccaagattgctgttagtggtatcgatgaggagatgccagatattctaaaagaacctaattctcctagtaactgtgtcaagactacttcacccaatggaaaacgggtctcaccgccacataatgcgctcagtgtttccccaaaccgaaaaggtggtaggaagttgatactgaagtcaattccctcatttccgtcacttgcgggagacacaatcagcggttctgcaatgaacaacactgatagcacattcagcgtgtcacctctcactttaggaccatcctaaagctgtgaagttggccatgggaccggagtacgacttgtagtccgaatatgtgcctcacaatctacggcaaggctggaggtaccgtcagacaatagtaagttagattttaagttgtagtaatctgtttttgtaaaatatggtagccccaataatctgtatgtaagatgctgtgatgcttgaagctgttatctttattaaattgtagcaacattacgaatcacttttgagtaggtttcataaa

SEQ ID NO: 21698 - DNA, 366 bp, Sorghum bicolor
  Clone ID: 13317578
gcacgaggagacgccggcgggggcctcgggaagagttatcttttctgcttaacggcctgccaaccctgcctccagaacctgtctgcttcatgcagccgccttgctgcttctgctaccactacattgcccacagtgacaccgccttctacaaatctaccacttaagcgcagcagtacaacatcgttgcaccaacagccgccatccggcctcaactcacaggatgcaccatgtggcgatttgctgccagggccaactagtaactcatcaaaaaagcgcaggggacgtggccctgaaaaactaatggaaccacgcaaagaagctgaaaggcccatgctgattcccagtggtactgaaactatcctggga

SEQ ID NO: 21699 - DNA, 519 bp, Sorghum bicolor
  Clone ID: 13317584
gcacgaggcctcgatgtcaccaagggacccgtccagatcaactggttcaagggagggaaaactaacatatgttacaacgctgttgaccgcaacatcgagtctggcaatggggacaagattgcaatgtactgggagggtaatgagcccagtcaggatgggaagctcacctattccgagctcctggagaaggtttgccagcttgcaaattacttgaagagccttggtgtcggcaagggtgatgctgttattatctacttaccaatgctactggagcttcccattgccatgcttgcctgtgcccgcattggtgctgtccactcggttgtgtttgctggcttctcagcagattctctagcccaaaggattgttgattgcaagccgaagcttgtcatcacgtgcaatgctgtgaagcggggagtcaagcccatctttctcaaagatatagtggatgtggctttggtcgaaagtgagaagaatggagtctctgtaggtctctgcttgacgtatgaaaatcagtca

SEQ ID NO: 21700 - DNA, 361 bp, Sorghum bicolor
  Clone ID: 13317635
gcacgagggttctttttgctcactgcttgctcagggtacctcaaggacgggcgcgtggtggcggtgaagcggctgtacaacaacagctaccgtcgcgtggagcagttccagaacgaggcggccatcctgtccgggctgcgccacccgaacctggtcatgttctacggctgcacgtccagccagagccgcgagctgctgctggtgtacgagttcgtggccaacggcacggtggccgaccacctgcacgggccgcgagcccccgagcgcgccctctcgtggccgctccgcctcagcatcgccgtcgagtccgccgcggcgctcacctacctgcacgccatcgagccccccgtcgtgcaccgcg

SEQ ID NO: 21701 - DNA, 479 bp, Sorghum bicolor
  Clone ID: 13317636
gcacgaggcttcggctttgctccgacgccggcgagcgagaccgcgcgagccaccgcggcggcggcggtttgcggcgatggggtccatgacgatcggcgccaagtacaagaccacgatcaaggaccccggcaccccaggcatcctccgcatgaacgatgataggttcaccttcacccctaatgatccacggtcggcaatgaagttcaatgttgatttccgaaccatcaaaggtcacaagttcaacaaagtagagggtaacaaagcagcattattgaacctttcaaaagaagacaaggctggaggctacatatttgagtttgacaatgttggtaaccgcgacctatgtcgagactttgtagctagggttttaggcaaacatcaagggacagtgcctcctagaccaactgtggctccagaaaactcagttgcttctgctgctctggaacaactcagtgttgctgaagtggagagacgggtga

SEQ ID NO: 21702 - DNA, 409 bp, Sorghum bicolor
  Clone ID: 13317644
tacttgatgaactttgcgacttaaagagaaaggaacaaatgctgcaagatgcaaacagggttctgaaaaggaaggtaagtgacagttgaactggaaaactcgtagcacgcacggttggcactggcagtagtagcccatataaacaatggtccttcagctacctctgcatttgccaccacaactttgaagctgaacgcctgaaccgatgatgccatgtgtatatgcagttcatagctgcagtctctgctttgcaacattccaactctcttttgcattttttgctggatcgtttattgttgggccactatttgtttcagctggacgagtttgaggcagaggctgcttctcccccgcagctagcgtggcaagacgggggcgggatggttgggccatgaccctccacagcccg

SEQ ID NO: 21703 - DNA, 443 bp, Sorghum bicolor
  Clone ID: 13317645
gcacgagggaacactggcaaaccaaagggatttgcattgtttgtttacaggtctgcagagagcgctcgccgtgctttggaggagccaatgaagaattttgatggcaagacactaaatgtgcagaaagccatagatgggaggaccaagggctcatctggagcgaatacaaatgctaactccaatcccactactgcatctgtggccgccgctgccgccgccgcagcgcagatgactgctcctgccagtgccgccattagcccatatgatgcatcagcatatggtgctactgcggttcctgacatgagttttgcacaacaagctgctatgctgggattaggtgcacagcaacaggcattcgctcaacccaatgcaatgcttgccatgatagcggcaatgcagaacccagctgcactagggatgacgccgccatgcttgctgctatg

SEQ ID NO: 21704 - DNA, 462 bp, Sorghum bicolor
  Clone ID: 13317648
gcacgaggacccccgaaggcgccgcccctcgtctcttgactcctcgagccttcccgtcttcccccttcatacgcgccctaaccctcgcatcctcttccttgccgccgccggggccggtctccgctgcccgccagccatggaagaggactactgcgtggtgtgcaccgaggcgctggagtgggtggcgtacggatcgtgcgggcaccgcgaggtgtgctccacctgcgtcgcccgcctccgtttcgtgatggacgataagaagtgctgcatctgcaagaccgtctgccccttcgtcttcgtcactaaggccatggataaatacactagagtggtgactgatttctcagtgttccccagtggggtgaatgagggcaaagctggggatttctggtaccatgaggatacacaggcatactttgacgacgcagaccactaccggatgatacgggcaatgggtcgact

SEQ ID NO: 21705 - DNA, 444 bp, Sorghum bicolor
  Clone ID: 13317657
gcacgagggctgatccaactccaagctagcagctcagctctccacccccttttgtgctgtgagctgtgtattcgttgcatgcatgcccttgctgttcttcagtttgttgcaacactactttgctcgctccccttctccttcgctccttctccttgttgttgggacaggcagttagctaggtgagagtgcagtggagctcatcggcgatagcaatggaggtagaggcttgctacaactacggcttccctcctgcagacagaggcagaggcagaggcagcaggcaccaaccaccacctccaccatcatatgggcatgggcatgggcatggcccccttactcacactgcagctgcagaagaaggtgagttgtgggagtacttcccttgccctttttgctacatcgaggttgaggtgccctgcatctgcaaccaccttcaggaggaaa

SEQ ID NO: 21706 - DNA, 531 bp, Sorghum bicolor
  Clone ID: 13317670
gcacgaggctcattgcaggtgtggacaggttacttagctctcaaaacgaggagttggcagaaagcgacgtttacatgtcttaccttcctcttgcacacatttttgatcgtgttgtggaggaattgtttattttccatggtgcctctattggattctggcgaggggatgttaagctgctagttgaagatattggtgtgctgaaaccaacaattatgtgtgctgttcctcgggttcttgatcggatattttctggactacaagctaaaatatcctctggtgggtttttaaagagtacactgtttaatgttgcttacaaattcaagcattttagaatgatgagaggagctaagcacaatgaagctgcttccatatgtgacaaagtagtttttagtaaggtgaaagagggtcttggtggaaacgttagagttattttatctggagctgctccacttgctacccatgttgaagaatacttgcgagtggtgacatgtgcacatgtcttacaaggatatggtctcacggaaacttgtg

SEQ ID NO: 21707 - DNA, 470 bp, Sorghum bicolor
  Clone ID: 13317682
gcacgagggcggcctcaccagtctcagggagctctacattggctactacaacagctactccagcgggataccgccggagttcggcaacatgacggatctcgtccgcctcgacgccgccaactgcgggctctccggcgagattccgccggagctcgggaatctcgagaacctcgacacgctcttcttgcaggtgaacgggctcacgggcgccatcccgccggagctgggccggctcaggagcctcagctccctcgacctgtccaacaacgggctcaccggcgagattccagcgagcttcgccgcgctcaagaacctcactttgctcaacctcttccgcaacaagctcaggggcagcatccccgagctcgtcggcgacctgcccaacctcgaggtgctgcaactctgggagaacaacttcaccggcggcatcccgcgccgtctcggccgcaacggacggctccagctggtcg

SEQ ID NO: 21708 - DNA, 557 bp, Sorghum bicolor
  Clone ID: 13317685
gcaggaacaagtctgactggtggtagtcagatacgtaattcacaggtcggtgggaattcatcaagcaaattaccctcaatcattcctctaaaagagccacccattactttgaagccatcagaaactgagcaggatgcaacagaggtagccattgtgaaagaattgatcaaatcctactatgacattgtgagaaaaagtattgaggatgcaatcccaaaggctgtaatgcactttctggtgaaccatacaaagcgggatctgcacaactttttaattcgcaaactatacagagagaacctgctcaatgaattgatgagggaaactgacgaagtacttatcagaaggcagcgtattcaagaaatgcttgaaattcttaaacaggcacataggacacttgaggaattccccattgaagctgataatattgagaagggctacaaccttactgaacatgcaactggcctgtcaaaaatccatggagtcagcggggacagcacaaatggcatttacacatcctcccctaattgctaccctccacatcaagcgtctcatatggt

SEQ ID NO: 21709 - DNA, 506 bp, Sorghum bicolor
  Clone ID: 13317686
gcacgaggcaggagttgtgcggacacaattcgcatctgggtaccccacagcaagctacgaattccgcccagagaaacggctaagggagttaagggaggatccacagagcatggtgaagcagctattaaccaagtgtgctgaagcattaagtgaggagaggatagaggagttccttacccttgttcagcaagctcgtggagttgtatcaattactggagagccaatccagcggttaggtgcttaccttcttgagggtttggttgctagacatgcaaactcaggcacaaacatatatcgtgctctgaagtgccgtgaaccagagagcaatgaactcttgtcttacatgaagattttatataatatctgtccgtacttcaagtttggctatatggctgccaatggggcaattgcagaagcattaagaaatgaagacaaaatccatataattgatttccagattgctcaagggacacaatggataacactgatacaagcgctcgctgcaa

SEQ ID NO: 21710 - DNA, 484 bp, Sorghum bicolor
  Clone ID: 13317687
gcacgaggcggcgcccacgtgcggtcctgctccacgctgtcctccatctcctccggcgcgcgcgccacgacgacggagcaggcgcggacgccgctgacggtgctggggaaaggcctcgccgcggaggccagcgcggaggagctgctccggcggtaccagctcggcgaggagctcgggcgcggcgagttcggcgtgacgcggcggtgcacggacacgtccacgggcgaggtgctcgcgtgcaagtccatcagcaagcgcaagctgcgcagcagcgtcgacatcgaggacgtccggcgggaggtgtccatcatggggtcgctgccggagcaccccaacgtcgtgcgcctgcgggaggccttcgaggacggcgacaccgtgcacctcgtcatggaggtctgcgagggcggcgagctctttgaccgcatcgtctcccgcggccactacaccgagcgcgcggcagcgaacgtcatgcgcaccattatgg

SEQ ID NO: 21711 - DNA, 395 bp, Sorghum bicolor
  Clone ID: 13317689
gcacgaggcggcttcgcgacccccggctgacgacgtccccgacgggaactcctcgcacctcctcgccgtccccgtccccatggaccccgccgccgaagacggccccgtcgccaagcaggtgcccgatgtggcgccgcgcccgccggagcgggacttcgccggcacgccctacgtgccggtctacgtcatgctcccgcttggggtggtgaatggcaacggcgaggtggtggacgcggacgagttggtgggccagctgcgggtgctcaaggcagcgggagtggatggggtcatggtcgattgctggtgggggaacgtcgaggcgcacaggccgcaggagtacaattggactggctacaggcgcctctttcagatgatcagggaactcaagctcaagt

SEQ ID NO: 21712 - DNA, 482 bp, Sorghum bicolor
  Clone ID: 13317693
gcacgagggttcctcttccatcatttgattcacctggtgagcggatgagaagccggagaaatgactcaggtgctaaccagtctgataataaacggcagtacgagcttgatgttgaccgcataatgcggggggaagactcacgaactacactgatgataaagaatatcccgaataagtatacctccaagatgctcttggctgctattgatgaaagtcataagggcacttatgattttatttacttgccgattgattttaagaataaatgtaatgttggctatgctttcatcaacatgaccaaccctcagcatatcatcccgttttatcagacttttaatggtaaaaagtgggagaagtttaacagtgagaaggtggcatcacttgcttatgccagaatccaagggaaaacagccctgattgctcatttccagaactctagtttgatgaatgaggacaaacgctgccgccccatactcttccac

SEQ ID NO: 21713 - DNA, 487 bp, Sorghum bicolor
  unsure (1)..(487): unsure at all n locations
  Clone ID: 13317717
ctactgcacgcgaaacgcctatataccaccgcaatgagttcatcacatattggcaagtancctgaaaacagtcttcgcaaaaatagtagacaatttcctcttgacagtcgcagtgccattcgccactgcagctgtcatcgtggcagcaacaacaagcaggtctgatgagttcaccactctgcttcattcagtcagcaacacggacgtgctctcaattgggctcctcttgggcacagcagcggtcgtagccatcatgcggcgcccacgggcggtgtatctcatcgactacgcttgcttccgtcccccacataccaaccgtgttcctgccgcagcctttgtggagcatgtccaacatgtcagccagttaactgaacgcagcaaacgtttcttgacacgtctttacgagcgttcaggccttggtgaggaaacatgcgtgcctctagtggggcactacattgacccggccaagtacagcaagtttgaggac

SEQ ID NO: 21714 - DNA, 446 bp, Sorghum bicolor
  Clone ID: 13317735
tttagctccaccacgagctcccactgaccgccaccgccgcgatgatctccctgctccgccgcgcactcgcctcgtctccggccgccacctgccggaggcccctcctcgccgcgctcctctctccgccatcggcacctcccggcccatgccaggcgcccacgccagggtcgccggcgccgccgaggcgggcgctccacggctcgccgaaccccctggggttcaggtccacccccgcgtcgtggaccaggcccggaccgggggaaggcgtgggcgtggatacgggggctgaggaggggctggagatcgcgaggctgtggatctcgccgcggatcgtggagaagctcgcggcgcggggcatcaccaagctcttccccatccagagggctgttcttgagccagcaatgcaaggaaaagacatgattgggcgtgctcgaacagggacaggg

SEQ ID NO: 21715 - DNA, 239 bp, Sorghum bicolor
  Clone ID: 13317741
gcacgaggcctcaatcaatccctctcccccgtttccaattggatcacctctgctttctccacgatgcccgggagcttcgtcgacgtcggctgccgcggggcgcgggcggtagcggccgggtggtggtcgcggcgccgggtgctggccggatcggaagatgttcatcccagcctcgcggtcctggcgcttgagctcgcccgcaaggccggcgccggcgccggcgccatggagctcctccc

SEQ ID NO: 21716 - DNA, 434 bp, Sorghum bicolor
  Clone ID: 13317744
gaaggtagtagtgtagtggcgtaggagcccagttggtctctgatctttccctgcaggggaaagagaagaacagagaccgagcttctcctcactcacacactagtgtatagggcttcggcttgcctgatactgtcgcaatggcaggagggctcttctccatggagcacccatgggtctctgcttttggcattctaggtacgctgctgctgcctgtgcaccaccaccaatactgaattgctcaccgtacgatacagctcgcatgcacggcagcacgatggcatgcgtgcccctgccaaacgattgctcatcagtgttgtttacaccgactgaaaaatactcccacaggtttactgacagaaattcccatctctccctttgctaattttcctgcaggcaacatcatctccttcctggtgttcctcgcaccagggtaa

SEQ ID NO: 21717 - DNA, 342 bp, Sorghum bicolor
  Clone ID: 13317754
gcacgaggaagtaacaggtcccagccatcacaaggacaaaggcctctttcttcgaagggtcaatattcagagcaaagaagagtacaggcaaagggctgatcgtgaagcgatgcaatcaacagtaaagagcaaggcaccaacaagtcaacctgcacgcctgtcaaatggatatggacctaagaacacagtgtcaactcaaaggcatgccgaaggtagggtagactccatgagaaaggaggctttcttgaatacacaaagggttgtttcacgtgacaatgagaggtcccatagtattgcaaaaaatggatccaaccaggcaagcactagcaaaaccacactccc

SEQ ID NO: 21718 - DNA, 522 bp, Sorghum bicolor
  Clone ID: 13317761
ttcggatcttcattgacagttcccttaagcatggacatgacatttctacttttcgtaaagaacggattggaggggattcccttggaatctcatactggtatgaagatgatgagattctcgggcatagattatatcgtgaaattagacgagtagaacaggtcaagaaggagccaggaaagaggtccaggggaaaaggaggatcttcagctatttcagttgtgtcctaccaatgggaaactgttgcgtccacctttgatgagtttgatgatgttgcagaaaagctcttttcaagtcggaacaggacagaggtatcacttggaaagaagttgaagattgagtatcttccagagatagaaaagatccataaaaagaaagagaggttgctcaaaaagcaacagagagaagctctccttcttgatagctacttgacatcagatggacttaccaccggccgctctctacgtgatagaaagcccgtgacttatacatttgatgactatgatcgctcaataaatgaagcca

SEQ ID NO: 21719 - DNA, 496 bp, Sorghum bicolor
  Clone ID: 13317772
cttcgatcggatgcccaaatccaagtgctgtggtgcctttttgtgcgcgtaggagtatgttctaggatctagagtactttacatacaggctgggacaaagatagatggccagatttgcttttatctaaagcgcgttctctgtctagcttgagcttactgattaagaaatgatcaattgaatgggtatacgggatttcgtggaacaagtatacgagttggcgtagcatgcttttcattgaacaagtatgagtatttcttatttgacagaatcaaccagtgcatggagtagcagagattcccaccttctctgatctacctcttgggtacgaatttaagcttgtcgaaacaatggtcaatgcgggaaattggttttctatatttccatttacttcagataaaaacgattctatggaactcacaaaatggacaacaattactcttactattttgttctacaaactggaactcacaaaatgggcaacgatattactgttac

SEQ ID NO: 21720 - DNA, 341 bp, Sorghum bicolor
  Clone ID: 13317787
gcacgaggaaccgctgctcaatccgctggccatggcgctgctgatggaacccggcgctgagcccctgactgagagcgagcaggccgacctggccggcatcgccgccataaaggagtcggctgcgcgcgaattcaaggagcaggggaaccagttcgtccggatgggccggaagcactacgccgaggcggtctcctgctacacgaaggccatcgcccagatggagcccctctcctcgctcgacgcatctgccgccgccgacgcctccgttctcttcgccaaccgagcacacgtcaacctcctcctcggcaaccaccgacgggccctcgacgacgccgagcagg

SEQ ID NO: 21721 - DNA, 429 bp, Sorghum bicolor
  Clone ID: 13317789
gcacgagggcagcgtcctcctgggcgcatcgggtggctcacgagctcaagaaggttcagagccgctccagctttgccgacgagatccagaagctcaagaggcgcctcaaggaagcgcaccaacgggtcatcgacgccattcctgttgcttgtggcggtcaacccagcggactgccattgccatcgatggtggcctcctcgaagccatgtcgcgtgacgcgcaacccgatcggcatcgagaaacccatggaggaggtacagttgcttctggatgaggtggacggtgagccgcagcagctgagagtgatctccatcgttgggttcggtggcatcgggaagactactcttgcgagggcagtatacgacagccctcaagcaaaggaaaagtttcagtgccgtgcttgggttgctgccaccggtagcgatagct

SEQ ID NO: 21722 - DNA, 515 bp, Sorghum bicolor
  Clone ID: 13317813
gcacgaggatacaaatgaagcagatgatgctaacccttatgtgacttcctttcgtggcattgataacaaggtctattacatgttagatctcaacaacaatgctcagctgctgaacttctcgggttgcgggaatacactaaactgcaaccaccctgttgtcaaggagcttgtactcgacagtttgagacattgggttacggagtatcacatagatggatttcggtttgaccttgcaagtgttctttgtcgtggaccagatggcagtcctcttgatgcacctccactcattaaggaaattgccaaagactctgtattgtctagatgtaagatcattgctgaaccttgggactgtggtggcctttatctagtagggaagttccctaattgggacaggtgggctgaatggaacgggaagtacagagatgatattcgaagatttattaagggagatcctggtatgaagggggtgtttgcaactcgtgtttctggttctgcagatctctaccaggtgaaca

SEQ ID NO: 21723 - DNA, 311 bp, Sorghum bicolor
  Clone ID: 13317828
gcacgagggctcgtcggctcgtcatccccatcatttcatctcgagtctccattccatcctccccaaattcccccaaattgatctcccccggaccctcgaatccccgcgcccccccgtctgaatccggcgcgccccgccccgatccgtccgatccgcgccgaatcgccgccgctcggggcggaaccctagcccgatctcgacccgtttccccgcgatgggcgccggccgtgtctgccgcggcggcccctcctccgcccaccccgccgccggcgcaggcgcggggcggccgttcccgccgctcgccgcgttct

SEQ ID NO: 21724 - DNA, 314 bp, Sorghum bicolor
  Clone ID: 13317831
gcacgaggcctccctccttccctccctgactctcaccgtattggtgcctataattgcctagtatacctttttttgttcttttccctgcctcgtgctaatccacgatttgcccaggtctcgcgtactgtattgaatttgaatagtggcccatgttttggctgcttccacttggatttgtgggcatgtagagtgaattctgctggatcaggcccccccccccccgcggaaaagattagatttgtgtgtatgcgtgctcgaggttgtactccttttggtaggttcagactgcaggacatgttgctcgtacggttaat

SEQ ID NO: 21725 - DNA, 493 bp, Sorghum bicolor
  unsure (1)..(493): unsure at all n locations
  Clone ID: 13317833
ggaaaagtgcaccgaagctagttgaaatcccattcaagcctgcccgcgtcctcctccaggattttactggtgtcccagctgttgttgatcttgcctgcatgagggatgccatgagcaaacttggcagtgatccgaacaaaattaatcctctggtacctgtcgaccttgttattgatcattcagtacaagtcgatgtggcaagatcagcaaatgctgctcaggcaaatatggagcttgagttccatcgtaacaaggaacggtttgggttcttgaaatgggggtcgtctgcattccgcaacatgcttgttgttccacctggatctggcattgtccaccaggtgaatcttgaatatctggccagggttgtgtttaacaatggtgggatcctttaccctgacagcgtcgtaggcactgactctcacacaactatgatagatggtcttggagttgctgggtggggagttggtggcatanaggcggaagctgcaatgct

SEQ ID NO: 21726 - DNA, 271 bp, Sorghum bicolor
  Clone ID: 13317838
gcacgaggtgcatttgatcctcgtcgatggcttgctcctggacagctgtccagccgtccctgtccttgtgaatgcccagtaaaatctgaggttataactgaggatattcacagaattgatgacaaatctataattataggcaaggcgtgtgacaagggacacagatggatatgttctaaaaccatctctgattgtgttgaggctataattggggcctattatgtggaagggggattaaaagcagcttttgctgttctcaaatggctgcaga

SEQ ID NO: 21727 - DNA, 442 bp, Sorghum bicolor
  Clone ID: 13317863
gcacgagggtgccccaaatttgctgtcgcgccgatcccgccgccgcccacgcgacctcacctgtcgccgaggactgggcgcgcttccacccacgccgccgcgcgagttcgccgtcccaggccctcctggagcttcatacaggcgagtaacgttggtgggtgattgacaagagaagggaacaacatcgaataccatgagctcgtgctgcccttttgcaggagctaccactggtggcggcgtatgccctgtgaaagccaccgatcagagcagcgctgggttatgccccgcagcaaaatctgacaagagcatcactggtgtatgccctgtgaccggcaagggtcatggcagtgagcacaaggaaagtatcgatggtggtgaagaaaaggcaccgatgatcctcgtatggtgccggcaaagtgcccgtttggctacgactccaaca

SEQ ID NO: 21728 - DNA, 519 bp, Sorghum bicolor
  Clone ID: 13317868
gcacgaggcacaactgtaacggaagtggatcctgagatacgaatagagctcattgatatttcagagataaggctgaaaatatctctggaaactgcgcctaatcaaagacctcgtggtgtcctaggcatatggagccccgtcctatctgctgtgggtaatgcattcaagattcaggtgcatctgcggaaggtcatgcacagaagccgttttatgcgaaagagctccatcatccctgctatcatgaaccgaatcaagagagatctgattcacaatccactgcatctaatcttctctgtggattttcttggagtgacaaaatcaactttatcatcacttagtaaaggatttgcagagctctctactgatgggcaatttcttcagctgagatcaaagcaggtttggtcaaggagaatcactggtcttggtgatgggctagttcaagggactgaagcatttgctcagggtttggcttttggggtttctggtgttttaagaaagccagttgagagtgccagacag

SEQ ID NO: 21729 - DNA, 433 bp, Sorghum bicolor
  Clone ID: 13317870
gcacgaggctccagcagtccggcgcagcttccgttcccccgccgtagttcgaccaggcggccggagcgcgacgcgctcgtggtttgcagcatgtcggcgcaggcgggtacagggacgtactccccggcggtggccgcaggggacaagcggcgggagaggaaggaggagctgcggcgccacctcgtcgaggacgccgactggccccgggccgacggccgctccttccacgactgccggccagcgtttatgcagacaggaccaactactgctgcatcagggtctgcttatgcggaatttgggaagacaaaggtcattgtatcggtgtttggaccaagggaaagtaaaaaagcaatgatgtacagtgatattggtaggctcaattgcaatgttagctatacaacctttgccactccagtgcgtggacagggagcag

SEQ ID NO: 21730 - DNA, 519 bp, Sorghum bicolor
  Clone ID: 13317879
gcacgagggttgagatggcaggctgagaatcaggctgaatttgagatcggggtcaatgttccggatgctgagccagttccagaccccttggtttctggtgttgtggatgaggagcatgatctggaaaggacagatgcgcggagcggtggcggcggttcgatgagtgacccggttccttccatttatgacattgtggatgatgatttcgctaccattgctgggatctttaggaggaggattcctgaggataatcgacctcagggtacttcagctggatctcagtgtccaaggtcgacccagggacgagacaatggtcttgcagcctatcatgctcgcattcgccttgaagttgagagagctagaacattgcgcaattctcgcaatcttgataagcgcataagggagctgcgggagaactgggcggctctgcgtgatggttctgtggggtttgctccgcatatgcctggcagaagaaggaaggatatggctggttctgcttctgttcctaccgagcatcag

SEQ ID NO: 21731 - DNA, 441 bp, Sorghum bicolor
  Clone ID: 13317884
gcacgaggcaaaggttatggctagaatggcctctgcagatatcatgtgtgttgactcaaaggctatcaaagaaaagttcactggcatgataaggcagcaagatgttcgtgcaactgaaattgacaaggttgatatgtaccagtcatatcggcctggggacattgttaaagctatggttgtatccttaattaggcaaatgatgcagtacaaataataatctgtgttttcttctcttgttatcaaccttggttaggttcacttgcccttgggttatccacatctacctgcttcaactgttgttatttttttaatctttaaacttttgctttaaatatctttcctgtttggagtagttaatatttttgtctgtctttggatccttaaatgatgccaaagctttcccttggtgatgcaagggcatattacctttccacggcgaac

SEQ ID NO: 21732 - DNA, 501 bp, Sorghum bicolor
  Clone ID: 13317890
atgctgaaatatttcaggatggtcaagaaaccatctcaactgaagaaattcaggataatatttgtgaagcgaatggatgtcttccattagagtacaaggtggagggccaacaacaacgtggcgtacgaagacgctgcctggtttttgaggcatctgggttttcaaatagtgttgtgaaaaaagggactgttgaaaatctctctgtctcaacatgtaaaggcaaaagtcctgtacaaacccaaccacgtggattgcgaggcatcggtctacatttgaatgcccttgcattaacaccaaaagggaaaatggcttgtcaggatcctacagcttctgctttgcttccgtcatcagcatctgaaaaggatgtgcatggcaggttgctttctgcaggagagaattttacacattcaggtggtgaactgttagaattccccgtggatgattgctcagctggaggttttcctgtaaatgatcatgtttcaggtcaaagtgtcagccctc

SEQ ID NO: 21733 - DNA, 533 bp, Sorghum bicolor
  Clone ID: 13317896
cttaaatctgaaggagtaccagtctaccgttgtgttcagcatgagggagagtttgtcctgacattcccacgggcataccatgctggttttaattgtggcttcaattgtgcagaagctgttaatgtggcacccattgattggttgccagttggacaaaatgctgttgaggtttatcgtgaacaagctcggaaaataactatctcacatgataagctgttgcttggggctgcaagagaagcaataagagctcagtgggacatcctatttctcaagaggaattctgctgataacttgaggtggaaaagcgtatgtggacctgatagcacaatatgcaagacactgaaggcacgaattgaaatggagttggcccaaagacaaaatatatcctctccatgtcaatctaggaaaatggataccgaatttgattctactgatagggaatgtgcattgtgttactatgatctgcatctttcagcttctggctgtccatgctccccagagaaatatgcttgcctggtacatgcaaaacagct

SEQ ID NO: 21734 - DNA, 200 bp, Sorghum bicolor
  Clone ID: 13317903
gcacgagggttcctagtaccaatgatgtcaacacgtctatgggtctggtgtgatgagtattgagtagttgtggtccattttcttgaatgatccgagaacttgataactactgatacgcaacctgacgacgaggcagtgcaccgtgagttcggcacatgcaatgaactgccggcacaattacccttccatgcaccaaagga

SEQ ID NO: 21735 - DNA, 542 bp, Sorghum bicolor
  Clone ID: 13317909
gcacgagggtgactggcatggaaccatcagatgaacctatacttcgtgttaattgcaatgaaacagcccttgtgcttggtggagctgcttctgccgcaatccccccttattccttctttgctgcttctggtaattcagtacctttgcaaagtgaaatagtggagcatttagcatctatcattgcgccagcattgtgcccttcggatattttaccaaaaatcaagttttctacttttttatatggcccgtcaggatgcggaaagcgcacagtggttcggcatgttgctaaccatcttggtctgcatgtggtcgagtgtagctgtcacgatctaatgacgtcatcagaaagtggggcacctgctgcacttgcaactgccttcaaagaagctcagaagtattctccttgtataatacttcttcgccactttgatgcaattgggaatgcatcctccaacgaaggtccacagtctgagcaatctgggattgcatcgagcattgaatctatcattaagcagtacactggacaatgttgggttgctaag

SEQ ID NO: 21736 - DNA, 368 bp, Sorghum bicolor
  Clone ID: 13317918
ggcactgcaagaggtccgggaaggagaagaacctgaacgcgtttttcgagctcgccacggcctgctgttccccgtcgccgtcgttgagacccaacacgaggcagattctcaagaggctcgaggagatcgcgagatgaatggatggatgagtaggtctggcaacttgctacttaatcagcattgctatctattgcagcataccgtcgatctgagaagtgggaagcgtacgtcctgcccgagctaaatgaacaacgtgttttgtggtgggcggttggggaatgggatgcatgttttcacatccagtccaggattaggaatctgtactgtacagtttcaccgagatgcagaggtggtggtcatatgaaaac

SEQ ID NO: 21737 - DNA, 648 bp, Sorghum bicolor
  Clone ID: 13317928
gttttctgcagttagttgtgtgctctggttgacctcctgcagcctcctcacagttctgtgggcactacttattggtctacttgcaaccttgctacatgccagcttcagaacacctaatctgaaggcacgtctgaacacattcagggaggaatttcgagcagtatggcggaactacagtgagctgtaaatgtctggtttgcccatgttttcgtcacaagagaatgatcagccaagttccaaaacttgattgttgtttgtgggcctcgagagaaatttcaccaaggtcacttttggttttccattggattgcccacatttatatataatatcattagatggtgaattggtgatatatctcagtgcccaccccctagataagcatctctataatttgatattcatttctagattttggggaaaacctcagaaactcctgctacgttacctcacttgagagttggacgacaaattatggcatacattgggcaaaaggaaaagagaaccccgagctttgttactggtgtttggtttaccctttggctctatgggttatgacaatgtttgcagactggatgtaagccggttcgtgtttaccgacggcatttgtaagaagttgatatgtgaatttggttgtaagagccatcatat

SEQ ID NO: 21738 - DNA, 248 bp, Sorghum bicolor
  unsure (1)..(248): unsure at all n locations
  Clone ID: 13317941
acgtcgtcgtgggcaacgtcagcagctccgaggcagccaaggtgtggggcgacaagtacttcaagggcaacttccgnaggctcgccatggccaaggcccagattgaccctcacgactacttcaggaacgagcagagcgtccctccacttgtggcgagcaactagtcacggtcgatggcaccgtatgtctgcatgcttatcctttatcaacgtgtcagacttagtacttctatatttaatgatacctgt

SEQ ID NO: 21739 - DNA, 623 bp, Sorghum bicolor
  unsure (1)..(623): unsure at all n locations
  Clone ID: 13318035
ggttatataatttctggtggacgcatgctttttcatatataaaaagaaacaatgtttttcattagctgcactgcacaaggcccatgctggatgtggggtgagattttttccctgctccaaacaaacaccgtatgcagctaaacaatgcgctgaacaacttcaagcctgtgggcaagcttttagctcacattttgaaaagatgccttagaaatcttgcatcttcgagttggatttgtcaaagcgtctgtagtgatcgcttgtttctgcatgcagtggcttacctgttggtttgcatcagtgtccgttggttctaatcctttccccccagtatccctcatttccatcagttgatgcattcctgagtgtcatcctgcagtatcatatcaattcgtgcaacagcagagaagtgtgtttgttgtcaactggattcacttaatatttcttctancagtgctgagtacctatcatttccaaatcagttcatgcaacagagtagtgtcctgcaacccaaacctcatgcagtcattcagagccaccctcatcgttaattttatgcacaaatgtggtcaacaatctcgatctgagcttaaaatgtactccgtaccatttgtcgtacttactgc

SEQ ID NO: 21740 - DNA, 642 bp, Sorghum bicolor
  unsure (1)..(642): unsure at all n locations
  Clone ID: 13318044
accttgatgttcgtcaatgtcacacgtgctgatggagagattgcaagcaaacgcaaacttggttctggtttcaccattacctgctggtctttagggacgccgttgagctccaaaagtataggctgggtgaaggaaggtgccatggaagcaggagaaatctggagtcagtatccaatttttgatcctcatattccctgcctttctccggagttcccatttgtaagcctgaatgaacacagcatcatttacgcattattgtgtgagagggaatatgctgctggacgaacatgggtgcttgtgattgacattaaaagaaagaaactggaattggtcattccctataatgatgtgaattcctcttgtgaagatactctggtgttggaggacatcctcattaattggccccttctgcctagtatgttctccatgtacttgaattcacatgcttcctggaagactcatgtgctgaatatggcgcatctggcgtataatgcatcttctcgccatcaactatgatgctcagggcggtctaggattggaatgaaggcctggaaatatttctattttcgcaactatgtttcagttaacaggttgaacgactaagagtggaactaccgtttgatgctcactggtgatacgggn

SEQ ID NO: 21741 - DNA, 565 bp, Sorghum bicolor
  Clone ID: 13318049
gaaggttttgttccgcccctatgaagatattctgggaattgggcactcgatgggcttttcttccatacttgttccaggttctggtgagccgaactttgatacctttgttgacaaccccatggaaactaccaagcagaaacgtgagaaggaggtacatgctctccttgataaactcccgccggagactatcatgctcaacccaaacatgatagccactgtaagagctccaaagaagaaagagaagaagaccaagaaagagattgaggaagagatggatgatgccattgaagctgccaagaacattgagcgcaagaagaagaccaagggtaggagcaaacccagcaagcgggccaagaagaaagaggaagatgttttcaaagccaagaggcccttcctggagcaatccgaggagatcaatggacgtcctgacaagaagcagcggataggcgaagaggtcgaactcccaaaagccttgcagcggtttgccaagaaaccacagtcatgatcatagttaacactgttgggatttcacattcgttatgcgtcgatagtgagtctttatgat

SEQ ID NO: 21742 - DNA, 643 bp, Sorghum bicolor
  Clone ID: 13318056
aggctcgtcgggacggtgccacggggagcacagcaaggacggcagcggccgcagcggccgtgcaatgccggatgcagcgaagcgattgccgtctgttggaagatcgtgcttcagcagcaggaatggcaggggaaaggattcgattcttccaatgtgaggttcttcttcgtctgactagggatacatgacatggatacttctttttttgtgcgcgtgtgattccggtgaagatcaaggtgccagtaccaaagtctgcagatctcatgcatcctgtttccatcagttcctatgaattgaattgtggtaacactgtggctgcagacagaaacccatcgtctgcaactacaacgtttggtgactggtgagatctcctacactgcacctgcttggtgtttctactggataaaattgtatagggcttggaacacttctttttacctctttcttccgtctcaacaagattggattcaagttcagagaattctccctgcattagtgagttaagtctcttagaccataggttttttctctgggtgagaagtcagtcagtcagtctccgcactggcttcttctaatagttgtcaacttagaagttagaacaatcatttgctgatgtgtgtgttgaacttgaaaagggaaggtg

SEQ ID NO: 21743 - DNA, 143 bp, Sorghum bicolor
  Clone ID: 13318062
gtaccattcatcaacttccctccaattcagctttgcttatacaagaaatcaaagttgtattctctaaataagtgtaaagagttcattgtcaaaaaaaaaaagtgtaaagagttcagatggccatgtggggtggtttgaccttt

SEQ ID NO: 21744 - DNA, 482 bp, Sorghum bicolor
  Clone ID: 13318071
tcttcgtttggcgagaaagttgaagaaaatagatggaaagaaaaatcttgtgaacttggtggcactgggagaacgctatggtctcagttcggaaggcccatctcatagagcaatgccagatgtggaagcattatgcaacattctcccaaaaatcactctggatttaaaattgacatgtgacgatctaatgaatgaggccatgagatttagtgatgtcagaaaggcttcttgaatatggtttccgatgtcctggttgttttagttataaacatatttgacatatcatttagctgattgttgttgcaaatggtgtagtttataaaattctcaatgaccatagcgttcttgttttgaaaggcttatggtgatttcatagattatctaattctcaatgtttatggtgtagtatgtcaaattctcagtgcctatggggatttcttagttatcctacttgtacttgctttactcatgagttgatgtga

SEQ ID NO: 21745 - DNA, 208 bp, Sorghum bicolor
  Clone ID: 13318111
gctcagtatcctagtcgcagggggttaacggtgtcacagcctagttttgttcttgctcttgatttgccttccctagagagtagtagcaatctcaaaatgtggagtactactactgtcctcacttgtcatgtcgccaaaggctctcttcttcttctttttcttttttttttttttggcatgggattgcttgtagctggagtaggtttgg

SEQ ID NO: 21746 - DNA, 552 bp, Sorghum bicolor
  Clone ID: 13318125
tgtccctcttcttgcacacaaatcaaatcttagccttttatcaaatgatatgaataagaagatgcacaacacactaagtggaagcaaaatcgcagtcaagttcttgcttaaccagcaagatgcagaaacagttgatctggaggcgaagaacatgtatggagagactcaacatatggcagtgaagaacagttcttgcagatcaacaaatctactctttgatcatggtgcacacgtagaaaccaaagccaatgtatgatctacctgttttgggttctacctaggttctgaaatagaagtatagaacctttgtgagcctttagtttgtactggtaattggctcacatgctagagtaacaactaaacttcaacagctttaaagtttcttccttgactatagaatatgtttccaatgtgttcatgcatgcttgtgcaacagtgctttgtatcagatttggacaactcactcgtattgtcgggtataagcagtttattggaaagttccttttatttgtgctatgtattctatgctgatgtaatgtgcataaacatttg

SEQ ID NO: 21747 - DNA, 552 bp, Sorghum bicolor
  Clone ID: 13318136
agccacggccagagcagcgggcgctgtcgcgagggtcatggcgaggaggcggtccagggcgctgagggagatggtgccgggagggagagggatggtggacgagtggacgctgctgggtgaaaccctagactacgccgtgtctctcaaagctcaggtcgatgcgatgcagctcctgttgaggactctccagcaggccccccaagaaccctgctctgctgaagcagccgtgaggggaattcggactacatatatataatgaaatgtgatcaagatcgtccattattcatggataagacttgtaagataaaattgagagttttctcccaccttcctatcctctcctgcatactctttttttttttgtttcttctgtagcaatataatgagggatcatgaggcatgaaaaggtcatgtgtatgtcgtatatgtacagtacccgagtgtgctatatactatatatatgtaaatgtaaatacggttgctctttaaacaagcaaacatcaatgtacagtttttatgtgatgtacctagcttttgtattaggaaaaggaa

SEQ ID NO: 21748 - DNA, 618 bp, Sorghum bicolor
  unsure (1)..(618): unsure at all n locations
  Clone ID: 13318162
actctcagcgtgggcaaagcagcggcatgacaagaaacctcagctctccggcatcacgccatatccaagacgagctctcccagatgccccacgacatgccaggccaggtgagctttgcttacaatgggctccccacacaccacggtcttgcgctgtcacacccccagcaagctgaagcagtcagcgccggcattggccttggcggcgtggctgccggcggtggcggcgtttccctcacactcggccttcaccagaacaacaggacttacattgccgagccacttccggccgcgctcccgctcaacctcccgcaccgttttgggctggaggacgtgagcgacgcctacgtgatggggtcattcggcggcggccaggaccgtcatttcaccaagggaataggtggccaccatttgctccatgactttgttggttgatctcgtattggaagtgtgttgtcagcatgcatgtattgtattattaggggtaggacagtcgaagagaccatttaatttggtcgtccatgcatccaagaatgctgtcgatatttgacaatgtgagggctatagagggcatgacataccgttgaagttctgttnccagttgtatgttgtagagttg

SEQ ID NO: 21749 - DNA, 652 bp, Sorghum bicolor
  Clone ID: 13318178
tcgtataaggatcatttgcaagagtgtcagactcctgtccttgcattggctggagataaagacctaatatgccctcccgaggctgtttatgaaactgtgaaactcattccaaagcacaaggtgaactatagggtgttcggaaagccacaaggcccacattatgcacattatgacttgattggaggtcgactggcgaccgatgatgtgtatccatgtatcatagagttcctctctcgccatgatggttgttgatttgattatatgatgctaacaccgggtaacttaacatgttcatctcaaaggttttaaagttgagctgaacaatcttttccacggtcttctcaatcaatggctagaaaataggtgaacgcacgagctctcgtgtgtgttggagaaaacaaatacacgagctcatctgatgtatccttgtaacaagcgtcggttagtgcttctctctttccccttttgaggaaatgttagtggtaattttgttatggaaaaaaggttgaaaaaattacagtagttacatgtactcccaggaacaagaagccgaggttgtaccatggatctcatactacgatgtaaccttttgtttgttgttttttgaactcaggcggatactatgttgacatgcaagaatgtataaaaactg

SEQ ID NO: 21750 - DNA, 574 bp, Sorghum bicolor
  Clone ID: 13318200
gcacgagggcggtcagttcactacccttctttccgcacctctactgtatttctgttcatccgcaattccttttactgaatacttctctttctttttattctctcttttatcctcaaaaatttctaggatttggccgacaagattgtaatccctaccgatcaaccccacctccaatgtcttggctcgctaggaaacccagatcccaccgatctgataaacgtagagacaaacagagttccttttaaagccgaaaacttctccttagatctatggaaggatgccttccgttcttggcccaatcctaccaagggatggaaggattggttcttgacagtcagccactcaaatgaggttcaatggggcgagcgaaaattggatcagtgcattaggttgtcctttgccgttatggagaggaacgagtcactgttaattgctgcctcatacttttggtcagacacgctcaatgcttttgtgtttggccatggccctgcttctcctacacttgccgatgtgctcatgctcaccggcctagatatatccactgccgataacagtcatctttttgacaccaaac

SEQ ID NO: 21751 - DNA, 608 bp, Sorghum bicolor
  Clone ID: 13318212
gcacgagggctagggtcttttgcacttcggaattcgttgtcgacggtgagctcgtaggcactgtcggcggcggcggcggcggcagcgatggactggagttctgtgacggcggaggacctcgtggacgcgctgcgagaggtggactggtcaacaccgccgcgccccgtctccgaattcttctcccgcttcaccgctccccgatcctactccaagtggaccagccgtctcaagtgcaacctctactactatcggaccaactacttcatcttgataatattccttcttggaatgggctttcttagaaagccagttgccatccttgcagctctagcaactggcctcagcattgcgtttctgaatgacagttttgcagttactttcaatgagaaaatcacaaggagtgtcagacaattttcaccacacttagccgcaaagatgaggccacccataacgcctgtcattcgagggcgaccaagtaaaagaagatcaattcatatatgtggccgacctcgctggatctttgtcctgttgttttctgcagttagttgtgtgctctggttgacctcctgcagcctcctcacagttctgtgggcactacttattggtct

SEQ ID NO: 21752 - DNA, 270 bp, Sorghum bicolor
  unsure (1)..(270): unsure at all n locations
  Clone ID: 13318226
ccagcggcgaccggctggcgttcccggccggcctgtgcccgaccatcggcgtcggtggccacctcagcggcggcgggttcgggatgctcctgcgcaagtacggcgtggcggccgaccacgtcgtcgacgccctgctcgtggacgcccggggcagggtgctggacagggacggcatgggcgccgacgtcttctgggcgatccgcggcggcggtggcgccagcttcggcgtcgtgctgtcntggcaggtcaggctcgtccccgtcccgcgcg

SEQ ID NO: 21753 - DNA, 580 bp, Sorghum bicolor
  Clone ID: 13318232
gcacgaggcaaaattccttttctcatatctaacttgtgaaattttgttttttgtaacagtagactggtgcatcggcaaagaccaagaggactcaaacatcgggagccgatgccccccagcccagtcaggctccacccaaaagaaaaggtccaaagagcaccaagacccaggcaaaacgacagaagacaacaccatcctctccacctcgtccagtatctccgatccaagtagaaccttctcctcctcgatcggtgccccagccgcaagaagttccttctcctcctcgatcggtgctccagccgcaagaagttccttctcctcctcgatcggtgctccagccgcaagaagttccttctcctccacaagcagatccaaccgatgtatctggacagacgaccaacccagtagatctgggcacctcatcggttgtccctcctgagcagacaatcactattcctcctcaaggtaaagtaccgattacagaatcattaccgatgattttataaataccattgtgacccctggtaatttccagctgaagatattccatcggcagctccagccgatcaaactatagtgc

SEQ ID NO: 21754 - DNA, 167 bp, Sorghum bicolor
  Clone ID: 13318234
cccttgccgtacgctctgcgtcactcctctgtctcttgctgagttgcttcccttgccgtcggcgtcggaggcgggagcttctcggcgggcggcggcgcgcggcgccgggcgcggatcggccgcgggtgcatggtggaggccgccgccgggcgccggccaggcaccag

SEQ ID NO: 21755 - DNA, 617 bp, Sorghum bicolor
  Clone ID: 13318272
gcacgagggcttactgacatggatggaacaaatctagttcgcatgctgcgagaatctgcaaggaaggctgttggggaaagaatagttcctgcagtggataacagaaagttgtactacaataaaggccaaaaggaaatattggaaaatagcaggcgtgaaataacaactgccttattgacaaggtatccacagcttttaagaaaattcatatctgacaaagctaagatatcgcccctagttgatatgatgactcttttgaaacttgagttgtattcatacaaaaggcaagagaagcatttcaagacagccatagatctcatcgcagatgctttctttaaacatggtgagaagggcccactgagatcttgcatcaaggcaattcttttctgttgcaccgagtgccaggctgatcttaaagattatgctgaaaataaacttaagaatcttgaagatgagttagtcttgaaagtcagaactgcaatcaaggaagtagaggcaggtgatgatgaatactccctcttggttaatttgaagcggttttatgaacttcagctgtcaaaacctgtcaagaatgatagtttatttgaggatatgtaccgaatcctcgctcatcttag

SEQ ID NO: 21756 - DNA, 284 bp, Sorghum bicolor
  Clone ID: 13318281
cgcgcgctcgggtacgacgcggcggtgtgcacgtcgcggtgggagaagaccccctcccacccggccggcgagcacgagtacatcgacgcgctggtggttgagtccgggtccggttccggctccggcgccggccggctcgtggtggaggtggacttccggtcggagttcgaggtggcgcggcccaccaaggcgtaccgcttggcgctgcaggcgctgccgccgctgttcgtgggcactcccgaccgtctgggccggatcgtggccgtcgtgacggaggccgggcg

SEQ ID NO: 21757 - DNA, 495 bp, Sorghum bicolor
  Clone ID: 13318283
gcacgaggcattactggaaattgtcggttttatgatgcatcagataatctgctgaggcttgagacacaaattgcactcagtggcaagaagaagtcttctcttaaaagaatcactgcttttgagttctccccaagcaacccaagtaaattaatggttacctctgctgactcgaagatcaaaattcttgatggaaccgttgtgactcagaattatagtggactccgaactggctcttgccagtcattggcaacattcactcctgatgggcagcatatagtttctgctagcgaagactccaatatttatgtatggaaccatgaaaaccaagatgagccttcactgaaacatgcaaaaaccatatggtcctcagagcgcttccactccaacaatgcagccatcgcaataccatggaatggccaaaaacccagaaaccctgtctctttggcctctcaaattttgtcaccgcaaggagataacttctggtgcatgagtaag

SEQ ID NO: 21758 - DNA, 511 bp, Sorghum bicolor
  unsure (1)..(511): unsure at all n locations
  Clone ID: 13318285
cgggagcgtggagctgcagcaggcgcgcgtggcggagggcgcggcggtggcggaggaggtgatggcggcgctggagcggaacggcgtcagcttcgtgggcggcgggctgggcaaggccaagaaggacggcagcgggaagcagctcatgggccgcgccgcgctgctgcagctgccggcgacggtgcgcatcgacatcccgcccaccagccccggccgggcggcgctcaaggtgtgggaggagctcgtcaacgtgctccgcaaggacggcgcagaccccgccgccgccttcgtccaccgcaagaaggtccagcacgccgagaagaacatccgcgacgccttcctcgccctctaccgcggcctcgaactcctcaagaagttcagctctctcaatgtgaaggctttcaccaaaatattgaagaaattcgtcaaggtgtcggagcagcagcggaaaactgacctgttttcagagaaggtgaagaggtcgccgttcancagctccgacaaggtgctt

SEQ ID NO: 21759 - DNA, 606 bp, Sorghum bicolor
  Clone ID: 13318286
ctcctgcgctacacaaacacaagcctaggcctagagggtggtggaaggggagcgtcgaccaattcgtcccgccctcgccgcgccgctggccttgcgtgcccccccccgatggcggcggcggcgatccaccagttcgccgagtgcatcacctgccacgcctggagccccgaccagtcgatgattgccttttgtccaaacaaccatgaagtacatatctataaattctttacagacaagtgggagaaacttcatgttctgtcaaagcatgatcaaatagtttcgggaatagactggagtaaatcatccaacaaaatcgtaacagtttcacatgatagaaattcatatgtttggacacaagaaggatctgattgggtacctaccctggttattctaaagttaaatcgtgcagctttatgtgttcagtggagcccaaaagaaaacaagttcgccgtgggaagtggtgccaaatctgtgtgtgtttgctactatgaacaagaaaacaactggtggattagcaaggttatcaggaaaaggcatgaatcttctgtcactagtctagcatggcatccaaacaatatatatcttgcaacaacttctacagatggt

SEQ ID NO: 21760 - DNA, 318 bp, Sorghum bicolor
  unsure (1)..(318): unsure at all n locations
  Clone ID: 13318288
gcacgaggcttccttccccccaccacctccctcccatgcccgcatcgagatcttagcgggacagcgagaggagaggcgacgcggacgcgggcgccccccgatccctcctcgccgcccgtcgccgccgccgccgccgaccgaccgaccggggngaggaggaggggaggggagacngacacnnatggagccnactccgggaanctcttcgtcggcggcatctcctgggagacggacgaggaccgcctccgcgagtacttcggtcgcttgcgggaggtcaccgaagccgttatcatgcgggaccgcaacaccggccgcgcc

SEQ ID NO: 21761 - DNA, 595 bp, Sorghum bicolor
  Clone ID: 13318318
caaatagagaactataggaatcaatccaattctcgttctacaacaagaagaagatccatgaactggaacggatggaagatagcactagaagtaaaagaaatattgaaaggtgcgaagcaatcacatcgcaacaaataggtatgtattactttgagtttctcgctgaactccactggacaccgacctcctaaaactgacctctctgctaattcgaatcgaggcttactgccgcttggtactatacttcttcctgccagactctttcaatacccagccctcttaagtgttttcaaacttggctagtttcttcgagaatggaagctttgtcctacggcctgcaaattcttctgctcctaaaggaagtttctgacccagctttagatgatagaggatttgacaaagagacctcttcctgccatactgatcgactattctcttgaaatgccatctcatccttcggcctagctttttcatttcttccttattggagaattcaaactgtttcaaaagtttggtacaaagtatataccaactttcctggcttccctagaggttgtattaaagccggcttgcctaacagcctgctcttctttcc

SEQ ID NO: 21762 - DNA, 593 bp, Sorghum bicolor
  Clone ID: 13318349
gcacgagggctgcttgagaaaccatttgcctctggatctccaaatgcagttcaggtgcctgagataattggaagcaaatgtcactagaatgatacacatgcattatcgctaaccacttataacagcatgattgaacatactgtaaaagattgattgttgaagatgtcaaaatcgatttttagcattgcaagttgtaacaaatataaaaactaaatagtgacaagctcaaacagcaccactgattattggaatctcaaacccagtattaataagaaaataagcttaatttagcctctgtagcacagaggctccaggaatcagtacatgaaaatactacagaacagaaaggagaaaagaacccaccttcgttgacaagtctaaagacttcctgtacagctcatttgcaggttcctacaaatagcaggtctgaactttagtttacagtcaaaccaaattgcacccgacattgcagcagaaatggaagttttttgaaagaaaaagacaatatcaaagttcttttattgatattcttccagatgcttgcatgacaacctgactgcatgtggctcaagccccacgtgaacaggtctgca

SEQ ID NO: 21763 - DNA, 500 bp, Sorghum bicolor
  Clone ID: 13318353
gcacgagggcagttcgttggccaggctgtgaaagccgtggaatcaaggttgggcccctcagcctcaagtcgatcgcgccttcttcctcgccggccgaaagccgcttcgcccgaggcgcgctcgtttcctaaatgggtgatgttcgacactgaaatctacgtcgaggatccccagtccttctgcgaggacgacccggagacaccgtcagctagatcccgtgactccaacggcgacgacgttctcgtatccttgcgcctcgtcgcgccaccaggggcgtctcatctccgccttcattactcgagggaagaggaagccaagatgttgaacgggaccgcgctcgtggcggctcacctcgactctgtcctcttccgcgtcgtgcccccctccagccccatcaacccattcaactcctggtgctgctacacggactactttgtctgcaaggcaggtccctctggtatgtcgatctatggccctctcccgccgtgctacaaagacgc

SEQ ID NO: 21764 - DNA, 297 bp, Sorghum bicolor
  Clone ID: 13318356
cgcacagacaggcgtcttcgtactcgcctatgtccgcgactcaaagcttctcccccttctgccatttcccaccgtcgacgccgttccacccttccgacgacaccatgagggagtgcatgtcgatccacatcggacaggccggtatccaggttggaaacgcgtgctgggagctctactgcctcgagcatggcattcaggctgatggccagatgcctggtgacaagaccggtgggggaggtgatgatgctttcaacaccttcttcagtgagactggcgctgggaagcatgtcccccgtg

SEQ ID NO: 21765 - DNA, 633 bp, Sorghum bicolor
  unsure (1)..(633): unsure at all n locations
  Clone ID: 13318357
gcacgagggggaaacctgccgcgcttggcggctccctcgacaccgtcggccgtcgcttgggactcgtcgggtcgaccccgtttccaccgggcacctcctgtgagacagtccaccccctccccccaattcgtttccttcggcccttgcctcactgggcgtattcgctccgccccactgccggccttccgccgtctctgtggtgcggcttcgtcatggcgccggcgcgggtggatgccgagaaggaagctcagcacgagctggaggtgaaggtggccaagtattcgcggggtcagggtgctgacttgaaggcgctgggggacaagaagttgaaagggcagctcagtgtaaaagaaaagctatatggccaatctgcaaaagctgctgcaaaggccgaaaagtggcttatgccgaatgatggaggtattttagagcctgatcatttggagaagacatatagattttcacaaagggatatattgacggaagtggatcttttgagttcaagaaaaccatttgatatgatcttacctgtgctcggtccttataatataggatacacaccaaatggccgctacatgctagtaggcggacgaaanagccatcttgcaatgatggatatgttgcatatggatc

SEQ ID NO: 21766 - DNA, 585 bp, Sorghum bicolor
  Clone ID: 13318365
gcacgaggaggaaaagaaaatgaaagcagagcggcagcgtcgggcccagcccccaaccaccaccatcttctccttccccctccccgtcagcttctaccactcgcgaaatactttgctttacaagcaagaacattctggtttggtttggccctcattcctctcactgatctgcactccgtagcagcaattcctcggaggctcatgcctcacactggcagcatctcgtgatctgtctcctccatctccgctcaacatttcccagctcctgtaaagctcagctgcatagatacgagcacagaggcacctacctctcttgcttccatcatatggccacaattatttggattttggagcagaaattcatgaagatgccatgctccagtgcgctgctagaacttggcagtctcaggaagattgtctgagatcaaggtagctgagatttaccctgcgttggggctcagtttctctatcctttcctcgcctttcaacccaccggggttggtggttgttgtcactgtgcttccgtcttccaagttccatccatggcggcagtggcgtcgtcttctcctcctgcaacaattgctg

SEQ ID NO: 21767 - DNA, 454 bp, Sorghum bicolor
  Clone ID: 13318377
gcacgaggatcgatccccctcgccgtcgcggcatcgcgcgttgcccgcgtacggttgccagttgccactgcaccgcctggctttaaaaccctcgtccatccaaacccgtcggcggtggcggcgacgagaaaggggcgcgggctttgcgatgggcatctcgtacctggtgtgagacgtggttcacctaagtcaaagaataattgttctgtgtcttgattccaagcacacatcttgcacaaaatgtcgtcactagttcttcgcttcaatctgctgaggaacaaaatacggaccagctgtccagttaggtttctcaagcaacatgctggattttcatctgggaaattgcttcaacctaaaagctacgagaaacgaaatttcgctacgaatcttacaggggcagttagttggcacaaaactgacccaggctattgtgttccttcaattccgccactgt

SEQ ID NO: 21768 - DNA, 638 bp, Sorghum bicolor
  Clone ID: 13318395
gcacgaggtcgaaggcaaatgatgtggtgttctgcgggcgcattattatgtttctagcacattttttcccattatccgagcgttcagctctcaacattaaaggagttttcaacacgtcaaatgtaaccaagtatgaaaaggatgctatggatggaatctctgttgatttcaacttctacaagaccctctggagtctacaggaacatttcagtaacccagctttgactaatacaaatccagcaaaatggcaaaagttctcttccaatttggcggttgtgttgagcacatttgaagctcaacctcttagcgacgatgatggaaaacttaacaatctcaacgaggaggaagacgccgctttcaatattaagtacctgactagcagtaaattaatgggtttagagttgaaggacccaagttttcgacgccacatccttgttcagtgccttatattttttgactatctcaaggcgcctggaaaaaatgacaaagaaggtccaacagggagcatgaaagaggaaatcaaatcttgtgaagagcatgttaagaagcttctggaaattattcccccaaaaggaaaggaatttcttaaaagcattgaacatattcttgagcgggagaaaaattgggtttggtggaag

SEQ ID NO: 21769 - DNA, 114 bp, Sorghum bicolor
  Clone ID: 13318398
atacaacgcaagacctttttatggacacttttaaaatatacaacatgctacaaatcaagtaagcaacaatatttcagacagatggacaacggttattaacatacagatcagatc

SEQ ID NO: 21770 - DNA, 519 bp, Sorghum bicolor
  Clone ID: 13318405
gcacgaggctaacctttagctttccttccttcctccctctcctctcctctcctcttcccctcctctaacaagaactagttccagccattcagatcctaagttgctgaccttgctgctgcttgttggaggtagatttgttggatctaagttgaaagtaccatgagtccaccgagtgtgatggggcagtttggggacacaacctacaccaaggtgtttgttggtggactcgcgtgggaaacccagaaggagaccatgaggaagtacttcgagcagtttggggagatcctggaggctgttgtcatgactgacaagaacactggcagatccaagggctacggatttggtaccttccgggacccggatgcggcgatgagagcttgcgttgatcccgcaccggcgattgacgggaggagggctaactgtaatcttgcttgccttggggtgcaaagatctaggcctcctactccccagcatggaggggctaggaactttagagtgatgaaatctttcagccagcag

SEQ ID NO: 21771 - DNA, 479 bp, Sorghum bicolor
  Clone ID: 13318416
gcacgaggcatgaaataactgaggatgcaataataaaaagctttaatgtccccgaggtatattgacatggacttagtcaatgcttatcttgcacgccgttcccttgattatctaattgggtttggcatatcaccacttctgaggacgaagttgcctggttgccaatcaactggacgggtccaatctgctgctttggcccttgtctgcgaccgcgaagctgaaatataacagcttaagccacaggagtactggacagtacagacatacttcaaaatgcattttgcagatcctccaaatggcacatatattccattccgtataaagcatttgaattcaaaaaagctggatcaactttccatacactctcaaaaagaagcgcaagctatagaaaataggattcattcttctaagtttgaagttttaagtgttaaaagaagtaaaattcacaagaatcctccaatgccatatattacatacag

SEQ ID NO: 21772 - DNA, 584 bp, Sorghum bicolor
  Clone ID: 13318420
gcacgagggttttatcttcacaagttccctcttctatcaaagagttcacgcctgcaaaggttagttgcttcaagcaatgaggagaaaaatgatgaagtggatatctctgacatccctggtggaccttcagcatttgaaatatgtgctaagttctgctatggcatgattgtaacactcaatgcatataatgtcctcgctgcccgctgtgcagctgagtacctagaaatgtttgagaccattgagaaaggaaaccttatatacaagattgatgtttttctaacatcaagtgtatttcgcacctggaaggactcgatcatagttttacagagcacaaagtcactactgccttggtgtgaaaatttgaaggtaatcaaccactgcattgactctatcgcgtcgaaggcgtcaattgatccatcagaggttgaatggtcatacacttacaacagaaagaaactcccatctgagaatggtattgattcacattggaatggtgtcaggaagcaacctatggtccctagtgactggtgggttgaggacctttgtgagcttgaagtggatttgtacaagcgggtgatcatgac

SEQ ID NO: 21773 - DNA, 426 bp, Sorghum bicolor
  Clone ID: 13318435
tcgccattttatccacctccccccctctctcgtctctcctatcctccgagctcgccgattcctccaggattattaccagcgacgacaggagcctgtgattcggatttaggattgggattctggcgcaggaatcgaagcggccacgcgctggagccggccgaattgtttgggtgagcacgccaacgccatgatggcgaacgggaggctccagaagcaggcgttgctcccgccgcggagcccgttcccggtggcggcggctgcgggggcggcgccgcacgccgagctcggcccgatcgcgcggccgcgggacgcgcaccacaggcacggccaccagcgcacgtcgtccgagagcttcctcgccgacgagcagccgcgtggggctggacgacctgctcgacgagcccgagtcgccggcggcgcgggcgc

SEQ ID NO: 21774 - DNA, 460 bp, Sorghum bicolor
  Clone ID: 13318447
gcacgaggctcactcatgtgtttgatgatcttgctaacaaccttgcattttttttccctttccttccctttatttctctctctctcagctcatcagctcacaattcacaaacaaatatctcctcccctttgatcgatccacaattattaaagcaccatcattaccaggtcgtatgtgattatccggcaaattagctagcacccggccggattcttctgagcagttgtgtatcacattcttgttccattggtacggtggccaagaagcccatccggccggtgtcgtcctcgcagttgcatcttccgttccatgtcttcttcaccaccacacagcagcagcctagtagcaggcggcatgagtgcaagctccaagaagttcaggcacgcgatcctcaagaacctgctactagggctcaggaaaagcggcggtgctgcgtcgtcgtcgagtggcatgagcctcc

SEQ ID NO: 21775 - DNA, 503 bp, Sorghum bicolor
  Clone ID: 13318454
gcacgagggtctcctctctcctctttctctccctgccgccgccgcaggccacaccacactaccacagtgcttgctgcgcgcgcctccttgctcggtgctcgccgccgtcgctggagcacggagtaccgcacgagctcgccgcaagcagccaggtgggggaagcgagagctgcaacattggccattgcgccatccgccaccatactgcttctccactccctatgatggacctagccgcatctcctcctgaagctggcgtcgagttcacatggtggatccactaggccatcgacggagcagcagcaagcaggacggcagcacagatagtccatctaagaaggagacaagcggatccagatggtccgacattgcttgcctgggctctaataagaagaagcaatacctatttctagcgccatcgaatccaaacggtggggacttccagtcgtgccccttgtctccgactcccccatgtcttctactaggcaggtacaccagtagcca

SEQ ID NO: 21776 - DNA, 499 bp, Sorghum bicolor
  Clone ID: 13389496
gcacgaggcggcggccggcggaggcgctgttttcatcccgcgggtgggttttttctttttcttttcgcgcatggcgagagccttggccgccgtttggccgctcgtgaagggatgcatcactggcggcgtgctcggcatcaccgtcgccgactggtgcgcctccgtcgtcaccatggacggcgcctccatgcaccccaccttcgacccgcagcaggccgagcgcgctctggtggagaagcgctgcctctaccgctacgacttctcccgcggcgacgtcgtcgtgatcaggtcgccgagggaccatcgtcaactgattgtgaagaggctgattgcgctgcctggggattggatccagatcccggagatgcaggagatccggcagatcccgcagggccactgctggattgaaggggacaatgccgcccttagccttgactcgagatcttatggccctgttcctatgggtctgttgcagggcagggtcacacacataatctgg

SEQ ID NO: 21777 - DNA, 360 bp, Sorghum bicolor
  Clone ID: 13389500
gaattgtgatcaggacatgcaggaagtgattgtgcagcaagaggagcagccggttgaaatcgtgttagatcaaagcaggactaatagtaatgttttaccgggatgcagagaggatctgttgccttctttgagctggctcttacgagcaaggcgacggtttgtgctcacttcagagcgcccaaacaagaagaggaagctcttacgtgctgatgctggtctagagcagcttgttctgctgccatcccctgacggtgaggctggttctatctgcgatgtttgttgtatgggagaaagtgacatgatgtctaacaggatgcttcattgcaagaattgcgagatatctgtgcaccaaaagtgttc

SEQ ID NO: 21778 - DNA, 522 bp, Sorghum bicolor
  Clone ID: 13389514
gcacgaggatttattctttacttgtttattatattattaggaggaaggcgacgacgcgatcccaattcccaaggaggaggacgacgacgacgcgatcccgattcccatggcggacgacggcgacgcggctgctaagagacgacgacggagaagcacgggcatgggcggcatgtcagctctgccggaccacctccaacacgaggtcttctcccgcgtgggcgacgtcaagtccctcttcaagctcgccgcgacatgccgcggctggctccgccgcttcaccgaccgggccttcctccgcgagctgtgcccgagcccgcagcaggggtcaggcctcctcctcggcgtcgtcgtacaggacaagtggttcaataggatggacaaggcgatggtgcgggcgcggatgacgacgatggcggcactgccgcagcagcgcgcgtcgtcgtcggccttggcgcccgtcttcttgccggcgctgggctcgccgctcggccccacgagtcgtgccctcacctccttcttcat

SEQ ID NO: 21779 - DNA, 613 bp, Sorghum bicolor
  unsure (1)..(613): unsure at all n locations
  Clone ID: 13389588
gcacgaggggcgacgactgggcggccgtcgctgccgccctacgcgccaggcgccaaggtcttcttcggccccttcgtcggcgacgagcaccaccaggttcctcgtctccggcgcgcagtgcaaagcggatcgatctcagttcagcacggaccttacgacttgacacccaagggctggatcatgtttcttcaagtgtaagagcttggatctcgtaggtctggttcagtccctggactgggaagaaccgtgcttgctccttgccgctgcaatcatgcagagcgggggcgagatgaggcctgtgcacaacagcgtcgatacagtgaacgctgctgctgttgccatcgtcaccgcggagagccgcacacagcctcctgcagaaccgagaaggaaatgggctgatcggttgagtgcgtacttctgctttggatcccagaagaatggccggcggatgcgtgtcaaccatgctgcacttgtcccagaacctgcacctcaaaggacagatgcacctgtagcagaaattccgaaccacccaccgcctcctgtgttcccctttgtggcacctncatcctctcctgcttctttccttcaatcagaacccacatcaatcgtacaa

SEQ ID NO: 21780 - DNA, 465 bp, Sorghum bicolor
  Clone ID: 13389648
gatggactccactgtacgtgggagggcagtgaaactaacggatatgatgctgatgatgattttatatctgtttgacaatcaatctccctgtcagaaccaactgtaggattgttggagaaaagaaccaattataggaaatgtctggtgagaacctttgctgcttgcagtttttggaatccttatgttgtcattgaaatgtagtatgatgcagcactgaatttttccattccatcaagagaagtattccttgtcctctctacaaatgctgtggttttatgaactcacctgtgtgcagaaaaaggtaacatgaacatttcgaaaacgacattttgctggtttgagcttaattagttccgtaacagctgagagagatgggcagaatatgatgctcataaatgttggtaaatgttaatctgaccaatggaaatggttggtgcctgagtcgttgtaatgagattagccaat

SEQ ID NO: 21781 - DNA, 586 bp, Sorghum bicolor
  Clone ID: 13389663
gatccaccgtcgaccaccacggtgcggcgcactggctgtgcatcgacgatggccgtttgcccaacgcgcgcggcggcggcggcggcgatcaccacctgtacaggctcagcgtggacgtggccaccgcgagcgtctccctgacgaggctccccgtccgtgtcggaggcaaacagctcctgtgcgtcaacagcgacggcaagctcgcagtcgcctccgtgtatcctctgcacgtgactgtttggactcagccagccggagccggagacgacggcgacggcgacaccactgctgcggcgtggccccgcacttcttttagaatagccccgcaacagaacgaggaccatgagaggtggtgcaactcggaccatggatcgtcgtcgttgctggcgctgttcatgggcaggggcgtcttcgtcctcgaccttgacaccaaggtgatggagaaagtcttcatcctcgacttcaacaataagactagggaattggctggtgatgctaagcaatatctgaggtgtgtgccctatgagatggacttggtggagttcttcacgctaccagcttggtggcatacgagagcgacttggaa

SEQ ID NO: 21782 - DNA, 522 bp, Sorghum bicolor
  unsure (1)..(522): unsure at all n locations
  Clone ID: 13389698
tcttcttgcccctagcgatattcattatttccgggatatcggttatcgtcacactacgatccaacactgccccgccaatgcgcctgcacgacaattgccgcggatcccatggctagaaaagaccacggaggatgaaaaggaacgcattgaagaagatgaatactgggcgaatccggaccctgtcaaggaaaacggtgtgggctgtcggtgcagatgtgacacggacattgttgatgtggaagggaaacagggcagctgtttcgccgaatgggtagaagtcgctggaggctatgcgtctccctaattctttttgtctatttcaacgcattgttcttgtatcatcttttttctttgacgcaccttattctcctctgccctatactgaaccttccgagcattatttgggtgtcgcccttgggagttgttttgcttgggcctgcatgttacgttgcctgtggtcttctggacggcgttttacggatcttgacggtttggaagacaggtgtggctattnccatccca

SEQ ID NO: 21783 - DNA, 702 bp, Sorghum bicolor
  unsure (1)..(702): unsure at all n locations
  Clone ID: 13389709
aatattggagaaagacggagaaaacacgagcttcgcgttctatcaagagtaggagctaactcagtggaagatcatgagttgccagatggtgacgcttctgaagatgacgcttctgaagatgaccatgagtcttcagaaggtggtgatgcttctgaagatggcttctatgaggatgttaaaagacagaggactgaaaaactatcaatcaagaatgctctgtactcgagaactccgggcattgaacctccagaggaagaaactgaaggcgacggcaagaggacgatttcataccagatcttgaagaaccgggggttgactcgttccaggaacaagaaaaagaagaatccgagaaagaactacagggataaacataaaaacaagcttgtcaagcggaaaggccaagtgcgtgatatcaagaagccgtctggtccatatggaggtgaaatgtctggcatcaacccgaatgtcagccgaagtgttcggttcaagagttgattccagtagtgtattcaggttggccatgttggacatgaaagggttgtttctggtcgtaatgtggcatgttttgcttattagaatggcttaactccttaatttgtctaacaatattatatatgagtaaaattttgcctgcgaaaaatacaattttcacccattgccctgtgtggctgntgtgtgtgaaagcgtgnttatgagaaacca

SEQ ID NO: 21784 - DNA, 429 bp, Sorghum bicolor
  Clone ID: 13389772
tttggtttttcctccctgatgagattcggaactatttaagaggccctgtaatggaaaaggagatttttcttgcttgtggtgaaggtattgggcttgcagatatcaacccactggaagctgttgctggaaaatgtactgttatatgtatttcaaaggacgagaggaatcgtcaaccttcccctcaggaactggaaattgctgattatatcttctataggttctttgatgttggaagtttaacacattctgatcagttacctgataaaattgctacattgacagttgatgttctgctgaatccaaaagatgagctagtcgtatccaatcctggtacaaatgttccgccaaatccaaatgtggatgagggtctggttgccacagtccctgcactcccttcagcagttaaaacggaggatgggagtcaggctg

SEQ ID NO: 21785 - DNA, 490 bp, Sorghum bicolor
  Clone ID: 13389776
gcacgaggcctcgcgtcgcgtcgcgtcgcgtgattcgatcgatcggactccaattcctccgccccgttccgttccgtccaggccgctgccgctgcgcccaggccccagcgagcccccgacccccaaaggctgcggccgtcgcagtcccatcgattcctcccgcttcgctttcccacccctcgaagccgaatccgatggttccacccgttgactgcctccgccatcggaggccgcgccgcctcctccccgccttcttcctcggtccccgcgcccgcctcctcctatagatacaccgcccgcgcatcgcccccatggcggtcggcggcgacgacgacagcatggagcgggacttcgctgccaggctgcgcctcgcgcattcgccctccccggcctcgcctgctgccgccgcttcctcctcccccaccgcagccggggggatcgccttccgcgcgccgcaggagcagttcaccgccgatgacttcgtactcgg

SEQ ID NO: 21786 - DNA, 555 bp, Sorghum bicolor
  Clone ID: 13389790
gcacgaggcccaaacccttggcgtggcggagccctctccgccgccgcggccgcgcgctagccacctacgctacgccccggcggccggcgcacccccccctaccctccgttcggcgcccgcccgccaagacgggactgctccggccggcggcccgtctccgcaccacgctcgctcccccgtcccatcgtccgaccccacccgtcggccgccgggatggcggcgtcgggcggggacgcgccggaactcgccgtgataacaaatgtttgtaatgctgcaaacgcacctgaagaaaataggcttgctggtgacagcaacaccatttcagaaaatgcccaggaatcattgagttccttaccagaacaagagtcaaatgatgctagtgttaacacagaaaagaaagaacctggcatttcaaaatgcaaatcggtggaagaaataccaaaaacagtgaccataaagaggtgcaagaacattgattcaaagaaagtctccttgaataacaataataatccaagctttactggcagtccagctctgaaaaagcagccgacaaag

SEQ ID NO: 21787 - DNA, 296 bp, Sorghum bicolor
  Clone ID: 13389794
gcacgagggctaggaacacacacacacacacacactcgaggtcgcactcgcatcataagagagggcgcggctgcgagggccacccccaccatagccataggccagggcctcctatcttgcctcgctcgtagggtatagtgcgtgtgttagcctagctagttgtgctaggtagccagccagccagctcgtcggtgatgatgggaggacgaagatcagtgctcttgctggcgatcatcatcgccatcgccgcggcggtggcgacgccagccgctggggcggtggagggggaggtgaac

SEQ ID NO: 21788 - DNA, 458 bp, Sorghum bicolor
  Clone ID: 13389801
gcacgaggggatatatcaccgctgaaagttgacctaaggtcagaggcgaagatggctgcagaggaaattcgaaggttatcatctggaaagaaaattcaccctttctttgcttctcggaaaatgaacaaatgtgctaaccaagatcaagatgttatcaatattgaaaatgtgaacggttgtgattctgagagggatccaccattttatcctattcatgttgcgtaccaatcagaggccagtatacctatccactggagtagttggataatcactgatctgtcttcctttgacactgatactgcctctcttaaaaaatccgtgtcattctttgagggcttggttaaaccactgacaatagaaactaattgcaagaggcattctaatcaactggcagagccgattcttgctgagtgtacaacttcaggaatgccttttcctattactgacaagcaaagtga

SEQ ID NO: 21789 - DNA, 346 bp, Sorghum bicolor
  Clone ID: 13389820
gcacgaggtctctctctctccctccctccctccctctcagctagcgctctctcttctcaaatactacatgcccacccatgcgccttgccctcctcctttgatgaggccaatggccagcaatggcatggcgtcctcaccctcgcccttcttccctccaaacttcctcctccaaatgcagcagacaccctccgatcatgacccccaagaacagcaacaccatcaccaccaccaccaccaccatgagcaccacctccctgctcctccccttcatcctcaccacaaccccttcctcccgtcctctcaatgcccctccctgcaagacttccgaggtatggcgccaatgctg

SEQ ID NO: 21790 - DNA, 577 bp, Sorghum bicolor
  Clone ID: 13389881
gcacgaggatcgagctcgacccgtatgtccaccggacaggcgatgtctggcacgtctcgatggagagcgtggagggatacgccagctacggcttccgcagcgggctgttcgccatgtttggcattgaccgtccgctgctcgacccgtacgccaaggtgatcggggacttcgtccctgccgactctgttaatgaggatgggctagcggtgccggccgtcaggtgcctcgcgtccttgaagaatgcacccagctacgattggggcagggacaagcatccgtgcttgccattggagaagctggtggtctaccgggcaaatgtagctttgttcaccaaggacaagtcgagtggactagcagacgatgtcgccggtactttctctggcatggctgcgaaggtgaaacacttcaggcatcttggtgtcaatgcagttttgctggagccagtgtttccataccaccaagtgaagggaccatatttcccgtaccatttcttttcacctatgagcttgtatagcagtgaatgctccagtgtttcagctatcaagtctatgaaggatatggtcaaaacaatgcacag

SEQ ID NO: 21791 - DNA, 330 bp, Sorghum bicolor
  Clone ID: 13389883
tgcaattctgcatccaatccttcctccctgcgagtcgcgggcgcgtgtcactcacgtttgcttcgctgcgctgtgagcttcgccaagccaggaacggaacaatggcgatcctgaagaggcgttcttccactgacaccgacactgacagcaccaagagctccgcggcggcggcggcggccggaggagaggctagtgctgtgacggcggccagcagcctgagcgacgacatgctggcggagatcatcctccggctgcccgtcgagtccgtggcgcggtccaagtgcgtgtccaagacgtggtgcgccaccgtcgccgacagctacctgcgcc

SEQ ID NO: 21792 - DNA, 586 bp, Sorghum bicolor
  Clone ID: 13389895
ggaaatgtgtaacatgttaaaaatagaactagcaatacttaacaagtcttcgcacaagagatcatctacatatttacgcaagctattatattctacaagagaccgtaaaaaaattatattctacaggaaagattgttatttagcttatacatcagctaccatttttttcattgtatatatgcagattgggcagtggagtagtgcatagtttttgagagggttagtgcaaataaagtccaggaataagcttgtcttgggctgtatttgagaatagatgcagattttagtttaatctcaacccttgtccaatgcacctgatttgttgctttgtgaactgcaggtaccgagcaggcgtaagccattagctgcacccaaggacacagatttggattgtttgaagtggtgaaggatcttccctttttacatcaagtgtagctctctataacaacagtgaaaacagcatgtgcagtgaggtactagagaaaaacttgtattctgcagggattacatttgtctccactattccctgatagcagctcttgatgcatgtaagcagctcaacatgttcgattccatagaagctcca

SEQ ID NO: 21793 - DNA, 487 bp, Sorghum bicolor
  Clone ID: 13389910
gcacgaggagaaaatatctcactgacgccggaggccggagcagaggggggagggccgaccatgtgagcgccgtcgccgccgtttcggtcctcctctgctcttccagccgtgctgggcgccgccttttcttgatcccgtccctagcagccggccccagcttacgattttcggttccttgaagtttcagtccagcactctgtgcctgctcgacaacctgagattactcaagcagtgtagctccactaggtgatggagggtctcccagagccactgcttgcggaaatcatcaagaggattacgaggacaagcgatctgaatgctatttccctagtgtcaaagcacctctataatgctgaggccgaggaaagggttaccatccgcgttggatgtggccttcaccctgcaacaaaagccttgtcatcactctgcttccggtttcccaacttgtggaaagtagagatcaattactccggttggacctccaaac

SEQ ID NO: 21794 - DNA, 555 bp, Sorghum bicolor
  Clone ID: 13389914
tgaaaggcaggcaaggcagtacgccgagaaagcgctaagctttggtcacgggagatcgcaagaaccgcctaggactctgtctctaagaaggaggttcgtcgtgcctcggatgagatgggcggcggcggaggaggcggcgggaagtccgagaaggcgcggcgttcgtcgtcggcgcgggtgaagctgtgggtagcgcgcgccagcaccgtgctgctctggacgtgcgtcgtccacctcgcggcctaccgggagctctgggcgcccagcgtgctcaccaggtggcctggctgcctcaaccacccgcacgtcgtgcagaatccatcggaggaggtggcggtggctgtggcggacgccggccagaggcaggcagcgcgcgccgtggtgcttccacccaaaagaatctacaagaacaatggctatctgatggtctcctgcaatggtgggcttaaccagatgcgagcagcaatttgtgatatggtaacgattgcacggtatctgaacgttactctaatcgtaccagagttggataaagcttcattttgggctgatcccagt

SEQ ID NO: 21795 - DNA, 589 bp, Sorghum bicolor
  Clone ID: 13389920
gcacgaggtcaatattcggacggttcaccggggccccgcctcggcctctccccctttcccagggccgccgcgtccgctccgtcccccacctcgcagtgcctccccaccgcccctcggcgccggccggccacgccccgatccagatccaggtatgcatgaatctccccttccgccgcaaccgcgtctctttcctccattcctcgcccgtcggcaggcgtccgcatccccaccctgcgctgggcgcctctggcatggcatggagtggagatccgaacggggttctatgttgcccgccttttggctggttcggatagggataggattgtcttgcttgttcgtttcgttggggcctgcgggattcttgattcattgatttgagcgctggaatccgaaccttcgcttaccattccaatcagtcgttcaatgtttgctgcgtgcatgtttttatttcgacgatttttttttctaggggtttgctccggcgcgtttctgccgatgtacctcagtcgttattaatgctttcgaggatagatgttttcttgaaactagaatcagaattaccaatttggggcaatgtgaatatggaata

SEQ ID NO: 21796 - DNA, 583 bp, Sorghum bicolor
  Clone ID: 13389940
gcacgaggctagcctccaggggcatccgcaaccgccgcgtcgtgccgtcgctgcccttctgcggttctgcccaagcctccggaggttctagcggagccggctcactctccacgcgacaccgccgcggcctccagccgtctatggacggcgaggaggcgcccctgggcgcgctcaacctggccgagtacgcccccgccggcgcccgcaccgtcgactgctacaggcgcatccgcaagatcggcgagggcacctacggcgaggtatttgaagctgtggatattattactggggaaagagcagcacttaagaaaataaaactggatgatggcaaagaagggtttccacgccaaatcttgcgtgagattaaactattaaaaaagctggatcatgagaacatcatcagattgaaagagattgtagtatctcctggttctgcacatggaacaggcggatcagatgatcacatctataggggagatatctacatggtgtttgaatacatggaccatgatttgaagaaagtattgcaccatagtgccccatcccaagtcaaggtttatatggggcagctgctaaaaggatt

SEQ ID NO: 21797 - DNA, 608 bp, Sorghum bicolor
  unsure (1)..(608): unsure at all n locations
  Clone ID: 13389946
ggtgagtctgtagtcttgatatcaaagctgaagaagattaataagctagcaaacaagaaggtccagttgatcctcactgacaaacctcaattgatatgtgttgacccttcaaaaatggtggccaagggaaacattatttggtctgatgacccaagtgaacttagtgtgcaagtatcagattcttcacattttagaatatgcacgccaaagaaggtgtcaaccgtttgaggatgcgaaacagcgtgcctggcaatggaagaaggcaattgaagacctccaacgcggccaaaggaattgattttcaattcaaatcaaaaccctaaaacctcaaattaggcattacagcaacagcacatccttttcacttggaggaacatgtgagggggtttatttctcctgccgtcctgatcccgtgcctggatgcaaggaatttgctactcgctaattcacacaactgaatggtggctcccaaaattttcccctttccatctatgttttcatatagcacacaattttgtttcacttttgcgacgttgcagcagatagcgtcaaaacaggctgcggtctggaaatattgacacaggaaatattttgtctaaacgatncta

SEQ ID NO: 21798 - DNA, 679 bp, Sorghum bicolor
  Clone ID: 13389950
acaccctgatgagcttgatgaggagtttgacacattcccttcctcaagaccagctgagattgtaaggatgcgctacgacaggctgaggagcgtcggaggccgtgtgcagactgtggttggggacctggcaacacaaggcgagagagcccatgctttgctgagctggagggaccctcgggccaccgccatcttcattttcttatccctggtggtcgccattgtgctgtacgtgacgccgttccaggttttgatggtgataggcatgctctacctgctgcgacatccccggttccgcagcaggatgccctccgtgcctttcaacttctacaggagactgcctgccaagtctgatatgcttctttgagattcagcgtaagagagacatgtgcaagtcatgcttatttatgtctgttccgctcggttccttctggttagcatcagatcagatgtgaatatacctgatgagttcatatattagaggtcattagtgtcccagcaataaggtgtcggtttaatggtttatttgcttggttatgccaaagaaagggaaccactggatcccttttgagttttgggatagtgacaggaggtttttgggtgcagaaatgtaatgttaacttcaggttattagcttatagaactaaaggcaggaacaatgttatccccccgtgtattatgt

SEQ ID NO: 21799 - DNA, 716 bp, Sorghum bicolor
  unsure (1)..(716): unsure at all n locations
  Clone ID: 13389956
agagtgctgtcagattgagaacggctgtagttctggaaagaatgcattcacaaagtcgaatggttgtggtgactctgaaacttgtgcggaggggcatgtaggggatgcaccagccatggaatcccggtctcagagtcgcaagcaggcatcagatttggagcaggagacctgtgttgatgatagcaatttggtggcccgtgctgctaggctcttcgccccgaagttaggccagttagatgacaactatgagtactgtgtgaagattatacgttggttggaatgttccggcctcattgagaaggatttcaggatgaaatttctaacctggttcagtttgagatcgacagagcaggagcggagagttgttatcaccttcatccgcaccctcattgatgaaccgagtagtttggctgcgcagcttttggattcctttgaagaaattgttaccagtaagaggctaagaactggtttctgtactaagttgtggcactaaccagatagggaaagcatgaaactgctatcttatactctagtattcttacatgggcaatattaactgggatgacagtgtcatagtacttttatttattttctgataaatgtagttaaactgatgttgctgaacatatttgccatgatgatatactcttacatgggcaaaaattatctgggatgacagtgtaatggtacttttgtttgttttnctgataatgtag

SEQ ID NO: 21800 - DNA, 615 bp, Sorghum bicolor
  unsure (1)..(615): unsure at all n locations
  Clone ID: 13389960
cgntgcctcccccgccgccgtactactactacagccctccgccgcccgcgacctaccccggggggtccgggtgcccgccgccgccgggcgcgtacatccagatcgggagcacgccgccgggcaagggcccgctgtacccgcaggacccggggttcatgcccaacagcgcgccgggccgcgccgcggcgccgccgccgctcacggtcgtcgtcgtcgtcgctgcgctcgcggcgttggcgtgcgcatgggccgccttcttgtgatgatctgcgacggcgatcgagctttcttttcggtaagtacgtagcgcgacggatcacggagtcgagatcgtgccggcgcgcacgggttaattgattcccccagtgtatttatgcatgcatgctgctgcttcttctgataataattttcactggccatcatatatgggctgcagtacgtagttcttcttggaatgtacgaaggttttctttgctttttagttttcgtttttaatctgatgatgattttagaacaaccacttgtaagaaatggaacgcagatcgaattcagaagaatgtgtaaccagcaggtcattccagatttcgtacgtttctcagaagtcaacttatgatg

SEQ ID NO: 21801 - DNA, 529 bp, Sorghum bicolor
  Clone ID: 13389981
tgggcaacctcctgtgcggcgtcgacgagccgccgccgttctggccgtgggccgaccaccagcacttccattgatcatcgtctcctcatctccatcgtcacaaacaataatataatgattcacaatggcatattgcattgcgatggcgatcaacaatatagtgaggagaaatagtggaggaaaccaccaatttggattaattcttggcgagtgcagaagggaaggaggaagccaggctgtgcatgatctgatcgaccgcgaggtatctgcgagattatgcgatttatatttggaaatggagtagttgatcatggtgggaagcaaggggttgtaattaaggggaataagcgaagaggtggtgtaatttaattaggtaggttttggtttgagttttgatagtatctttatttttgcgccttcattttttttttgtctttgcgtttttcttttcttttatttttgttgacacatatataaatttgtgaattgtgagttgtataggtgcatggtttttaaaaaattgctggac

SEQ ID NO: 21802 - DNA, 407 bp, Sorghum bicolor
  Clone ID: 13390042
ccagctgatgcgctccagtggcggctgaagcacgccgtcaaactcggcgacgtcgtccagctggggaaaaagtgcggctgcggcaggggaagcgaggccaggttcctggcgctgcacccggagaaggacgcggtgtatgtgtggtcggcggggaagctcctggagtatgacctgacgaggaaggaggtcgccggagtgtgggcgtttggcaagggcgagaagaatcgtgtcgtcaagacgtggcttgtcccgtcatcgatgtacctgtccgactgcctgcctctggctgatgcatagcatgtactgacagatgtattttgtctctgtatttatcctaattgttgtacaggacaatttgatgaagagtctaaagaaaggagaatttgataaaagaaggaacatttgat

SEQ ID NO: 21803 - DNA, 710 bp, Sorghum bicolor
  Clone ID: 13390054
gtaatgactgctgttatttatggacttcccacatgcttttatttatttatatttatgataaatatatcctggtttaaatcattttgtaattactcttagtccttatgacagccatgctgtgactaaaaaatttagacctttttaccattgtgcagttctattatcccaatccaatgaatttaggtttatgacaagtatcatacctcttttttatcatagttttaattaaaattgaatttgggaaaattgagaccatactttacttcaattttcacatatatttatcatagttttaattaaaaattgattcttgtggctgttgatgttttttatagttagcagccaacatctttggctctgcaaattagtttagtactttgcaaacatttttattagtaaacttaatttttctgatatcattttatctacctcagtttagtctgattgtaggcatgagaacataccacttggtttggtggacttctgtcagcatgaactgggaagtggagtcgacatcaaccttagtcttattttcttgttatctttccccttgtcttttttaatctgttgttttttatctttttggttcatgtagcaagtaacaattcggatcattttgataaaggtagccggtactagacttatcattgatgaatcagtgtttcatgtttgtaatgtaatggttgatcttgtatgtatgagtgattaga

SEQ ID NO: 21804 - DNA, 491 bp, Sorghum bicolor
  Clone ID: 13390127
gcacgaggcacctgtgctcctcgccggcttcgactcctcctccgatttgtcatagccacctgaggtgggttcagtcgctgatggtggccatggtgaggaaggacgaggaagaggggccggcggaccgcgtgccacacctgccgtggatgcggtgccccgtcgacatcgacaccttctccggctgtcccgtcacacagctcccccgtctcgacccgagactggcagaggctttgcagagaatgggaattgaatcgtttttcccggttcaagaagcagcttggctggaaacaattggtcctggtgcttttgagagggatatctgtatcaactccccaactggatctggcaaaactcttgcttatgccctacctattgtgcaaatgctctgcaaacggaaagtaaggtgcttacgagctttggttgtgcttcctacacgcgatttagccttgcaggttaaagaggtttttgatgctattgctcctgtggtgggc

SEQ ID NO: 21805 - DNA, 587 bp, Sorghum bicolor
  Clone ID: 13390136
gcacgaggctcttctcttctcttctcttctcttcgtccgactccaacggccgaccgacgttcgttacgggcttaacggccaccgccgccgaaaggccgagcgagcccatttttgcccacaaccctaaacccctttcactcgccgcctctcgctgtggacgagtcccgtccgtccacctcggaacgccctgcccggagccggagccggagggtctgggaggggactaggggagggagggaaccttcgcttggtccggccggcgtccctcgccctcatccgccgagcgcacccccaggcttcaccgaggaaaacctttgctccgtttctcttggcttggcagtgcttcaccatttgccaggtcttgaactagtgatcctctgtcagacacagacaagaaaccaagctctctaaccaaacacaacgatgacaaaagcctgtaagaagaggaggggagtttgtgtaagcagtgaatttggagacttgagtttgagtacaatctttgaggttgacgaaagcagactctctgaaatggatggtgtgacatcaattcctacatgtgagcaccaatcgtcttatgaactgaaggc

SEQ ID NO: 21806 - DNA, 227 bp, Sorghum bicolor
  unsure (1)..(227): unsure at all n locations
  Clone ID: 13390168
ccactgtggcggcgcaacagccggcgatggccgcagccgcgagcagcaggtcgctgtcccctccgcttccccgcatgttgtgcacagttccacgatgaaggatctggctcctccgacctgccaggcaccgtgccgcccccaccctaagccgccggccgacctgacaccgacgaccccacgagggcgtcncgggcaagccccaacgggccctgcccaccctggcccac

SEQ ID NO: 21807 - DNA, 545 bp, Sorghum bicolor
  Clone ID: 13390204
gcacgaggcgagcacaagcgagagcagagagcatcagcaaagccagcctcggctctccacgaactccacggagcctcctcgcgccgccgctgggatcatcacgccgttgcccgatctgctcgcgcggaaacctgttgctgttgctgtcttcggacggacgccgaatcggagcggctaggcatcacagtttggtccgagaccgagatcgggaggggaagctgccgtggaaggccctcccccggctagctctacaggtcttccgcttactttctggaagcctcagcggactgcggtgtacggctgcccgcggctgggtctgggtctgttctgggctccacgtggatgcgctgcgtctccggagccggtgccggtgccggaggagcatacgacgaggctgtggctgctgcttccggttgggcgcggggcccgggctgtcgttccacctgctgtggctctgggtggggatcggcggcggggagtgagccgtgagcggatggaagaggactgcacttactgctcttgaatcttactatatacagcacctg

SEQ ID NO: 21808 - DNA, 599 bp, Sorghum bicolor
  Clone ID: 13390206
gcacgaggctaatagaacattgcttgagtgccttgtattttgtcttctagacgatcattcttcagaagccttggaggaggcctgctctcttcttcccaagatctctagcaaggaaacacatccaaagatagcacaagttcttctggaacgtcacaaacctgatatggcacttcttgtgctgaagtgcacagggcgtgatagcttctctgctacagaaaactttgaaaaagatggcatttcatctcttagcgaggcagtgactgtggtccgtgttagaattgaatgtggcctccttacagaagcgtttatgtatcataggagctactgctctaaggtgaaagagcaacgctcagcagatatgacacattctgaggatgcattcaaaagctcttggatttatcatgttgagatgatgatgaccgaattttgtactatctgcattgaaaggaatttagttgataaaatgattgatctgccctgggattctgaggaagagaaacatcttcacaagtccctctttgagtctgctcatgaaatgcccatgaaaccaaatggtagtctgcttgttgtctactaccttcggcgttatcggtatttgg

SEQ ID NO: 21809 - DNA, 411 bp, Sorghum bicolor
  Clone ID: 13390211
ccgccgatttcctcacctcgctccacgatctcgcagcggatcgcatgggcttcaccaacagggtgcaggccgccgtcgccaaggcgcatctcagagccttcgacgccttcagggctctgccggacccacctcagtacaccttggagctcggtctgctcccacacatcccgctcccgctgcccaatcctaaggctgccgcggatgctgacaccacccccgcttccccttccaggaggggcaggaagaggaaggagcaactcgtcaaggacttcgactccgatgaggactgggaccccaggaagaggggtgccaccgactctgattccgatgtggattttgaccgcaggagaggattcaggggcaggggcggtggcggcggtgctggcagtggcgcgccccgtggcaggcctc

SEQ ID NO: 21810 - DNA, 436 bp, Sorghum bicolor
  Clone ID: 13390213
gcacgaggaccttacccccgccgcgcggcgcaacaagaagcgcaagctccccgagaagcagctccctgaccgcgtcgccgcgctgctcccagaatccgcgctctacacgcagctgctcgagttcgaggcccgcgtggacgccgcgctcgcgcggaagaaggtagacatccaggaggcgctcaagacaccgccctcgctccagcgcacactccgcatctacgtcttcaacacctttgccaaccaggggccgcgcaccatcccaccacccaagaatgccgatccgccaacctggtcgctcaagatcattggtcgtgtgctggaggacggcgccgagctggatcctgccagtgttgtgcccaagcacaacccagtgtaccccaagttctctcaattcttcaagagggggacgattgcactggacccgtctctgtaccca

SEQ ID NO: 21811 - DNA, 528 bp, Sorghum bicolor
  Clone ID: 13390227
gtgaagctcgttggcggctagggtttttgcggcctcccgcagtgaccaaagcccaaaccctagagcacccgcgcccattccatggcgtgctaggcctcgatcgaggctgcggggattagtaccgcgggttgggattagagcaagcgccgacccgaaatggcgtcgaggaaccaattcgatctccttggagacgtcgacaacgacgaccccgcccacctcctcgcagccgccgagaagaaggcggccgcggcgcctaagcctgcgcctgcgccagcgcccgcgccggccaagctgcctaccaggccacctccgcccgcgcaagctgtgagggaagaaaggagctatggtgctccaccgcgcgatggacctggacgtggtggtccaggacgcggaagaggcagccgtggcggcaggactggcccgaggcgagaatttggtgatgctggtgccaatggctttgagggagggtatggtggtgggtggtggctttggagacggtgcagttgctcgcggtgaaaatggtgaggg

SEQ ID NO: 21812 - DNA, 524 bp, Sorghum bicolor
  Clone ID: 13390248
gcacgagggaccacgtatttggttacaacattgaagttgccttggataataaagaaacttggaagaatcggagaaagccaaacccgatatacattaaagatgcattgcctgaagacgctgttcagcaaaatggtcgttctcgggatcacatgaatgaggagcaggatccgtctgctatggtatccctaggccttagaaattcgcaagagatatggagtcttgctgaaaattcaagagtgttcttggaggctttaaaattattttttgagaaaagagagaaggaaatagggagccttatttttgacaaggatgaccaattggctgtcgagtttgttactgctgcagcaaatatcagagcttcctcttttggaataccactgcatagccttttcgaagctaaaggtgttgctggaaatatagttcatgctgtggcaactactaatgctataatagctggtttaatcgtcattgaagcaattaaagttctcaagggtgattatcaagattatagaatgacgtattgt

SEQ ID NO: 21813 - DNA, 392 bp, Sorghum bicolor
  Clone ID: 13390253
gcacgaggcatcgcaccatgtcggccgccgaaaccgccgtttctccggcgccgcagccgccatcggatccgaacgccgccgccaacgccgacgcggcccattccaactctttctccatggccgacgaggcgcaaaccctaaccgaggccctgcttcagccccaaccaaaccacatgtcgccgcctccttccggggaggaggacgacggggtcactgcctccggtgctcccgttggtggggacgccgcggcttccgctgctgctgctgcggcggctaacgcgacgatggaggagcgggtgagggggccgtggtccccggaggaggacacggtgctgagcaacctggtggagaagctcggggcgcggaactggacgctgatcgcgcgcggcatc

SEQ ID NO: 21814 - DNA, 414 bp, Sorghum bicolor
  Clone ID: 13390263
gcacgaggcagcgcctctccggcttccacgcctcgcagtgtggcttctgcacacccggcatgtgcatgtccatcttctccgcgcttgtgaaggctgacaagaagtctgatcgcccagaccctcccgctggcttctccaagatcacttgctcggaggcatagaaggctgtctcaggcaacctttgccgctgcactgggtacagacccattgttgacgcttgcaaaagctttgcctctgatgttgacctcgaggatctgggcctcaattgcttctggaagaagggtgacgaacctgcacaagtcagcaagctgccgggctacaacagtggcgccatttgcacatttccagagtttctcaaatctgagatcaagtctacactgaagcaggataatgatgttcctattgcagtctccg

SEQ ID NO: 21815 - DNA, 547 bp, Sorghum bicolor
  Clone ID: 13390270
gcacgaggccattgaagggagtggatggtgaactgttgaaccaccatagtagtagtgagtcagaggagtgctttatggcatttgcaagggtcttcagtggtgtccttcatgcagggcagaaggtatttgtgctgtcgccattgtatgatccagtgaaaggggatacagttcacaagcatgtgcaggaggtggagcttcaatacttgtatgagatgctaggacaaggcctgaagccagttgccagtgtgggtgcggggaatgtggttgcaatccagggccttgggcagcatatattgaagagtgccacattgtcgtcgaccaagaattgctggcccttctcgagtatgatgttccaggcatctccaatgcttaaagttgcgattgagccctcaaatccagctgatctaggagctcttgttaaagggcttaggcttcttaaccgggcagatccatttgtcgagtatactgtttcgcagaggggtgagcatgtccttgctgctgctggtgagatacatttggagcggtgcataaaggatttggaggagag

SEQ ID NO: 21816 - DNA, 589 bp, Sorghum bicolor
  Clone ID: 13390290
ttcttaagaaagcatgaggttaaaacttttgacaaaatgctcaagaaggcagacaatgctagctgcagtcttcattcattgcctgaggaatcaatagaaacacttcgtccaactttctccagtgctctgaggaaactggaagaatcactggaatcagaagcagcaaagaaatctaatttaggagataaaatgccaggtgcttctaaacggaagagatcaaatcagtaatgaaagcaatagtgctttagttctaacgtcttgacattacacctgcattttctacagagtattgggaagaaatgtgaggaggcaattgagtcccagttcaaagcagctagaatgggacatgttaaacctacaatttgaagcatgcttggcttttgttagtcaaatttgagcctggttattctggcctgggcttgaaaatttgagccaaatatttggtcaaccattttacttgttaatttaatcaacccttagaagttagatcaaatagagttctgttaattttctgctttctttatttgtttgtatctcttataaggtattacagttcagacattttgttctcccactaacaaaataggtt

SEQ ID NO: 21817 - DNA, 731 bp, Sorghum bicolor
  Clone ID: 13390298
tccatactgtcgctaaagaactgaatcgagtatttgatttattatgggaatcaatggaaaggaaatttataggcccaagcccagttcaagagcagaagacaatattcacagaagttcaagctctaatggattcaaagtctacaattgggtgctcaaattcaaaaccttcggttattagaaggccagttgcttgctcaaattcgattgcaaataagccattgacagatgtgttatcctttaaagtaaaaatcgtatctttcgtgggcagcgataagcagatttcttccaaaggaatccagaaggatgaggtttcttcccaggtggagtacactaagaggtcctgaagtcggtggtcctgcattttcattagcaaggtcagaaggaaggagacaacggcctcgcgatcaagtcaagcatcctgcagtgcgtctgaaaggtgtgtagtttggaaatagccattgagctgtaatagctggtctgggcttgtaataagtcgtagtcatcttagccagggtggtgagaaataaatagacttggtcatggcctcatgggtgttgtatcccttggctgtgctggggtttggtggttttgggtgctttttgtctaaagccctgggaggtcagtactatggattgttaaacttttgtgactttgttgctcttcggttcgtccatggtaaaaaaaaataaaggacatggatagctgtagcagcaagtatttgcatcgtgaac

SEQ ID NO: 21818 - DNA, 115 bp, Sorghum bicolor
  Clone ID: 13390325
atcaggatattggccattaatattcatctttggttgggccgcatatacaaaccagagtattacatgaatcagttacatttttatgaattagcagtgaaattaaggtggtgtcacc

SEQ ID NO: 21819 - DNA, 585 bp, Sorghum bicolor
  Clone ID: 13390334
ctcgtcgacgtcgggggaagctccggcgcctgcctcgagatgatcatgcgcagggtccccactatcaaggagggtatcaacttcgacctgcccgacgtcgtcgccgacgcgccggccatcgccggagtgaggcatgttggcggagacatgttcaagtccatcccctctggtgatgccatcttcatgaagtgggttctgacgacgtggaccaacgacgagtgcacggccatcctcaggaactgccacgccgcgctgccggacggcggcaagctggtcgcctgcgagccggtggtgccggaggagacggacagcagcaccaggacgagggcacttctggagaacgacatcttcgtcatgaccacctaccggacgcaggggagggagcgctccgaggaggagttccaccacctcggcatcgccgccggcttcaccggcttccgcgccatctacctcgaccccttctatgccgtcctcgagtacaccaagtgaatctctcaaatcatgttttctctagcatgtataataacgaacagatgtcaggcaaagttgagattcacgttccaactgcgcactgtactgtactct

SEQ ID NO: 21820 - DNA, 653 bp, Sorghum bicolor
  Clone ID: 13390369
attaagaggagcaaatgccttcaatttcctcatctggttatgagagtaacaaaggttatctgaagcaacctcaccctgataccaagtatctgagccaagtgcactgcataccttcaacactggacttctcagagtacattgatcaggactggttgttttctgtgggtcatgttaagcaaacagagacacttgaggctatagaatcacaccaagtttggactgatgcacagctaattgatactgccgatgtaagtgctatgccttacgttgttcctttctgatggcactcacagtgatatacacggtgagttggctactgcaacttgagttatgatatgaagggtccaggagatcgcctgactagtttacaacataactactgtgatgcatatcaggctgtttcactcactcaagcaatctttgttgaactgagagcaaacatttggtgtctggctgaataaatgttggctgtgtccaaactcggcacttttggtgtctgcctggcggttctcttgtctctgatgtatccaatcattctactaaccaatgctcaaaatgttgtactccctctgtccctgaataaatagattcttggattgtcttaggttaaagtttttaaactttgactaaatttgtagaaaagaaaagcaaga

SEQ ID NO: 21821 - DNA, 724 bp, Sorghum bicolor
  Clone ID: 13390372
taatatgagatcaactgcagggggtatgttccccacagtgggccagaatgttgagagtccatttttgaggggggctatagatatcagttctagaaaaggagagtcaggtttcaaaaaagggactaaatatgctgatcatgatccactgcctatgtatttgaacttaagttctggtgatacacctacgaaagactaccaaacaagtttgttgaagacagaggttaacaaaaccacctatcttcaaggaaaagattctgttgtaaaaggagagttccagtttggttcacgtgctgagaagcctttcatcttaaatggaactggtgtaggtcaaaatggccttgctaaggtctctggatatgctggttttcgtgaggattataaagtaccaactaaggagaacatcttgagctttagcaagaaatcttcagttgatggagcacaagccagcaaaggtgtgtcaaggtggagatctgatgagtctagtgaagatgaagaagagagaacaaaccgggagagcgcagcttctcttgttgctagaaggcggcctagattttcgagaagatgatatatccacatcctcagggatctttaattgttggcagtggaggattgttttaatatctccatagttacaccctaatgtaacaatactttgttccaagggaaatgtgtatgtcaccaaggatgctagaaaacaaaaatgaaaaggcatgcacatgtacca

SEQ ID NO: 21822 - DNA, 416 bp, Sorghum bicolor
  Clone ID: 13390376
gcggccctctcagaacactaacaggagtcccaataagaagatgaagcaggaggagcagccacctcgaggagccccatcggatgtgaaaaatggggctcctacagatccatcattttaaatgctgcattctgcactggatatcctgcgattcagaggaaatgcaccatgaagtttggagcaacggagcataaattggtgtcactgacgtagagttaggatggctcactgaccgggtcacattagtcactgagttgagtgagcaaattttaggctttctgtggttacatgcatccagacgactggttctgtacttggtaccggagttagcttatgttaaatcattagattgtagagtagattatgtagcgtgatgcgctttgctttatgttagcaaccttcttttttgtattgcctag

SEQ ID NO: 21823 - DNA, 518 bp, Sorghum bicolor
  Clone ID: 13390378
atgatgtgctggtggatgttccattccccgctgcagaaagagatgatggcgttccttgccaacacagagaagcacaaggacattgaggcttgcgatgaggtgatatctgcttcgatcaagaagatccatgagcaccgcaggaggagagcgttcttcctgggtttcagccagtccccagtggagtttatcaatgcactgatagcttcccagagcaaagatttaaagctggtcgccggcgaggcgaataggaatattgagaaggaaagacgtgctgacttctataaccaaccatgggttgaagacgccgttataagatacttgaaccgcaaaccggctaatgagggctcaggtggtggtgctggtggttcttgaggcgtggatttcttctagtgctgttttggtgtagaaacaaattatctgttctgtattgctagtaaaattcagacgtattagcaaagagatttgttcagtgttgtgaaaggatgttcaggctagtcgttgtatgttgtgttctatat

SEQ ID NO: 21824 - DNA, 412 bp, Sorghum bicolor
  Clone ID: 13390422
actcaactcataaagtcttgactcctgaaagtgaggttttcaagtttgttgatcctatatgcttttctgctgaggtgccaagcaaatgtgggcatggttgttgcggtgctcacaagcagcctcgtaagaactcgttgctgggtcctgagttcaatgagtttgaagatcatccaccgattttaaatactagctttgcttcattggtatcagaaattagcagcattgcctggatgagaagtggtatgcaaagcagtgatgccagtaccttgtttcagtcagttccgccaacctgacaaagtaggaatcttatgaacttgcacggtggaatattttgtagttgtttgttatattcagacatagtgatgtcagatcactaattacaatcctgaggctcactgttaatgggcgagtg

SEQ ID NO: 21825 - DNA, 456 bp, Sorghum bicolor
  Clone ID: 13390441
gcacgaggctcttgtcctcgccttcaagttcattctaaaaggtacaggatataccaagcagttctttcagaagtctgaacctgtttctgtatttattgctattggctatgaatgctagaactagaagtaactgaagattatcaagatattgcattgcttttcttagatttacctctgaatagcctggcatgcactgaatgcaagacagatatccctactctttgctccaatccttttttggttctggtctaataattaattttgactgcaggtagagacttagaaattacaagtgaaaatcaagacaggtatatctgcatctatcatttgcaacagcctgcggataagaatgctcaagagcaaaccacaccaggtgatctggaatcaatggttgctgaagcagatcgtcccaattttactacattgcccgctaaggaacatgatcaagagattgtc

SEQ ID NO: 21826 - DNA, 532 bp, Sorghum bicolor
  Clone ID: 13390460
gcacgaggcaggttttccccttccaatcacctctccggtcctccccggctccccctcgcgaatcgcggcctcgcgccgaccgccgcctcctcacaaccgcggaagccgcctccctctgcatcccgcggccgccaccgcgacgccgccgccttccctctacctcccacggctcactgcccacacggcacaagagcacctttctgtaaacttataacaggtttgaaggaaagaatagttttggtgctgtgattgatttcactgtgaggagtgaaatgaggctaagtattggacaagtccatcgaaatgttcttgcgctggcatcttcgcggtcatgttttgttctgggagatcgtctttcgttcaggatgctgtcacagccacgggtagctggatttcatcagactgcttggcgtggtagtcaaattttagaagataatagcaggggaggaccattaactcttgctagcctagaagtgcaaagcagggttggatatgggaagaaggagaaagtggcacgaactgcagttccaaa

SEQ ID NO: 21827 - DNA, 471 bp, Sorghum bicolor
  Clone ID: 13390462
gcacgagggctccccacccggaaaacgaagccaaaaaagccacgctcttgccaccgccgccgcttccgcttccggggccaccgtcccttccccttgcggccttgcctccctcgcacgcccatctccggcgtcaccaccggcccccctcgccaccactgtcaactcagcggagcagctctcctcctcaaactctcggtgtctcgcttgcttaccttaaccttcctccgctccgctgcaatcccactcctgatcctggctccacccggaagtgcccacgcattttggtctcttgtgcttggagccttctcggttgcaccaaatttggcctttttaggtgggtggggagctccgatcttttcagctacagcttttatatttttcctgtttcttggttgggtttgtgccacagatttgagcatcttgggctgggacgattaactctgagccgtcctcctccccatatattgatca

SEQ ID NO: 21828 - DNA, 332 bp, Sorghum bicolor
  Clone ID: 13390464
ggcacgaggtttaattgcttcggcgcacttgttctctttaatggccacttcttccaacgcctccgtcctagcggcttccacgcgttcgcagtgagggctagggtttgtccgcgtcgcgtcgctcgacaaggaggaggaggggaggggtgcgctgccgtcggcggcggcggttggaggccggagcccgttcgtcgctgtcgcgtccccggcattgctgggtgtctagaggaaggagatgatggtgggctcttcccagcagcagctgctgcagaggaagggcaagtccgtggctggcaaggccgcggccgccgccaccgcggcggcagagaatg

SEQ ID NO: 21829 - DNA, 579 bp, Sorghum bicolor
  Clone ID: 13390474
cgccgaccaaaaacgccggcgcaaccatgcgccccttccaccctccccgccccaaccccaaccaacaccaccgcccacggcccggcggcgacccgggcccgcctcaccttccgggtacccccatgcaccccgccttcccgccgcctgtccccaacctcgccgccgccgccgccaacccaatggctgcagcggcggcggccaaccctttcctggcgctgcagctcctcggccaggcccagcagctccagaatctcggattcctcgccgccgccgcgctccagcagcagcagcagcagcagcaggcgccgtttttccccggagggttcccggcgaaccccaatcagtttgcgcccttcgcgggcggcccgcggcctgccggtttcaatggcggcggggcgtttcggcctggcggtcctgggttttgtggcccgcggccacccagtcccatgatgagccctgcggggaacggttccaacaacaataacaacgctggaagcgggggagcatcgaggccgattcttaacgtttggaggaaggaccacaacagcaaagctggcagcggtggcacgccggggccaa

SEQ ID NO: 21830 - DNA, 529 bp, Sorghum bicolor
  Clone ID: 13390498
gcacgaggccgtcccgtcgccgtcatcccagtccacgcccacgccaacgcacccgcatccctctctcgcctccgccgcaacgatgtcgggctgggacgagggcgccgtgttctatagcgaccaggcgcagttcccccgcggcggccccggcggcgacccagccgccgacctcacccgccactccgccctccgcaagttcaaggagttcctcagaggcttcaccggccccaccggcgacttcccctaccgtgagagcctagtacacaaccgcgaccatgtcaccgtcgccatcgaggacctcgacgccttcgatgccgagctctctgacaggatccgcaagtcgccggccgattatcttccgctgtttgagacggctgcggccgaggttctcgcaagcctccgttcgaaggtcgccggcgagaccggggagatggaggagcccgtcacgggagatgtccagatcttcctctcctccaaggagaactgcctgtccatgagatctgttggggctgattacatgtcgaagctg

SEQ ID NO: 21831 - DNA, 295 bp, Sorghum bicolor
  Clone ID: 13390511
gcacgagggtccgtcatcctctcgctcgccttctcctcttcttggccttgtgccgactgctgctgagcacacacacggtctcgcatactcggaggcgacaatggcagggtgtcttgttgcccggacgtcctcgtccaagcgccagcagctgagcttgtctattctcctcctcgtcctcttccagagctcgtgctcgtgctgctacgcggcgacggtgggttacagttacagcgaacaggagggcgaccgggttgcgttcctccccgggcagccgcggagccctccggtgtcgcag

SEQ ID NO: 21832 - DNA, 337 bp, Sorghum bicolor
  Clone ID: 13390571
gcacgaggcagaagcaggagatcggcgctcagttctacgagtccaagactgaggcttctaccgaggcttccgctgaggcctctgccgatatccccaagcctgtctactcggcccctgccgccaccaagcctgccgcctccaagcccaaggcttctaagcccaagaccggcggctccagctctggcttcaccggcactggctccggtgttgacaagaagttcgagagcggcactatcagctgcgacaccttcccctctgagtacggtgccgttgctcttgactggctcgagctcggtggctggtctggtatccaatacgttcctgacttcagcctctc

SEQ ID NO: 21833 - DNA, 617 bp, Sorghum bicolor
  Clone ID: 13390589
gcacgaggtatcgagcacctgagatcattcttgggctgccctatgaccacccgttggacatgtggtcagttggttgctgtctctatgagctttgcacaggaaaagccttattccaaggaaaatcaaacaatgagatgcttcggcttcatatggagttgaagggcagcttccctaagaagatgcttcgcagtggtgcctttacgatgcaacacttcgatcgagacatgagatttcaagatactcacgatgaccctgtcaaaggaaaggttgtgagaagatccagcgaagaggataaacgtccaagaagcacttagccatccttttattactggcaagtgaagacaagatctgatcccttttgacattgtttatagctaataattaactaacagttttaaattctaatcaacggtatttttgtctttgtgtctggcgagctatgagatcatctgagcacgtggatgaattatgcatggaactatggaaaaatggaggtttacgggaatagggctgtatatcccttaggcctactttggcagcccaaattcctagagggatccctgcaaattccccgtgcaaatctcctccgtgccaaaattgggtgctctttggaagcc

SEQ ID NO: 21834 - DNA, 562 bp, Sorghum bicolor
  Clone ID: 13390601
gcacgaggatcgaatgttagcaatcaggctacacataaaagccatgtgagcacccgtctgtaaccatagaacagaaatcatcggtcaatcatcatggctcctcgattctggactacgctgtgtgccctgacttttggctcggctgttctagctgccccgcagcttgcccctcgtgcaactgatagcctagatacttggttggcatctgaagtcccttttgctaaagagggtatattggataatattgggtctgatggggcgtatgcgaaaagctccaagtcgggcatcgtgattgctagtccgagtacaagcaatcctgactattattatacctggactcgtgactcggctcttgttgtgaaaacgctagtggatcttttcaagaacggcgatacggacctactcaccgtcattgaggagtacatcagctcccaggcttacatccagaccatctcaaacccttcaggaggtctttcaagtggtggacttggcgaacccaagttcaatgtggatgagacctcatacactgggtcgtggggacgacctcagcgtgatggtcctg

SEQ ID NO: 21835 - DNA, 565 bp, Sorghum bicolor
  Clone ID: 13390612
tttgggccaggatttccagaattagagcaagttgaacagcatttaagccagaatcccaacttgatgagggagataatgaatatgccggcgatgcaaaatctcatgaacaaccctgatttaatacgcaatatgatcatgagcaacccacaaatgcgcgagatcatggatcggaatcctgatcttgcccatgtgctcaatgacccaagtgtcctccgccaaaccctcgaagctgctaggaaccctgaaatcatgagagagatgatgcggaacacagacagagctatgagcaacattgagtcttctcctgaaggttttaatatgctccggcgcatgtatgaaactgtccaggagccacttctaaatgcaacaacaatgggcggggaaggaaacacagcctcaaacccattttcagctcttctcggcaatcaggggtctaaccaacctggacaaggtcaacctgcaacaaatgctcctgctactggctcagagtcgacaactggaaccccagctccaaatactaatccactgccaaatccctggagcaccaatgctgggagtgcacaag

SEQ ID NO: 21836 - DNA, 477 bp, Sorghum bicolor
  unsure (1)..(477): unsure at all n locations
  Clone ID: 13390632
tgcaaggcgatgcttctccatgggcacttaccagtatgttcttggggcttctgaacttcgagtggctctccagacaggtcgtggcggaaacggtgcaagcagcaggtttaaaggaagagttgctggcttatgtcctgtcaatgctgacattatggagggcaagaggatttgtgcgaggagcaaaggcgagagcttctctgtgtcgaagatttggcagtggtctagtgtgaagggcaagttgccagctcctccagacacttgctcagatactgggagcctaccatggatgaaaataaatgctgctggagataagtctaatatgtgactctgtctatagtactttgtttttttttctgcctgatgttggctgctgagttgcttagctctagctatttcatctgatttagggtgtctcaacaatcattcatcaagggatatttttgacaggcttgctatattgcacatagtttgtgnttg

SEQ ID NO: 21837 - DNA, 674 bp, Sorghum bicolor
  unsure (1)..(674): unsure at all n locations
  Clone ID: 13390666
agccatcatacgtttgagtgaatctcttgcaaagatgagattgacaagtgtggctacaccagaacatgtcgactaggcattcagactgtttaatgtctccaccgttgatgctgcaagatccggaatcaacgagcatttgaacctgtcaccggagattgctaatgaaatcaagcaagcggaagcacaaataaagagaagaatgggcattggaagccacatatctgagcgacggctgattgatgaactaaataggatgggaatgaatgaatccattgtcagaagagcccttctgatcatgcatcaaagagatgaggtggagtacaagcgagagcgccacgtgattgtccgaaaggcttgaggtgcagagtccagtcagattcatgggtggcagacaacataaattgaaggcgtccttcctcttcagacgtgtgtataccttcactgaaactgcacctctgtccagaggacgaggcacgccttagttgatctctgacatgactgttgtaacctgcaaacgaatggatgcaacttgttgcttcgtggaaatgaagctgtgtatctgtaccgcagtagtttgttactgcctgtgatcttaaaccatctagtgtgtgagcattgtttcggaagtanaccaaaggttctgaacctgcattgtgctgtgtaaactcgtcaat

SEQ ID NO: 21838 - DNA, 469 bp, Sorghum bicolor
  Clone ID: 13390679
ttatcaaatcaggattgagggtctggctctacaggtattttactcagtggagatgcagatggtagggttccagtgattggatcgcggtattgtgtggaagccctgggcctgcctgtcaagacacaatggcaaccctggtacctgaacaaacaggttgcaggaagatttgtggagtaccatggcatgacaatggtgacaatcagaggagctggtcatttggtgcccctcaacaaaccttcagaaggtctcacacttatcgacacattccttcagggcaaacagcttcccgcacacagatgacaatagtgtttaggattgtgatgagggttatttcagaaaacaaaatctcaaggattggacactatgtgcgccacacatgggctaattagtaaggatttcatttccagttgttgcacaaattgggttacttggttacaaatagaccatactcaactggatattggttaca

SEQ ID NO: 21839 - DNA, 674 bp, Sorghum bicolor
  unsure (1)..(674): unsure at all n locations
  Clone ID: 13390713
aagtccaagatggcgctcgccgaggaccccgccagcctcgagcgccgctacatcgagcgccagaagaacgccaggatcgagaccgccaaccgcgccatcggcgccgtcgcgctcgaggtcgacaagctcgccgatcaggtaaccagtatcgagaaatcgattgccagagggaacaaggtggctgaggtgcagatcacgacgctgatcgagctgctgatgcggcacgccgtgaagctggagagcatacctgcagccggcggggactcctcttcgcagaagaacattcaggcgaagcgggtgcagaaatgcgtggagacgctggacgtgctcaaggtgtccaacgcgcggctgcaggcggtggtggtgaccacgaaatgggagacgttcgacgcggcggccaccacgcagacgcagtgggagctcttcgactgaaaaaaggagaacgtcgatcgtcagtgcagtgcagtggatacgtgcatggtgtttttgtttttgtgtcgtcgctattctctctcggttttaatttggtgcgcattgattcgttgtggtcatgcatggtggtgagacgacggtaggttaggacaacgctaggagaaccaaaaccccactgttaactgtttgtaatcacagtaccgttcctcccctccggatgatggagccgattgatcgtncta

SEQ ID NO: 21840 - DNA, 510 bp, Sorghum bicolor
  Clone ID: 13390741
tcggccgcaggccacgaacgattgcgagcagtggaacatcatttgagcctgtcaccaaagtgttcgattgctggtgcgctcggggctcctccccctcttatgctggataaaatatcttggatggataaccaataggactgcaagtcaattcgacggccggtcttggtgataatcttgttctccggatgttttaccggtaatttttgcattaaatttcttatgtcagcacgtactccatatactgcgttttggacttgtcacgaatcgactatgccttgaatcattgtatggcgacggaacggacgtatgcagccagcgattgcgaattcttttgcattgggaggagcccacatggcgttttataccccgatgagagggcgatgggagaatctctcggagcatcgacaacaacatcaggtggtcgacaccgttgggtcctggaataagacgccctcttagagcttagcttgtctatgtaatgttttttgaattggatagtgtataggttct

SEQ ID NO: 21841 - DNA, 547 bp, Sorghum bicolor
  Clone ID: 13390769
cttgacttggtcatatgcagctcttctcacagcgaatatgcgtcgtaactcggttgtgcccccttcatggggcgagacatctgcaagcagtgtccctggccaatgctacgcaacctctgcaacaggaacttatagcacggcgacaaacacgaattggccaagcacattgaccggggggtcgagctctactaccactagcgtaacgacaactagcagaaccacgacgacttcgaagacgactaccacatgcaccaccccaacttctgtggcggtcacctttaatgtcatcgctactacgacatatggtgagaatatcaagttggctggatcaatcgctgggctgggtagttgggacactagcaacgcaattgcactgagcgcggacaagtatactagctcgaatcatctctggtatgtcacgaagaccctgccagctggacaggttattcagtataagtatattcgtgtcgagagcgatggatccactaagtgggaaagtgatccaaatcgttcatataccgttccagcggcgtgtgcgacgacatgc

SEQ ID NO: 21842 - DNA, 441 bp, Sorghum bicolor
  Clone ID: 13390777
gcacgaggttcaactgcttcagaagaggatatcaaatcagacaaaatggttgaacttatacatcctcccgatccccgcactttactgcctcccattctggcatgcctccccaccgcattcgtatcgccacgccctcctccggctcttctccctcttctgtctccgattctgcgccaacgagtccagttcctcacttctgtttcggtttcgccaacggattcatggctccgattactttcgtggaaatcagagaaaggagaggagcttcaggctttggtggacggcacgaatttcgagccgcaccccgtctcgggggagatcgagctgcccgatgaactgcccgtgagctacaaacggatcgacgaagagactctccatgcacagctctcgcttcctgaatactgcttgaaggctatctatctctggtgcccgcctgatcag

SEQ ID NO: 21843 - DNA, 473 bp, Sorghum bicolor
  Clone ID: 13390842
gcacgaggagcgagctcgtcgtcgtctcagcttttgcaggcttgcagcagccaggcagtggtaggtaacagggccacggcgccgtctgatccatccatcaagtaggcaggcacacacacagccggccggcggcattcgattccatcgacagatccatccatccatcgagcgagcagcaggtagcaggtagctagcagcggattcggattggatcgatcgatatgatgggtcggggcgactcggcggcggcggagcagcaggcgtcgtcgacggcgccgttgctggagaagacgtcgtcggccgcggcggaggagtcggaggcggcgtcggcgccggcggaggctggcggcgggtactactactactactacgtggacgggtgccccgggtgcgccgtggagcggcacaaggcggcgaacccggggatcccctacgccaacttcatctacgtctggatcgtcaccctctgcaca

SEQ ID NO: 21844 - DNA, 435 bp, Sorghum bicolor
  Clone ID: 13390865
gcacgagggtgcgaccgggcagaccctccaattccttgtgagcttgtgaggggccatcttgactatacacctcatgcttggaacgttgttcctgttagaaaagggaatggctgggtaaggatgatttttgatgcttgttaccccaccaacataaaggaagagacagatccagagtacttttgcaggtatgtaccgctcagtcgacttcaaattgcactcgatgatgagggctatactcctcggtgttccttcccatcagtctcatcatgcaaagaaattgaagttacagcttctagttctgtctatcactgtaaaattggtgctgttgatgctgctgcaaagataccatatctggatactcgcagtgcctcaaatgatgaagttaaactttttgaatacaagcttctgggagaagtaagaatgctgggtgcgtta

SEQ ID NO: 21845 - DNA, 488 bp, Sorghum bicolor
  Clone ID: 13390876
gcacgagggtaatgaagaggattattgcttcagagataactcaacaagtacagctttgtccattccatttcattccttctggtttgcatgttccagtaacagccatatacaatacaagatatggtgagatcgaggagaggcaaagtgagctgcgaaaagaactgcatataaggctaggacttcccttagatcggcctttgttgcgaatttctaatgcattgacttttggcagcatgggaaagaggaagaaaagcatgccaagaagtggttcttcgctgcttcgagaagtccacagagaaattccatctagtggtgtatctggaggtgttatgtctttgattgatggttcgtatgagtattatcactaccttcacgatggtattgatgacaatggatggggatgtgcatatcggtctctacaaacaattgtctcttggtacagattgcaacaatattcatcaatagatgttccttctcacagggagatt

SEQ ID NO: 21846 - DNA, 439 bp, Sorghum bicolor
  Clone ID: 13390949
gcacgaggctcatatttggtgagtggtgtacgtgtcagtgagcttggagagatctctcgcgaggggaaaaaaaaataagctatatctagcagtgagtgatcgagttaggttcgccggcggcaggacggacgccggtgatcgatgatcccttacggcacggcggcggaggcggaggcggcgctggggcgcggcctgacgccggcggaggccgcctggttccgctactcggcggcgatgccggaccactggctgctgtggcacaacaccttcatcctgttcctagcccacatggtggtgccgctgccgctggcgctcctggaacgcgtggcgccggcgttcgccatgaggtacaagctgcagccccgggtgcggctctccatggctgccgtcgcccgctacttcggcgacaccatccgtgtcttcctgctcgtcctcgttc

SEQ ID NO: 21847 - DNA, 233 bp, Sorghum bicolor
  Clone ID: 13390969
gcacgaggaccaggtgctcttaatgagcctggccttggagttggattcaatggggcagataatcaggtggatccatcatcattgaatggccttgttaaacctgaccaggggatccttcaaatgtccccaccccaaagtactgttccctcacaactatttcctttcgctcaaggacatggaattgaatccttcacatttgacgaagtatatggtaatggattgagtatcaagga

SEQ ID NO: 21848 - DNA, 463 bp, Sorghum bicolor
  Clone ID: 13390975
gcacgaggctctgctagtttggtaattcatcgtacccagattgaggccactcacacaatacaatggtactcatcagcgaggacagtagggagttgctccaagcccacgtcgagctatggaaccagacctacagctttatgaagtcggtggcactcgccgttgctttggacctccacatcgctgatgccatccaccgccgtggtggcgccgccaccctctcccagatacttggagagattggtgtccgcccatgtaagcttcctggcctccatcgcataatgcgcgttctcaccgtctcaggaaccttcaccatcgtccagccatcatcggaaaccatgtcatcagagtcagacgggcgtgagcctgtctataagctgacaacagcgtccagcctcctcgtcagcagcgagagctcggcgacagcgagcttgtctcctatgctaaaccatgtgcttagcccctt

SEQ ID NO: 21849 - DNA, 439 bp, Sorghum bicolor
  unsure (1)..(439): unsure at all n locations
  Clone ID: 13390990
cctgcaacggcaggttgatggatctgaagcagactcatctgcgcagaccaacggctacccgccaggagcagccaacgaggcgagtctcgcgtcactcaatcatcctcgaccatcgtcggactcgactgccagctctgatgcagtagcaaaactggaattggaagcagagagccggtctgcatgtgaagtaggagtcaaacagcacatcacttccaacatcaagagtttgttcagactggccaaaagcacggggatctctcgaacggagtttcagtccttggtcaagacagaattggacttgctggatatggctgatgttgatgagtaacgatgtctttgttgtctttgctgttttgagctttttgttgattccagagcgtgtcttggacggggtctgggcatagagtatacactagtatggnttgggagttgggctgct

SEQ ID NO: 21850 - DNA, 386 bp, Sorghum bicolor
  unsure (1)..(386): unsure at all n locations
  Clone ID: 13391040
gagttggtcagttttgtagcggcacggcatctgggtccacttgtagtagtgtcatctgngtcatgtgtgtaaccccatcccccctttttccccttttcattgttgccatcatcacttgatggggggtttaagttatcaatttaggtcattggtgccccaaggcatttgtctgctagaccgctgcattggcttctgtacgtgtattgtattatttatttttattcttttatttagagaaaaattgagtcagtcggcgactgtcgtccgtgtacttgtaacatttgattgatgacatttgagtgtatcttagcgaggttatttatgctgatttcaccagctttttgtgcatgagatgagctcctcggaaacctgtatcgtgtaccttn

SEQ ID NO: 21851 - DNA, 569 bp, Sorghum bicolor
  Clone ID: 13391062
ttgcacttagttatgtacagaaagtatctgaaaaggtttcccttgcatctgatttcatgtacaatcaaatgacaaaggatgtaacagcaacctttggttatgattatatgctgagacagtgtcgattgagggggaaactggataccaatggcgtaatttctgctcttttggaggagcgattgactccaggcgtcactttccagttgtctgcagagcttgaccactggaagaaagattacaaatttgggttcggtatggctcttggagagtaaaacgacttgagcaaactcttctagacacatgtacaattatagtggttggcattagtcaacagagatcaagacgattctacttttttttttggcatttatttgtctcccagttattcgttcagctgctatggctgtggcctgtgggccgtggagaccttttgaagttttgatttcactgggctcatcacttgagtagtgttaaactgaaacgggaatgcatgaatagactgcagtccagcagattaggatttctgcatgccaaacgcttgatttctagacgtagtcatgtcttgatgc

SEQ ID NO: 21852 - DNA, 546 bp, Sorghum bicolor
  Clone ID: 13391109
cactcacggtgtcccagcccgttcccaccaggtgctgctgttccctgtttcctccccacctcgacttcctcacatttggtcttctgctgaactgggtgctggcggagaattaagctgctgcaggctaggaggctctggagccggaatctctttgcggaatgaattgttggtgcattagatcagacctggtaaaattgttcaggacaaatgcaaccctttcgtatgttcctttgttcgctgcataaatgaactctgtttgctttgtacttgcatgaatgaactctgcagtgattaaggtcacatggtttggtgtgtcaacctctaatgaagattgcggctactgatatatctctacagtaaggtctaggtccttctaaaaacatccatcctattcattcaactactggcagtagggtctgtatgtgtattctgcaagtgttttgcttctgtcttcctccaatcaggaatctgtcaatttgactggtgttcagtctttgcaatagttgaagggctctaggcagtgtttcagtttgtccttgtagtctc

SEQ ID NO: 21853 - DNA, 565 bp, Sorghum bicolor
  Clone ID: 13391114
tcagtattttcgaggccatcagcgcccactgcgggtacaacttcccgtttgatcccaccaagctgatcccgtaccacggaggagcagaattccatgactaccatcacttggttggaaggcaaagcaacagcaactttagctcaattttcacctactgcgattacatatacggaacagataaaggctataagtactacaaggcaaacgtagcaaaggtgaaggcaaagctggcaagaaacagtacggagagagaaggcagaaacggattcagcagtacgaagctggactgagatttgtcaccccccggccccttgcacgtgaataatggtgcctagctatatctatacatacagtttgttatagtcttgcgggtctttttctcaaggaacctaagatggacaaataatctgaagttaataagtacaactacttaattatgccctgtacattatactcacttgtaatctgcttttgtacaacccctgccatgtacattatactcacttgtaatctgcttaattatgctacctgcgtctattattataccttacatataaataataaa

SEQ ID NO: 21854 - DNA, 522 bp, Sorghum bicolor
  Clone ID: 13391168
gcacgaggctgcctttcccttcttcgggatgcgctggtggcgcccacaacaaggagaaggagaaggagatggagaaggagaaggagaagggatcgtccgggccgctgccggcgggcgcagcggcggcggtcgggtacatgtcggtggaggacgccgacgccctcgactgcggcgcctgctaccacccgctcaagccccccatcttccagtgtgactagggccatgtggtgtgttcgtcatgccgtgacaagcttgtgccatcgggcaagtgccatgtatgtggcactgccacaagcaactaccacatgtgccatgccatggagcgcctagtggactccatccgcgtcccatgtccgaacgcggcctatggctgcaacaccaggccagcctactacgaccaccatggccactgcaagacgtgtccatatgcaccgtaccactgcccgaacaaggaatgtagcttttttggttccacagatgcgctccttgaccacttgaccggtgcacatggctggccttccc

SEQ ID NO: 21855 - DNA, 557 bp, Sorghum bicolor
  unsure (1)..(557): unsure at all n locations
  Clone ID: 13391219
gcacgaggtgaacgtggtgtgcctgcaatggtagcagcatttgcaacacgccgattattatatccaagccaggcgtttgacataatccattgctcacgttgccgaataaattggactcgtgatgatggtatcctgctcctggaagttaatagattgcttagagctggaggctactttgcttgggcagcccaacctgtttataagcatgaagaggcccaacaagaggcatggaaagagatggaagacctcactacccgactttgttgggagcttgtgaagaaagagggatatattgctatgtggaggaaacccttaaataactcttgctacatgaatcgtggtcctgcagtcaaacctccactttgtgatgctgatgataacagcagatnatgtctggtatgttagtctgaaagcatgtattagtcggcttccagagaatgccgaagcaccaactcctgttcaatggcctgcacgcttaatggagccaccaaagaggcttcaaggtgttgaaatggatgcctactcatcaaagaatgagcttttcaaagcagaaacaa

SEQ ID NO: 21856 - DNA, 537 bp, Sorghum bicolor
  unsure (1)..(537): unsure at all n locations
  Clone ID: 13391231
gcacgagggtggaatttatgtaagactttttcttaaggaccccaagtttccactgagaaaccctaaaagattccttgaagggctcctagatcagtatgtctcctctgttgctgctacacattatgaagcaactgctacagatccagagcttcctttgctactgtccgcggcattggtttccttactacgagttcatccagcacttgctgaccatgttggctacctcggctatgttccaaagcttgttgcagctatcgcttatgagggaagaagggaaactatggcatctgggcaggctaccagtggattgcaggcagaacctagtgaacatgacaactcagctcactctgaggccactgtgcagactccacaagaacgtgttcgccttacttgtttgcgtgttctgcatcagcttgcgtctagcacaacctgtgcagaagctatggcagcaacaagtgcaggaactcctcangtcgtaccactgctaatgaaagcaattggatggcaaggtgggaagtatactggcattggagacat

SEQ ID NO: 21857 - DNA, 421 bp, Sorghum bicolor
  Clone ID: 13391250
gcacgaggggcacagcggccgtcggcggcgaggcgaggcggggcccgcggttgccttcttcctgctcctgcagtcctgctcggcgccggagaggttattagggtttccatctcatcaactttggccccaacataaacaaaggagtggtaccagccagcagaggaggccgggctcgatgctggccgcccggaacccccctccgccgccccatgacattgccgcgcgcctccaccacctgcgcgacctccgcagggtgccgctccccaaccgcgtcgcgcgcatcgccgacctccacaccgatgaggccagccccgtgcgcaagctggtcgccgagatcattggtgagcttgggtcaaaacacatggcgtatctacctgatatgatcccttgtttgctgcaccttctgaatgatgagacacct

SEQ ID NO: 21858 - DNA, 549 bp, Sorghum bicolor
  Clone ID: 13391265
gcacgaggttacaacctgtttcttcaaatgatagatcgggggattccaccggatgttgtgacatacaacacagtaattgatggcctatgcaaagctcaagtggttgacagagccaaggctgtctttcagcagatgcttgataaaggtgttaagccaagcaatggcacatataattgtctgatccatggatacctttccactggaaagtggaaagaagtagttcgtttgctggaagaaatgtccacacatgatcttgagccagattgttttatttatgctttactgctggactacctatgcaagaatggaagatgcacagaagccaggaatatttttgattctgtgattaggaagggcataaaacccgatgtaactatctatggcattatgcttcatggatatgctacagaaggcgctctttctgaaatgcatgagatttgatggtaggaaatgttgtttcgcctaatcatcacatctttaacataatgttttgtgcatatgctgaaaaggcaatgatagatgaagcagtgtgtatatttgacaaaatga

SEQ ID NO: 21859 - DNA, 512 bp, Sorghum bicolor
  Clone ID: 13391287
gcacgaggccagaatgcaatgatggctaaaacaggagttttaggagcagatgctgagagcaaggtagcagagcgaccgcgtctgaatctgaagcctcgttcctatgcaacaggacagtctgatgaaattgctgttaaggaaaggccatccctctttggtggtgctcgccctcgggaacaagttctcaaagaacgcggagtggatgttttggccagtgatcttgagaagacttcaccagttggcaggcctaaaggtgaatttgcaaaagttgagcagaaggttgaagctttgtccattaacccttctgttgaaagagctgatggttttccagctggtcatagaggcccaaggagtgttgataagaaagattacaagcgggatactgacaggggtgatgcatataggcctactcgttgggaggacaacaggagggtcgctagagatatggagaagccacaggagcaaccacgctcagagcctgagacatggcgtaagccagtggagcctccaaa

SEQ ID NO: 21860 - DNA, 383 bp, Sorghum bicolor
  Clone ID: 13391319
ttgttgttgttgttgttgttgttgttgttgttgttgttgttgttaggctagtacaacatgtcttgtatccaaactaagaatcacatgctagcatatcccattctgtagacatcaatcgtctgattgggtggcagagtggttgcaaatgccggtgacaattatattagctagaatatgttttattacctccatgtttggctgaattagtaaaaaattgaaattggttcatacaaaagtctgatggaatgacgaggatcttagctagcaacactatcgctttaacaagtcacgaagcagtagtgctttgtgtatgtctgcttggccccactcttctgaacattgctatctataatctattgccataaaatataatgtagccaaag

SEQ ID NO: 21861 - DNA, 689 bp, Sorghum bicolor
  Clone ID: 13391373
gctggatttggagggtttgcagctgcattgatcagccggaaacttgattggtgggtgatgaatgttgttcctattagtgagccaaatacattacctgtaatttttgatcgggggcttcttggagtagctcatgactggtgtgagccctttgatacataccctaggacgtatgatctgctgcacgcatctggtcttttctcaaaggagcagaaaaggtgtaatatctctagcatcttgctggagatggaccggatactcagaccaggtggtaaagcatatattcgtgaccggaaagaagttatacaggagatcaaagaaataacaaacgccatggggtggcgtggtactatacgtgacactgccgaaggtgcatacgccagtaggaaggttttgatgtgtgacaagcctatggggcgttaggcgatcaggggaaggtatgatgacacctttggaatttcgaattgctaagcaggggtaattttcaggcactttttggaactgacaagagctgctgtcgagactgacattcgttctgtagatagggtaggtcaaggtctaatttgtaatgatttgattgatcatccatttgtacaatgatgatcggtgtaattcctgagatgccattttttgttgtataattgtcatggaaaccttgcaaaagtgaggagatatttttcagaagaaggtca

SEQ ID NO: 21862 - DNA, 508 bp, Sorghum bicolor
  Clone ID: 13391386
ttgctgggctcattgagagctcatcatcaagactcacttacgccatcaccgcaccgccacctcaaccttcattggtccggctgccatcttcttctccatctccaccatcagctcctgcaaaccctagtggacggcattcttatcagcattcgtagtagaaaatgaaacacgttaatctcagctccttgtagtatgaccatgaaggcaccatggtaacgatttgtagagtgaggctaccttgagtgggcttgttactgccaccaattacagctcgtgcctccattccccaccaatgtgcagctgctcagttgctgcatttcagtacatagcatttgtacagtttccattacatagggttcggggtcggttttgcgtttttttttcttgtacacatgtaaagcatatgatcttttttgtaacatagatgtccatagaatactcgagctgaaacttgtaacgattcattgctgggtggatgcactccttgttcggatcacacgatttattg

SEQ ID NO: 21863 - DNA, 603 bp, Sorghum bicolor
  Clone ID: 13391419
cagtctagatgcaagcagagcaggcatcagacaagagatccatgcttgaaagagaataccagagggcgctatgtcttttttctttttgactctcaggttacttcagacggggcagaactgaagtgccactgcaacagaaactgtatttcaagatgacaaaaagcgcagcggaattagcatgtactgacatagttctatctaatcttggtcataataattgtattgatgaagggtgttatgacaaagtgattagcagcagctaatcttcttgatgaggagtgttgctgcaggagttggatgatccttcattttttccccactatggagaagaatcatcgcattgccaactctgtccatattctaaatgtagttgctggtagtggtagatccgtagagcaacttgcaggttcttatcaattatcatgatgtttggattgtgcagttgtgaattactgatttttcgaagtcgagaagaattctacattgtaaagaatgtttgacagccatatattatcctgactgcatccagttaaagatgaagtggtaaacgctgctacagtagcttcgcatctttgagtaactaaagtggtagcgagatggtat

SEQ ID NO: 21864 - DNA, 360 bp, Sorghum bicolor
  Clone ID: 13391467
gcacgaggctttatgatggttctaatgactgctacttccacagcggtaaaagaggacatcacaagtattggggcaccaggatgtttaaatatgatgatgtggatgttctgcacttcttgttgtccaatttgaattggtgggtcactgaataccggattgatggattccagtttcactctttgtcttctatgttatatacacataatgggttttctacttttactggtgccatggaagagtattgcaatcagtatgttgacaaggatgcactgatatatctcattctagcaaatgaaatgttacatcagcttcatccagatattataacaattgctgaagatgcaacattttatcctggat

SEQ ID NO: 21865 - DNA, 389 bp, Sorghum bicolor
  Clone ID: 13391479
gcacgagggttaatggcttttgacaggtggttacaccaacagaattgtaaaagtaaatctacacttgaatcatatggtttctgactcctcttttttagtcattacagttaaaaatctagataatctgctttggtaacaaattttaatttttaatatgttgccatatacagtgatgtttgaaactgtgcttctattttccagttctactgtaatgataagtgaattctttgtgaatgatcacttactttggaaaaattttagtttgatcctgataaccataagaggaacatatggctgaaactatggacgcaactattagaacaggagcaggtcaaactcagtgtactgaaggagatgcacaataccagttacaagtgtatctagatatt

SEQ ID NO: 21866 - DNA, 372 bp, Sorghum bicolor
  Clone ID: 13391501
gcacgagggttaactgccgcctcccccctcccttctgccgcacggagcccaaaccgcggcggaatcctcgccctccgccctccagggagccgctgcggcgccgggtttcgtgcaccgacttgtttgcccgcctccacctcctccgcggcgacccatggctctcctcgcccccgccatctccggcgaggttggtttgcggctcttattggcaccgctaagctctaacgtagtcatccgtacagccagttgtgctgtggggatcggtctacccatgtactccactttcagagctatagagaagaaggatgagaaagagaaagagcggttgcttttgtattgggcagcatatggatcttttagcatcgctaaagt

SEQ ID NO: 21867 - DNA, 380 bp, Sorghum bicolor
  Clone ID: 13391508
gcacgagggttattcagtgaaatataactacaatcctattccttgcctgttttcagggtgtcttaattgacacttcatgacttcaatacacaaaccaatggtcagcaagtcacctagcattcctataagggcgtccccaacagccgatgaaatcgccagctcagtaggctcggtacgaggttcgtactgacgtggcagggagaaaacgagtaaaaagtgaaacactagcgatttctttggcgctagcgcggagtctgttaaagcgaacgctgataggtgcattttgctttttcctctggccggcgatcacagtgtctgctaaagagagtaatttactggcagctatcgaaatcgatagcgccgctgcggacgctctaaca

SEQ ID NO: 21868 - DNA, 386 bp, Sorghum bicolor
  Clone ID: 13391511
gcacgaggctctactccccgcttcccgattcaagtcagcggttttagggttcgagatctcggcatcgcgcggaagccatggcggcaagcacgcttagtactgtgaaggtgagcaatgtatcactgaaagcagcacagcgtgatataaaggaattcttttccttttctggtgacattgtgcatgttgaaatgcagagtggcgatgagctttctcaagttgcctacattacttttaaagacaatcaaggagctgagactgcaatgcttctcacgggggccacaatagtttatatggctgtaatcgtgacgccagccaatgattatgagctaccggcttctgttttagctgctcttgagcccaaagacacaaaaccttctgcccttcaa

SEQ ID NO: 21869 - DNA, 366 bp, Sorghum bicolor
  Clone ID: 13391549
tgccaattgcccgccatgtggagaaccggcctgctctacctcgaccgcggggacagctccatcctcaatgccctgcgcaatgcggggtacgacacccagaaccagccaacctcgccctcgcgcaccccccgccgcttctccattgccagcgacaccgagagcgccctcgagagcaagctcaagcacgacatgaaggtccaccccggcgtccagcactgggtcatgccctcggacgtcaatggcctcaagtttgccagcccccgcgccagccctcgcgccagagccattgaccccgcagacgccctgggcctggccaccgatgccaccctgttcgaggagcccgtcctttattcgctggatcgaaat

SEQ ID NO: 21870 - DNA, 404 bp, Sorghum bicolor
  Clone ID: 13391554
gcacgaggctcgatctccccactcctaccgccccgcagctggctgcgaggcaagctccggcggcccccgcggtgagcttcatcgctcccgccccatgtctgtgcctctcgttgggttggctcgtatccctatcccaacatcttcttccctcccattgccatggagctcctgcctgctccctttcccactttcctccctagaccccaccaattacttccccaattgcctctttctagaccctgccatggccgcctccaagaacccatcatggctgctttcgcccaggctcctccccttgcactccccttccaagaagcaacgagaagcagcagctcccagcctccacgcccaagtaaccgtcccagcccccccgcccagagaccaacaacagctcacctggccgc

SEQ ID NO: 21871 - DNA, 294 bp, Sorghum bicolor
  Clone ID: 13391557
gcacgaggcaagtcttttagcaaacttttatgcgatgcaccatatctacctgagtcttcgtttagattactggaggatctttgcatgtcacaagacaacagccaacaattaaaggatggggatggggaccgtgttacccaaggcctgggaactgtatggagccttatcttgggtcggcctccacttcgcgatgattgcttggatattgctctgaagtgtgctgcccactctcaagatgaagtcaggggaagggcagttagattggtttcaaaaaggctctatgatctaccatat

SEQ ID NO: 21872 - DNA, 306 bp, Sorghum bicolor
  Clone ID: 13391601
gcacgaggccaatccctccccccgcgcgcccctctcgcggcgccggcgccggcgccgcccctctcgctgttgcttctcctccggctggagccgctcctccccccacggaaggttcaggctgcggcgctcgggcacaccatggagcttgatgatgccttcaggaagcgggcctgcgtgagtggtgtcatcgaaagatgcttggctggcggcccaaaccggttgagctctctgccagacagcctccttcatatcatcatgtccttcttgaaagcccggcaggcggttcagacatgcctgctgtccaca

SEQ ID NO: 21873 - DNA, 416 bp, Sorghum bicolor
  unsure (1)..(416): unsure at all n locations
  Clone ID: 13391621
ccagcacgaacccacgagagcaagaaaccacgcaccgcgtcgcgtctcaccctacccccatcccatggcgggctcagatcggaacaacatcgtcatcgcctgcttcgccctgctcgtgtcgatctccgctctccaagtcccatcctgcatcatcgacgacgagcggggtactagtactagtactagtgcgggcactactaccgcagctgctgtcacggcatccgcgtccgctccgcctcccctcttcgacgacggcgctctgatgaaggcggccatgctggcgctggccgggatggatgcactcgtcatcgccgcggcggtcatctacagccgccacacgcaccacgccgccntgggcgcaggcggcggcggcaactggcgtgtctcggagctcgccttcttcgtcttgtgcctgc

SEQ ID NO: 21874 - DNA, 584 bp, Sorghum bicolor
  Clone ID: 13391694
ctgctgaacagagtgtctcgactgccggatctgctatcatgaagaacaggtatgtcctcaccggagcagcatgggtaactggtgctttcagcaaggtcaccagtgcagccaacgatgttggtgcaaaggcaaaggagaaaatagcagtcgagcaggagcacaagaatgctgaggccgggcctgcacaagcaaacatctcagagttccctgcagcacccagggaattggacagcgaattcacgaagatacatgttgctgaaacccctgaagaaattcccgtctctacggtgactgtccctgctgttacagaggaggagctcagcgaggcctctccaccagctgatgttcctacaaagccagaagctgcacagggtttggtactataagtgatacagttttgcctcatacatgcatgtaatgtaaatagacatgagatgaggtagccattgaactcattccgtgatgttgtggttgccatcttcagattgaaaccccttttttttaaggttgaaatttattgggacctaaaggagtttgcaatttgtacctggtacgttttatcaattaaccattaatcgttatta

SEQ ID NO: 21875 - DNA, 158 bp, Sorghum bicolor
  Clone ID: 13391725
tttgttttgttttcacctttctgagtacacctctctgcccttctcatgataatgcgacacgatgatgccgaatgtcttatgttattactacataacccatccctttcccttctaccatccaagtttgttttactttttgcatgtttctttgctgcaca

SEQ ID NO: 21876 - DNA, 582 bp, Sorghum bicolor
  Clone ID: 13391791
tcttgtgcctgcagctgcaggtcggcgtcctccagttcgtcctgttcgtccaggagcccacagcagctgcccgtgagctcggggccagtgctgcccgtgctttgccctgcgttgccttcgtcaccttcttcctgggcatcacgcttatctacgcgcacgttgacgttggtaacggcggcggagctgccggaggtgctgtcgctggcgatggaccagtcccggcgcccgccacggccaccgtcaggcttcttgctgatatgacgctcggggctgcattagcctgcctgatgagcatcatcctcgccttgttctacatcaaaaccaagtgacattcaaatatacaattgaggcgttggtgaacctgagaattacatacctaaactacttacgtagtttggtgaaccatctgatctgatggttcgtgcattattggcatatactatgatctggctgtaataaaaatctcctgaaagataagtgccttctgcttggctatttattttgaaaaaaaagtgaggcctacgacagtttgggccttgtttagtttttttttttttttgcaaaatggagtactgtaatact

SEQ ID NO: 21877 - DNA, 547 bp, Sorghum bicolor
  Clone ID: 13391823
gcacgagggagatatgttgtgtaccaaatgttgtaattacttgttggactagcaagtttaatgttgattccatggattgccatatttccttgtttctgtatcagtgtgcttgtagtttatgtatttggcctggggctatagttgcataatttgtggtaggcctatttatttataacatcttatctgaatctttcagtggtctttctcggatcctcgtttattactagtgaagctctgtgatgtctgctactgttgattcgactatcatagagacatgatttcgaaatacagaacttgcaaagcccattacagagaagcttggaatccttgttatacaaaaccagctttaggaagctatttgcatactattgtgatcatgagaacactaatatgttacctattgcagtatttttaaagttttagcttttgtaacttgctatgttctttttggagatttgccaagaagttgacttccacaacattggcttttttttatcattatttgaaatctattgcctcttgttgcagcggtatggattgacccctc

SEQ ID NO: 21878 - DNA, 480 bp, Sorghum bicolor
  Clone ID: 13391828
gcacgaggcaccgcacgggtacgccctcacggccgcacgggtacgccctcaccggctcacccctcagcgtctgctcggtcctcccgcagccgcacgggcacggcggctggcgaccgcacgggagacggcgcacgcgacacgccctcttccatccagcgcctcgacggttaaccggcctcggcgcctggcctccccgacctcgcccctacagtcgagctgacctgcgcagctcgccgaggaatccagtagtgcaactgcaacaggtacgacgtacgactgtacgagtagttcagtagtgccgtatatgcagtccaccgatccgaatccgcccctgaccatgagctctcgttggattccgatccgagtaggcgtccagcctccccgccgccatccatcccatgtgatgtgacaataaattgatgccacatccgcacagagagagagagagatcccttttgttgccacccagccctccgattt

SEQ ID NO: 21879 - DNA, 492 bp, Sorghum bicolor
  unsure (1)..(492): unsure at all n locations
  Clone ID: 13391831
gcacgagggcgacgaggacctcaagacgcttcgccggatcatcgctgccgtccgcgccgccgagatgcgcgcggcctccgcgtccgacgtctgcccggtggcagcgacgacgacgacgacacctgcaggcaagggcgccaagagtacgttcggccgcgacgacnaacagtcgccgtccccgtcgccgccgacgccacagcagcagcacaaggtggtgcgcgccggggagcagcagtaccccagcccggactcggtgctggacgccatcagctccccgaggttcccatgcaggaagcggccgtctccctgcacggatctcgatgtggggggcaagggcggttgcggtaacggcgccttggcccccaccgtcggatcgaagatcgtcaagccctcccgaacacttgttttctccggtggatactgcaagaccaaatcagacggtgatgagctgccactgcacgccgtccattacccggtgccgctggtggtggg

SEQ ID NO: 21880 - DNA, 353 bp, Sorghum bicolor
  Clone ID: 13391849
gcacgaggcagagtcttctgccaatggaagctcacgcaatcgtcaccataatactctgctacctccaccgaccaccagtgaaagtttgactatccccaccgcaacaaattttaatgttccatatcctcctgtggaacagctaaaccagagtactaatattgctgcaagctctactttgtctgatcactattcttcatatagtgatccacatgcaaacgaattcgtgcgaaacacacggatgcgaataaaccctagcgattatgatcaatcgcttcccagtctattacctgaggggagtttcaggtgctcagcttatcagtctacacagcagcagtcatcatttattccagtgc

SEQ ID NO: 21881 - DNA, 378 bp, Sorghum bicolor
  Clone ID: 13391866
cgcacgcgcgcgcgcgcctcctcctgcggcggcgacccccgcggcgtcgccctagggttagggttccggcgacctccctcccttccgcgtcgcggcgagcgaacgcgtgggagatccgcaccccatgtcgtccgacccctcgccccacctcccctcgccggtggccccgccgggcgcggcggaggcggatccccagccccttcccctgccccagcctaccgagccgcccgaggtgatgcaccggacgagggccgtcgacttcctcggacgacgcacgcccatcgtctaccagaacgacaacgggccctgccccctcctcgcaatctgtaacgtgcttctgctgaagaatgtgatcagcctgaaccctgacgagggcga

SEQ ID NO: 21882 - DNA, 492 bp, Sorghum bicolor
  unsure (1)..(492): unsure at all n locations
  Clone ID: 13391911
gctacctcctcctcctcgtcctcgccggtgacggcaggggcgaggtcgccgcgtttgagctggaggaggccaccatcgactcgatccatcgcgccttcgcgaccggggggcttacctcccgcggtctcgtcgagctctacctgcgccgcatcgcgtccctcgatcccactctccacgccatcatcgagatcgacccggacggcgcgctcgccgccgccgaccgcgccgacgccgctgcccggtctagctccggcgtgctcccgccgctgcacggcgtccctgtgctgctcaaggacaacatcgccgcggcaggcgacggtggggtgctgaacgctacggccgggtcgctcgccatggtcgggtcacgccccgcgcgcgacgccngcgtggtcgagcggctcaggcgcgccggcgcggtgctgctcggcaccgcgagcctcagcgagtggtgcaacttccgcggccccggcatacccgccggctggagccccc

SEQ ID NO: 21883 - DNA, 480 bp, Sorghum bicolor
  Clone ID: 13391925
gcacgaggcggcttcgttccccaagcaagctagccatggcagccgccgccgccgccaccccgcttgacgacgccaaggccaagaatgttatccgccaggtggagttctattttagcgacagcaacctcccccgcgacgggttcctacgtaggaccgtcgaggaaagcgagaatgggttggtgagcttggctctcatttgttccttctcgcggatgaggtcacacctaggtctcgaaggggatgtgaaaccggatactgtgccagaggagaccgtacttgcagttgctgacgtcttgcgccgttccacagccctccgtgtatcaaaggatgggaagaaagttggtaggtctaaggagttgttgaagccagatgaggttatagatcaagtggactctaggacagttgctgcatcaccgcttccttacaatgtaaaactggaggaagttgaatctttttttgctcaatgtggcaaggtaaata

SEQ ID NO: 21884 - DNA, 476 bp, Sorghum bicolor
  Clone ID: 13391936
ccacgaacaagctaaggtacttgaaccgggcctgcgtgcttcggaacccgggcaaggtggacggggcggcgtgcgacccgtggcggctgtgcacggtgcagcaggtggaggacgccaaggccgtcatccgcgtgctcccgatatggtcgacggggatcatgcccggcgtcgtcgtcgggcagcagatgttcccgacgctgcaagcgaagacgatggagcggagggtgggcaagctggacatccccgcggcctccttcggcgtcttcgccatcctgacgctcaccgtctgggtggccgtgtacgaccgcgtgctggtgcggcccctgtcccggctcaccggccacgcgcgcgggctcagcctgcggcagcggatgggcgccggcctggcgctcttcgccgtggccatggccgtggccgcgcacaccgagagcgtccgccgagccgccgcgatcgcccaggggctcctcgaccgcggc

SEQ ID NO: 21885 - DNA, 438 bp, Sorghum bicolor
  Clone ID: 13391943
gcacgagggctgcagccaagaaccataaggatgttcttattgtggtggatcataatgattaccctgctttactggagtaccttaaaggaaagcaagaggatcagcagttccgcaggatgttggcatggaaagctttccagcatgttgcctcttacgattctgttgtgtcagaatggttttggaagcaatcgaataaagtaggagagatgtttcccccaagctttactgtgccacttgagctgaagtctacactccggtatggcgaaaatcctcatcagagtgctgcgttctatgctgacaagagcctttctcgtgttggtgctggtggtattgccactgctattcaacaccatggaaaggaaatgtcttacaacaattacttggatgcggatgctgcatggaactgcgtatcaaagtttgatagtcctacttgtgttg

SEQ ID NO: 21886 - DNA, 504 bp, Sorghum bicolor
  Clone ID: 13391949
gcacgaggccgcgagcccacccgtcggcgagcacccatgacggaggaccgagcgcacaaggtcgccgatgagcccgccgccgcaggcaggcgaagacctgaaaggaagaagaggaagtgggatcagcccgcggaggacttggtctccgcggcgatgaaggctgctgccgtggcggggatgcctgtgatgaatttctgtgctcttcctggcgctgcactgcccggcgtcacggcatatggagctgctacattgccaagtgtagtccctgttccacattcgttgccgccccatattgcgccatcggtgctcccgagtgctgctgctgcagttcagaaattgagtcaggcaaaactaccagatgaggtcattgcacgcgagattgttataaacgacgcagatccatctgtgcgatataagcttacaaaacgacaaacacaagaagagattcagagatgcacaaacactgtcatcattactaggggaaaatatcaccctccaaatgaa

SEQ ID NO: 21887 - DNA, 527 bp, Sorghum bicolor
  Clone ID: 13391953
gcacgagggttttggatagcttgttcagtgtagttgttagctgttgatttgtgcgtcatgttattaggatcttgtagatctgggttagggtgttatttttctctgcaagtagctttgtatgcagagttcagtttttcagactttcgattcttagttcatttttttgaagtaggcaattccccttgggatgttttcgagtgctgaatggtagccctcgctgacagagatttgtattattcttaagtttcggattgactggttggatggatgcagattaattttgttggatcatattttcagagcagacaattttattttgtattcgtgatatctgcttgactgataccctagttcagctttttttaactgatattcaggttgtagtttcaattttagttttgttatttacatgtatcttttttgaatgctaccttaaacctgaactcaactagtttactacattgatttatttttcagttgatttacatttttttaaggttgaggcttagctgatgttgtttgagggt

SEQ ID NO: 21888 - DNA, 179 bp, Sorghum bicolor
  Clone ID: 13391965
gcacgagggctgaactggcatcgtgcctgcttcagaaccttacaaaagtagcacaagaaactctcccagcatcttttggacttgcagagagggtactaggcctatgcagggacaagctcaaacctgtccttcatgagttacttaagggcactcccttggatgaatacagcaatgttgct

SEQ ID NO: 21889 - DNA, 258 bp, Sorghum bicolor
  Clone ID: 13391978
gcacgaggcttccccaaatttctccgcattcatagcgctccacttccctgcctgctcgttagagagcgacgccgcccggcccgacgcaccaaagggacgagagcgagaggaggccaagccaagcagcagctgcggcagaggacagacaggcgccgcaatgcagggctccaagaccaaatctggctccgccgaggcgaagagcaacggcaagccgaagccggacaaggagaagaagggcggcggcggcggtggcggcgg

SEQ ID NO: 21890 - DNA, 440 bp, Sorghum bicolor
  Clone ID: 13391980
gcacgagggggaggagaacgccgccggagccaccttgccggaccggaaacagcgaatcggatcgcatcaaagctgcctagtcatcccccccctccccgaccggaactcgctgcaatccgtcgcaagtcgccggggccgtggacgccgggccgccgtcgccaaacggaagacgctgcctcctagccgctgccgcatggaggtaccgtctcggggccgcaactgcaggggcgaattgtcgctcagcaggcggtcagattcatggcgcccacggagacttatgcaagggacgacgatgcaaaacttgaggccacacgtgcaaggctgtcaaacatcctcacaaggcatgaagatctgaaagagcgcctttcacgggattctgataagctgatttttgagcgcctacagaaagaatttgaggctgcacgagctgctcaaaccga

SEQ ID NO: 21891 - DNA, 590 bp, Sorghum bicolor
  Clone ID: 13391993
tcaaggcaatggagttcttcccaggcacaccagggctacacacctgccgagtcctcgaggcagtggagtaccgcgcatcagagctacactcctgagccatcgaggcagcggagctctgaacgtcagggctacaatgttgagccctcgaggtcttggagttccggccagcagggccagaatccggaggcatccagacaatggaaccggggaaagcaagatccttactacaatcccagtgatggtcgaagatcatacgatcagcaccggaggagataacaaaagctgtatactacattagctagaatcctggagggaggcggtcggttcttgggagggtttctttcatttgatttgatgtgaggccggttattcgttacattgggctttgtgattgcacaaaggccattgagaaaagctatagatcatgtaccaatctagttttgtctcaaaatgaaaaaaaaatgtatccatctagcattctagctggagaggggaaagaagaaaaatgaatgaatgaatagctcagaaagagataagaggcaccggctcgatttaattgcagtcttgaatgctaaatcgaacgatggtca

SEQ ID NO: 21892 - DNA, 261 bp, Sorghum bicolor
  Clone ID: 13391997
aattatctacgaccttgttgatccaaatgctaatctgatatttggcgctgtcatagacccgtcactgagtggacaggtgagcataaccttgatagctactggcttcaaacggcaggatgaaccagaaggtcgcgcttctaagggtggccaacaaggtgagaatggccgacgcccatcctttgcagaaggcagcatggtggagatcccagagttccttcgaagaagaggaccttctcgcttccctcgagtttgactgtccag

SEQ ID NO: 21893 - DNA, 536 bp, Sorghum bicolor
  Clone ID: 13391999
acgatcgtgagggcggcgcggcggccgcgggacccgagagacgacgaggtcagagactacatgggccggcgcgtacgctacgagtacatcattcctgggcccaagcgagctcgtctcgccgcctccaccgagaccatccagcgcctgctgcgagaggtgagggcgggcgacgcgtcgcagacggagtgcgccgtgtgcctgcaggactacgccgcggaggagacgatcagggcgatgccggtgtgcgcccacgccttccaccaccactgcatctccgagtggctcagccggaacgccgtctgccccatctgtcgccgcgagctgccgctgcccacgcaccaggaccaagaggagcagcagcagcaagaggaagaggtggacgacgaggaggacgagaacggcgtcaggaggagttggaattggatcagagttccagtttcagcatgagctgggcgcaactggtgaaagagaggatttatttatttgcattattagcagtcagcactaaggtgtgcgtttttttgttctctcccaat

SEQ ID NO: 21894 - DNA, 626 bp, Sorghum bicolor
  Clone ID: 13392003
cggtgggagcaggaggccgcggcggcggggcgggtgatcagccgcgcgacggcggagagcgtgggggaggcaataatgtgggtgcggcagcagcagggccagctgggcggcgcgggcgacgacgagcgcggcagggtcgcggccgcgctggagcgtgccatcgtgcacgacctggtggccgacctggttgccgagctgctgcaggcgcagtccggcgggcacggggccgggtccgggtgcaggaagagattgtgcttctgaatttctgatcaatcgcgggccgggactttcgcgtcattttcttgggtccttgtttttgtcgcgtgcgtcgcatgtgcttgaatttgttggcaggtcaaggtctgaggctctgactgagctgtgctgtgtacgagaggaaataactgcctctgctgcccgctgcggcggctgcggctgcagctgcgccatgggtgtcagtcgctacagctcgcctgggtagctagctacccccacctgataaaagagaccggtgaatgccgatcgtggttgtattaaaagaacggattcgccgcggcgttcagttgtaggtggagtaatcaatatcaaagtgatgatgagaagctgctgccaagtacgcaggcggg

SEQ ID NO: 21895 - DNA, 590 bp, Sorghum bicolor
  Clone ID: 13392065
agaggtccttcagattgctggcaccagtgaatccacacctgctccaatcattgattcagagaaaacacctactaaagatcataagaatgaatcatcggtgcccgtgacaactgcccgtaaaagattatttgaagaagaaaatgttattgacaaagaaagtacaggtgctcaggatctagatgcacagactgcgggtggagacaatctcatggatctaactgatccaccaccaccagcaaaaacaaaaaggcccaaatataaggctcccaagtaacgaacccgctctcatccaacgtacatggacaaatcagaaaataaatcttcaaagacgatgggcaacaaccttttgtgcaagatggtacttacaccccttagaagcatgttgctttttatctgcaagacaagattgtatctatcagcagctaatgccaacaggcaactttattttgctacatagtatgttcgttatgtaataatgctttaggatactgttatctgaacaaagactgagattatgtactttttatgtatccgtaatactgatatggttacctatttgtgcttctacaacaagtacgcaagtataacca

SEQ ID NO: 21896 - DNA, 604 bp, Sorghum bicolor
  Clone ID: 13392079
agaggaagttcaggaggcaaagcaacagatactaaaaatccaggtggcgttggtgcaggacggagagaagccgcgagtgatgagttcatgcttgagcgtttccgcaaacgagaaaaattccgtgcccttcgaagatagccagagctgacatgctgctagattgtgccagttacctttgaagctcaaaaatgtcattgtgatcacatcaaggcccaacatgtcatgtcctttttagtgagaaatttactgtaaaatgcatctttggttgttgaatctgcttctgcagttgctaagggcaaggagcagattaaatccttattacagaggtgatttggggcaatatatttgagctgagggatatctgaaatttgtgtcagctcggaggctcagatgtcagaggggccttattggttcaggacaaaggtgtgctctccatgaccatgaccaatataaatgaacatcttgagcaaacaccaaagggtagcgtgatctcattttctttgggtgcatggcaaagcctgcaaaatttatctttctagccttgaatatattgtttctctgaattgttcgtagtctgctgaagtagcatcagctatctataaga

SEQ ID NO: 21897 - DNA, 642 bp, Sorghum bicolor
  Clone ID: 13392086
gacaaccttgagataccaagcatgaatgtcattaatgatgcaatgcaaagtggtgagcgtgctcttatgcttgctgaattcaagctatcactcaactcctacttatctgaactggccacttcacctgttagatcattatcagacataattgagtttaacaagaagcaccccattgaggaaaggatggctgaatttggacaagattaccttctacaatctgaagcaaccaatggcattggtccaactgaggagcatgctattttgaatctgaacaaactgtgcaaaagaggccttgagaaaataatgcaagataaccaattggatgcaattgtagccccaggtgcatctgctcacagcctgcttgccattggcggttatccggcaataactgttccggctgggtatgctgcaaatggcgtcccttttgccatctgcttcggagggttgaaaggatcggagccgaagcttattgagatatcatattcatttgagcaggcaacgagagtaaggaaacctccgtcaatgcagcattctgtcatttgaatgtaactacggagatgaatcatgtaaaattttttggcagtatttttgtttaactttgaggaaacatttattttgtttgtcagtatttttgttactttg

SEQ ID NO: 21898 - DNA, 663 bp, Sorghum bicolor
  Clone ID: 13392096
ataaaggcaatgtgagtgaggagcagtcagatgctgttgaggaattgaaaggggtatctgctggggaaacttcacaatctgttgacaaggatgataaaagcccttcagacaatgctcaagataaaatctcgagggaggacttaaaagaagaattcactaaatttggcacagtgcggtatgtggactttagcattggggaagattctggattcattcggttcgaggattccacagcagctgacaaggcccgtgcatttgcagccattgcagatgaaggtggtttgactatgaaaggccacatagtcactttggaacctgtgtctggtcaagccgaaaaggattattggagtgcaattcgaggtggtcaggagaaatataaagatagccgaaacaacagaggacgagactggaggaataatagaggcggaaagccgtttggtggtgggaagcgggggcgacacttcgactcccgtgacagggcctccaataaagctcagaaagtttagatgcaatatagatttagtctcgatataatgaggaaaacatatatatgctgcgccgcttccgtccgcatttgtggaaggggcattttttatgtttattatttgaatgttggcctgaactttgaaaagcagactgtgaaccatgaggcatgctgataag

SEQ ID NO: 21899 - DNA, 649 bp, Sorghum bicolor
  Clone ID: 13392114
atatccactaagttgccagcaccacccctgaagagcatgctgccgccaccaaccaagaacatgccaccgccaccgcccaagagcatgcctccgccgctgccacccaaaaacatgctaccgccaccgtctaagagcatgcctccgctgccaccaaaatttccttcagatgagttattgtcaagaaatgagaacaagacttttgctttaaaagagctgacagcacctccaaggcccttggatgcaaaatcagtcctgccatctcaacaacgaccaaaggagcctgaggaacaaacaaaaggcacacctgtgtctgatactttgctgaaacttattgattatggagatgatgatgatgatgatgacgacgacgacgatactgatgtgacagacaacatacccaagggcagtccaactcctggttcagagcagaaaccattttgggctgtttaaaactgggtctgctaacgtagtctagtgtgagatcgatattgctgataaggatgcttgctgccctggtgcatcttctgaatcgaagaggcaatcgagctccttgttcttgttccgtagtaattctaacaggcgatgggatttttctttgaacttgtattcattgtggtgtagtcaaaatgaaccgtatgtttcacatttt

SEQ ID NO: 21900 - DNA, 626 bp, Sorghum bicolor
  unsure (1)..(626): unsure at all n locations
  Clone ID: 13392150
agctaacagaatcagggaggtagctgatgctgaaactatccaatggaaggagaaggtattagaccaagagaatgaattgcagaacataaaacaggagaatgatgacctgcaggcaaaggaatcagctgcttctgagaagattaagcaactcgcttcccagcttgcaaatgcaaaagatggcacgataaatggtaacaccaaggaaggagataatgagaagggggacactgaagatgaagatgaacctgttgtggtagtttccaaaatgtgggagaacagcaagtttgctgactatgattcatctaaggagaaggagaatgatggtgagtcacaggttgatttggaatcaaacaagggggatgcaggtctcgacggcaatgggctgcactcagctaaggagagcagtggcaagacatcaccaactaaacagcaccagcagcataagaagaagcctttgctgaagagattcagtggtttgctgaagaagaaaggcgaaaattagcataaaaccattttatgataattctttgttctgtcctttgtgacatatttctttgactagccatctagttcctgagtcttcttccncccatgttatggtaactcaaatgatggatgctcgaaag

SEQ ID NO: 21901 - DNA, 513 bp, Sorghum bicolor
  Clone ID: 13392167
gcacgagggaccacaccactctgcctgcctgcgctcgacccctgcggccctccccgtccttgacccgacccgccccggcgcgagcgcgagcgcggccgcgatgcgcgaggaggtacggagctcgtcggcggcgccccccgacccgccgcccgggaggtcggcctcgccgccgcccacacccgtcgccagttctgctggtgcctcgtcgccccctgcacaaactaatgtagctagcatagattggcttggcagtgaccaagtgcccaaagcgggatcctctcatattgctccgccgacatctcagcctgcgcttagtactaacgctaatggagctgctgtggattgctttcagtcatcatgcagaccgtgggaacgaggtgacttgcttcgtcggctggctacatttaagccttctacttgggcttctaagccaaaggctgctagttcactggcttgtgctcgaagaggctgggtgaacattgacatggacaagattgaatgtgaatcttgtgg

SEQ ID NO: 21902 - DNA, 514 bp, Sorghum bicolor
  Clone ID: 13392177
gcacgagggattattcttcccaaatatgattgcatgcagcataaccaaatcaataatcttaaggttctagatgttgtggtgaagtcttacttcgaaggaaatatgtttgcgaacaagatatggactgggactgttgaaggtcttcctgtctactttattgagccgcagcatccaggtaagttcttctggagggcgcaatactacggagagcatgatgacttcaaacgtttttcctactttagccgtgttgcactggaattgctgtaccaatccgggaagaaagttgacataattcactgtcatgactggcagactgcatttgttgcacctctttactgggatgtttatgcaaatctgggcttcaactcagctagaatttgttttacctgtcacaattttgaatatcaaggagttgctccagctcaggatttagcatattgtggccttgatgttgatcacctggatagaccagacagaatgcgggataattcacatggcagaataaatgtagtta

SEQ ID NO: 21903 - DNA, 546 bp, Sorghum bicolor
  Clone ID: 13392187
gcacgaggcgtccacccacacacccactcactcatccactcccccctccgggaatctcattttctttaccgcggttaggaggcggcggcgtcggcggcgtcggcggcggcgatgaagttcggcaagagcctgagcgggcagatcgtggagacgctcccggagtggcgcgacaagttcctctcctacaaggacctgaagaagcgcctcaagctcatcggcgccgggaacggggccgccgagcggcagccgaagcgggcccgccgcgacgacgccggggagcctgacgcgtccgcggcggcggcggcgatgacgccggaggaggcggactttatgcggctcctggaggccgagctcgacaagttcaactctttcttcgtcgagaaggaagaggagtacatcatccgccagaaggaactgcaggaccgggtggccagggcggccggccgggagtccaaggaggagctcatgcgggtgcgcaaggagatcgtcgacttccatggcgagatggtgctgctcgagaactacagcgccctcaactacaccgga

SEQ ID NO: 21904 - DNA, 464 bp, Sorghum bicolor
  Clone ID: 13392201
gcacgaggcttgtctctgtctcgtcttgagacttcccctccctttctttttgccttgtttccgcgtgtcgttcgttttagatcagcagctggcctgttctttacttgtcgtgcttaatataggtcgttcgttccttgtcattctttacccctcctggcttgaagccgttgcattcgtttgaagttggatcatttcgtttgatctttcgttttatcccccttcttgcgggaaagaccaagatatctgagggagaattcgcaatataaatccatgtgtcgataaggttatcgatttgatgcagacgattattaccgatattcatttcaaatggaccacgatttgagcacagcaaagactggcaagggtcagcgcgactatcttcatttcgaaacccggcccccatggaccttggcgaacctacggacagcacaaccatggaagaggagcgatgtgccttcagaaaa

SEQ ID NO: 21905 - DNA, 561 bp, Sorghum bicolor
  Clone ID: 13392213
gcacgaggcacagaccaaaacatcatcgacataaaatgcatgctccatcaccctcgccttttagttctgcacctaaagccttgccatcaccatctgcttctgcacctgcaatatcttcttcaggatctcttcatccattggcagcccctccccgactgcttattagctcttcaccttccatctctccaccacataaacattcctcgagaaactacagtttggtcgctgcagggagtgcagtgtttgttgtcatggctgcagcttctgttatgtactgtcgagttaagaaggtgggcactgtgaggccatgggccacaggtttaagcgggcaactgcaacgggcattcgtaacaggtgtacctgcgttgaaacgatccgagctggaagcagcctgtgaggactttagcaacatagttggttctactcctagctgcatgctgtacaaggggacattatcgagtggagttgaaatagcagttgtgtcaagctcagtaacatccgtgaaggattggtcaaaagaatgtgaatcccactacaggaagaaatcacaagtttatccaa

SEQ ID NO: 21906 - DNA, 454 bp, Sorghum bicolor
  Clone ID: 13392223
gcacgagggcccctctctcgttgcccaatcccgatctccgcatcatcgatctggtggtgcttatcctccccaatcaggagtctcttgcctccccaaccccaatgagcagctcgtgcctgtcctcatccccacgcaccccgttccctcctctgctcctagtccagcacaccaacagaaccgcatcacctggcgagggtgctacgtgcgtcgccgccgccggttgaacgggatggccgaccatctcccgttgcaacgccctgcgccgccgctgcccgcgcactccctgtgccgccgccgacgcccacgtgcgccccttccccagccagtgagccacctttgtgtgcgccaccactgcctgtgcacgccctgtgccgccgacgatgcccacgtgcggccctgatccagccagcgagccaccgcacctcccgtcgagccgccgggcgacggcgcatct

SEQ ID NO: 21907 - DNA, 476 bp, Sorghum bicolor
  Clone ID: 13392228
gcacgaggattcccctctcctttctcctcgcccgcgtcggctcgaatccaatccctccaataatacgcaccgccaccaccccatttgcgccatgctgccgcggccggcgaccacgagtcaagaacacgcgcggcatccctgagccaccacaccaggctagcaaaaacgattcctttctctctcggatcccagccgctccccaagcgtgcgcgcgatttctctccttgcctcgcctcgcccagcgccgtgctcttgtgctgaagatccatggaggggtgccaactgctagtaggctgtaggattgagatggaggaggaagcgttctttgactcgcgagaggagctcacggcgtcgccggcgcccagcccgggccctgcattgccgtggtcgggaagcctcgacagtgtgtgccagaagagggagcggttcatgagaagcatgggcctagagtgctgcccggctcccccgcaggccga

SEQ ID NO: 21908 - DNA, 601 bp, Sorghum bicolor
  Clone ID: 13392239
gcacgaggcgatcaagtgatattcttactacgtctgatggcttagctaagagagcaagatttgacatgtctgccacttcaaatcttccagttctgggatcctctgattattctgatatgcaggctgacgatggttccagtgtgggtcatttgtctgatccagccatattgaataacgacgtgtctcctgtcgagaagatgattgaaatgattggtgctttacttgctgaaggagaaagaggagctgaatccttgggtattcttgtctcaacagtagaggcagatgtcatggctgacattgtgatagaaacaatgaaacatctatcagaagcttcatttcatttagcaacaaataacggtgtccaacaactgaattttaaatattcctctggtctcctagcacaaaatctaccagccaattcagactcttcactgttcactgcacaatcgacacccacagcagatggagtcagcatgtcaccatctgaagcctttgttatgactagtgttcatgatgctaagcgtgatccaagaagggaccctcgtcgcctcgatccacggcggatagtttcaccttctgctttaaattcgatacagggtga

SEQ ID NO: 21909 - DNA, 451 bp, Sorghum bicolor
  Clone ID: 13392256
gaaacttctggcacactcagggattcctgaagacctggaagttggttatgtcccacttagttttagtggagcttttcctggcttgtacctctttacaaatccagctagatttgttcgacctgtcagaaatcttttattctatctgatggaaagcaaagtattgagcttattggaccatttgaacaggcatttatggagatacgttgtcctgatggtggggatggtgggagacaagaacaattccctgcaactcatgaagagatccatcctacagctattctcagtgtagttgccaatctgacaccttggtctgatcacaaccaaagtcctaggaacatgtaccaatgccagatggcaaagcaaactatgggtttttgtggacaagctctaaaattccgtactgatgtaaaagcattccacctacagacccctcagacaccaattgttcgga

SEQ ID NO: 21910 - DNA, 603 bp, Sorghum bicolor
  unsure (1)..(603): unsure at all n locations
  Clone ID: 13392266
gcacgagggtcctcgcaccagcaccgcgcgagctcgacggcgacggcaccaatccgctccccctcgcctgcaacagagggaccagcacggcgattatcgcaccagcacggcgatagacgatatcctcgctggaccggtgcccggctcagatattcgcggtctttaccgggtcgattgtcaggcggtgcccagctcagatcttcgcggtctttaccgggtcgattgtcagagatcatggcaccgctacaatggcctgagcccatgatggactattttgtggatgagtgtttcaagatggttcagggtggtagaacgccagcgaatgaaactttttttcggacacttgaccgctccatggccagtaaatcctttggtactaccttcagtcaaatggatctgactaagcagtttgaacgagtaaaatctttatggaatagttaccatacgattctgaagaatttggaaataacaaaggcaaacgaacgacgaanccagacttatcctgaaaaattgcatcttaaaactggtgatatttatgctaggaaattcacccttattaggaaatatgaaataaagctcaacacgatctttgaaagttattat

SEQ ID NO: 21911 - DNA, 636 bp, Sorghum bicolor
  unsure (1)..(636): unsure at all n locations
  Clone ID: 13392277
gaagtcaacaagatggagtgagctacatgttgctgacaattgcttctttcactaccgaagggttagtaggttccctatgtttacagttggtactacatcattccttgaagcagattatatctgatttgattattcatattgacctgtagcatctttttaaagcctatacaatatgtttgcagaccagagcttttcaatgcacaccacgatttatactttatgttgttttggacttccatttgttgacacattccaatggcatagcacacatcctgtttgccaaccagtctgactgacagcatgtgtatttaccggccttcttgttgcatccttgcagtcccttcttcttgagctactagaaagtcgcctggggaatggagaggattcccttagttgggagtcagaaacttaccttctatggaaggtatcgatgtattcgatcaaaagctaattacctttttcctacagttatttgtaatcacttcaggcatcatatcctctctttccattatgaatatgatacaaagcagaagacaaaggatccatgaatcattgtgttttacaacattggtttcctttatcctatggttagttgatacccacccatcttggtgcanactaaaattgaagtgtata

SEQ ID NO: 21912 - DNA, 512 bp, Sorghum bicolor
  unsure (1)..(512): unsure at all n locations
  Clone ID: 13392307
gcacgagggtgtggncggaaacttcaatgtggcctccattgatatcgagggtgaaaatggtggagctcgaatgtacatgcctccactattgcctcctccacagtgtgaatcgaagctaataaccagagcagatgatactgaagaagtggtaaaagagcggctacgtgtgtaccatgatttggtaggttccaattgcctgagattgccttttgagattttagcttgctcattctttttaatatctatttatctgacccgaatactcaatttgtgctacttgtagtaaatgagtttgttgttgatatataggtcagttagactattttcttgcatttaaaaagactatgggggtgtttagttccccatagaatccaaaatgcaaaatgtcaactactttggagtgatgaaatgcaaaatgccgaaattttgagggtcatgtttagttccatccaaaatgcaaaatttattgccctcacgagagcctcttgactcttgaggctctttttgggggg

SEQ ID NO: 21913 - DNA, 291 bp, Sorghum bicolor
  Clone ID: 13392322
gcacgagggcagtggaaaacagtagctattttgaaattccaccagaaatgtatcctaaagaagttggtgatgtttccaagggcatggcagaagctgatcacaggattccctcaactgaagtaaagcttgcctctgagtactacttctacatggaaacacagacagcactagcagttccagatgaggataacactttggtagtttacagttcgtcgcaataccctgaacttgcacaaagtgtgatagcaaggtgcctaggcattccattcagcagtgtgcgtgtcattacaa

SEQ ID NO: 21914 - DNA, 186 bp, Sorghum bicolor
  Clone ID: 13392345
gcacgagggcctcgtctccaagtggcgccccaaggaccggatgaagacgggatgtgttgcacttgtattatgcttaaacataagtgtggatccacctgatgtaattaaaatttccccttgtgcaagaacggagtgctggatagatcctttttctatggcacctcctaaagcccttgatactattgg

SEQ ID NO: 21915 - DNA, 496 bp, Sorghum bicolor
  Clone ID: 13392353
gcacgaggcacactcctctcttttcttccccagcaccaccgtacccgcagctacaagtggagggtctgaggcagtgagcgccggcatggtgagccgtgagcagcacacccacagctacgagcacctggtgctggacccggcgtccctccctctgggcgtgtcgtgggccgacccggccgccgtcgagatcccgccgcagctcctcgcggcgctgggggagtacctctccgccgcccgcggcggcggtggcgaggaggacgcggaggcggacgacgagttcatgatgtacgagttcaaggtgcggcggtgcgcgcgcgcgcggagccacgactggacggcgtgcccgtacgcgcacccgggcgaggccgcgcggcgccgggacccgcgccgcgtcgcctacacgggggagccgtgcccggacttccggcgccgcccgggcgccgcgtgcccgcgcggccccgcgtgcccgttcgcgcacggcaccttcgagctgtgg

SEQ ID NO: 21916 - DNA, 495 bp, Sorghum bicolor
  Clone ID: 13392375
gcacgagggcaagggtgctcggccgggaggagtcggtgccagagttttgggacttgatccaggaaattaaggctgccgggatgcacgttgatatcgacacttacctcaagctgtccaggaacttccagaagcggcacatggtcagggaggctgtggagctgtatgagctcatgatggatggccctttcaagccatcccagcaggatggacccatcatcatcaggcgcatctcgctggggcggtcaccggaccttgagcttgtcaaccgggttgtcaacaagtttgaagccgtctggggcgtcaagaccaaagagttgcttgacggggtccatagggcacttaccagtaatgggaagttcgacgaggctgcagagattgtgcaaacaatgagggaccaaggccaccagccggacaatgttacatatagccagttggtatatggtctttgcaaggctggcaagctggaggatgctcgcaaggtgctcgatgaaatgg

SEQ ID NO: 21917 - DNA, 452 bp, Sorghum bicolor
  Clone ID: 13392391
gcacgagggtaagttaaggccggccgggctcggctaaacttcgcgtcttcttctccgcggccgcgcgcgggggggggggagcgagcgaggggattggattcttcttccggccgcctcagcctgcctgccggggcccggattggaggagggccggcggcatggggctcggcgtggtggcggagctggtgcggctgggcgtgctgagctcgacctcggaccactcgtcggtggtgtccatcaacctgttcgtcgcgctgctctgcgcctgcatcgtcctcggccatctcctggaggagaaccgctgggtcaacgagtccatcaccgcgctcatcatcgggttgtgcaccggcgtggtgatcctgctgaccaccaaggggaagagctcgcacatcctcgtcttcagcgaggacttcttcttcatctacctcctccctcccatcatcttcaatgcc

SEQ ID NO: 21918 - DNA, 426 bp, Sorghum bicolor
  Clone ID: 13392407
gcacgaggctgaactaaagctgtagtagtatgggcagtatggcggttgacacgatggaatcggttgccgtggtggccgtgccgttcccggcgcagggccatctgaaccagctgctccacctgtcgctgctgctcgcctcgcggggcctctccgtgcactacgcggcgccgccgccgcacgtccggcaggcgcgcgcgcgcgtgcacggctgggaccccaaggcgctgggctccatcgagttccacgacctcgacgtgccggcgtacgactctccgcccccggaccttgccgcgccgtcgccgttcccgaaccacctcatgcccatgttcgaggccttcgccgccgccgcgcgcgccccgctcgcggcgctcctccagcgcctctccgccacccaccggcgcgtggccgtcgtgttcgaccgcctca

SEQ ID NO: 21919 - DNA, 633 bp, Sorghum bicolor
  unsure (1)..(633): unsure at all n locations
  Clone ID: 13392440
caagaaatgattttgagcaaggacgcaggtctgatgctactaggttcttttatacccagtagcatatgatgaaccaatcgatttccaaaactacatcaacacttctcttgctcataatgagcagaattagaatgagcagcgctagtggaatcagaacaccactcagactctggccaccattagagaaggacaagaccaagtaaatagcactttaaatgatatcttcatgttcctgcaaatcccgaaagaagactagcttgggggaggacccccgttgtcaaggtaagttttctttctcttcatttcaatttattttcttttattgcatatacaaaataaatattttgctgtttaatttagtgtttaagtttgagtttgtttaaaaatgaaaaccaaataaaaatagtgtgtaatataaatttgttttatttttctattaagtttgctataaataaaatatgtagagatgaagaatgtatgatggaaatgatgaatagttgctctatcgtaattntttttgaagtacctagtttcaaatttgagttctcccaaggattggatacactatttgacaactgaatttactctactctttaaacatgtgggaacatatgcttaaactaagtctaggta

SEQ ID NO: 21920 - DNA, 618 bp, Sorghum bicolor
  Clone ID: 13392446
gcacgaggggaaaacacaagcatggaatgaaaagataaaaaggcttcgacttctgctcacggtgaaggaatcagctatggatgtccctacaaacctggatgctagaaggaggatatctttctttgctaattctctttttatgtcgatgccagatgccccaaaagtgcggcaaatgttgcccttctctgtcttgactccttattataaagaagacgttcttttctcttcacaagcactaggggaacagaatgaggatggggtttctatccttttctatttgcaaaaaatctacccagatgaatggaaaaattttcttgaaagggtgcattgtgagagtgaagatcaactccacgagaccgagcaatctgaagagcagcttcgcctttgggcatcataccggggacaaactttgacaagaactgtaagggggatgatgtactacagacaagctttagtccttcaggctttccttgatatggccagagatgacgatcttatggagggttttagagcagctgacctgttatctgaatctgatgaatcgcaacttttgactcaatgcaaagctatagctgacatgaaattcacatatgttgtgtcatgccagcaatatggtat

SEQ ID NO: 21921 - DNA, 486 bp, Sorghum bicolor
  unsure (1)..(486): unsure at all n locations
  Clone ID: 13392454
gcacgaggcggccgtcgcccttgacgccatgctgaaccagaagcgctggaacaactctggcgacgagaagctcaagctctacaccatctacgtcgccgtcggtcagaagcgttccaccgtcgctcaacttgtcaaggccctcgaggagaacgacgccatgaagtactccatcgtcgttgccgctaccgcctccgaggctgctcccttgcagtacattgctcctttcaccggttgcgccatgggtgaatggttccgtgacaacggccgccacgccgtcgtcacctacaatgacctgaccaagcaggctgtcgcctaccgtcagatgtcgctgctgctccgtcgtccccctggtcgtgaggccttccccggtgacgtcttctacctccactcccgtctcctggagcgttccgccaagatgaacgacgaccacggtggtggttcgctcactgccctccccgtcattgagacccanggtggtgacgtgtc

SEQ ID NO: 21922 - DNA, 496 bp, Sorghum bicolor
  unsure (1)..(496): unsure at all n locations
  Clone ID: 13392456
gcacgaggcgccaccggccggatcgacgacagcatctctgctgcgcgcggcggctcgatctcacaccgacacacagcaggccaggcgcgcgcataggcgatcgatctcgagggcccccgcgagggatggtgtggtcggctgggaggatggcaatgcgaggcgcctccgccgcgctgctcgtgctggcgctcgtcgccgcggtggcgcgcgcggaggacccctaccacttcttcgagtggaaggtgacgtacgggacgaagaccatcatggggacgccgcanaaggtgatcctcatcaacgacatgttgcccggccctaccatcaactgcacatccaacaacaacatcgtcatcaatgtcttcaacatgctggaccagccgctcctcttcacctggcacgggatccagcagaggaagaactcgtggcaggacggcatgccgggcaccatgtgcccgatccagcccaacaccaacttcacgtaccactggcagcccaa

SEQ ID NO: 21923 - DNA, 530 bp, Sorghum bicolor
  Clone ID: 13392459
gcacgagggaaattgtaagccaatcgaaaattggactgcacctattgggtcctggtggcttctttccgaggtctcttcattcgcgccaaaatcagttgactggaagttcctctcccaccactggaaactccttgataatgttgttcaagacgacagaggtaaagcttgttctcaagtggaaccaaactcagcgctctgggcagtcaatcgtgtgtcactcttgcaaaccatttcaaatgtctccatggagctgcctgtgaaacctgcagcagaattggcacagagcttgcttacaaggattgaggattttgatatgaacctgagtgaggttgacgcgcatgtaaaagcactgaaaactttatgtaaaaggaaagcaaaatcagctaatgagggtgaggcactgatcctgaagtgggcacagcaacttatccatagtgcttttgacatccttgaccagtacataaaagaggcatcagaatcagccaggggtcacagtttcgttactcctatgactggcaaacgcaagggaa

SEQ ID NO: 21924 - DNA, 489 bp, Sorghum bicolor
  Clone ID: 13392506
gcacgagggtcacctgccacaggagagagggctaggttttgtttttctagtcctcggccagtgtcctgcaggggcaacggacaaaactaacgcgagacttgtcgcctgctggcctcactctggtctgtcacctctcacctccagcccccgcccaccctctgctctcccgatccctctctatatagctcggtctggccaccagcttccgatccatatatcccccatctgcgtctctccactgcgactgcgaccgagcacgtacgccgtcgccgcgtgtcagccaaccatgatgtccaccagccatgcggtgaagcagtcgccggcgtgcgcggctcgttggcggcggcggcagcacggccagcggtccgcggacgcgccggcccgcacggcgacgttctcggctaggcacgggaggcagcggcgaggaggccgcggcgtggcgccgtgctccgtgcgcgccgcgggctccaacaccattggctgcctcga

SEQ ID NO: 21925 - DNA, 528 bp, Sorghum bicolor
  Clone ID: 13392516
gcacgaggtcaaaccccaaaaccctaaaccatggcgccgccggcccattccgccggcgcccgcctcctactccgccgcctgctctctacggttaccgaagcagcggcggagacaactgcgcccaccgcccctgccgccgcctccggtgtcgctgcgcccaccgctgccgccactcccagtgcctctgccgccgccgcgaaaccggcgaagaaggacccgaagctcctctaccgtcgtctgtcggcgcttggaatagccggggaggggagtgtgtcgcgggtgctgaacaagtgggtgcgggagggcggcgcgccgcgaagcgaggaactcgtcaagcatgtcaaggagctccgcaagtacaagcgccacgcccacgccctcgaggtgatggattggatggtcaatgcaaggggtatgaacatgtcaatcactaaccatgcaatacgtctggatctcatctataaagtgcgtggccttgaggcagctgagaattattttgctaacctccctgatccagccaagaaccat

SEQ ID NO: 21926 - DNA, 148 bp, Sorghum bicolor
  Clone ID: 13392528
ctctcgtcccgcaccctcttccgtgccgtcttcttcgaccacagcgacgacccggaccccgacgtcctactcgccgccgcctccagcgacggatccctcgcctcattctccctttcaacctgcatctccgccggctccgctgcctccc

SEQ ID NO: 21927 - DNA, 614 bp, Sorghum bicolor
  Clone ID: 13392562
gcacgaggagaaggcattgcctccagatgttgtcaaagcaattgttgatgcaaggctaagtcttggattagttttaccagaggacaagggcttccctaacatacatgtaagaagagtacacagggcgctggattctgatgatgtagagctagtccgaatgctactcaaggaaggaaaaactaatctcgatgatgcatatgcgttacactatgctgtcgaacattgcgactcaaagatcacaacagaacttctggatctcgcacttgcagatgttaatcataggaacccaagaggctatacggttcttcacattgctgctatgagaagggaacctaaaatcattgtctctcttttgaccaagggagctcggccgtcagatctcacatttgatcacagaaaagcagtacagatctctaaacgacttacaaatcatggggattactttgggcctactgaggatggaaagccttctcctaaagatagattatgtattgagatactagagcaagctgaaagaagggacccacatcttggagaagcatcagtttctcttgcaatagaaggagactctgcgcgtggaaggttgctctaccttgaaaaccgagttgctttag

SEQ ID NO: 21928 - DNA, 449 bp, Sorghum bicolor
  Clone ID: 13392568
gcacgaggggcgttctggcgataggtcggggaccgcggcgccaccgtgatccgcgggtggcaggtgatgagctacttctccgacgccgccgcgctctgctggttcctcgagccagagctggagcgcgaggtgcgacgactccaccgcgtcgtcggaaacgccgtggacgacggctaccacctcgtggtcggcaccggcgccacccagctctaccaggccgccatgtacgcgctcagctcgtcggcgcgcggggaccagcgccagcccgtccccgtcgtctcgccggcgccgtactactcctcgtatccgccccagacggacctcctgctctcggacttgtaccgctgggccggcgatgccaacaagttcaccggcgatgaatgcatcgagctggtctgctcgccgaacaaccccgacggcgccatccgcgaggccgtcgtgcgctccgc

SEQ ID NO: 21929 - DNA, 230 bp, Sorghum bicolor
  Clone ID: 13392570
gcacgagggaccatgggaacccgcggcatcgccctggtgctcctggcagcggcgctgctccaggccctgctccccgcgtccgcggcggcggagggcctggtgcgggtcgcgctgaagaagcagcccatcgaccagaacggccgcgtctccgcgcgcctctccgccgaggagaggcagcgcctcctactccgcggcgccaacgccctgggctcgggcagcgacgactgcga

SEQ ID NO: 21930 - DNA, 590 bp, Sorghum bicolor
  Clone ID: 13392582
gcacgaggctcaaaggtaatattccctttctctctttaatttttctcgcacttggtttcttgccacgcgctcctttctctgtggatggtaaaattttggaatgagacagcttctctttttccttggatgaacgttctctggccaagaagccatttttagtccactcgtttttgctcttattaatcgctgttggttttagtaattgtcttaccacaccctgatctttcgcatgagaagtaggagtctgttttcacccattggctggagatgtgctcagctgctcagggttataatcatgcatggtgcatatgggtgttatgcttcagttaggaagaagcgttggatgaaaccattgtcaactatggttggatagaaaattcgttcagagtacgtaacatgtagatatttaaatgttcaaaaaaaaaacccgtaacatgtagatatcgctattgtctgtgacaacatttcatggttcattacttctagaaattcagttgcatgtaaaatgtcgcatatcacttctattatcagaccagcatgcatgcccatgcactctagtactattactctactcaatttctagttgagtg

SEQ ID NO: 21931 - DNA, 555 bp, Sorghum bicolor
  unsure (1)..(555): unsure at all n locations
  Clone ID: 13392600
gcacgaggcagctatggcagcagctgtccgagctgttggaggtgaatctgctctggaagattcttttgcaagagatagggtctcttcaatagccaatcacatacgaaaggcacaattggctcggcgagcagaacagactggtattccaggcactgtatgcatacttgatgatgaaccaaggagtactggtcgtcattgtggagaacttgacttgtgcctctgtcaaagtcaaaaggttactttgtctattgctgtcatggttcaacctgtatctggtccagtgtgtctttttggaagtgaattccaaaagaaggtttgctgggaaatcttagtggcaggatcagaacagggaatggaagctggacaggttggtcttcgattagtgactaagggtgaaaggatgactactgttgctaaagagtggaacattggtgcgtctagtattgcagatggcaggtggcatcttgtcactgtaactttagatgccgacctangtgaagcaacttctttcattgatggagtttatgatggatatcagaatgggttgccgttgcc

SEQ ID NO: 21932 - DNA, 394 bp, Sorghum bicolor
  Clone ID: 13392608
cggcacgaggcttgtctctctgcccccctcacgccgcccccgctcccgccccagcgcacccccacccgcattctccagatctccatggaccaggcctcgcccgcggacccagccgcctcctgctcggcctccgcctccccctccccctccgcctctgcggcggcgtcggcggcggcgtcggcgtcaggggacgtcgccgcgatgctgccggactcgccgccgcggcgcggggcggggcaccgccgcgcgcagtcggagatcctcctcgggggcgccgcgctccccgacgacctcaccttcgacgccgacctcggcgtcgtcggggaggcctgcgtggccggcgacgaggacgaggaggacgaggacgaggacgaggaagggggcggcggcgggg

SEQ ID NO: 21933 - DNA, 463 bp, Sorghum bicolor
  Clone ID: 13392610
gtcgaagccgtcgacaacatccgcgccgtggctgccttctcccttgagaagcagtcgtacgccgtgttcggccgcgcactggtcaagccctaccacgcgaccatgaaggccatcgcatggggaaatgtgtggctcgcggccgcgttcagtatcagtaaccttgtgtacgcactggcatactggtggggttcgcggcagatcgcagcgcatctatacacgcagacagaattctttatcgtcctccccgccctgctcttcagtacccagtcctgcggacagatgttcgccctggcacccgatatctccaaggcccgcgtggcatccagcaatatcgtcgagctgctcaccactcgctctgccgaagaagaaatgtcccccggctcaaccgccaacgtccaaccctccagccgactcctcgacgagaaactccccgacgtcgaagccaacgaaaaagccgcctcca

SEQ ID NO: 21934 - DNA, 526 bp, Sorghum bicolor
  unsure (1)..(526): unsure at all n locations
  Clone ID: 13392612
ctgcagtattcagtatatgctgcaagttacagggttaagcatataattataacaagtcttttgcttgttcttggtgcaatgtcaatgacatggatttgtgacaccataacagaatctggatttggacatggttcatctttgattatctgtgtgggaattttgactggctacacagatacactacacaagatgataactcagttttcagggaatttttcctattgttggccttacgtcttgggagtagctggaatttttatgattctcaccatgggggctgtgctggtgcctgaaggatgcaggaagataaaacttcagtactacggatttaaattagcttctggtgcagggaatgaaagcaccccagttacagaggttgagccatatatccccttcaacatcaatccgactggaatgcagcccttgcttacaacctcatacttgctagcttttccaagcatcatggccagtatttttgcctcgcccttttgggaaaacttgagggaaattntgaatccaaagactt

SEQ ID NO: 21935 - DNA, 482 bp, Sorghum bicolor
  Clone ID: 13392624
gcacgagggccgctccaactccagctccagcagcttgcccttgcccctctcccctctccgactccaacccaacccccccatccaatggccctccggctccgcccccgttgttgtctcacctcacgcgctccctgacctgccccgccccgccccgcccccagcacgacgcgatgctccgcaccgcgtcggatagatggacgatattgctggggagccgggaaggaaaggggacgactcttcccgtgccgtgctgacgccaccaccacgcggccccggtctcctctcgccctcctctcctccgtctggatctggtcctatcccctccccaccctccgccgccgccgccgctgtcctcgccctcccggcctcagccacgagccagggcgccgggctcctggcctcgtctcgcctcgccggcgagatggacggcggcggggagacgctgctggtgcggaggagcaagggcaagaagaagagaccgc

SEQ ID NO: 21936 - DNA, 626 bp, Sorghum bicolor
  unsure (1)..(626): unsure at all n locations
  Clone ID: 13392630
gcacgagggccggtcatctttcacgatctaatagccgcaatgctcttgagggcccaactccaatcaggtcatctgattcacccaagccacaactgcagaatagatcagaatccatgaatggcctgcgatctggatccacttcacccagtctggtcagggtccaaagtcttggttcttcaatgtctcatacctttgcttctgcagtaggttcatctatctcaagaagcaccacccctgacccccagctcatacggagaactccaagtccctgccttcctcctgttggagttcggatggggagttctgataaaaaagttgaagctgcagctgttgcttcacttaatcatgatggtgctgacattgcggcaactctgtctagcttaagcctatctggaaataagatgtcgaatgtggaaaatgaagttcagaatcatgtttaccagaactttggtgaccaggcagatgtgctgtttaatgtaccaaaggatcataggcaattttcacaacaaaatttaactcanaataccaatgaagactcgcttaatgcccctgaatatgcagttttcccaaatggggggagtaacttcagtaatttgcatgctagtaagctggcatctcatagaaat

SEQ ID NO: 21937 - DNA, 430 bp, Sorghum bicolor
  Clone ID: 13392648
gcacgaggcccacgcaggctcccgtgtccgcctcctgctgccccgacgccgccaccaccgcatacggcgccgcacctggccgatggggccgccgccccgggtgtcgtcgcgcgcctcatgggcctggagtcctggcccgccaccgcctccgccaccgccgcgccgcccagaccgcagaagcagaggaaggtggaggcgtcgcgcccggacagcggcgccaccaacgactcggcggcggtcgtgctggtgctacccacgacccggagccgtcgccctcccgcgcccgctccgacggccaggagccaccacggggccgacctgcctgcgcggagcccgaggcggacccggctcgtgcacgcggccgcggccaagctgctggacccgggcgcgcgcgccaagctggccctcgcgtacgcctgctcttccccgc

SEQ ID NO: 21938 - DNA, 537 bp, Sorghum bicolor
  Clone ID: 13392654
gcacgagggttccctcgggcatggactgtttatgatggtgaaccagatccagaccttaaaatctcatgtcgtcaaatatcacctttcattcctcatgattacaaggatagcagccttccaacatctgtgtttgtgtatactctagtaaacactgggagagaccgtgcaaaagtaagcctgttaatgacatgggcgaattctattggaggtttttcacataattcaggaggccactacaatgagcccttcattgcggaagatggagtatcaggagtgcttctgcatcacaaaacagctaaggataatccaccagtcacttttgctgttgctgcctgcgaaactcagaatgtgaatgtgacagtcttgccagtgtttggcctttctggagaaaaccatgtttctgcaaaggaaatgtggaacaccatgcaacagaatggtcacttcgatcgggaaaatttcagtgctggttctagtatgccttcttctccaggacagaaactctgtgcagccgtctcagcctcaacttgggtagagcca

SEQ ID NO: 21939 - DNA, 541 bp, Sorghum bicolor
  Clone ID: 13392675
gcacgaggccgtttctgccctcccctcttcgttctcgctctcgctcgcggcggcggcggcgctcactctgcaatccggaggctgaagccatgggggagaagagcgcgtggtttcagccgcgcgcgccgcgtcccttctggcctcgctgttgttgaaggccctccggagcgcggatcggtggcgacgaggaggaggagctcctcacggcaccgccgactctgcgagatggacatcgtttgtgaagtgtgtggtgttgttggctacaggaagcttttagtacgatgtgtcaactgcgagaacgctgcgaggcacctatattgtttggatccggtaatttatgatgcctcatcatttgaatggttgtgtgacgattgcccccaaaaacataatgaagtcccaaaatcattagagcggaattgtgatcatagtcacaaagttcctcagtggaaggggtcaaggaacgtgatcgacgaacacaacatgctatttgaggaaggttttaacaaggcaggggtgagaatgttttcgcatcccgagaaca

SEQ ID NO: 21940 - DNA, 538 bp, Sorghum bicolor
  Clone ID: 13392685
gcacgaggggaacccagatctgatttcgccgcggccctctcccctttaacaagacgacgacgtgctctcccttttgaaaaaagaaaccaggaacatgccgagacaactcggccaaaaggttttcacccgctcggggtcgggggcggagcagatgaccgccgccatgcaggccacacagatgcagggccaggaacgtgagcaggaagatagaattagcgaacttccagaccacattctcatgaatattttagataggtttgaagaagaaccacgcaatgctgtgaggacctgtgtactttcaaagcggtggaggcatattccgggattgctttcaattattgttttagacgtggcgtactatgaggccaattctgattatacagatgatgaggtggcacaggccaatgtctcgttggttgaagctacaaagagtatcttggcacataagagtcagcataccatcaactatttgagcataaagttctatttgagggatgaatcaattgacattattcgttctgtggataatgccatggca

SEQ ID NO: 21941 - DNA, 538 bp, Sorghum bicolor
  Clone ID: 13392686
gcacgaggtgtacttctactcacccgcgtgcccgcgcgcgctctctcgtgcggcaactggacgaccgccgccgccgccgccctacgccaggtgctgaggtcttcgtcagtacttttagcaggtcttcgccggcgacgagcacccaccaggtgtggattatggggaagtttatgcatgacaatcgactgctttctccgagcgaagtaaatagacgtcagtatagtcttgcggcagttgctgtcggtttgggactaggagttgccgggttatgcaaggcattgcatagtggtttgtccataccatgggtttctccaaggaatttatttttggggtcagggagagtatactatgttggaggtctgcgaaatcttggcaacaattgctttcttaatgtcatcctccaggcacttgccagctgtggtggttttatttcctttctagataatttgcttgcaactgatggcttgctacctgaagaaaaggctgtaagaatgcctcttcttcttgctctaagttctctcttggaagacttgagcat

SEQ ID NO: 21942 - DNA, 568 bp, Sorghum bicolor
  Clone ID: 13392727
gcacgaggcgacgactccgtgctgcgcaccggggaggacttcaactcctcgtccactggcgccgccggcgaggccgccgctgggggtgtcgaagtcgttgcggaggccgtcccgttcatcaagctctccgaggttggcgccgaggccgagaagacggagcccgagacggagcgggccgtcaccgtcgacactgatgccgccacgggcgaaggtgcggcggtggcggaggaaaccgccgttgcggaggcggtttcctgcgacacggaggcgcccgtggactgcacgggggacagggaactcttcaacctgctcatgcgcgcggccatcgagcgcttccccgacctccacttctaccgcttcggccgtcccgtggccgtgccggggagtcccatggagtgtgacctcgcctggcgcttccgccccgctgccgacgccatcggcaccggccggaccacatactacaaggactaccgacggttcacgctcacccgcgacatcaacacctgcaccctcgtcgtcgacaccgtgggtgagtaccactcgggtgtgggtgccaagcgcaacggac

SEQ ID NO: 21943 - DNA, 510 bp, Sorghum bicolor
  Clone ID: 13392728
gcacgaggccgagcagaagtcccgaacctaaaccctactcagaagccagccaatgccatcggtggcggcggcgggtgccatggccgtggcggccgcggcggctgggttcacggccgcggagtgggaggcggtgaccgggtccgtggccctggaggcggtgaccgggtccgcggtcgtggaggcggtcacctggtccgcggccgcggatttggggctcaaagtactggcggctggggccgcgtccatggtcgctgccacggtcaaggagtgggggacgtctaatgctgccgggcccatggccgcgaagttggccgtggcggccagggccgcgggtgctggtcctgtggcgcgcgagtgggaggcggcgccgcggaagactttggttgtgcggaagccaggcttccgactccccaccgcttgcccgatgtgcctaaccgtacttctctacctcagaatggctgatgttcccttcgacctcgaagtggacacctgcaacccaaacgcagagca

SEQ ID NO: 21944 - DNA, 512 bp, Sorghum bicolor
  Clone ID: 13392756
gcacgaggcaaacaccagaactccagcctacattggtgaaattacgcttaccgacctcaattttggcaagcttccaccatatctgcacagaatgagagtcctcccaccggatttgaacgaatcatgggcttttgaagttgactttgagtattctagtggaatattactgcatatcgaaacaagacttgaggttcaagcgccagagttggaaaaggacatactgaagaccaatactaaagacgattctaatggggatgtgagttcagatttccttgatagtattgagcaatatggtaaccaattcaggccttcagaagcttcagattctgcagcagaggttaatgatgaagcagataccttacggaagtcaaagagcactggatgggcatcaaggtggaaaagtatcgtgaattcaatagcggaccaggtttcacaggtgccattgtcattgacgattaaaatgtcatctcttcgtggaacattgcggatacatctaaaacctcctccgagtg

SEQ ID NO: 21945 - DNA, 558 bp, Sorghum bicolor
  Clone ID: 13392760
gcacgaggcctcgcgccgcctccaaatgccggcgctgctgcccttccgccgccggtcctccccgattcccctgctactgcttttatcgctcttcgcctcctccccactcttcttctccccgagccccgcagcaaccgccgtcggagattgccctctggattttagctgggcaaacttcacactagctgcggccgcctgctctgatccgtcccagcgggcgacgtgctgccgctacatcaatgcgttcgttgccatctccattgctcgctacgccaacgcaactggtaggctgggggtccctcctgcctttgcagagatctgtctcagctccgtgtccgagacgttcaagctgcgggggatccccactgatgccgatgtcttctgcgggctgggacccaagatacgggtttcgtatcagtgcgctgggcgggataccgtgctggagatgatgcagtccccgaatttcaacgatgttatcgggagctgcaggggccctctgtcgctggatatcacctgcaagacttgcttgaattatggcatcgtgtacctccatcgcct

SEQ ID NO: 21946 - DNA, 116 bp, Sorghum bicolor
  Clone ID: 13392830
ctgcagctactgtcggtacagaagcgcatacgagatcgggatgccagggcgagcaaatacccagttatacacgtgattgttgagatatataggtgtgtgaattgagacatttttat

SEQ ID NO: 21947 - DNA, 517 bp, Sorghum bicolor
  Clone ID: 13392854
gagaaattgggaatactggacgcaggaaacccccaccacccgccttgcaacgatccgatctccgcgcagcgacagagcaactaagggccctcgccccaacaagtcctaactccagtcgatttacaacgagcactcagtcctcgggcccgctaccatccatctaccgtatggcgctggaatcccgcagccacaaacgcaatagcagcaacaatacaaactgctggtcctttaaccaggacacacgcagcgcagtggatagtgaggaccgtgtgccgagtttaccatcgccatcgcctatgcttcggaatatcctccggcccagccctaaacccgagccgtcgcctccgcatgtatatcgaatgatccagcgaccgccgtcggctcatcattgtgatacgagagtacatgagaatggtgttgttttgcctatgcttccacggagcatttttgccgtgaatgatcttgttgttagtaaataatatgttgttatcgtcatgctggaactttatgtattata

SEQ ID NO: 21948 - DNA, 504 bp, Sorghum bicolor
  unsure (1)..(504): unsure at all n locations
  Clone ID: 13392876
caatcagacaacacaaaatctagcaaattttatatatccaagagatcgtaattcttgctttcttctcaattcattttaaatttgaaaatctacgaaaaaacatgaatatttatgttaacattttgattgggatattttatttagaattacacagtacaacacagacatttataacacaagtatacttatccaaataaatatatgtaaaccctatctttatgagcaccttcgaaatatttttttagtcggaatagagccagtctagtagtaatctaataccctagttctccactccgtgtaggcgcaaacaatctgctggctgtgcaggtatcaaagaaacaaggaaggacttggctatgcgccaaaaagaggcaagaaagcctttgctcctcacaagatctttgtgagaaacaataataggcattgcaacaagtgcaaggacatttggtatattcaagtccttcactgtcnaagtgtcattgcaatacttgtcattattacaac

SEQ ID NO: 21949 - DNA, 236 bp, Sorghum bicolor
  Clone ID: 13392905
gaatccaataaccagaagaaagccaagcacgagatgcttgggctccccactgtgagaccgccaaagaactttgcatgccaggcctgcaaagcaagcaaggggatggagaccgtggcgatgccgtatgtgttcaggtacctggctgctgagctggctgccatgaacataaagttggagctccggttgagcaacaaatcaggattgcttcccagccaagaatcatgaagttcgtcgtt

SEQ ID NO: 21950 - DNA, 474 bp, Sorghum bicolor
  Clone ID: 13392917
ctctgaaatacaagactatgacaaagcaatgggcgaacttatcaataaagttgatgatggaacttatgtcatagctggtcaatgccttcgagaccctaaaattctgcaatcatactcacatattccaaccattgaaagaaagatcagtttcttgcacggaacctggagggtgatgcatgaacccaagtgtgtcttagagaatttgcaaccagccgatcagctatttgtgaggagcccaaactcctgagctcccgcctgctgtctgacagaaggagatgcgagttcttcaagtggtatgatgataaagcttttcctcaatatatcaccaacttgctgggggacttgcgagacaaggtcaactttggaggactacttgaaccggtgttcaagcaggactacttgaaccggtgttcatgcaggactacttgaaccagtgctaccttgcttattgttcatgtagaaccattttatatt

SEQ ID NO: 21951 - DNA, 633 bp, Sorghum bicolor
  Clone ID: 13392927
ggatatcaaaggcaaccactacctgttttacccagtttgcttaattgcttagtgctggtagtttgctaggatagattcttttgctatcaagtgaaggattcagtttagttttgactgggaaactattcgttggatgcagcaagtcccggcattgaaagggaagctggaagagaggctgcatcccatttccatggggaggctgcaggaagtgatggaaagagcctgcaggccggagaagaggcggttgtggatgaatctgctgggcttggttgatcaatcccgctgacagagatggccccctttctttgttgagtttgagggtgtgagcttcgattgcagctgtaatgtaaaagaaacaggtggttggttcagtttcacacgtggcatggagacaagtgtttgcttcaggtcgtgcgttattgtaaaaacaaacttttattcctctcttaattgaaatgcatagctcctgccattgtgtgtgcgttttttttataaaaaaaacaaattactgtacacccaatgcacaaataggatgtgtgtgtttagttgggacttgggaacaatgttggttgtttacccctatcattttgatgcatgtatgtatgtcctgaatgatgcctggcctgacagcgt

SEQ ID NO: 21952 - DNA, 555 bp, Sorghum bicolor
  Clone ID: 13392963
tgacattccttcagctttggttagctttcctgagttcagttctgctcgaagttaccctgaaattgatccagtacttgaatctcctttactagaaaatttccaggaaaatagtgttgtgaagtcgtatacagaagtattgctcgttcccctgacaactcctgatttcagcatgccatacaatgtcatcaccttcacatgcactgtcttagctctttactttggctcattattgaatgctctgagacgaagaattggcgaggaagagagggagttgaagaaaacagccacaaggcgtggactcattcctcagttgctagctaagttaagggggcagaaggtggatccaacagagtcagggtcttcatctgaatcgagtggatcaaagaagctgctattcaaggttgtatttgttgcagtagcggcagttctatttcactatttctcaaacaacagttgagacttaacatctgtatctaaaattttgggctagtttggactgtggagccacggcggtagaatgtaccatgttgtgtaacatatgtattgcctgtaaat

SEQ ID NO: 21953 - DNA, 497 bp, Sorghum bicolor
  Clone ID: 13393002
tctcgcccaagtccacccttgcgccgctctgggagtcgccgccggtgtctccagtggaggcgggccggaggtgggtcgacgccatcgacgagccgtcgttggacgccgccgacgcggagatggaggagctgatgctcgcaatgcgggagctcagcttcaggaaggcccaggcagcgtcgtcggcgccggtcctgcctgcggtcacggaggaggacgggccggacttggggtgggtgtcggagctggtgatgtaggcatgccagcacctgcccagttccccagtgccggcggccgagcccaagatgtggatgccatctccgtcaagaggcgcctctcgatcgccattcggaacagcttcattaagcaatattaattctagcattttcatgaatgaattgcatcattcttctgtggataaaccaaacatgatgcaagcaactattaatactgcaatctgtaagcgtggcgcgtgtgtgtttcccccctttttcccggag

SEQ ID NO: 21954 - DNA, 704 bp, Sorghum bicolor
  Clone ID: 13393021
ttctagatgttttgatctcaatccacttgagaagggttctaccggggattctgtttctcctgccagcacaagtgcccgtatagatggattggatgattacgttgaaggattatctttgcttcatctagcatgtcgtgttgcggacctgggcatggttgaactactcttgcagtatggtgcaaatgtaaattctacagattcaagagggcggacaccacttcatcacagcatcatgaaagggagacatgtgtacgccaagctactgctttccaggggtgctgattctcaagccgtggaccgagatggtagaacagcattaaagtatgcaatcgacagcggaaccatagaggatgaagagatccttgttttgttagaggacccaagtagataaatcatgtaggtagtcaagtctcgagttcctgcggtaccttgtgcttttgtggccgcctgttgcagtcacctggcacacggccgaggatacgtttgctgatatttcttagtttgtggcgagggaagttatagttttctagggctatctgcggttttggtcgcgcttagggtaaagtggcctgtttgtcgtggatggatgcagtttgcgagttgtctttgctgcctttgtttgcagatgttgcagtgtacattgggaagtggttgcccattgttgtgacagatgtacatatagcgagttctgatacaagtaattc

SEQ ID NO: 21955 - DNA, 566 bp, Sorghum bicolor
  Clone ID: 13393031
gcagagaatgggatatcagaggcgcccgataaagcaagatgaggaagaatcccaaaatgaggatttaatggatgtggccactccccagattgcgggcaaggaaaatcagttcccaccaaaggacgacaaatcaaaatcgaacaaggaaccagaaaacgaagcgaaagcgtcaactcctggtgccatggattcggaagtcttgggtgagatgaagaatgtggctatttaggccaggctcgcggaactattacctcaatttggttgctgcagcgcgtctttttgcccgcttccttttatgacttttttcaccccggctcgattgcaccagcacgccatgttcgaattgatgggatcgcgtaagaggctgttcagagtctttccctcttgtataaaatgttaggctctattctctacttgtccgggaggttttatctctgcatcctttttttattcctttttttttttcttccttattattgccttcttcactaggagtctactctcttcgtttatattgtcagtgtaactttacctggaggatcatgcagtattatactcgttcgata

SEQ ID NO: 21956 - DNA, 600 bp, Sorghum bicolor
  Clone ID: 13393055
gacatatacgccgacgcgtccggcgagagccggcacgccaagttcctgtccgagttcaccgaggaaactcgaggcatcgggctgctgatcaccgggtgggcgccgcagctggagatcctggcgcacggcgccacggcggcgttcatgagccactgcggctggaactcgaccatggagagcctgagccacgggaagccagtgctggcctggcccatgcactccgaccagccctgggactcggagctgctgtgcaagtacctcaaggcggggctcctggtgaggccatgggagaagcacgcggacatcataccggcgcaggccatccagaaggtgatcgaggaggcgatgctatctgacagcggcatggcggtgcggcagcgggcaaaggagctcggggaggcggttcgcgcctccgtggccgacggcgggaactcccgtaaggatctcgacgacttcattggctacatcacgaggtgaacgtacgccatgacgacgaacgcatgcatgtgcggaaattaaagaaaaacatagcattagcatatctggtgctgccagcggttgatcggatcagcttgattttttacagcaaggaaaagaatc

SEQ ID NO: 21957 - DNA, 643 bp, Sorghum bicolor
  Clone ID: 13393061
gctggaaagtatgagttttaaaaactttgctaacggccctgttgcttttattggtcaatcacaggggcgcttgtgctatataaatactaggagacatctcagttctaaaatatcagtctggattcttgaagattatagtgcgggtcaatggatgtttaagtataatgttagcacttcccagctttgcggaaaggtggatctcatgttcgagcgggattattctttaatcgcaatccacccagagtgcaacgtgattttcgttgtttggaaatgtgggaatctgctaatgtcatatgacatggatcatgggaaagtttgtgttatatgtagtctcacagagcctatgtatgatgcatttctaccatattttccatatgttccttttttctcagactcactggctgatcaaaactagaagcccaacacaaaaggtgaagatcaacaactgtggctacaaaatgctatggatgtcttctcatgggctgggacttcggtggtgaccaaattaaatcatgaggataggttatctactttattttctcttcttttcatagtatgtgtttatggtagtatgatacattcctggtcttgttttgaagaattgctatgtaccgacaatcacaaagaggttgtaaccttttgc

SEQ ID NO: 21958 - DNA, 570 bp, Sorghum bicolor
  Clone ID: 13393086
acgagcaaaagataagcttgggagagtttgttgatggttttaaccatcaaatttatatataaactaaggagaagaaaggggataaaaactgaacatcaccatagacttagggttttcactaacaatttccacgagttttggtgaatgtctgtttctgcagggggttatcagaaaataaccaaaaggaggtccacacgtcagatttacatagagagaagaccccgtcggtaactcaggaatactctagaagactcaggaagatagcaccccagagttggggcccacctgtcattgggcaggggtgggcgctgaagccctaggggcggccgcccggggttacccaccaatcaggtgcaacctcgtggatcttgcctctatcgcctttgaggagtaatcttggccatcaatcaaggtcggtttgatccgagggctgtggtgcttcctaggaggctataaatacaaccctgaccccctagaggagagcttagaataagaaaaacataattatttttattctcatatgagaattagaggtagccattagagatagggattagagatctatccacc

SEQ ID NO: 21959 - DNA, 423 bp, Sorghum bicolor
  Clone ID: 13393091
cttgcgttcatgccgagtgggtggggtttgcttctgatagcacaaactatgaggtcagctatttcacatatggggctatggggatcggtcaaagcgcttgcccgaggctatgagatcatcatgggcttgctgctgttcaccccgatcgcattcctagcttggttcccgtttgtttcggagttccagacaaggatgctattcaaccaggccttcagtagaggtctgcagatttctcgtatcctaggtggacacaaaaaagacagggctgcacggaacaaggagtgagtagccgattaggtagatggagggtggtgtcgttgggcaatttaactagttggcaccctccctcttgactgtaaatggtagtttctctttgaactctgttggacgataatatgtaagtgtgtgtatgtgtgtgtgtgt

SEQ ID NO: 21960 - DNA, 511 bp, Sorghum bicolor
  unsure (1)..(511): unsure at all n locations
  Clone ID: 13393100
gtatccgtcccgccattaacgtcggtctgtccgtctcccgtgtcggttccgctgcncaggtcaaggccatgaagcaggttgccggttccctgaagctgttcttggctcagtaccgtgaggttgctgccttcgcccagttcggttccgacctggatgcctccacccgccagacccttgcccgtggtgagcgtctgaccgagcttctcaagcagaagcagtactctcccatgtccgtctcggagatggttcctctgatcttcgctggcgtcaacggtttccttgacaacatccccgttggcaaggttctccagtgggaggctgacctcctctctcacctcaagaccaaccaccccgagatccctgaggccatcgagaaggagggtcaggtcagcaaggagctggaggccaagcttaaggacgtcgttggcggcttcagcgcctctttcaacgcataggtgagctcctaaattccaatcgatcaaaactagggatgctccatcgttgtaccgat

SEQ ID NO: 21961 - DNA, 294 bp, Sorghum bicolor
  Clone ID: 13393108
cgacatgcagaagtacgaggcaggcaaggggaagggcaaggctgccgagcaggccgaggccgaggctggtcccagcggcaccggcaggtccccggctgctgctggtgatgcgtctgcgagagccactgtcaggtcggtgctgaaggaggtgaacctgaaggcgccgacgccgccgctgcactcgatgagcgtgcccaaggtgaagtccattctggggagcgccgggccgggctctcgccgccccggtgtcctcgagtcggtccgtgcggcttcagccgtttgagtcgagacgat

SEQ ID NO: 21962 - DNA, 625 bp, Sorghum bicolor
  Clone ID: 13393156
cctggccaaccagctcaccaacatcctcagggacgtcggcgaggacgccagaaggggaaggatctatctcccacaggacgagctggagatggcggggctctccgacgccgacatcttggacggccgggtcaccgacgagtggaggagcttcatgaggggccagatcacgagggccagagccttcttcaggcaggccgaggaaggcgccaccgagctcaatcaggagagccgatggccggtgtgggcttctctgctcctgtaccggcagatcctggacgagatcgaggccaacgactacaacaacttcaccaggagggcctacgttccaaagacgaagaagctgatggcgctgcccaaggcgtacctgagatcactggttcccccctcttcttctcaggctgagagacagagacaccactccagcctaacatagaacggtctctgtcgcgttcggtacatagcagtgaatgatgtacaaatttctggtcaggctacatacatcaatagtagtacatggttggcatgtagtggtggtggtggtggtggtggcgcagatttcttgtactcggagttttgccatgtattacaaaaagcactggatatatcacatagatatgtacactaa

SEQ ID NO: 21963 - DNA, 682 bp, Sorghum bicolor
  unsure (1)..(682): unsure at all n locations
  Clone ID: 13393168
acgacattgggaagctactcaagaggttgggcgacgagcgatgagataccagatacgtacttatcttcattccaatttgcttgagtggttaattctgttgatcccttccatgagcatcagaaatcaaatgtagatcaacggtttgggtgtctgcattggaaacatatcagttctttcgttgttccatgtaaaggatggctcatgcctgggctggtgcccttccagcttttggtgcccttgcaaaaagcagtggggaacaataagattcttgcaagtgcaacgtgaggtcttatctagctaggcttttttgagatactcctttgttctacttttcttcttgtcaatgaaattgctgttacagcacgaatcctactacagaaccgcttctctttctctgtcttgtggtcagtgtgccatcaggttgatgtcctgacagtgatctgtgcacgctcgcgagaagtgtagtgtggataggtctctgtgaacagagcagccattcgtgctggaaataattgccttcaggacggtggtccaaagctgtctactggtgtgcctaggcttgtgtcgtgtcaaaccgtgaaaatggtgaaacctgaaatcgagattttttcttttggtggtacaggcatacggttgctgaacgtgttagtctacttacagtagttatattgtgtcttntttt

SEQ ID NO: 21964 - DNA, 421 bp, Sorghum bicolor
  Clone ID: 13393180
agctgtgttgccattgatgcaagtgaaagttggctggcctgtggcacgtctagtggtatatcagtttggagtcttctctcaaatgagtgcatctttaatttggactgtcatgctcctgttcaagatttattgtttgacaagaatcaaattttggcagttggtgctgaacctgtgctctcccgtctcacaataaacgggacagtcctttcacaaataaaatgtgctcctcagtcggcgttttctgtctccatgcattcatctgggatagcagctgttgctggatacggaggtctggtggatgtgatctcagaagttgggagccatctgtgcacattcggtagccggggcctagacaagtaaatgtcccataagcaaccatgctccctccgaacagcgcagagaaaagatcacatttgagtct

SEQ ID NO: 21965 - DNA, 666 bp, Sorghum bicolor
  Clone ID: 13393216
cccttggttctaatgctaatctgcctaccgagattcagcggacagttgacctgaacgatactcctttcataatgaaggaagagcacttggctcggatgagagccctagccaaaacagttgaactcgggaaacgtttcttcccacggtgttcaaaagtgctcgacaagatcatggatgacgaaaccgagctggcttccctcggacgagacacatccacagagaagaagaggaggttccatgacctgcaagacttggttcacaaggcattcagcgaggacaaggaggagaacgacaggtcggcggcccggtcgtcttcctcgtcgtcgacgacgtcgatcggaatcggagccgtccggcctcggagatgaaaggaggcatgggttctgtttctgcctcgccattttggtagctgatgatccccctggtcctaacagttttagcatcgcctgatattctcccaatccgttggccacatagagatcgtaatcatgctcacttgtgcttgtattgtatagtattagtgcagaacctatactcctactaactatatactaggtgtaaatcggtactggagattgtaatggtagtagtcacagtgtggcgtagtcaaattcccgcgtgtgtgtccagcagctagctgctcgggattgtaatggcgttttgagc

SEQ ID NO: 21966 - DNA, 561 bp, Sorghum bicolor
  Clone ID: 13393223
gagacctccggctactgcaacttcgccaagcaaaacctgacagcttgtcctgcgttcgcgtggctgcgatgtgagaaggaaggcgtggaggactgcgccaagctgctcgccggccacaagatcgtggctcgcggcggggagcagttcggaggagacgcgcggtgcgtcaggatcaacatgctggacagggacaatgtgttcaacctgcttgttcagcgcctgtccgctataaactgatcagagtgaatgcatggaattggagcaagcagcaaggaagaaaagaataaaatggacacagaagattttggtgttcttttttctcaatttggtatctctggttcctggttgggaaacaagttttggtttgcttatgatgcactgaactctatcaatcagtagattgttatggattcagaaaacaagggttttgtgtcctagaatcattaccttgaatgaactcttcagctagcctcattcattgacaccagtggatcagattccaaaagggtgtcactgggtagtccaactaaccgaaacatcaagacagtttggtcccatttc

SEQ ID NO: 21967 - DNA, 326 bp, Sorghum bicolor
  Clone ID: 13393247
aggctgtttaattcaagattgagatcccatgtgtttggcggtagctgcgtctgctgggcagggcttcttgtcacccatgtaacgtaggatccagctgtgggttctcgggaattaggtaatgggtataggaattgcctcatggacaacttcaatcaatcttgctgcatgcaaagtacataagttcggttgcttgctgcagaactgacaaaaggcaatgcttcttgtgctgaagggaaggagagaaggcaggattcatggttctttgatagctgcgcaaagcgcagggtgagaagcgttgttctaatgtttgtagataggtggtaact

SEQ ID NO: 21968 - DNA, 568 bp, Sorghum bicolor
  unsure (1)..(568): unsure at all n locations
  Clone ID: 13393255
gcagctgaaggttgcaacaggacaggtaaatgccaacattggaaaaatgggaaactttagtatgtcgtcatttggaggcaatccacaaagctaccagcggagccatatacagtctcttctggctgctcagcagctgcagcagctccagatccactcccaacatcagcaacagcagacgcatttgcagcagcagcaccagttgctgcaggaggctcatccattcccggtggacctaaagatgagagggtttgccatgtcatcacatgctcaaaatgcaggcgcctcagacagccatgctgtcaagagtgaaccctgaccttgagattgtcagttgttagaaataatgtttgctctgtctgactgagcgattcatgcatcgcttagcgtggtgtctaggtaaacttcagattgtttgaggcacttagtttttgtgcagcctgtagctcccatttggttgtaagctttagtgctgatggaccaagctgagtcatttaccgtgccggatgcttattgtaactagccatggctttgtncctggagcagttcgcgctctgtgcaagagcagaat

SEQ ID NO: 21969 - DNA, 566 bp, Sorghum bicolor
  Clone ID: 13393257
caaaccacgaacccagccaagcggagatcgaaaccgcttgcaaaatggccaacatccacgatgtcatcacatccctgccccagggctacgacaccatgtgcagccacgacggaaagcaattctccggtggccagcggcaacgtctttccattgctcgcgcgcttgtccggaagcctcggatgttgctgttggacgagtctactagcgccctcgatgtggaatccgaaaagcgcatccaagaagcactggctacattagccggtcggacaacagttgttgcgatcgcgcatcggttgaacacgatccatcgcgctgattgcattttcctcattgaggatggtgtttgtgtggagcgggggacgcacacggagttgatccagaggagtgagacgtatcgcacaagtgtgatccatcagtcgttggagacttaaaaaaacactccgcagtgcgaagcacggaggagtgagtacggagaattactggtctgtaccttgaaatatattaaatagttctgttattgtctctttattatagagcattattggcgtttgggaattgataccttg

SEQ ID NO: 21970 - DNA, 636 bp, Sorghum bicolor
  Clone ID: 13393272
gagactgagggaaagaagaagatgctggcgagcacgaagcggagaagcctcgccttgcttgctgaagtcaagttcttgcgaaggaagtaccaatcctttctcaagggtggctcacagcagaaacattacaagttgaagaagcaagctcggtacatgccatctccattgggaagcaacaaggccaccgcgttaggtgatcatggtgcaaggaccaaagtgccttctaccagcaaaaactcaaaccttcacttaaatcaagattctgttccgaatgatgtggtgaatgatcaccaggggcaacagggccatccagaagtcgaaaagtttgatgaggtcggggtggatgaagatatgatgacacctgatgtcaaattatcagtttgtagggatacaggaaactcgcctgcaagtgaaggtaagaggacggttccatggcaagatcggttagcgttgaaggcctaggtcctcagctgatgtggctaagaaataagctgcttctctgatagctggctttgcaactgtatccctcaaatgatcaatagtgctttgtacagaaacgatgggatatgatatatgcatgttacattgcctgattgaaaaaactcagatggttataccatgcgcctaagcaagttc

SEQ ID NO: 21971 - DNA, 570 bp, Sorghum bicolor
  Clone ID: 13393331
ctcaaatgagacacccaagcaattgccgatcatcattagtgcaaaacgaactggcaatgtagctcgctttatgaaccacagctgctcgcctaatgtcttttggcaaccagttttgtatgatcatggtgatgagggacatccacacattgcattctttgcaatgaagcatattcctccaatgacagagctcacatatgattatggtcagagccaaggtaatgttcaactgggatccaattctggttgtcggaagtctaaaaattgcttatgtcggtcccacaagtgcagaggctcctttggataatcaatcctgtaatgaatggatttggtcatattttgccatacaaggccagagttacccagatgaagttgtggaaaacgccattatgcagctccattgtttctatatgccttcatgtggcattatgatctgttgaatctactgttgcacaaaactagtgaagagtgccagtgtgtggaatctgtatggtgtagttttgataattgatacagatgttgggaagatcatgtaccattgattactctgtacaatagccataagttcatgaa

SEQ ID NO: 21972 - DNA, 675 bp, Sorghum bicolor
  unsure (1)..(675): unsure at all n locations
  Clone ID: 13393342
tccttcgtaatgtgaccatagtaaatctagatttgaattttcanagtcgaaagatttggattcaacctgaagcaacaaggccattagctcctcttttgcgtaatcttcaaatgcttagattacgtttcattcatgaaaagtgtgacctctcttggacaatgtttatcttagaagctgcgcccctcttgaaggaaattaacatacaggtgtgggaccatgtgtgtaatgcaaacgaagaggatatgtccagggaggaattgcagatgcagcaagaattttttaaaatagaaagtgatcacttgagttgggaagcacatgatttcaagcattataatttgagcaagcttacgatagaaggtttccaagtagaagagaaactcaagagttatataagacaagttctgaagacagcagtgaatttagaacttgtagcacttcgtaaaaggcgcctctgtggaaagtgccgtattcgtccttcatcaatggcatatccacaaaatgaagagcagaaggacctgatatggacacaaatttcggaccagatatcctcgaatgctagaattagatttttcccttgatcatatcttggcatttcgtgtcccttaagcatcatagctctcgcatcttgttctaacatgtatggacgtctttattggtacctggttatgtatgnat

SEQ ID NO: 21973 - DNA, 481 bp, Sorghum bicolor
  Clone ID: 13393386
cttgatagagatacctcgccagacagtattcttgcgtcacttaatgataaggttggtgctggccggtatttgtacattgctaccaatgagcctgacaaatcgttctttgacccacttaaggaaaagtataaaacacacttcctcgatgatttcaagtacctgtgggatgagaatagtgagtggttcactgaaactaaggagctgagcaatggtaagccagtagaatttgatggttacatgaggattgcagttgacacggaggtattcttgagggggaagaggcacgtggagacgttcaacgagcttacacgtgattgcaaggacggcgtgaatacatgcccagcttcttcctgaacatttggtgtgctaaggtgagctgatattatgaaatattatgcttcagaggatattttcgactgtgttgttggcgtctcttatgccacccctagccttgttgtagcttagtagatggtaccatttt

SEQ ID NO: 21974 - DNA, 661 bp, Sorghum bicolor
  Clone ID: 13393423
accctgtgatgaagagtgctctctatttggacatggccgcaaaaatgtcagggtatgtgtcggtggtgggagtacatgatgcacttgcagtctgctgttgagaattcagttttgaggcagcaatatttgccacaggaactagcttgtgtgatgtaaaggtaactagctggcatgtggcaggaatctcaaaaaagaaaaacagagaagtagtgtaatctgtatgctagttgaggcgaagtcagtcggaagctggggggaagtggaaccagacgaatgcacgtctgtttggttttgcagagactgtttgagaaggcaaggcatcaaggttttgcactctttactcaactgtttgtggtattggcatgccagtgtgctttcttttcttgccccctgattgcaggtatagatctcgtttttttttttttttgagttgtgtcggtgaatgggtgtagtgcttgttgggccacgtggggatggaagagattccatgcatcatcgtaggcaacttgctggtgattgtgattgctgttttttttatttgtttggttgttagtatattatatcatgtgtctgtgtgtgggtgggaagcggtaggtgcagtatttttttgtttgtttatttatttatttggtttttgttttgtaagaaaaaggaattgtca

SEQ ID NO: 21975 - DNA, 620 bp, Sorghum bicolor
  Clone ID: 13393468
ggagcacacagtggtgctcatgtcggagctttccccggcgaggatggagctgtttggagattcaattgatgcctgggtgcaaattgcttgtcctcgtttgtccattgattggggggagggtttcaagaagccagtgctgacaaccttcgagtttgatgtcgcactgggctatgtccctgggtggtgggagaaggggagtagggaatgtggtggtgaatgtggtagtgggtgctgttcaggatcaggaacttgtggaaactgcaactgcagtggtggggattttggtggtgactacccgatggattactattcgcaagatggtggtgattggaatagctgctatatgaagaagaagccatctactggcgagaggaaattgcgggttcggattgcaagcaacggagttcaagccgagaagcgtggaaatcaggactcttgtggcgtggaaatcaatactcttgtgaggtagtcaggtgaatagggataccgagaacagcttcatggcatttagaagaatttttgacaccagggtttaatgtggttgtaacactatttagttaccaaaaggaatcttgtgacattgtacctgtatcattatactccaccttcatcatcatatc

SEQ ID NO: 21976 - DNA, 645 bp, Sorghum bicolor
  unsure (1)..(645): unsure at all n locations
  Clone ID: 13393474
atttcttctatgaaatgagagcaactagtaatggaaacactgaaaacagtctgcaattgaaggcttctgtcacaaatacaagggagtggcaaggtctcagccctacagaagctttccttttggttccatatgccttcatcaaatctagcaaacttacactaaatgtctctattgagagggttgctcatgggatgtgaatatctgcagtttgtaatgtgttgtaaaatgtaaaaaaggcagcagtgtaagtttgtcttagaaactgtttttttttttcactgaggcatctctggccaatttggtttgctaaacccctgactctattcatgtgattcagatgctgacatcaaggtctgtaactgtatgtgtatacttccatgtaccaaaatttttaactgagatgcttgacgtaggaactataggaactcatgttgcattcttatgtaaatcctgaattcttgatgtacatgcaacaattggttccttctgttgttagacctgggaatttggtttacgtgtttattaatgtatttagatgcaaagaatgaatgtcgccatctatacatggtataacttttttnagttattatgtccggcccgctatgttcctgaggtcggtgtgttctgtattcccaaaaacagtca

SEQ ID NO: 21977 - DNA, 363 bp, Sorghum bicolor
  Clone ID: 13393499
atcgaggccaggtcggttaggaggccatcgcgaggatgtcggtcgtggatccgcaggcgtccctgcccgctgacaagcatcctgagcgtcgtctcaagtcgacatttaaggcattgaagaggcagagctccctaagctgaaggaagaaaagcccaggcctaacgctgcaccagtacaaagacatgatatggaaattgggaagaagtctccagacaaccctcttaccaggctgctgactaattttgcaatcctactgaaccatttgtgtattaaagatcaacctccaaacagccctaactgcgttgctcctttttcttggagtggatgtgcaacaaaccttgaatcagaagatgtctagcctcg

SEQ ID NO: 21978 - DNA, 321 bp, Sorghum bicolor
  unsure (1)..(321): unsure at all n locations
  Clone ID: 13393535
aanggagcacacaaggcttgcacgtcgctgatggcgggcactcggtagncgcgccggtgagcaggttcaggagtaggatggcggcggtggtcttgtcgcacaggacgaggaggccctccaccgagcccaagtggtggtggagcccggcgtccgtgcgggagctggtggccacgtgacgagggtgcaagcgcgacgtcggggcgcagtggagcgtcgcgatccagtcgcgagggcggaagccgctgtgcgcgcgcgccagggcttgcacgccgcgcggaggcggagatactcagccacgtcgacggcgagcagccaggctgg

SEQ ID NO: 21979 - DNA, 146 bp, Sorghum bicolor
  unsure (1)..(146): unsure at all n locations
  Clone ID: 13393542
acacgccgtcaaaagcacgcgctctaccttgccttccatctcacacgcgacggattcaatggangcaacatcgtgttccccatcgtacccaagggagaagaacgagttcgacttttcctccacgcgcacaacaccaaagangaagt

SEQ ID NO: 21980 - DNA, 246 bp, Sorghum bicolor
  unsure (1)..(246): unsure at all n locations
  Clone ID: 13393555
cgctgaggtgagggggtggctcagggctcgcaaggaggatgacgcgtccaagttggcgtcggcgtggtaccacgtgacgtaccacccggaccgccgcggcgagaagcggttctggagcttcccgtgggtcgcctgcgacaccctgctggcgatcaaggcggcgcgtaggtgccggaagcgggtggaagacgccgctgcgcccatggactgcgacgcctcctagacggaggtgccactgtcaaangt

SEQ ID NO: 21981 - DNA, 207 bp, Sorghum bicolor
  Clone ID: 13393572
tgtctatgtgcagtgcagttgctgcaagcaccagtgcttctgtatttgtaaaggtaggagctgaggtgctgcggctatcatctgggtctgcgataagttaattgtactgatagttgacatctaactattttgtgtatcaaaatgtaaggttggaactggtgggaaccatttgtatctcccctcctattaaaggatcggaatgatata

SEQ ID NO: 21982 - DNA, 467 bp, Sorghum bicolor
  unsure (1)..(467): unsure at all n locations
  Clone ID: 13393590
ggatcacaggctcctccccttttgccggcttcgctgtggaagcgaaacatcaggtggcgtggagaacgtccttgcagagcacctgaacttcttcagctcagggttcgggatccacatcaagaccaacaccggcaggggaggcttcatccggaacgtcactgtctccgacgtgaccctggataacgtccgctacggcctgcggatcgtcggcgatgttggcaaccaccccgacgagcgctacaaccggagcgcgctcccaatcgttgacgccctgacgataaagaatgtccagggccagaacatcaaggaggctgggctgatcaagggcattgccaactcggccttctcccggatctgcctgtcgaacgtcaagctcactggaggtgcgcctgtccagccgtgaagtgcaggctgtcagcggtggcgctctcgacgngcagccgtcgccgtgcacagaactgcttccc

SEQ ID NO: 21983 - DNA, 344 bp, Sorghum bicolor
  Clone ID: 13393592
accagcgcatcgtcagtggcagctacgacatgagcgtcaaggtctacgacgctcgcacgggtgagtagtcaattgacttgcctggatggactaccagctggatgctgagcgtgaaatcggattatcgacgcatcgtggccaccagccaagactcccgggccgttatcatggactttggatatggactggatggcattgagctactcgaggagtgatcccaccagtcttccagtctcagtctacatctacatctacatctacatctgcatctatctacatatctatgcttgcttagtgcgacaaaaaattcttgggcttggagtttctttaggatttgtttttcc

SEQ ID NO: 21984 - DNA, 201 bp, Sorghum bicolor
  Clone ID: 13393608
tattaagaacaccggatctgtcgaatcggactacactgcgatggcattgtcaacactacagccggacccagcccccatccaatcaagtggctaattggctttgatcgtcttggtgatctgaagccacgggcgtctcagacttgaatattcccatctcgctggacaaatgtcgcgcagtaccgaatgtggacggaaaatcgg

SEQ ID NO: 21985 - DNA, 213 bp, Sorghum bicolor
  Clone ID: 13393618
gctgagaaggcacagcagacctgcagagcaagctgatcgagatcctagaccggaacagccggttggtggctgcacagttggaggcgcagaaccaaaactgcgagctcgacagggagcagaggaaagaccaagctaacagcctagttctcgtgctcggcaggctggcggatgcccttggcaggatcgccgataagctatagtcagtcagtcacc

SEQ ID NO: 21986 - DNA, 184 bp, Sorghum bicolor
  unsure (1)..(184): unsure at all n locations
  Clone ID: 13393624
actcatattcaagaacttacatcatcttctcaattccctacgacctcatcaggcaagggccacattgattcacatgcttgagagccaaattcagctccgcaagcaagcaattgaagatanaaagcagaggagagaggaagcacaaaaactgcttggggaatcactgcatatcttgganggaagc

SEQ ID NO: 21987 - DNA, 147 bp, Sorghum bicolor
  Clone ID: 13393627
ccaaatggttccgagggaggcagcgcgggacattccgcagtggaggttctgggaggcaagagagcaggcgaaatgggatggatgctaatgatatatttggtgaagtctccgacagcagcccaaggcatgcagcacagcaacgttagc

SEQ ID NO: 21988 - DNA, 279 bp, Sorghum bicolor
  unsure (1)..(279): unsure at all n locations
  Clone ID: 13393643
aataatgcagtgagcagttcgttcttgttggangatgattccagcattccattttcggtggatgacatctcgaagtcgangacagagatcgaggtaacagatgtcgacatgccacctttgatccgggagaattctggctttaccttcctacaccaaagaaaggactgacagggtggtccttccagctgcaagtctctttctacattcttttccccgctcaacctgtgcataactcatgtcatacgctcatgccttttgctctctggtcagggtaattgt

SEQ ID NO: 21989 - DNA, 313 bp, Sorghum bicolor
  unsure (1)..(313): unsure at all n locations
  Clone ID: 13393682
caaataccaagggtaaaggtttcacgggtgtatgaagagacacgggttcggtggtcaggatcgcagtcacggtgtcagtttaacgcatcgttcgctcggttctgcgggtcccggtcagggtggtggttccagagtgtatcccggcaaaaagatggcagggaacatgggtaatgaacagaacacagtgcagaacttgaagattctgaaggttgatgcggagaacggcannttgttgttgttacaggtgccgtcagcggtcctaagggatgcanggtcaggatacaagatgcaatcaagaagccttggccgaggt

SEQ ID NO: 21990 - DNA, 323 bp, Sorghum bicolor
  unsure (1)..(323): unsure at all n locations
  Clone ID: 13393684
ccggagtcacaccaagttggaaaccataccttactccgctcgcacatccaaattgccgaccagcgacaaaacgtgaaaacaaccaaaaacattcggcgtaccgttgtatcatcccaactcatcttatctctcttgctcgctctcttttnctagtggagtttgcttacccctatcgcgttccccctgatccttaattcaacgatatcaacgagctcttcccctctctgcttgcggagagagtacacgacgacgaaactgtgtttcctttgttttgtgctttagggaatcaagcgcttgtgtatgaataccaaggaaaagaagag

SEQ ID NO: 21991 - DNA, 306 bp, Sorghum bicolor
  Clone ID: 13393729
tctcttattgcaaatttgggggacacatgcacaaaggacgaactaaatgaagtttatccaaggaacctgggtttgatgtcctaaaatgcgtcgccgtggtggaatgcctgttgcttttgctgattttacggatattgaatcgtctacagctgcatgaacagcctccaaggcactgtattggcttcttctgatagcgatggattgcacattgagtatgcaaggtcaaagatgaggaaaagctaaagctgctggaccgtaaattctcctgtcttcctgaaggtatcagtaggcatacctgcacaagta

SEQ ID NO: 21992 - DNA, 326 bp, Sorghum bicolor
  unsure (1)..(326): unsure at all n locations
  Clone ID: 13393757
acggactggagggcgctcgacaagttcgtcgcgtcacagctcagccccgccgcggagtgcggcggcagcttggaggcggccgcagcagcagcgtcgacggccgccgccggcaacgtgggctcacagctggaccacgttgaggatgatgacgacatggcggcattgctgttcctcaacagcgacgggagggaggaagcggagaggtggacggggctgctcggccccgccggcggggacggcgactttggactgtgtgtgttcgagaaantgagtggcagacgctagggcgcgcgcgcgccgcgcggcgcgtgcacggtctggcgcgg

SEQ ID NO: 21993 - DNA, 285 bp, Sorghum bicolor
  Clone ID: 13393772
acgtgatgccgccgccatgaaggcagtcgttggtgaggaggctctgtcctccgaggacaagctctctctcgagttcctcgacaagttcgaacgtaccttcatcagccagtccgcatatgaatcccggagtatcttcgaatcgctcgacatcgcttggaacctcctccgtgtctaccccaaggagctgctcaaccgtattcccaagcgtgttcggacgagttctcacccgccatggtcgaaagtgcccaacaaggacacgagggacggcacgcaggcgccacagaa

SEQ ID NO: 21994 - DNA, 207 bp, Sorghum bicolor
  Clone ID: 13393776
cgctaaagaatgggaagactggacgatcctggtccaaggcaaacggaaagcaacgacagcagcggcggcagcagcgcgatccggtattgcgcaacgtgtatgagccattcttgcggtccaagaggtacaagctggcgacctcactgggtcttcgactcatccgatgccgctgccggttctgcggtcatcggctatttgctgtctaat

SEQ ID NO: 21995 - DNA, 144 bp, Sorghum bicolor
  Clone ID: 13393791
cctttgagaaggcagcatggtggagatcccagagttccttgaagaagaggaccttctcgcttccctcgagtttgactgtccagtcatgctccctgctcctgcccagcacctgtaaaaaatgccccactcttagatcagaattaa

SEQ ID NO: 21996 - DNA, 329 bp, Sorghum bicolor
  Clone ID: 13393832
gaataaaacccacatctttgccaagagagagagtctgttcatcaaaagatagtcataatcaggactctgacaacgaagagcagagagcaggatcctatgttgcccgaacaataataagccccccaagatcacaagaggagggccgcaagcttcagtccagctaccagtgcgccacaagcactgctgattcctgcgccaagagctatctgaagagcgccgctaatatcagtgcttccaggcatggcatcaaagggaaaactggccgaaaggagaaggaatctccgaggctgtgaacgaggcggcgctgcctcatgaactgtagacaaggt

SEQ ID NO: 21997 - DNA, 283 bp, Sorghum bicolor
  Clone ID: 13393833
aacccgctgcacatcgaccccgagttcagcaaggtgggtggcttcaagacccccatcctgcatggtctggcctcgctcggtgtctcgggcaagcacgtcttcggcaagttcggcgcctcaagaaccttaaggtccgttttgccggtgtcgtgctccccggccagactcgaagacgagatgtggaaggaaggaaacacggtcatcttccagacgaccgttgtgacaccggcaagccggccttacgggcgctggtgctgagctcttggacggtgccaaggctaag

SEQ ID NO: 21998 - DNA, 240 bp, Sorghum bicolor
  Clone ID: 13393884
ccagttcagacaaaatttgagtcacacccccacatggcttgcagaagatcaaggaagaatttccaaatgccagtgtaggaacaaagagaaaggaacctatggcagttggacacagaaaggtctcatacaagcaattgtcatggcaatgagggctcgaaggagatcattttgcacccgactggtttgtattgagcataggtaccagcatgagaacttggacggtgtctgtcactggactat

SEQ ID NO: 21999 - DNA, 142 bp, Sorghum bicolor
  Clone ID: 13393888
agagagatcccctgtttcccgggcaatcttccttccatcaccgcagaccccagactggcccattttctcccccatgttgccttccagaaacccttcgtgcagtagcggggtccggcccggccgggccccttgcggccgtagc

SEQ ID NO: 22000 - DNA, 209 bp, Sorghum bicolor
  Clone ID: 13393890
cagcttatcgagcctgctcttttacccccaccacccatttcgtggtacgtgagagggattccacaaggacaactgagatgctggtaatgacctgatagcagaaactgctcgattgcggggcatctcaaacaacaccgttccaagcaagatactgaagaaaatgggtggtgctagcccaagtgatccaacaagagagtctggtgacataa

SEQ ID NO: 22001 - DNA, 212 bp, Sorghum bicolor
  unsure (1)..(212): unsure at all n locations
  Clone ID: 13393893
gcaccaagaagccgaacaagaagaaagagagaacgaaaagtgcttctcccctcacaaagccggaagcttcagaacctgcttccaacatagatgcttgagtgttttcattcagtcctgtgactggagcatcactttggtggtcatgttcgagcccacaatgttctgcattgaccctagaaactgttattgaattcagaaacagaagctgaant

SEQ ID NO: 22002 - DNA, 201 bp, Sorghum bicolor
  unsure (1)..(201): unsure at all n locations
  Clone ID: 13393903
gcaaactctgccctctatgaantgttgctgagacgacattgttgctcaacaagctacaagagctatcaatggccaagctgcgccctgatttttccagtaatcacctaccaagccatgcgataagctctgtgagattggctttggcatcaaatctggcacgtgccattcttggagacccgtaatccaagcacattttagcac

SEQ ID NO: 22003 - DNA, 373 bp, Sorghum bicolor
  Clone ID: 13393909
tacaacgtgaagctggaggagagctcgctgctggaccagtacccgaggaaccaccaggtgctcaccgacccctacgccgtgcacaagcagggctgggacgcgctcaagacggcgtacctggacaagcagaacatccggatggatcttgacaggttcagagccacgctgcgggaggcaatgagccggttgccgtctccgtgaccggagctccaactgcccggtccggaggtgggaggaggtagataggttggtgtatccatcgtccccggctccccgctgtatgctctcaagttgacttaatcttcttcttcgtctttctcccctttttgcttcctttttctagcaagattcattgatccaattgttttgttgt

SEQ ID NO: 22004 - DNA, 300 bp, Sorghum bicolor
  unsure (1)..(300): unsure at all n locations
  Clone ID: 13393910
ggacgagtccccgctgttttgcttcatgacgtgtcatgtgtgttggtaaacgaagacaaatgtttctgcgtacatgggccttgttttgcttgtactggcgttcctgcttggctcgccacccgaccagttcattttggtgactattcaggcaaanggattgtggtantacgtgaactcggtgacaggcaaacgagtggcaccgtggtcagccacgagggtgacgtgctctctggcaccgggaaaaaaaaaaatcgaatgtttggttttgttgcgaaacggtgtctgttggtgaaaagacac

SEQ ID NO: 22005 - DNA, 385 bp, Sorghum bicolor
  Clone ID: 13393912
tgacgatgacgaggactccgacgagtcggaggaggaggaagaagaggaggatgagccactcgcggccatcgtcaccgctgccaagaagaggcgcgcgaggaagctcagcgacgagttcgatcgcatcgccgtgagcaacagctggtgagaaggagaaggcgggtgccgcgacgccggcgaggacgtcaccaaagaggaaggctgccgcaccggccgcggcgccggcgagggtgtcgccgaagaggaaggcttctgcatccgctgctggggcgacggctagggcgtcgccaaagatggaagagctgccgcacccgctgcggcgccctcatcggcgactggggcaaggaggaccctcgccgaggaacaagcacatgagtgcagtcgc

SEQ ID NO: 22006 - DNA, 296 bp, Sorghum bicolor
  Clone ID: 13393929
cgtacctgcagagagccagcagcctgggcggcggccatggcgcggtggcgccggcggccgtcacggacacgctcgcgaaggcgatcacgtccgatccgagcttccagtccgccctggccgcggcgatcacgtccgtcatgggccgcggcggggccgctgctgcccagaagtgatcaggaattcaggatccgcggcgcaggcatgcaccatgcggaagatcgattggcaagggcaaatcgccgtttttgagcccagctgccatgcatgcatgcaatggattagtggttcatgtgtat

SEQ ID NO: 22007 - DNA, 233 bp, Sorghum bicolor
  unsure (1)..(233): unsure at all n locations
  Clone ID: 13393940
cggcagcttggcgccgatcagcgtgccgtcgttcgacatcatgcgggggcggtcggtcaccggctcgctcttcggtgggatcaagcccaaggacgacatccccgtgctggcacacaagtacctagacaaggagctggagctggacgacttcatcacgcaccagangggtttccaggagataaaccgcgcgttcgcctgctcacccaagggaagtgcatccgctgcatcatctg

SEQ ID NO: 22008 - DNA, 490 bp, Sorghum bicolor
  unsure (1)..(490): unsure at all n locations
  Clone ID: 13393954
gcacgagggctcagccaagacacctcgccgacctccnttcccccgaatcgcatagcggagtccggattgcagttgctccggcccatccggccgtcacatcagccccacgccgcgccgccagtcgccgcacgaggggggcgcccgcgatgccgaagaagatgggcgtgaactccaaggcggaggcggcccgcgagcgccgctccgccgcggaggccgaccggcgcgaccgccaggagcgcgccaaggaggagcagtactgggccgaggccgagggccccaagtcccgcgccgcgcgccgccgggaggaggacgccgagaagcgcgccgaggccgcggcgcgcaaggctgagaaccgccgcctcgccgaggccgaggccgccgccgtcgccgcttccgcgtcggcgccgtccaaggccgccgcgcgcaaggcgtcccgcgtcgctgccccgccccccaaggtcaccgaggccgagctcgcgcgcctcgggag

SEQ ID NO: 22009 - DNA, 122 bp, Sorghum bicolor
  unsure (1)..(122): unsure at all n locations
  Clone ID: 13393966
catatgacaatcaaagcttcttggttttgctgagctgaaactaaaggaagcaatctcaaaggaacccacccnttctgattatgcttgttggtgtccctaatgttggcaagtccgcactcata

SEQ ID NO: 22010 - DNA, 167 bp, Sorghum bicolor
  Clone ID: 13393974
gttgtcacccaaaagaacttgcacacaaataagcaaagcaagaagtaatgcaataaacaaaaatagaggtggctgatctcccccatggtattgggtcatttccacatatcgggttcatgttggtgcaccaaagattcccaatgctcagtaaaagcttgcttcctagt

SEQ ID NO: 22011 - DNA, 145 bp, Sorghum bicolor
  Clone ID: 13393975
gattttgacatcgaccttgcctggcgcatgcacaaggcatcagatggtcagaggagacgtgtccagatttgcatgggacttcttaggcattcaggttctcctcctcgatgagatcacagttgaccttgatgttctggcagatcaa

SEQ ID NO: 22012 - DNA, 335 bp, Sorghum bicolor
  unsure (1)..(335): unsure at all n locations
  Clone ID: 13393979
tannctcctttcatcatgacagttctggagtctcaggctacgagagactatggtgcccagtggagggaagagtgggctgatgctcagcggctcaaagggcccagcatgaagaacagttctgtcttttccgaaacatcgaagaggagctggacctcaatcgaaaagccggtctccacttcccaatccacctacccagtcacgtcagtgatttctccacctgcgatgttcttggcatgagccatacgggcgctctgagggaggaattcatgaaagaactcgaggccaacccaaactttgctatgggagcaggtggctcgcgcctccttgatgggact

SEQ ID NO: 22013 - DNA, 172 bp, Sorghum bicolor
  unsure (1)..(172): unsure at all n locations
  Clone ID: 13393986
ggacntcagggagtgctttgggtgccaccnttgatgggacgggcgccatcttgctgcagctgacttatgcaccaagaatatacactgcaatttctgggtcaacagttaaatcgaggttacagatgaccgctttcatgcntgcaaggaggatgccaatttgcatgggtagagc

SEQ ID NO: 22014 - DNA, 183 bp, Sorghum bicolor
  Clone ID: 13393987
tctaccgcgcccactctcgtctcgccaccatccaaggccgtggtctacgacgagcacggcccacctgagcaggtgctgaggacggtggacgtgccaccggtggaggtcggcgaccgcgacgtctgcgtcaggatgctggctgcccccatcaacccctcggacatcaaccgcgtcgagggcgtc

SEQ ID NO: 22015 - DNA, 340 bp, Sorghum bicolor
  unsure (1)..(340): unsure at all n locations
  Clone ID: 13393988
gcacgaggcaagagcatgcagctgcaggacacgaaccagagccatgccacgccgagggaatcgctgcccgttgtggccgagaacggcgcggcggtggcgaggaacgacggcggcgagtcgcggctgttcgtcgacctggagcccgtgccggcgatcagcaagcggcccgacgacggagaccacgcggcgccgtgcgccaggaccantgtccaccagctcaaggagccgccccgtaacgccgaccgcgtccctctgtccggccccgtgcagctcgccgcgtcaccggcttcgcctgggccaagaagccccggcccgacgccgccgctgtgacgaagcggag

SEQ ID NO: 22016 - DNA, 366 bp, Sorghum bicolor
  unsure (1)..(366): unsure at all n locations
  Clone ID: 13393993
gcacgaggccnctccgccgatccgggcccagatcgccntggccgcccccaacagcaacgacgccgccagcgccagtggcaccggcccggctggcgaggaggacatctccatcgaggcgttggcgcggcgcgtgcaggagcacatgaccctcaactccaaccccgccgctcgccgccacaagttctgggagacgcagcccgtcggccagttccgcgacgccgccgacacgtcgctaccggacggccccatcgagccgcccacgccactctccgaggtgcgcgctgacccctacccgctgcctgccgccttcgagtggctcacctgcgacctcgatgacgacgcgctcctcgccgacctctactcgct

SEQ ID NO: 22017 - DNA, 397 bp, Sorghum bicolor
  unsure (1)..(397): unsure at all n locations
  Clone ID: 13394000
gcacgaggcgcacaacaacgcgttctccttcggcaccgctgtcctagattcttctccaggcctccccgttgacagtccccgtactgctgactgcgtcccccgccctccatgcactgacggcaccctagcaaagggtctctgcaaggccgctcgtcgtcaatctgcgaagcaggctgtcagcatcgcccccctacagccaggtctgaaggtggatgctactctctcctcagagcactcctgtccttcaaagtcaatcgatggtgagaaggggaggcaggtaggcagcagccggatctaaagttggatgctactctcttcccatctgtgttccntgattgcaatttcttatttctgaagattcttcntactgcagtgaaatgccgagatgtgaatgaag

SEQ ID NO: 22018 - DNA, 379 bp, Sorghum bicolor
  unsure (1)..(379): unsure at all n locations
  Clone ID: 13394013
ttnantgtcccgactggatccgttcctgcgcnctatcccggccatggccacgaacnctccganttgtcccccagggcatgggcggaggctctgcagcccgggcggcggccgcggnctagaatgaaatgacacgggtggaacgcgacaatgccaaataccgggacgccaacttgtgtctggactcggagagtgggattgggatcgacctacgagaccgttcagatcgttccgagaccgagttatccgtggtgcgcattgatcctgtacatatctgccgtctgaaatcatggcgcaagtcctctcgtatcttgatccagactcggttctgcaggctgagcttgtttctcggggatggaatgagcaggcggtttctcgtcat

SEQ ID NO: 22019 - DNA, 211 bp, Sorghum bicolor
  Clone ID: 13394021
tactatgaatgttgtggattgggcattcccagactgctccaacgggccgctgaaggacacgatagtttgcgacaaatcggcacggcctcatgatcgagccgcagctctcgtttccatgttcacattcgaagagctcgtcaacagtaccggaaatcttattccggccattccgcgactcggacttcccccgtaccaggtctggagtgagggc

SEQ ID NO: 22020 - DNA, 259 bp, Sorghum bicolor
  unsure (1)..(259): unsure at all n locations
  Clone ID: 13394025
gntcaacttccgccacaaaagcacacgcggccctgccctgtcccagccatgtccaccgccggcgaccccgccggcgcagcagcagctgctgctgccgcagcggcggcggccaccccgtcgggtcgcgcgccgaggctgccgcggtggacccggcaggagatactggtgctcatcgagggcaagcgcatggtggagggccgcggcgggcgcggcgggaggggccgcgtggcggcggcggccgcggcggcgtcggggtcgg

SEQ ID NO: 22021 - DNA, 292 bp, Sorghum bicolor
  unsure (1)..(292): unsure at all n locations
  Clone ID: 13394026
cttcntccaactctgccaacatcgagatcttccgcctcgacttccagtcggactccccggacctgccgctcctcgcctcggcgcccgccccggaccgcttcaaccgcctctcctggtcgcgcccgggcgccgtcgagggcgactccttcgccctcggactcctcgccggtggcctcagcgatggctccgtcgccgtgtggaacccgctgagcatgatcagctccgaggggaaagcggaggacgccatggtcgcgcgtctggagaagccaccgggccggtttgtggactggag

SEQ ID NO: 22022 - DNA, 422 bp, Sorghum bicolor
  unsure (1)..(422): unsure at all n locations
  Clone ID: 13394028
gcacgaggggcagtgccgccacccgctcgtgccgcgctcgggcgtcgcccggcgcncaccactgaccgccccaccggancatcgctcggcaccggcgcagctacgcggggcggatccagccaccggaccaggagcaagactggaggaggccccgcgcgctccatccccaattccccgtccagtggcccagtgctgagtgctcgagttgttttggtttcttcgtttagaggatggcaatggccacatcatcatcgtatcctccacctcctccattttccgattgtacagaaattttagcaagatgcctcatccgcaccagaaccaccaccaccaattgatggaccanttcaagccttgggtgttgatacacaggagatgttgtgattccagcttggagagtcatatgttcgtcagctttatcc

SEQ ID NO: 22023 - DNA, 188 bp, Sorghum bicolor
  Clone ID: 13394030
caagtggaccaacatcggcaagggctggcgcccgcgctggttcgccatccgcggcgccatcctcacttactccaagatcccacgctgctcctcctccgccgcccattacggccaggaccgccccgtcgtcggcctcgtgcacctcaagatctcctcattccgtgaaagcaagtcagatgacaggcggt

SEQ ID NO: 22024 - DNA, 418 bp, Sorghum bicolor
  Clone ID: 13394039
gcacgagggctgcaagagacattgcatgatatgcaacttcaagttgaagaatcgaaggccatggtggttaaggagagggaagctgctagaaaggcaattgaagaagcacctccagtaatcaaagagactcctgtgctagttgaagacacggaaaagataactcactgacggccgaagttgaacaactaagggctttgctgctaactgaaaggcaagcgacagaagctgcaaaaagagaacatgctgaatctgaacggagaaatgaagaactaataagaagtttgagagtgcagagaaaaagattgagcaacttcaggacactgtccagaggctggaggagaaagcaaccaacatggaatctgagaacaaagtcctccgtcacaggctgttgcaatttctcctacggcaaagtcattag

SEQ ID NO: 22025 - DNA, 158 bp, Sorghum bicolor
  unsure (1)..(158): unsure at all n locations
  Clone ID: 13394047
acccttgttggaagcttgagatatattgttcgtacatcagatgttgggtgcagtcactggatgcaaatattcttgcaagtttgaagagaaactgacaaacgatgttgctgatctgacccccaaaaatccgtatttggaagtttcacaaatttcaanaa

SEQ ID NO: 22026 - DNA, 345 bp, Sorghum bicolor
  unsure (1)..(345): unsure at all n locations
  Clone ID: 13394061
gcacgaggtctcgttccnttccgccntgtcgccgcgtctattccgggggctggcacagcttcctttggccctctgggcccctcaatcgacacccaccatcaacgcttaccattatatgccggttcggacatttggaatcaaatccgtgaccacccccaaacccagccgattcaatgttggtcccgacttgccgatactgaagtcgacgcctgcggcggctctcgagcgcaaggcttacaccctacccctccgaagcggagcagttgccatcaagaagggaatgaccggcatctacgacgcacaaactgggacccgcattccgtgcaccgtcctccaactcgaccg

SEQ ID NO: 22027 - DNA, 234 bp, Sorghum bicolor
  unsure (1)..(234): unsure at all n locations
  Clone ID: 13394062
ctggataccgcaaggacagccatgatggatggtggctcaccagcgctcacctcttcntcgtgacagtcatcgttggttccgaccagcgactgttcgccgcgcatgaagatgtattaagtcactctccgtattttgctgaactgctgcggggcncagttcttcgagtccgctaatcgccgcatcgatctgcccacggaggaacctgagattttcagttgtatcctcgagtatttg

SEQ ID NO: 22028 - DNA, 418 bp, Sorghum bicolor
  unsure (1)..(418): unsure at all n locations
  Clone ID: 13394096
gcacgagggcggttacggccaccatcgtcccgtcctgctcttccntggcagcgacntgtggaagcagagcaagtcggccatgaacgccgtgaagatggacgtgcacgccaagctgatgcagaggtacaggcaggtgccacagtggtggttcctcatgctgctgctgggcagcgtggttgtgtcgctgctcatgtccttcgtctggaaggaggaggtgcagctgccgtggtgggggatgctcttcgccttcgcgctcgccttcgtcgtacactccccntcggcgtcatccaggccaccaccaaccagcaaccggggtacgacatcatcgcgcagttcatgatcggctacgcgctgcccggcaagcccntcgccaacctgctcttcagatttacggccggatcagcaccgtgcacgcgct

SEQ ID NO: 22029 - DNA, 289 bp, Sorghum bicolor
  unsure (1)..(289): unsure at all n locations
  Clone ID: 13394105
ttntgaaagatcaagaacacatacgcacactcttcctctctgacaagagcttgcttgttctgcaacaaaccagcagtatagatcgatcctctatctaacaggtgcaggtggaggtgatcatatggactccatggaatcatgcgtgcccccgggcttcaggttccaccccaccgacgaggagctcgtcggctactacctcaggaagaaggtggcctctcagaagatcgacctcgacgtcatacgcgacatcgatctctaccgcatcgagccatgggatcttcaagaacan

SEQ ID NO: 22030 - DNA, 344 bp, Sorghum bicolor
  unsure (1)..(344): unsure at all n locations
  Clone ID: 13394110
ctcnggccgggcccgacgagacggaggcgaggggtgacgacggaggcgaggaggacgaggaggcgggggaggggaagcccatgccggccgccggggcccgcctgctcnctcgcgtcttcatgcccaaggcgcccaagccgccgcaatcccaggaccaggccgaccccgccacccgggtcctccgctccggcaagcgcctcgccgccgaccggatccgctgggacgccaaggaggccccagcccttcacgtcgacatcaaccacggccacggccacgaccagcagcaccaaaaggaggattgccccaaaccgggattgccacctctgacgaagtccttcgggatc

SEQ ID NO: 22031 - DNA, 313 bp, Sorghum bicolor
  Clone ID: 13394113
agtcctgaaaaaccgcaataatggcgtccgaattcgtcgacccccggatgacctccatcaagcctcgtatccgcatcaacaccatcggaggtatcaacggacctctggtcgtccttgataacgtcaaattcccccggtacaatgaaatcgtctccttgacgctcgccgatggcacagaacgctcgggtcaagtcctcgaagcgagaggcaacagagcggtcgttcaggtgttcgaaggtacctcgggtgtcgatgtcaagaagacccaaagtcgagtcaccgggcacagcttgaagctgggtgtgtccgaaga

SEQ ID NO: 22032 - DNA, 340 bp, Sorghum bicolor
  unsure (1)..(340): unsure at all n locations
  Clone ID: 13394115
gcacgaggcactgaaacgccncgttgagccgncntgcgccntttgcagaaaccaagtgagatgcaccaggaagctccagccctgcaaaacgattgctgcggtcgacgagagtgcaccagcccncagcggttttgacgggcaaaagcagaacgatgccctcgacggggacaccgctgtcatccatggcggatcaaccacaatcgaagtcgaccaggcaatcactcgacaagttggaccagacggacaaacttcatcaccggcaatctttggacccntcgaccccgatgaagcgccataagcgttctccctctgggcccacttccccagctcgcgtatctgt

SEQ ID NO: 22033 - DNA, 182 bp, Sorghum bicolor
  unsure (1)..(182): unsure at all n locations
  Clone ID: 13394117
ttcagaaaaccaacgaaacaacagatgggaaaagattgatggaaattgccaaaaaggaagggtattcaagctcaagagaatgcaatggaagagcttgctgaaagagtgcacggagatattcgcatggcactcaaccantttgcagtatatgagcctctcccaatctgtggtcaaatacgatg

SEQ ID NO: 22034 - DNA, 247 bp, Sorghum bicolor
  Clone ID: 13394122
ggctgccatgacgtccaccgtgacgacgcccagcaggccgctcgccgccgggacccggccgcggcggtcctggcccgccgtgctctcgctcagcaagggcagcagcggcccgcggcggcgtaggccgccgtccacgagctgcgctgcgctcgcgtcgcccgacaagcagcgcacggccaacaagctcccggtgtcgtcgaggaaacagcagcagcaggaggaggaggaggaggtgagggcgacggaa

SEQ ID NO: 22035 - DNA, 154 bp, Sorghum bicolor
  unsure (1)..(154): unsure at all n locations
  Clone ID: 13394132
cgnnggcggcggaggtccnngcgtcctcgtcacgctccaggcctggcgcncgcgcggccgcaggaaatcagccgcggcggcgggctctgcctcgcggtaccgccgcccgctccggagatggcctctgcggctgctgaaggggatggggaggggg

SEQ ID NO: 22036 - DNA, 210 bp, Sorghum bicolor
  Clone ID: 13394134
tcgaagaagagaaggtggcgctgccggccagctgcctcctttcagcgaaccgcgtcgcctccgccacgctgtccgctacctctcctcctaaccgcgtcgctgcttcgtttgcctctgcggccgcgagggcgggaggctccgccgggggcctctgccttctcttaaggccaatttctcaacatggaatctgaaagcactctttaacattgc

SEQ ID NO: 22037 - DNA, 153 bp, Sorghum bicolor
  unsure (1)..(153): unsure at all n locations
  Clone ID: 13394141
gtgacagaaacttntggattcagagtgaaaagccctattctcggaggctgttgacttggcacttgagcgttggtctggacaacacatcccgtagaagtagaagcgattcttgttcctcacgtgttggaggatgaactgaagacagtaagaatt

SEQ ID NO: 22038 - DNA, 367 bp, Sorghum bicolor
  unsure (1)..(367): unsure at all n locations
  Clone ID: 13394144
gcacatatccgtcatgtttatacagatacgaccgccttcntgaaagtgacctcgtttccgaagcaaggactacagtcgaagagccaacgttggcaaaattagtggaatggcgtggggatgatgaaaatggaaagacagttcttgaggatgttttccgggaggtcatagttatatctgatgatgatgatgactctgattctgacgagggagagaacattccaccaagatttaaccgagatcatagcgtggaatatgtgtcgggcagggcaagggctgtcgaactcccaacaggaccaaccgcatatgcagatccaaactcgcaacgatcattgcgggaattgtccgaagatgaagcaccacccggctt

SEQ ID NO: 22039 - DNA, 109 bp, Sorghum bicolor
  Clone ID: 13394147
ttatgctgccccctacccgaagggagttcaaagatatctatgttgtctttgagctcatggaatctgacctgcatcaagtgatcaaagcaaatgataacctgactccaga

SEQ ID NO: 22040 - DNA, 109 bp, Sorghum bicolor
  Clone ID: 13394151
ccgtatgacggccacagttatgccccccgatgttcttgacacttgaagcccgactgggtggttcctttggtggctgccctcgtccactcctcgaacaccaccgagaact

SEQ ID NO: 22041 - DNA, 192 bp, Sorghum bicolor
  unsure (1)..(192): unsure at all n locations
  Clone ID: 13394152
cgatctatgtggccaaagtcaaantgttaactgtacctctcaaggtcctgagcagtatggtggcagtgatcgtaatggtataaattctcagccaactgacctgagatacacccatataggacattcctgctaggtgcagagcaagcagactcttttactttgaatcctagtgaaaatcctttgagtgatttt

SEQ ID NO: 22042 - DNA, 183 bp, Sorghum bicolor
  unsure (1)..(183): unsure at all n locations
  Clone ID: 13394156
nctcaggctcactcgcccaagttgttgtcgcgcgtgtgttgtcgccactgcgacaaggacgtgacgctcgatcgccgttgcgtgtgtggagaaaaatacgccgaggcttgtggcgggcacggngtcttccacgatcacatggcgagctacgggacagggacgccattattccttgccaccagt

SEQ ID NO: 22043 - DNA, 358 bp, Sorghum bicolor
  Clone ID: 13394170
tggatggcattgaactcttggaggcatgagtttttcacaaagattcaaacaacccaacttttgcttgattggcttttttttcgccctttgctctcatacacccatcgtcatgtcattgagctatgagtattctttatttttctctctttcagttttgttgcattttctagtcgtttaagcgttctgttttgggggaaagcatcatacacatacacatgggactatatggcgtggcaattgccacaagtcaagaaacaattggaaaaacctggtgatacaagggacacgaaaaatggcaaacggcttgctcaggaatattgcagccgacggataattcttgcttggctattgagatgct

SEQ ID NO: 22044 - DNA, 584 bp, Sorghum bicolor
  Clone ID: 13394209
acctgaaagatgaaatgaaggtgaatctccaatactttgatggccggccaatgtctggtacagttcctcaacgagtgacttgtactgttgttgaagcacagccaaatacaaaagggctaactgctcaacctcagtataaaagggtcttgctggacaatggtctttcagtgcttgcaccaccctttattgaagcgggtgagaagattgtaatcagtacagccgatgattcttatatgacgagggcataaccagatatcgtggatacgttttgttctcccaaatgggcgagtatgatttggctaatggataagttttcactcctgcagttgccgtaaacagtcaagcttggtcgacaccaaccaataattttagttctttaccaatagcaacacattttgtactcacagatcttttcatttcgccctcgtttcaaatatttatgcaaaagaatccattcatggtgaaccatggaatctttttggggaacagagatagagaagctgttttggtatagatacgttcaaattatttgtattcccttgtatggcttactgttctgcggaactcattgggtttgattgttt

SEQ ID NO: 22045 - DNA, 176 bp, Sorghum bicolor
  Clone ID: 13394216
atcacaagttatggtgacattctggcttatgggctcaatgatgtgttaaaaaaagggctgtactttgtcttagatgagcaaatgctatcgtctccagctatgtaaatttgtaggtgtctctgtatcaaatatcaactggtaattttaacctcatgtgtcgtattgtttgtttctta

SEQ ID NO: 22046 - DNA, 305 bp, Sorghum bicolor
  Clone ID: 13394234
ggaagatgtgtacagattaaaaggtgttatatctgtaaatgagtccactggacgtttcatgtttcagggcgtgcactgtatgctggaaggatgcccagcaaagccgtgggaacctgatgagaagagaatcaacaaactcgtgtttatttgcagaaatttggacgaagctgcacttcgaaaggccttcaacggttgcttactctgaactttctgatcgtgttttaatcctgagaggttgaattttgcgaaagaaatgcaccacagggagaaacaggcgggactgcaaattccattatttgaccgct

SEQ ID NO: 22047 - DNA, 380 bp, Sorghum bicolor
  Clone ID: 13394253
tgttacctgtcgtgcacaaaatattgcaggatagctggagaagcaacgcggtggttgaagagatgtttggaaggatggctctgcagataactgactacccaggctcaggcccgaacgatcgtcacactcccaaagcaccgggcccatgacgacaaagacagagacaactactgaaccctgaagattgtgcacagagatttcaagctaatctgggtcttttggcctggaacaaattcaagctaatcatagatcggctaacgccttgaaaatcgtagtagggacctgcaagtgtaaatatacatgtagtgtacctgtgcagcctgaatttctacgctgtctgttctgtgacacgctgattagctgtagagtaagaattgtat

SEQ ID NO: 22048 - DNA, 489 bp, Sorghum bicolor
  Clone ID: 13394291
ttgggtagaaattagagggaggagcagggacaacaaagaagaagaatgcccctcttggatcaatcaagatttcctcatctgtccctgcctcttgtctctgggaggaggattggtttagtgattggattaggtgggagggaggttgggattagttaggtaatctgtcgtagtttcatcaatcaatgatgctttttctttttggtttttgatgatgatggaaattgttttttgtccgtccgtccgtccatgcaaccaagaaatttctttgtcccaaggccatggagaatctgtacaaaagagtggctacctacaagaggagagagttgagtttgtctgagagcagaagcagaagctaggtttaagtcagtcggtcagccagtcagtggatgagctgagagagacattcattcacatgctgagactgagagggttattatttgtgatatttttcctcttcttttttttttccctgattttgtatattgtaat

SEQ ID NO: 22049 - DNA, 500 bp, Sorghum bicolor
  Clone ID: 13394306
aggacgagcagcatggatgtgagatatgctcatgctcttaacttgatctccagaaagggatacagtgaggctcaattgaaggagtgcttggaggaatacgcttccctgaacgtgtggcaaatccatccaagcacctttgacatccacttcatcgatgcttgatgcagaagtcaataccaatcacgtaacatttcatcatgagccaaggaatggaacatcaagagtttgtagcttcatggttcgtgattggagggaggaacacggtcgagtgaagcctaacaagatttaaaatttctagtgatagtgaacaacagcccatttcatgatgtcaatgatgtaatgctgactgctgagcagaagcctatctcaattgtactagtagagcaattcttgtctgacttatgagtagcttgttttctggctatttccttgtgacagttgacactaagtggatgccctgccgtgtttccttattgctgctgatacttgatagttgtatc

SEQ ID NO: 22050 - DNA, 491 bp, Sorghum bicolor
  Clone ID: 13394308
agcagtctgatgaggaggaagaaaatgaagacggcgagaacaagaacggcgaatccgcagaaagcagcgaacccaaggctaaggccaagtctgaggacgacgatgacctagttgttggaggctacgaactctacatggctggtgatggacacgatgaggaagatgcagcgatctaccgttccgccgatgccgatgaagacgacgggattttactcacgactgcagcgggctggaaccgactcagcattgtgctgcgagatcaggggacactgaagtttgtcaagtacgttagtgcagcggccaagggcgatcggtgggatattacgggagagatgggggttgaatacgatgacaatgatgacgatgaggacgaggaaaaagaggaggaggatgaagagggggatgacgatgaagagggagacgatgaggagtaatgtacatcgagaataaaaaggttactcaagcaagggcaagcagaccagataccacac

SEQ ID NO: 22051 - DNA, 280 bp, Sorghum bicolor
  Clone ID: 13394324
agcggcacggcgctgagcaggcgcttgttcgagagcaagcacctggaggttggccagatcacgccctactccctcgccgtccagatgcggtggttcaagcaggtgctctccatgctcctcgccgcctccacagacgacgatttcggtaccacatcatgatcaccctagctattgccatcgatcagcgtcagtttttgtctggcccttcgtggaactattactatagtatatgtcaccgccggccgcgccaattgattatcaatgattttatatattcgtg

SEQ ID NO: 22052 - DNA, 422 bp, Sorghum bicolor
  Clone ID: 13394327
cacgacgacccgcacatggagatccccaaagaaggccaagatgtctgccgcgaatttttgagagaatgcattcccgaatttggcaaccgtccatggactcataccagaatctgctggtacacagacactcccaccggcgactgggtcatcgactaccaccccaagtacaagggtctgtttgtcgcgaccggtggttcagggcatggctacaagttcgtgccgaagattggcgagaggatcgtggatgtaatgaagcgccaaccacgggatgacttgggtactgaattccagaagaagtggtcatggccgaagcagaagtaccactttgatcacatctggacgaacgactggagaggtggacggaagggtatgattgttgaggaagagcagaggaggggcgagaagacatgtaagctgtaaag

SEQ ID NO: 22053 - DNA, 129 bp, Sorghum bicolor
  Clone ID: 13394334
tcaagatgcggcacagggtttgccagatgtgtatgcataagtacatttcatgcattagtaagttccatagcaattgatatgtgcattttgctcatcaagttttgtgttagttggtgaatttgataccaa

SEQ ID NO: 22054 - DNA, 366 bp, Sorghum bicolor
  Clone ID: 13394339
aagaccgagctttgagcgacgatggtagatagcatgtcaggacagcaagctaaacatttgctgtgaggcggcagcagcgacagaatttcatcaatttgatcaagctacagacgagctgcgaatgaatggcggctgtggctgtggttgtggatggttgatgtcaagcgcagcgaaatcaatcaacattttcagaggggggacgcgcacatatagtgatagggatactattggcgttgagctgaaaacgggggatgcatgatgggccaggataccagctttcctgccgctgtcgttgtagagatgggcaagccctgctgctatcgttgaagagatgggcaagcgatactatggtttcgttgctgatat

SEQ ID NO: 22055 - DNA, 403 bp, Sorghum bicolor
  Clone ID: 13394361
agggtaggcgtggccgcaaaccctctagagggagaggcaggggagccaaaaaggcaacccctgaggcaaagccatctggaaggggcagaggccgccctaagaaaaccgagagtcctgctcagaaagctggaacctcaggcagccgtggtggaaagagaggaggaaaaagaggacgaccacgtaagtgatcgcctgttctacagtaacgtggtgttgaaatcagtttaagtgatctctaacacctgatggtccaacggtccaaccattgaagattcattttggtagcaatgcccatttctcaccgattgcggctattcaaagacattagttttcccccttatttccaaatggagtgtgccatctcattgtaattctagaattgcttaacctgtactctgtgttt

SEQ ID NO: 22056 - DNA, 670 bp, Sorghum bicolor
  Clone ID: 13394371
ttgataactgtgttcagtctgcaccaattgacacaaggagagctctgtacaagaatatagtattatctggtggatctactatgtttaaagacttccacaagagactccaaaatgatataaagaagatagtggatgagcgtgttgccgcgactaatgcccgtcatcgtgtggaagtgagacctattgaagtcaacgtggttgcccatccaatacagagttatgcagtttggttcggggggtcagtagctgcgtctaaccctgaattctttgagttttgccacacaaaggaggaatacgaggaacatggagccagcatctgcagaacaagcccagttttcaaaggaatgtactgaaattttcctcacaacccatcctctgttaggagctcatttaggtttcttttcgatagaatatagccaattttgattcttttttggtccgttccaaccattatcgggccaccctgactagatttgtagctctgtttgtaccagttgtttgttctgtgttctgcgtcgcatgttgtgtatagccaacagcttggttcctgttcgaggtgcttgattgtagccacaaccttggacagtttagaggaaaaatattggttattcttttacattagcttgttcagacagatttacggaactcttattaataagaagtcaggcta

SEQ ID NO: 22057 - DNA, 647 bp, Sorghum bicolor
  Clone ID: 13394393
cagaaagcaagaaaggagagaagaaaaataccgatgcagaggcacatgaagccggtgataataataagaagagcaaggactctaagcaactgaagatgttcaaggttgcacttgcagactttgtgaaggaagcgctgaagccaacgtggaaagatggccagatgagcagggaggttcataaaaccatcgtgaagaaggttgtcgacaaagttacaagcactgtggaaaatacccctccgaccaaagagaagattgacatctacatgacctactccaaggagaaactaaataagcttgtgcaggcatatgttggcaagtatgccaaggcgtaacgctgtttcgccaataacattctgatgtgcattttgtgcccgaggtctggaaggatttgaagcaccgcctgcatccgtgcccagaggtttaggatttgtgaagtaggagcggggtgggcgctcctgggcgaaagccgtcagtcttctgctgcagtttcagagtttagcgtgttgtttggtagacaggttgtgggcaatgatgccgttccaacatctgactgtaacttttgtagaattgttttattcggggattgaacattgtctagcgaaatcatgcattgtgtggaccaattttttttttatgaataaatagga

SEQ ID NO: 22058 - DNA, 502 bp, Sorghum bicolor
  unsure (1)..(502): unsure at all n locations
  Clone ID: 13394416
ctcattatggcctccgtctgacgcattccttttttcgccctgagcaagtacacgatttgtcaacagctgacccctttccatgatcgggctgattccttcttatgaccataataacctctgtcctgacttggaggtaattctatgcttttcatatctgagacttgagtcagcagcagggaagtaatggaacaaaatatacatttgcacatcccggcaaaccaactcttggtctactggttgtcctacgtgtttcattatacatattgatactggtctgaagtttatctgtggtatatatggcttctgtatatccctaatcacaacattttgctccattttatagactgaattctatacttgggctataaggccgtgtttagttggtgaacgaaaaaatttcgcgacattgtagtactttcgtttgtttgtggtaattattgtccaattatggactaactaggctcaaaagattcatctcgtaaatttcganccaaactattca

SEQ ID NO: 22059 - DNA, 324 bp, Sorghum bicolor
  Clone ID: 13394423
tggtggcggggacccccgaggcggagatcgtgcggcagaagcaggcggccgtcacgctcgccaagaccgtggagcggctgtgcggggagatgtacaagtgcatccaggacgagctgctcacgctgctcgtcgagcccatgaccatcgcggcctacaggccggacggccccgaccgagccagggagctcgcggcctgattttttttttatttttactacttgcggcccagtgtggcagcagatgcatatacagcgtgcgtgccgtgaaatgcttgttttttacggtgttaacataggaggattgaagtgtactgatgttaattaa

SEQ ID NO: 22060 - DNA, 232 bp, Sorghum bicolor
  Clone ID: 13394437
gaacgagtgcccatagtgttgttagaataatcttggttgtgtgttttcatgacttcatcatcctaatgttctgttgtagcagattccggaatggaacaatatgcttgttttactggttgaggaatcctaacagttttggattatagggaaatctttcacgtgtatcaaacactgagagagaaaggaagttaaaacttcagaacttgaatgcaatgctatagccatccaaaat

SEQ ID NO: 22061 - DNA, 526 bp, Sorghum bicolor
  unsure (1)..(526): unsure at all n locations
  Clone ID: 13468681
gcacgaggggcggtcgtgggaggctcgaggagctgtgccacgaggagctaggcctgccaatcctcgtccaagttgtcactacggcctcgcaagtggggcacaaggaagagtggttagagtggcttctgttcaaagtctgtgttgaggagcagaagttcgagagcttgttctatgccttatgctccactaatgatgtcgagcacacagacagtggcgagtataatgccaagcatgtttttcttctgggtacactgtcaaggtgtttgaacagccaccccaaagaagttactgtctcggacggttttgcacatgatgttttcaatctacacaagcatgctgccgaaactgtgaattttactcaccgaggtacgtcccctcttccaactgggagccctgcaatcgatgtccttggatatacactgcagctcctgagggacatttgtgcctgggaatccacctcatcagatactcaacgtcctgttgactcgctattgcagactggctntgtacagcgccttctgagata

SEQ ID NO: 22062 - DNA, 130 bp, Sorghum bicolor
  Clone ID: 13468683
gacatcatggagtgctttgggtgccatcttgatgggacgggcgccatcttgctgcaggtgacttatgcaccaggaatatacactggccttgctggggcaacagttaaatcgagggttacagatgaccgct

SEQ ID NO: 22063 - DNA, 267 bp, Sorghum bicolor
  Clone ID: 13468686
gcacgaggctacggttctgctcctcgccggcgatgacgcccgcggagacctcgccgccggcgccatatccccgtgcttctcactctgtctcagccccgctcctcctacaagaccccacaacccaggccacgccgccttggagggagcagctcaccctccgtggcatcgccgtggcggcggcgctgggcgcgctgctctgcgtggtaatccaccgcctcaacctcaccgtcggggtcataccggctctgaacgtcgcctcgggcctcc

SEQ ID NO: 22064 - DNA, 397 bp, Sorghum bicolor
  Clone ID: 13468687
ggagacacttttgacaagctcttgaaggtgtagcattagtattttagataactgtgtaggaattcatatttaacaactgaacacacaatgttataagtttaaagaataccactgtatgcaccattcaatcaaaatctttagcagggtctggtctgacctataggtatagtcatgttaaaggccattcttgtttgtctaaacttttttttttgcaggcctgaggcactaggtcttgttgtggggattgtctacttggtcattgctattatatttcagcagtttcactatgccccagactccattgtatgccgtgactagcagtatttttttgacatttacagactgtcttatgtcctgaaacatatttcacagtggtttttggtgtcttcttgttgca

SEQ ID NO: 22065 - DNA, 340 bp, Sorghum bicolor
  Clone ID: 13468691
gctcgcagaaaaaaaaaacagcaagataggctttttatttttatttttaagctgcatctcgcgcctgcagttgctgcagaagaagatgtggagctccagcattctgtggccgctgatcttgggggaaagatatgctgtgaccctctgacgtgacggtgagtcggtgacgctagctgctcttggcctcttgctctgcaggctgcagagacgcgaggccggccgatcgatacgcggacaacccagaggccaccgtccgtcgttacccgccgaagcaacggctcgaacctaatccgctctcgctcacggctcaccgcccgccgagcgccacgccggcgcggta

SEQ ID NO: 22066 - DNA, 366 bp, Sorghum bicolor
  Clone ID: 13468698
gcacgaggcccctctgctcacaagctggaccgccagcaccaggactgcaacatgcagattgtttgcatgaccgagccctccaacatcttccacgttctccgtcgccagatgcaccgccagttccgcaagccccttgtcatcttcttctccaagtcgctcctgcgtcaccccattgcccgctcggacattgaggccttcactggtgactcacacttcaagtggatcatccccgaccccgcccacaagaccgaggctattgaggctcccgagaagatcgatcgtgtgattatgtgttccggccaagtgtacgctgctcttgtgaagcaccgtgaggccaacggcatccgcaacaccgccatcacccgt

SEQ ID NO: 22067 - DNA, 486 bp, Sorghum bicolor
  Clone ID: 13468702
cgtcattgacggaccattcgcagagcttccaacgactaaaagagcttgtcgatggctggcatgcctccattgtgcccagcggtcgcttgatcactgcggtcgacttcgacgagctgtcgccaccatatcatatggatatgcaaacgccaagtccgagcacagggatcatgctgctgtataagaattgcttgctccttttatccaaagccccagacagccggatgactgcacgtggactgttggctgatcttgaccacgccgcatcgacaacgacagatgctccgggaacattcagcaccaccgagattagggtcgcacgggtattcgacattcacagcgttcgttgtatgcaatcaacatgtgggcgcatcttgtttctcgcgccggcctccgccaaatctggagtcgcaaatgacaatgctacggatcttctcgcactagagttgtctggtatgtatgaagcacgagccaatcgactgattgaag

SEQ ID NO: 22068 - DNA, 335 bp, Sorghum bicolor
  unsure (1)..(335): unsure at all n locations
  Clone ID: 13468709
gcacgaggcatgctcatatagcacatagtattaccgaatgtggttcaaatgaaaatgtgtgtagtctttgctaaacagttcttttatgcgacctatgctaatacttaggaaatgtgacatctatgatctatccaaattttgacggcagcacacctgaaattctggagaggaaagcttaagtgacagataaacggctttcttgtattttttagaaactatattgtacagagattatcaacgcacaaatgaatatcatattttaagtgccagtgccatctcttaacaagaacatttggtncnnnaaaaaaaaaaaaaaaaaaaaaaaaaaaaaaaaa

SEQ ID NO: 22069 - DNA, 589 bp, Sorghum bicolor
  Clone ID: 13468723
gcacgagggaaggtaaaaaaggtatctgagatgaatttggaccgttcagctgctcctgcaaatggtagtcctggtggtgtgggctatctgagcccatctctctcaaatggcaatgctctaaaacctggcgggtttcctttgcttcgcctgcctgtggtagttgtacttaactcagtttcatttatgcaccttgtgataacatattctaattatttagaactattaagctaattcatggaatttgtgcagctgaaaaatctattttaattgattctatcatctttcctgtctttgttacattgacccagtctaaactgtaaacaggttacaagccaagaaacaagtcttgccgcgagctgccgaagagtatatgctcatgcacatgactaccatataaattctatatcaaataacagtgatggtgagacatttatatcagctgatgatttgcggataaatctctggaatttggaaatcagcaatcaaagtttcaatattattgatgttaagcctacaaacatggaagatctcactgaggtgataacatctgctgaattcccaccctactcattgcatacattagcgtata

SEQ ID NO: 22070 - DNA, 505 bp, Sorghum bicolor
  Clone ID: 13468730
gcacgaggcctacatgtctcaggcttcaacagtatcattggcaccttcggtggtttgcaaagaacagaacaacaatggaaataagatgctgaacacatctagtttggaaacggatacttctggtcctttttccgagccaataaaatctggaaatgtttcactacaaaaggagacacaaatgaggaatgaggtattgtgtacgctaaacaacagtgtcagtcctgaaggccacaaaggctcactaaactttccagttccttctggtcagtcattttcttccaattttgcaacaaggtccttaagtacttcaggtgaatctatgaaaactgcatatggcttggcagtatttgaagggagtagagaatcttctcggtctggaaactgtatatcttcagttggtgtgcatcataacataccaccaataatggttgatcaaggaaacaacatgaatcctagtatggagagctcaaataattcacataggttgatggcatctaacactaat

SEQ ID NO: 22071 - DNA, 383 bp, Sorghum bicolor
  Clone ID: 13468737
gcacgaggcacatcgttatggagctctgcgcgggcggggagctattcgaccgtatcatacagcgtgggcattacagcgagcgcaaggcggcggacctcacgcgcattatcgttggggtcgtggaggcgtgccactcgctcggtgttatgcacagggatctcaagcccgagaacttcttgctcgcgaataaggatgacgatatgtcgctcaaggccatcgacttcggcctctccgtgttcttcaagcctggtcaaatatttaccgatgttgtgggaagcccttactatgtagctccagaagtgctgcgcaaacgatatggaccagaagctgatgtgtggacagctggagtgattctttacatactgctaagtggtgtaccggca

SEQ ID NO: 22072 - DNA, 465 bp, Sorghum bicolor
  Clone ID: 13468753
gcacgaggctactgcaccctgcgcactggacaggaggttaaggaagtgcctttcgccaaccatgttgcctgtaccattgaaatggtgtccactgaggagctctatgaagtcgccgtggttgatgagatacagatgatggctgaccctgtcaggggctttgcatggacgcgcgctgtgcttgggctcaaggcggatgagatacacctctgcggtgaccctagcgtgctcaagcttgtccggaagatttgtgcagatactggggatgatttggtggtgcaccaatatgagcgattcaagcctcttgttgttgaggcaaagacgcttcttggggacctcaagaatatccgctctggtgactgcgttgttgctttctcacgcaaggagatattcgaggtgaagctggcaattgagaagtttacaaagcacaagtgttgtgttatttatggagctctgccaccatagaca

SEQ ID NO: 22073 - DNA, 532 bp, Sorghum bicolor
  Clone ID: 13468755
gcacgaggaaaggtttcgccatccataccacccagctcccaactataaccacatatccagcagcccgaccgatgataatcatcatgaaccccagcgaaataagataaacagcggcctgcactatatcttgctcgagcatcttcacgacgctttgcaagatcacctgtgggtattcgttgccaaagagctcgctggaaaagcgttggatatatgcgatggagaggattaggatgtcgaagagaagggctagtgtcaaggggtatgctgcgtcttcgttgtcacagttctcaacagcatcttgcgctgtttgtttgaactccccatcgggtttggcgtccacaattctcgtgctcgggcctttgtcgttttcttctggaataatcgatgagactggagacacgctcctacgagacggctcagaattgaccagagacgggccggaaatacttctcttttccccgctgcttcctttgctcattggaaccggcatcgacgactggcgtttattcgtgctcgtgctttgctctgtgga

SEQ ID NO: 22074 - DNA, 559 bp, Sorghum bicolor
  unsure (1)..(559): unsure at all n locations
  Clone ID: 13468765
gcacgaggctgaagcaacattctgcacccacaagtggtgtttgtatttcaccatccagtgataaggttttgtggttgtaaatgcagctggcatttcatgtctgaatgaataatgtctttcccacacttgaggcttttattttgtttttgcagacaattgctacagttggccttgacaagaagttatacatattagattcggggtcaagacggccaacacaaactattcctcatgaggctccattctcctcattggcatataatgatgatggtactatattagcagcgggcacaaatagtggacgtgtggtgttttatgatgtccgaggaaaaccaaaaccattgaccatccttcgtgcatataatacctctgaggccgtgacaggtttatgctggcaacggtcgaagcctgtcgttgttaatgagaacagttcttctgaagttgctcttcttgggggaactagtgaagaatctgttcttatgccagatcccttgccttcagcaacacctacnagtcttggttctggagtggccagtacaagtcttcgctcttctttgac

SEQ ID NO: 22075 - DNA, 495 bp, Sorghum bicolor
  Clone ID: 13468782
gcacgaggcaagactttttgcgccgccaggtgggacaggcgcggtgtcccatgcccttgctcccccgcacccggccacgcctcgcgcaactccgcctgcctttcacggttccgcctcgcctccccgcatgacccgtgcaaagatctcggagattcgttcgccgcccggtgcccccgacttcgcgacgccctcgacagccatcgccaccgtcagggccgccagcaccgccgccttctgctcaatgtcggcgcaatcgccgtaccagagagcctcctcacgatctgaacctggccattgtctagggggcaggggctttcttgcagttcctttttgataacctgtttgtttcttccttgaattgtaggcatgtcaagatgacgattttgcactacaattcataaggtacctcctcatagtccttcaacagacttagttttgatgtttgactgaattttgatgcttggtgtggcattgtgttggacatgctgcatctag

SEQ ID NO: 22076 - DNA, 488 bp, Sorghum bicolor
  unsure (1)..(488): unsure at all n locations
  Clone ID: 13468783
gcacgaggccgcaacgcaaaccagcatcgccgaacgggtcgcgcccgcccgagcccgataagcccgcgaagcccaggcccacccgcgaagcgatgcgacggaggagatcgtgagatcgcgcgccgccgccgccccgctgccgccggcgatgacctccgccgtcctcgccggccggaatgaggtccaccacgcgcacccgcaccaccaccgccactggggcggcgcccgcgtccccctcatgcccaagccgtcctccaaccctaaccctaggcgccaccaccgcccgggcccaaaccctatccccacaggctcgccgccgccgcgggccgtcccggcggtcgcggccgagcccctgccgtcgtcatcggggcacgtgaagttcaggccgtcgganatgacccccgccgaggccagccttctccgcgcgcggctcaccggcgagctcggccgcgtccgcgctttcctctcccgcatcgactcgtggcagg

SEQ ID NO: 22077 - DNA, 152 bp, Sorghum bicolor
  Clone ID: 13468787
gcacgagggacaattaccgattatcacaaacaactctgcagcatctgatgtaactgggccacctaataatccacgcttctgccaaaatgtagcttgcagggctattctcacggacaaattttgcagacgctgatcatgctgcatttgtttca

SEQ ID NO: 22078 - DNA, 499 bp, Sorghum bicolor
  Clone ID: 13468791
gcacgaggcttcggcacgagcacttagcgcgcaccccctcaaaccctaaccccctctgctcccagccgccaacgccatgggctccactgccgccgcctccgtgctcccggtgtccgccggcaccggccagaacctcgtcctcatcctcgactacggctcgcagtacacccacctcatcacccgccgcgtgcgccagctcggcgtcctctccctatgcgtgtccggcacggcgccgctcgcctccctcgagggcctgcgcccgcgcgccgtcatcctctccggcgggccccactccgtccacgccccgggcgcgcctgcctttcccgaggggttcctggacttcgcggccgccgcgggcgcgcacgtgctcggcgtctgctacgggatgcagctcctcgtgcagtccctcggcggcgccgtcgtgcccggggagcgccaggagtacggcaagatggacgttcaggtgacggcggcctcctccgcgctctacggggaagcg

SEQ ID NO: 22079 - DNA, 405 bp, Sorghum bicolor
  Clone ID: 13468822
gtatttctgacccgacacgagagaggtcgataaagttgagtgaagatgagattctttcccgggtggcccagctcgtgtcaactgatactgaaatttgcactgatggcaagccactcccgtgtcatcacaaacgacctccggaaaatgacctgagcaagtatctttccgcgactctggaggaagacgaagagggagtagacatgccacaggcagcagacgctgtcaccatagtcagccagccccctctgaagaaaccgaggacccttggtgccggctcctctggggagtcggttcaacagaagggcattgaagttgtggcccacttctgcagtgagctggcacaacagagagagtccggcaacagtgtgccaattgcccagccgctgtctgatgatgaggacacgg

SEQ ID NO: 22080 - DNA, 133 bp, Sorghum bicolor
  Clone ID: 13468826
cacaacaaaactagttggggagcacgattcccgggtgcataagatggctattgaaccaggaagcccttacatattttacagttgtggagaggatggcttggtacagcattttgacttaagaagcgtttcagca

SEQ ID NO: 22081 - DNA, 572 bp, Sorghum bicolor
  Clone ID: 13468830
gcacgagggcctcctcctctgcttccttgctctcaccctgcttcccgttcgcgcgcgcgcagacacgagcttgttgtccgccactcccgcctcgtacgtgcgctatcccccaccgcctcagcccgctgtccccctgctcatctcatctcatctcatcgccgcgatttataccaccaccaggaaccagccagccagccaccactccctcctcctcagcattccgcttctctactctagtctagtccccaacaacaacaccggcgggggctagctcgttaggcgtgcgtgggagctactctactctactgctagccgccgcctagctagctaggcctatccggccagtagtacatgtgaggtcggtccatgggggaggaggtagcggcggcggcggcggtggtgctggagccgccacggcccaagtcgccgccgaggtacccggacctgtgcggccgccggcggctgcagctggagctccagatcctcaaccgcgagatcgacttcctcaaggacgagctacaatcactagaaggagttccaccagtttctagaagttgtaaagaggtaaatga

SEQ ID NO: 22082 - DNA, 664 bp, Sorghum bicolor
  Clone ID: 13468845
gttgctactgcagcaatgtgtcatcgatgaagataatccatacttgagggagtggggtctgctggctgttaagaacttgcttgaagaaaatgaagaaaatcagaaggaggtttctgaacttgagatgcaagaacctgttataactccagagattgctaacataggtctcaaggtggagatagacaaggaaacaggtcgtccaaaactggtcaatacttctgatacctgaactctgactacaggcactgtcagaatcaaggttatgttgatgctgtagaatacatgtgctaccttttggttgaaaaagtctgcaatttactccgatgatgaaaaggtctcatgtatgtactgtggttatgattgagaaaacagagttttgctacaagagtgatttggattttgagagaagtgattcatggtaagcaaagcagttgtgtagatgtatgtggttggtggtctcggaagtgaactttgtatgcggaaaacgtggacatgggctaagcatgtggcccttcctgtgtggaaattttagttttatgacgtcgatagattacactttccaaaaggtgagcttgatagaagtagatacgccgactttctgaaattcttatttggttctgtgttaaacctggaatttggtatcctgtacgatgctagttctaag

SEQ ID NO: 22083 - DNA, 538 bp, Sorghum bicolor
  Clone ID: 13468850
ttcagcgagacgttattgctcttctttttacctcaagttctaaatttcttgtgttcagtcccacagctctttcactttgttccttgcccaagacataggttgccgaggtttgatcctgaaactggtcttttgactggtacgaaagatgggaatctggttaatatattccttaggttatttggaaagtgttcagagaaggtcctttgcataaggctccttatttttcaggctctatgctgcgtattctgcttctggctaaggtacatgcttaccggatggtacaagtgatctcctgggaacggctttccagctcgttggaaaaagccagttgcatctgatggctgttattttcctcgacatacttgtagactaaccacccaaaatttccagtagtattcacgcagtaggttttggattcgttttctgtacttgtgctaactaacagtttccaaatttttgtaactatatgtaaaatttggcttcaaggaagtttgctgcacacctgaactcgctactatgtatacttaccaagagcctg

SEQ ID NO: 22084 - DNA, 399 bp, Sorghum bicolor
  Clone ID: 13468854
caccgcccgtcccggttcaagctagaggccatggcggcggccgcggcacccgcaccggctccggacgcccgccgggcccgccagagctagtgggacttcgcgcagtcgctgtgggacccgtacgagcttgtcgccgtgtcgcggaggctcgagtccggcgtcgtcatcgccgaccacgccgccgcagcctccgccgcgccgcaggatgggggcgacgcgcggggagcggcggagaagcggcgcagggagagcggccgcagcctgaggaacctgttccttcgctccacctcaaagaggttcgggttcgacgaaccaagcagctagctttgctctccgtcagtctaaatggataaatttctagccgcaattgtaatttttcattcacacgcgcagcaatca

SEQ ID NO: 22085 - DNA, 501 bp, Sorghum bicolor
  Clone ID: 13468861
cggtgcctggtcgtacgtccagccccgtattgagaccatgctcaactccactgagcaccacaaccgccgccacgtcctttacgccggtcgtgcccctagcgcctctgtggccaccggtctcaaggctgttcacttgaaggaggagcaggagttcctggaggatgccttctccatccaccaggaccgcctgaagggcgagtaaatgtgactgtcattttcactggatcgggggaatcacccgcattcaaatattttgattgggttgctttcctatgttcattgggttttgccggaagctagcgtccgatttcatctctttgtcttctttttttttttttcacactcgccattactctgtgtaccgtgtacgactttgtgtttattactactgcatgatttcatttgtctgccttgacctagtgtatacgacctgtcggtgccgtcgcgctgaagttggtttcgcttataccatagacaagtacgtcttttgtaaaatacaca

SEQ ID NO: 22086 - DNA, 584 bp, Sorghum bicolor
  Clone ID: 13468865
tgaaggcgagtgattgaacgataccacgccaatgtcgacgtcgattttgatttccaggctattgaacgagtgtctggtgctggccacgcaggcccatgtttgattccgtccgatgatcgtgaaatggacacgagatcatgtttattgatggcctttcctttttctttcttaatggtatcaatgcagccgtggatatgactagagagtatataaggccgactctcttgggaacgacatatttctgattctggttctgtctttttctacctgtttggtttttactcatgtctattttcttttcttttttgtcatttgcatctctcgtttggcaaacatatgcatattatgcatgcactcttgcactctctggagtctattggcagaattttcttttctttgcatttttgcagttgggagcaagtcaagttatcttctagccttgtctatccttggactttcatttcttcattttacttttcttttcaccttttctattgcattccttttcgtctgtcttgtagaataggagaggatttttatattttagcgttcattactttcatatctaagaccaaaccaatcaa

SEQ ID NO: 22087 - DNA, 487 bp, Sorghum bicolor
  Clone ID: 13468872
accttgtcactagggcgtagtgccacagttttatcggctttcttggatggcagcctgaaatcggagctcctgccatatggccatgttctgtatcagaactgtcagtgatgcatgcattgcagtgctttagctgcaatttgaacaggtctgaacctgacctcgtgctgaacaatgtcaaaatttatggagtgatgttgtacattgagagcggcaactgggcaaagtctgcatattgtttccattgattctactcgtgtacatccacaagctgcgcgatgggaggttgaaactggggcccggatgtgtaatggaaaatcggtgcttgggagctcagcgacactccaactaagatgttgcaactaacgcatttaaacatccatttggacaggttttagtttatactgtatctcgcaactgccacgtgttgttgacacataacttaagtgttgatggccatcgggattcgggacgcagctgttagcgacac

SEQ ID NO: 22088 - DNA, 675 bp, Sorghum bicolor
  Clone ID: 13468888
aagcactggaatagatgccaatggaaattcctatgatctgagcacaaagttgctccatttggcttggcacccatctgaaaacctaattgcgtgtgctgcagccaatagcttgtacatgtactatgcataaacaagcgaaatgaacagagcgacagtttttttggtggttgctcccggtgagaaagacacgtttagcccctggtggattgaagccaggagttgctggagatggtgtatcttgtgccagttggatgcagttcttttcggtgtcatatagagctgtccagagtccaagaggaaatgactcgatcattcccgggaagcagctttgattctgattaatttttttgcggggacatgcttgtctttcccccataggttcatttagatttaaagataaggtcctagtttgacaacatttgggcatctgtagtagatgttaaggggatgacgatgatccaccgttgtattcgtgttgggcatgggtttgtaacttcagagggtggctgttgaagctttcgataattttatcttacatacaggtctacctttttttttcctcttatgtggggaaccttattttcgaggaacgctgggacctatgtttaatgcgaaccctagaataggtaatatactctgtcattctattgtatgtacattttaaaatagctggaa

SEQ ID NO: 22089 - DNA, 504 bp, Sorghum bicolor
  Clone ID: 13585048
gaatgtgtcaggcaactgcggctggcaagggaagaacaagaggacaaaatccgtgaaatagtttcgaaatctctggtgccacagtctgaaaaccctgagctccaaaaccatatcgcagagctaaaaaaacgcctggaagtgaccagattagaagcgtcatcttccatgctattacagcatgatctacaggaaaggcttcaggcagttgagagagaaaacttggaccttaaagccaagcttcaggcaactgagaaagagaatacagatctcaaggccaaacttcttgtacagtccaaggatctgaagatactaatgttggaaagggatctgagcaaccaagcagcggagacagcaagtaaacaacacttggaaagtgttaaaaagattgccagggttgaggcagaatgccgtaggctacagcatctaacgcggaaaacaacacttatcaataattctaggtctacacaaaacaattgctgcatggaatcactgactgacagccag

SEQ ID NO: 22090 - DNA, 558 bp, Sorghum bicolor
  unsure (1)..(558): unsure at all n locations
  Clone ID: 13585056
gcacgaggccagattcatacctcacagccatcctcacccaaccccaaatcagcaaacagatgtcgtcagccagcgggtgaggagtgtgaggacgaaggggatttggagctatacgagcagctgcgtgttgaggccttccaccggacctggtccaagatccaatccaccattgacgaggtcctcagggccatcaacctcaagctgtttgaccaggttctgcagtgggcaaaggagtccttcacctcagtccgtgccatcacggaaccgcaccgcactgaagtccagcagccgtaccctctcctgactgatgtgatctgcagaaggattcccacagcattcgtcctcaccaagaatgcggagtttgttgatgatatcacaacgtttcatgatcttgcagggcatatgaagtccaatggatgtcatgtagtcaagctgtcagcagctgaattatcagcaaaacatggagttggtggttgctttangagcctgttgaggcagctactatccgatgttccagttgttgctgatgtatctgcgcttgcatcatggtattgtgaa

SEQ ID NO: 22091 - DNA, 541 bp, Sorghum bicolor
  Clone ID: 13585057
gcacgagggtcacatggatggatagtgcaagttctttgaacctcaaatttatgcaagagctggagagcagcccagagtttgcttgcctgcagccactctttggttggctgcactcctactttcgaacttgcccagatttcctcaagccatgtatcttctatctgtcaatttttcctcgaggtcacaggatccggagaaggcgattggtgagacggtggattgcagagggctatgccagggacacggacaaaatttctgcggatgagagaggggagcacttcttctgcaggctcctcgatctgagcataataatgcagaaaacatattcagtcaccaccacattcggtggcagaagaatgactttgtgccaagtcaatagttttgtccgggagtatatcatctcacgtcaaatggaagagaaccttgtatttgaactgggaggcagttgcaccctaacctctcagcgcacggggcgtcacctcatcatactgaaaagctgggacagagacagaattgtgtttgagagcattgacttctcacg

SEQ ID NO: 22092 - DNA, 435 bp, Sorghum bicolor
  Clone ID: 13585061
gcgaacagccctgttcacactgcctcaccatatgattccccacacctgccaatgccaaatgggagcattagcacaaactttgttagaaatacaggtgatgttagtcccaggataccaggtctacctggatatgatcggatgccaaacccatggactcctcccaatggcaacataccatatagagttgttggacatgatgttccttctgccatggaaaacactagtgcttttgcacctaggtctaatccaactgctgctcagtatgttcagccttttattgctcctgaatcaatccagcatcaacctggaggtccattgattcatcctgaaagagcataccctgaacccatgccggcatcatatgctgatagcaaagtagctgtttctgcattgcccctcactgatcaattatccaggttggatgcaaacacaatg

SEQ ID NO: 22093 - DNA, 375 bp, Sorghum bicolor
  Clone ID: 13585062
gcacgaggctccctttcattcccataccaattatcataatggccgacactgaggtcttcgacggtgccgtcggtatcgatctgggtaccacctactcttgcgttgccaactacgagggcaccaatgtcgagatcatcgccaacgaccagggtagctacaccaccccctccttcgtctctttcaccgacaaggagcgtctcatcggtgatgccgccaagaaccaggctgctatgaaccctgccaacaccatcttcgatatcaagcgtctgattggtcgccgctacgatgaccccatcgtcaagaaggatgttgagtcctggcccttcaaggtcatcgaccagggtggcaaccccgttgtccaggtcgagtacctca

SEQ ID NO: 22094 - DNA, 373 bp, Sorghum bicolor
  Clone ID: 13585065
gcacgaggcgcgctcgccgcgcacgccgaggagcagcgccacctcctcaagacgtaccagatcacggcgcggaagctggagtcggacctccgcgccagggacgccgaggccgaccgcgccaggagctccctcaccgccgagctccgcgccgagcgcgccctggaggcgcgtctccaccccggccggacccttgcgtcgctcgacgagctccacctctccggcctcaacccgacccacttcctcaccgcgctgcggcacacggtgaagtcgatccgctccttcgccaggtccatgctcaactcgatgcagtccgccggatgggatctgggcgcggccgccgccgcggtccacccgggcgtcccgctgcaccgcg

SEQ ID NO: 22095 - DNA, 474 bp, Sorghum bicolor
  Clone ID: 13585068
gcacgaggcccggcggccggcctcctccgcggggcccgccaccaccaagcgcgggggcctcctgctcggccgctacgagctgggccgcctgctcggccacggcaccttcgccaaggtctaccacgcccgccacgccgacaccggcgagaccgtcgccatcaaggtgctcgacaaggagaaggccctccgcaacggcctcgtcccgcacatcaagcgcgagatcgccatcctccgccgcgtgcgccacccaaacatcgtccgcctcttcgaggtcatggccaccaagtccaagatctacttcgtcatggagttcgtccgcggcggggagctcttcgcgcgcgtcgccaagggccgcctcaaggaggacaccgcgcggaggtacttccagcagctcatctccgccgtcggcttctgccacgcccggggcgtcttccaccgggacctcaagcccgagaacctcctcgtcgaccagcg

SEQ ID NO: 22096 - DNA, 492 bp, Sorghum bicolor
  Clone ID: 13585077
gcacgaggctcaatcgctccctgagttagagctgtcgtcaagaagagaaataactcagaaaaaaacaagggagcccctcgatcctctcggtgactgtctcgaataagctccggtgctgctccatgctttgaacctctccaactcatgacaagaaagccccctgcagtctgcagctgattgcaggggacgtctgctgcctacagctctcggtcggatgccatagatgagctgcggaagggtccccatggagtgcggccacgactgcgttgttccacggcctcaggaacaccaggcgccgctcaaatgcgagagcccgacgctttcttctgaagaattccttcagttcaagaggaaggccaccacgatcgtggaggagtacttctccacggacgacgtcgcggcgacggcgaacgagctgcgggagctccgcgtgccgtgctaccactactacttcgtcaagaagctggtgtccgtggcgatggaccgccacga

SEQ ID NO: 22097 - DNA, 429 bp, Sorghum bicolor
  Clone ID: 13585092
gcacgaggctcaaattctgggttcaaactcctcttgggagtgaatttcaggctgtggttaaaaaattcccttcgtgtgtctgacgccaatgcctcacagggctacgttgtcgctgtgtacgggtggggcaggggtacgaggtttttcttgacctgcgtgagaaggtcttccttttagcaaaatgacgggggccatcttactctctgcgggtcaagtttttttattagtgttatttgcatttgctgcctctgtagggaatttcccttcatttattttgggctttttaaagatatctatctgcgttacaagatttgcaccttggagcatgtatattaaccaaatatggatagggatttcatatgttatctttccacatggtgccattttggtatggtcattgatagagattttctgctatctgttccaagc

SEQ ID NO: 22098 - DNA, 372 bp, Sorghum bicolor
  Clone ID: 13585100
gcacgaggcctccatccccgctcccctccccacactgctccggcctcccctccagaagtccaaaaccctagcaaccagctgtaagcttccagaatcccaggggcgggaacaaggcggcgagatgattctccggactccaccacagaggaagcgccgcgctggctctagcgctggcgacgacgccgaccttgctcttgtcaaatccgtgggcggcgcgagcgcgaccggccgtagtccggtctccgatcgccgcctggttctctacgaccgccccaccgccctcgtgcctgccgacgcccccggggagccgttcgacgacatggtctgcacgtaccactgccgccagatggtgaaatcggagttcatggtggc

SEQ ID NO: 22099 - DNA, 155 bp, Sorghum bicolor
  Clone ID: 13585103
attgtctttaaccttgacactcggcaagttaaatgggctgcagagcttgatttgagcacagatactgtacatttccgtgctcatgtattttcctctccaactgtggttgatttggatggtgatggatatttggacatacttattggaaccgcctg

SEQ ID NO: 22100 - DNA, 410 bp, Sorghum bicolor
  Clone ID: 13585106
gagaattgggttactcaatgatccgcgcaggttaaatgttgcgttaactcatgcacgttatgggatagttattcttggtaatccaaaagtactaagcaagcagccactttggaatagcttgttgacacattacaaggagcatgagtgcttggtagaagggcctttgaacaacttaaagcagagtatggtgcaatttcagaagccaaaaagatatataatgaccggagattgttcctgggcggtggtcaaggtgtcatgcatggggctggggcgtcaagccaagcagcagataagagaagcggcagggggaaaggacaatcatttgttccttatggccctccaaatggggtgcataagcctggcgtgcacccagcaggctatgctgtacctcgtatgccttttcctccatt

SEQ ID NO: 22101 - DNA, 414 bp, Sorghum bicolor
  Clone ID: 13585111
gcacgaggcgggactcgaatccaaatcgaaagattattcgcggggagcacgcgctggtttggagttggatagcctcacgaagatgagaaaactcaagatccgatccaaacagcgaggggggcgaggagcaggacagaagagagaccggtggagagagaaccgacaggaagagacgcttagtctgatttctcgtccctttctccttgcatctcctgcgagatagagagaagcatcgtccgccatggggctgctggatctgatgcgcctcatgcccacgaattgccagcgggaccagcagcgccgccgccggcaagccaaggcccaagcccgtgatggatccatcgcttcacggcttaaaagagagggctcaccctgccaactagatgactattctcagggtgctgacctagagat

SEQ ID NO: 22102 - DNA, 560 bp, Sorghum bicolor
  Clone ID: 13585114
gcacgaggcacgttttccttgcatgatttgcgtctccggttccctggttaccactttttaaaacgctgcatgtgctcgttctttgcatgttgtttaccttgtccgtgttgcgcgcgctgtgactccccagccatcacagccctgttttgatatcaactactcccttttcgtcgcagttacgactgctgggtgcttgttgtcgctgctacctggaagatacgaaaagaacgcgaagcgtacaaactattgctgctgctgctgcttcccgtcgtcgtcggggactgcatttgttttgataccgcaaggatacgtagagcgtcaacacgccatttattcacctccacaccttaacccacatctaacacccttactccttgccccttctgggtctatcctggcgcaagatgaccgtcgatacaagctacttgaccacccaggtcaataatatcgtctctcaattgcacggtgtcttcgatgatattggtgtctcgagtcatgagcgggactcgcgcgaggcagagctcttcagttctctgtcggagactttaaataaccatctc

SEQ ID NO: 22103 - DNA, 480 bp, Sorghum bicolor
  Clone ID: 13585118
ggcaactccacgctatctacatgaccactagctcccatgatcctgacaagtgggcccacctcgtcagggagtacgcctcccaatccttgctccgggaagccgccctcgtctacgccaggaacgtgccccgtcggacgcaccaccagcccctcctccccatcctcctcagggccgccgctaccgcctcccctgccgagcccggactcggcaagtccctccatgcggaggcgctcaagtccgccttcgcccgcgacctgctcgtcggcaccacgatcgtgtcgatgtactgcaagtgcggcgcactcgccgacgcgcgcagggcgttcgacgaaatgccggaccggaacgtcatcagttacaacgcgcttctcgccgggtacgccgcggcgggggacatggacggtgccctggcgctgttcggtggcatgcgctcctggacgtacgtcacgtgggcgacgctgatccgtgggttcgcgaaga

SEQ ID NO: 22104 - DNA, 518 bp, Sorghum bicolor
  unsure (1)..(518): unsure at all n locations
  Clone ID: 13585119
gcacgaggctgatccttgctccaacaaattatactagtgaaggtcgagctgacatcagaagatcgaattccatggaactattcacggttaccaatgtgacacggggatctaacaggaatacagagaaattactatgagaagaattgagcacttgaagcatcactacaaaagacatgatcaatacaccattttggttcgaggaattccaacatgtccagatcatggaacttatgggtgctatgttgatcacttcttctcaaagcattatcagacataccaatcataccaaattgtacacgacataggaaacattgaggcattgcagaagttggcatcctccattcagaaacggatacagaggaaaagagagaccagaaaatgtaatcttttgggacggatttggagcaagtttacatcagaagcaacaaatattcacaaccatgaaaaaaaactgaaaaatctgcaagagactatccgcctcctacagtgtngaaatttgcttaaacaaaaggaggtac

SEQ ID NO: 22105 - DNA, 516 bp, Sorghum bicolor
  unsure (1)..(516): unsure at all n locations
  Clone ID: 13585121
gcacgaggcccaagtgctgtcgaccaatttaggaagcaatttgctcatcttgaagaaaatagtggaaacggacctgttattccaatggaaagaaaacatacttctcttcctaggtaattgttaaactgtatactctgtacttgttttgttgtattttgcatgcttgcatggtcatagtggaaaaacactgaagcataactcatgattgagttattagggttctttactttggcctatattataactggtgaataaatgttttcctaattctatataaagaaaggctgcactttgaaatacatacatctgccacacctgtcacataatgacaaggttgtttcagtatatagccctggcagcaaaggtgaaccagctacaaatgaaaacacatttatattcaggtgctgaagttaggatgacaaaatgaacatgatttgtttctcacttcatcccgctataccaaatgttaagaacagtactngaagaggagtgacagctacagtttattctaaaaat

SEQ ID NO: 22106 - DNA, 433 bp, Sorghum bicolor
  Clone ID: 13585136
gcacgaggtatcttcgagctaacaaaatgtttgttgattacaacgagactcaaacagaaagagtttactcatcgtacctagagttagatcttgcagatgttgaaccatgtgtttcaggcccgaaaagacctcatgaccgtgttgctctgaaagatatgaaagcagactggcgtgcctgtctcagaaataaagttggttttaagggctttggcatacctaaagagcaacaggataaactagtcaagttcaccttccatggacaacctgcagagattagacatggtagcattgtgatcgctgccataacaagttgcacaaacacctcgaacccaagtgtcatgcttggtgctggccttgttgcaaagaaggcgtgtgagcttggccttgaggttaatccatggattaaaactagtcttgcgccaggatccggggg

SEQ ID NO: 22107 - DNA, 507 bp, Sorghum bicolor
  Clone ID: 13585139
gcacgaggagtacccatctttgccaagcacaaaccagaacctgaaacaatctgtaagcatggttcccccaacagagcttgacaaggggttacaacctgcccaagattcggttcaggttatgaatcacggtcattctgctgctgacagcaagctcccatatggtactgattggtctccacaagacgacccaacatctgcgaaccaatcatcccttcctgagacatctggtgatccgtccttgtatgaagcatcatttcagtcatctacattggttactgatgtagttaattcacatgaaaatttgcacttggatgaagacagcacctttgcaatgagaccagtacctgcctctgagatacacttggaacctagtgatggtatttctgaatacaatgatggaatgttgaacaactcaagttcctatcagcctcaaaattactcttacacagaacaagaagtcgaggattccagtgctgatctatcagcagcagcagcagcagcaaactt

SEQ ID NO: 22108 - DNA, 546 bp, Sorghum bicolor
  Clone ID: 13585140
gcacgaggcgatcccccgagcttcgctcacaccggtcacctccgcctccgcccgcttcgcgcgcgaacgcatctccttctatcgctccagcctccagcacacatccccatgccctcgcggtcctgatccggccacagccatgcagcaccgctcgccggaggcggcgtcggcctccgcctccccgacggccgcggcggcggcggccatggcgccgggcgtcggcggggtggagccggccgtgacgctcgaccaggtcccgcgttggagcgacccggaccagcgcatctccccgctgtcccccactgccgccggatccgagactccgccctcgtccttcctctccttctccgacccgctaaccggggacgacgcggccgcgggggccgggggccgtggcgcgtcgcggttccccgtcgatcacgagatcaactcgaagatctacctctggcgaggccacccgtggagcctcgaggtcgacgccgtcgtcaactccaccaacgagaacttggacgaagctcatagcagtcctgggcttcacgctgctgc

SEQ ID NO: 22109 - DNA, 444 bp, Sorghum bicolor
  Clone ID: 13585145
gcacgaggcctaattcctaccaccaattgtggcccaccttcttttctggactccaggtcttcaagtgtgtcgtcgttgtcgactaccacattccgctcgctcccattctcaaatcgaacatttaacaatacttttaattctataattcgacctgtatccttccaacatgcactactctgctgctcttgcggctgtcgtcgccgtcgcacccattgttagcggccatggaacaggtgttcccaacattgtcggattgaacccaagggatctcaaggcccgtgacttgctttctcgtgttggagcgcgattcactggtgtcaacgagcttctcgagcctaagaacgatgtcaagacgcagattatccgccgccaggatgatcgccagtgtggtactggcattggcaactgccctgctggccagtgctgctcaagcgctgggtactg

SEQ ID NO: 22110 - DNA, 490 bp, Sorghum bicolor
  Clone ID: 13585147
gcacgagggattcttgtgcccaagacatacatctggccagtagaaaaggatcagtacttggcgccatcgcccaccagtttggtcaaagatgctcatgccatcgggctggaagtgtatgcatccggatttgccaatgatatcgtcttgagttacaactacagctatgatccctctgcagagtacttgcagttcatagacaatccagacttctctgttgacggtgtgcttacggacttcccggtcaccgcatcaggggctgttgcttgcatggctcattccaagggcaatcctctaccacctcctggaaaaagcaggccgctgatcatcacccacaacggcgcgagcggcatgttcgccggcagcacagatcttgcctaccaggaggcgatcaaagatgccgctgacatcatcgattgcacggttcagatgtcaaaagacggaacggccttctgcatgcactccgctgatatctccagctccacgaccgcgg

SEQ ID NO: 22111 - DNA, 627 bp, Sorghum bicolor
  Clone ID: 13585152
gcacgaggctttcttggaatacatggtgatgagcttggtattcatactggatggaaatctttggatgatctttacaagtatcacctgaacagacttacatggctggttgttcctggggaattgactgtagtaactggagtaccgaattctggtaagagcgagtggatagatgctttattatgcaatataaacacacaatgtgggtggaaatttgttctgtgctcgatggaaaacaaggtaaaggagcatgctaggaaactcttagagaagcgcattggaaaaccattcttttatgctaggtatggtggggatgcgcagcggatgactcctgatgattttgaagcaggaaaagaatggttaaatgaaactttccatcttatccggtgtgaagatgatagccttccatctattaattgggttcttgaccttgcaaaagctgcagttctaagacatggagtgcgtggtcttgtgattgatccttataatgaacttgaccatcagcgcccctcaaaccagacagaaacagaatacgtcagccagattcttaccaaggttaagcgctttgctcagcaccattcatgtcatgtatggtttgttgcgcatcctagacagcttcataactggaat

SEQ ID NO: 22112 - DNA, 508 bp, Sorghum bicolor
  Clone ID: 13585160
gcacgaggctagatttggtttctcattaggtgatgcagcaatcacagaggcttatgttgatccttcagagactgctttgcttggtcctgttgtcttccgtccctcgaatcactgcatgtggtcaaccatggttttgatcagaaacaacctgtcaggcgtggagatgctgcctctgcgggcatatgggggacggcaatctattgtccttctagaggaatctgaacctgcttggaagctagagtttagccttggatccaatattcagaaccaatcaacaatgaccaaacaagaggtcccaagctctttgtgcagtcaacagttaaccaaagagatacatgttaaaaacagtggtgaccttcctctccaagtgacaaaggttaaagtttcaggagctgattgtggtgtggatggatttactgtggagaactgcaagggatttagcttagctccgagtgaatcaataagaatgctcatttcttttcaagctgacttctcttcagctatggtt

SEQ ID NO: 22113 - DNA, 536 bp, Sorghum bicolor
  Clone ID: 13585165
gcacgaggccatggtcaaactcaacattctttgtccaatgtcagcgcaataactgctgcttcatctatcagagattgcccgccaatgacagtgacctacagactgcagggtttagatggtgaagctactgagcctatgattaaagagctggatgaggaaagggaggaatcacaagatcctgaaattgagtttgctatagcaggtgctgttagggaatgtggaggccttgagattattttgagcatgattcagagcctacgtgatgatgagttcagatctaatcaagaagagttggcttctgttcttaaccttctcaagtattgttgcaaaatccgtgaaaatagatgtgccctattacgtctgggtgctttaggtttgctgcttgagacagctagacgtgcattttctgcggatgcaatggaaccagctgaaggtattctactaattgtagaaagtcttactatggaagctaatgagagtgacataagcatcgcccaaagtgtttttacaactagtattgaggccactggtgctgg

SEQ ID NO: 22114 - DNA, 588 bp, Sorghum bicolor
  unsure (1)..(588): unsure at all n locations
  Clone ID: 13585172
ctcgcgcgtgcgaccatgacccgtattaggaaacaacaattccatcccgcaatcgttgcgatcctctccctgctcgcgccgccacacacgctcgcgatccccttcctgctcgctacgccacacacgcccgctcctagatggccgctcgcgcctcctcctcccgcccaacgccgctgcctgcgctcgcaggtggccatgcccaacgcccgcgcctgctcgtaggtggctcgccgcgcccgctcgtgcctcctcctccgcccaacacctctgcacgtgcagctcgcaccgcacgcgctcgttgcctgcgctcgccggtggccgggcccaatgcacgtgcccactgcgtgggatacatggaggttgccgtcggagatgccgtcgcgtgggataagtagaggtcgccatcagagaccactccgcacctgcaccgagcacctcgccaagtcagactgcccctgccttcgatcatcanactgctaccgcaggagctgcggccaacgtcaacgagcatcgccggctcgacaacaagatgaacccctacgccccgatctctcgctctatctcccttggctagatcaacgttggggc

SEQ ID NO: 22115 - DNA, 167 bp, Sorghum bicolor
  Clone ID: 13585187
gcacgaggcttcttcgccactgctgggcgcaattcatccgccgcctccatctggggtcaagaggggccgtggactccctcggaatagcgtccttgtccctgtgcgttcctccttttcacagctactgaaatctattgctccaccacctccggctggggtcaagcggg

SEQ ID NO: 22116 - DNA, 529 bp, Sorghum bicolor
  Clone ID: 13585202
ggttcctgagatgttcgcgccgagtcgccagtggttcgagggtttgactgtggcagctgcgaggaggatgatctcttatatcttgtcttaccactagccgtgatcggagcgcgcgagacagttgccgtgttcaagaaaatatcgtcctcttttgggttgttcttgctatctgctttatcggagagagacctccattccctgtacgccatgatattgtcatccatatctccaggcacacgacgaccagtcggtttcgtctttgctcttggcttccttgagattggtgatgaaatgtcgacgacttttgggcgctcagtcgttgtcgagaagaacaagatctcatctgggttcttctcccctggacccatctctttgcatcccaagaaggaaccatccggagtagtgtcggggcttttttgctttgcttttgaaggagcctcctcccatattgtactacagcgtttctttccgatttcttcgggcgaatagtaccttccaggctgtagagggccggtgctattggcgtttg

SEQ ID NO: 22117 - DNA, 215 bp, Sorghum bicolor
  Clone ID: 13585207
tattcagagcaggctccggctccccctggaaggatcaggtgctgcaagagcctgtcgccggaggcactctgcaagctgagtagatggcttgagtctgaccattagacgctgctgtagagagaggcctgtgtttctgttctgtggctgtgtaaatatttctgcgctaatgttgttcgtacgtatagtacggctgtgcttacacggccagcaatttt

SEQ ID NO: 22118 - DNA, 548 bp, Sorghum bicolor
  Clone ID: 13585209
accatatatagtcctcgagcgcattggatcggtggcttacaaattggagcttccacctcacagtgagattcaccccgtctttcatatttctcagctgaaaccctttgtccccgattacacaccagtttattcagagttgccaagtgtaaccgatcttcagacctccaatgctgtccctgagatgattctgcaacgtcgtttggtacgcaagggaaattctgctattccacaggttttcgtcaaatggaccggtctgtcaccagcttcggctacatgggaggactacaatgtcatcaagaatcgctttcctaaagctcctgcttggggacaagcagaaacttcggccggaggagatgtcgcgatccaagggtgatggcgtattccgagaagacgtattcgtctgatgatagcgtagtagtattcatgatgtatgctactctatgacaggtggggccttcgtgccagtctgggctaaccgtataaggttccccactgcgtgtaagaaaccaagttgaattttgattaagtaaaaagcgcgagagacagag

SEQ ID NO: 22119 - DNA, 501 bp, Sorghum bicolor
  Clone ID: 13585229
tagtatttgcattattagtgtataatgtctgataactgagggtaacaatgttactcaatctcattcttgatgcaggttcaagttgttgatgtaaacccttcatattgttgggatctcacatggcaaactcaaaatccccaaccaacaaaagttggccttattacttcactaaggataaagtgaaggggaagggttttaatcctgcgtggtggtgcgatgtgccaattgtttgtcaagggctgcattgtcgtctaaagtgacactgccgcaagattcacctgccttggtatggactcaagtgtagaatgtctccaatgcagtgtgtttatgtgaatatttttgtcgtgtggatgatagctgtgagaatggaagttgagagttgagaattagaacttgatgtgtgctcccataattagtagaacagaatggatgataagttgtagctatgtgaggacaatgttgtgtacttggccaaatgtgatctgtaatgtgttggccact

SEQ ID NO: 22120 - DNA, 466 bp, Sorghum bicolor
  Clone ID: 13585268
cgaccccggacggtgttgaggttgttgctgagcgactgggtatcttcccgactgagctgacagatgaagcagtagcaccagcagctaatggggggcactgccacatcggtgatgcgaacccatcgggatgcagttagtgcttgcaccaagaggttgatgaccttatggtgcagttgcaggcaagtccggtaggcagaacttttggcaactaggtctgtattacctaatcttggtcaatgcacctgtaatatatactctttgaagtactcaggagatatgagttaattatgtatatatttagggcctttttgatccattagctgctaatagttacgaagctaattaatagctcatagctaatattggttagcgaactattagctggtttggcccaactagtaagatagttgttagttgtgtattagctagaaattaggtagactattagctggacctgtttgatccc

SEQ ID NO: 22121 - DNA, 580 bp, Sorghum bicolor
  Clone ID: 13585275
gctccggctgcaacccctgcggcagttgcaagcagtgttgctcatgccccaccgactgctgcaactgcaagccaagctgcggctgtttcagcgcgcaatgttgcagctgtgcggcatgctgctcctcgtgcttaagctgcttcagttgcttcggttgcttcaagtccttcaagtgctccaacctgttcgggtgctgctcctgcaagcagtgcttcaagtgccagtcgtcgtgctgcaagggtgcgccatcctgctgcaagtgccagtcgtcgtgctgtgagggtgaagacggcagcagctgctgccggaggtcatgctgcagtgttccgaagccggcttgccctgggtgctcgtgcgggtgcgtttggtcctgcaagaagtgtacagatgggtgtcgatgttctgggtgccgcaatccgtgctgtgccactggatgcttgtgttgaggttgaactagacgttttctttggttgttattttttgcgtgtgccattttagatggccgttggtttcccgtcgtgctttgatatatggtgtggcgtccttgtctgtaaagaatcccatgtcaccagaagaaatt

SEQ ID NO: 22122 - DNA, 532 bp, Sorghum bicolor
  unsure (1)..(532): unsure at all n locations
  Clone ID: 13585279
acaagctcgatgcttatggagttgaagcgggagtggaacattacggttgtctggtcgatctattaggccgggctggaaaactgaaggaagcctacgagattgtcaagaacatgcctgaggaacccaatgaggtgatctggggatcgttgcttggagcttgcagagtgcatggtgatgcagaaatgtcaagattggtaacggatgagatccatcgattgcattctgttcacgcatcgtccaatgatgcagagtacatcatgctgtcaaatatcatggctgcttcgaagaggtgggagcaggcagagcaaataaggaggaaaatggcacgacatggggttgagaagactcctgcctgcagttcgcttgagcttggcattcctgaataccaagtgtgtgcaggcagtaggcagtagtgctctgagcagactacattactgtaagtttgtttaataattttgtttcatgtttttcatcggtctgatttcagtagctcacccagagaagaaagatcttgatgtgatgcgtttgntat

SEQ ID NO: 22123 - DNA, 504 bp, Sorghum bicolor
  Clone ID: 13585280
agttgcaccccttctactcccgatccttttgatatattttctgctcggttatgcagtgtacatcaaccagatggaagatgtttatgagatcacatacgatacatgcggacaatactggcccaacattcaccactacatatttctatcagtaacactcatgcaaatcacaatgataggactgtttgggctcaagtcaaagccaggagcttccttcgcgacaattccgttgctcgtgttgaacattcttttcaatgagtactgcaaggtccgatttcttccaaatttcagccatcgaccagttcaggttgccaaacagagtgatgagcttgatgaggctgatggtatgactgaaggcgatgtgaacgatgcaatttgcgcttattggccaccatggatgcgtccgacaagcctggaatctagttctgtgcagcctttgaatatttgatctgttttgcacaatgcaccagcaatactggtgctgatgtcagttttgttgtttacatg

SEQ ID NO: 22124 - DNA, 278 bp, Sorghum bicolor
  Clone ID: 13585286
gcctactaaagtgccagagaggcctgaagctccagaaaagaccaaagttttggaggagccattacctgcatagtggatggaactgagatgaatagggcacagttagtttgcaggaattgtaacataccccatttcattgtaccatctcattttcagccatatcagaattttattgtgtacagacagcaagaaaatttgttgttcttgactaccaattatcaccagtttggatttttgcagtgcccattattacagtcaaatctacggggtaaacataa

SEQ ID NO: 22125 - DNA, 597 bp, Sorghum bicolor
  Clone ID: 13585302
tttaggattcatgaaacggttgcaacagatactaggtcggaagcatcaaaaaaatcttcatacaatatatatactccacccgacgctgggattgagaacagctgttatggcaatgcagctttttgttgacggggaggtctggaagaaagttgtatatgtcgacagacttgtgcagctattcagatatgtaccgcgtgaacagctaaccattcctgattttgtattccagcatgatcttgaagtgaatggtggaaagggcataatcgttgacccaagaacaaagcatgtctaccagagaccatctggctgatctgtcatgaacctgcaaatgagcgcttcacggtaccactctctctgtagtctgtacagactctctgtccagtcctctgtagaaggtcctgtcctcctctgtagaagagttcccttctagagctgcgcattttgttgctctatgctattccttctccttttagggaggcatatttctgtataaacaaataaatgccgcatctaaatgtctctcaagttgcctagagctgggcgtgcttattaggtactgtaaaattttgacaggtccatagatatgagaaataagat

SEQ ID NO: 22126 - DNA, 401 bp, Sorghum bicolor
  Clone ID: 13585307
tccaaatccattgcctcgcttaagcctattagcaccctcaaggtgtccaccgatgccacctgcggcggaaagtatggcttcacatgcgccggctccactttcggaaactgctgcagctgtgcgggctggtgcggtagtaccaccgcttactgcggtactggctgccagcctggattcggcaaatgcacttaaattaggattgcccgctcgcatactgtgctgaaccaaccatctttgccattactaggagtacatctttttgcctcaagattccttgggcagatttgtgttttcttggtttaaaagggtgaatgtatttgtacaaaattttgtttactgtagcaatacgagagcggcagacgcgtccgtttgacgaccgttacgaggtaatagtgcaagca

SEQ ID NO: 22127 - DNA, 706 bp, Sorghum bicolor
  unsure (1)..(706): unsure at all n locations
  Clone ID: 13585313
agtgcanaatcggcaaaacagttatgcaaagagtaaaaaggacaatgtggcatatgagatgccatttccacatcctgttgaagacgactcagtttctgctgaagacgatgggaatagttttggtctgaacagtgcataagaaagacatgttcctgctgatttgctgtactcttgtatcaatcaacgcaagtgagattacacgattgtttctggggatggcctgttggagctcaggtagtcctcattgatgaactggattggaaaccccaggtttcctctgattcctgctgcaaatgaggttcaaagctaaaacttagatgcacacaagacatttgcggggtggtgtatagcagtaagcttatgtagattaattgccacaccaggtgctatcctatgaacatttgggtgggttatatcagtagctaaactttagtgctagggtagtaaggttaatcatgcaggcctttgccaaaaaaaaagtagcatttggaagggtttttctgttcacacttctccacacctgacgaggaacctactatgtctttaatgtgccccagccgcgaattcaggtgttcgtttgacacatgcaaagcaatctaccgaccatgtgccgagcattttagattggggaccgtctccgtcaatctgttttgtaacaggagccgcgctgctgtgctgtgcagctggaacaattagcatgaatgaa

SEQ ID NO: 22128 - DNA, 617 bp, Sorghum bicolor
  unsure (1)..(617): unsure at all n locations
  Clone ID: 13585330
agtttttgtctgatgggtttgttggtgtcggtgttgcagagattgtggcagcaacgtccatcgcgagccacgggcggatgtcgcgtactgcatccatgcgcttgcccggcgcgacaagccaaaaccaggaactagattcttttaaaggtagccgctgtataagctcagaccaagcaaattccgtgcagcaattgaggcagcttttctcactgaacgtgattttttatcaaaaaatggatggggtatgctcactgcggaagtctgtaaataagcagtctgatcctaatagctttcaggaagaggcgaattcaaataacgagcaagagtgccaatccgattctcaggttgttcgaaaattggcactgtcttgtgatagctgtgataatcgcctaccatccaaggttccgaaaaaaaggaagcaagggatgagcaggtgctcggcactacgaaaagatgtgctagcacttcaaaggaaaagttggccgcaatgatagatatttgctacaacagcgaggaggcactgtatgtacctgacaagcacatgtaattatttggtattttggtggtatctcactgtaatttagaacnatatattattcaactgtgttgggagagtn

SEQ ID NO: 22129 - DNA, 425 bp, Sorghum bicolor
  Clone ID: 13585340
acgagctgaggccagtggctctacctgagggagcatattcacagtgatcaacaacacgctccagctcaagggggatatctgtgctgaagagaagacggatgacaacttataattgataagtgtttgtcaactacaccatcatgggctaaccgagctatggtgactaaggttgccggcaacggaaaatggccatggatatcctctccctaaacttgatgcctgaaatgcctccaagatttcagtcgactgaagtgtagatgtgtatcttaaaatatgaagcaaaacaaaaacactgtaggaattcaacaatcagcagtgaaggtaaaatcgctccaactgcttcctccataacaccatgtctgcaccacgatctacataggagaaatgaaaacctataagctagaaatcaactttgtccttagctg

SEQ ID NO: 22130 - DNA, 682 bp, Sorghum bicolor
  Clone ID: 13585368
caaaccaggccatcacatgtgaccactatagtgctgacttccgtcaaggatatacgggaaatggcacccttacatctgtattgacacggcttggtgaattggaggagaagatacagacacttgaagcaaagccaccccaagtgccatttgaaaaggaggaattgttacgtacttctgtttaccgcgtggatgtgttggaagctgaactaatttctatgaagaaggtcttgtatgagacattgattcggcaggatgagctgcttgcatatattgaccaacaacagacagcaaaattttgtcggcggaagttctgcttctaagggcctgtttggaagagctccggcagctagcactgtattgtggcggagccgtcggagcctcaaaacgctgggtcctccggctcctgcactttgcagttgtattttgccaaagccagagccggccagctccgcgttacagtgcagcacagtactgtaaagtgcacctgcgcagggagccagagccggcgagagcgggtgccaaacagcctcgaagtactggagtacctgccacctattttcttctctttggagatggcatgctgctgttgtggatgcagtatacttgtaaatacctttgtatttttttcttgaattatcttcgtattttgttgcagtgtaaagcatcacaatttttagaaata

SEQ ID NO: 22131 - DNA, 455 bp, Sorghum bicolor
  Clone ID: 13585371
ttcaccaagcgcttcgagtcccgccagcagctcgagtcttacatctcccgtgttgaggagatcgtctccgaccccagcatgtccatgaagctcaagcgcggcaacaaggagcgcattgagtccgctctctccgacgccatggcccagctcgaggttgaggactcctcccccgaggacctcaagaagaaggagcttgctctcaagcgtctgatcaccaaggctatggccacacggtaaatgcatacattggacgacatgaacatagacttacggccaacgaattttcctctttcccgagactcggcttctcagggaatctgcacctagacccagggcagagttggtctctgtcacgctttgtttatgaagccgggcttttgggcgcagttttcttttcttgaaaagtacgatttgttttgtttttttgtagacgaagttcaccatctgcaatttaa

SEQ ID NO: 22132 - DNA, 555 bp, Sorghum bicolor
  Clone ID: 13585374
gccgcctggagcagcgcggcatcgtcagcgccgggcccgggttcccggagagctcgtggttcgccgacttcgccgagatggcgcgccgggtgtggctgctgcactgcctcttcttcgcgttcgacggcgtcgccgaggaggacggcgcgtccatcttccaggtgcgcacgggggcgcgcttctcggaggtgtacatggagagcgtcagcgacgggcgcgccggcgacgacgctggggccgccgcggccgccgaggaccgcgtggtcggcttcaccgtgctgccggggttcagagtcggccggacactgatccaatgccgcgtctacctgtccaagccgtccaagccggtgcggcggccgtaagaccgaagaagagaaaagaaagggccgtgcttggttccggcgtccggcggatgatgggggaagaatgcccattttgggtcggccgtcgaggtctcccgccggcagccggccggggcggttgccatgatgatgatgatgaagggtggctatgtatgtaaaaaatctatccagaccatgtagggatgttctaatc

SEQ ID NO: 22133 - DNA, 594 bp, Sorghum bicolor
  Clone ID: 13585376
ctgtgtttcatttccatagttggaagctgcttcagcttcttgactctgtcttacactattttcctgatggcatacactcttcccatgttgtatgagaagtacgaagatcaagttgatgttgtgggtgaaaaggcccttattgagataaaaaagcagtataaagtgattgatgctaagtttatctctaagatcccaatgttgtctgagaagaaacaacactgaaggggtgctccaaaaggactaattcagcacattaccaatatatgaaaatagttcttttggctttgctatgcccacatttagcaatctttaagacgaaaccatagatattatatggatttttaagctggaaaattgagtcttctgagtccaagaacagtgtcaaccatcatacaaagtagttgcttcttcctgtcagatagtccatttgattttgtatggatgtggacatatatgcctgaccaattgtgattatttgctatttctatatgttaagtgcatttaatagctctccatttatgtagttagtttgagttgaatcaatttagtaatgtcacatcaactaatattttatagttcatggtgctaacaatt

SEQ ID NO: 22134 - DNA, 604 bp, Sorghum bicolor
  Clone ID: 13585386
cgtgccgatgcatcaaggatctcggcatgcccttcttccaccacgaggtggtgaagaaggcgctggtggcgatcatcgagaagcggggcaaagacgagcgcctctgggggctcctcagcgagtgctacggccgcggtctgatcacgcccaaccagatgaccaagggcttcgacagggtggccgactgcgtcgacgacctcgcactcgacgtgcctgacgccgcgaagcagctcggctgctgcatcgaccgcgccaagaaggaaggatggctggacccgtccttctcgatgacgaggccagggcagccagttgccaatggcgtttgttcgtgagcagccggttacgttcaggatgcagcactgcaattccattacctggggagttcgtctgcaacttttagtacttttatatatctcagctatatatacttgtactatgtatatcaacaggagcaagagagggactatatagaagtatatatgtcgccacaacccacaacaattttggtataggattggaagcagatcttccatcttaggagtttgcatggcgtttagcggagaggacttgtgaattggagagtttatgtttcccagcatttgtt

SEQ ID NO: 22135 - DNA, 660 bp, Sorghum bicolor
  unsure (1)..(660): unsure at all n locations
  Clone ID: 13585418
gtccttctccatcggtgatggaagggtgggcttgttgcttgatctggacgagaggctagagctaagagaagatgttgctgcaatgatggcgaccaaggaggtggcctcgtgtgaatttatatcgggcgttttcttgagaagaaaggcgagctccggccgtgccggagaagaagaggaagaaaggcaaggcttggagcaggggaaacggaaaggaaaacgagggagataatgcccatgccaccgcgcgttattgaagactctggaagaagaaagaaaacaggggggcaagacgaggagacaagagtttgtctggtcggcccaatcgtgctgggtaaggccacttttaaggccgggttctgtctgatccaaccagatttcggcaaagcccatccgtttcgagagcagcagttaacatctcgaatctaccatggatttttcattggaagctttttcaatttctgcatgtacgaaactctttgacttcttcgagctccgtcgaatctattagctattcagcggtgtttgtctctcacaataaatcagattacagtatttttcagccaaatgaacatgttggagagtatacaactttttaaatttttttacgaagtagtggatgattaaaaagnagagacttgcattgctctaagcataagcatg

SEQ ID NO: 22136 - DNA, 550 bp, Sorghum bicolor
  Clone ID: 13585422
ttctcacttgatagcgatattctcatggaaggttacaggggagtcttggctatcagaaggtatattgagcctagggtcccctccacagtaaagctgcaagttttagagctttgcagctgccatgctgctgtacattagatgtcatgttgatctggctgttcaatgtttaatcatgttgttgttgttgctgctgctgctgcttcttctcaattatgttggtgtttacatgggtcatgcttgtgtgtgtgtgtgtgtgtgtgtgtgtgtgtgtgtgtgtgtgtgtgtgtgtgtgtgtgtgtctacaaggccctgttattgatcctacagaagaagacgtggggaagttagccgagagaaagtgaggagatggactctgtaattttgttgccactcctctgttctatgagattcatctgaacctatccctgttgctgtgcttcctatccttgatctaatctggttcgcagcttacaacttggcctgaatggcatctgaactactatcctcagaatgtaagcttgtgagttaggacatgagcagttgtttcagt

SEQ ID NO: 22137 - DNA, 718 bp, Sorghum bicolor
  Clone ID: 13585425
atgctagtgaagtgtattatgccaaactccgtgctgcgcatggaaagcgatttgcccccgaggacgcgcaacccttgtctctggctgggaagaaacctaagggcattcgaagtgtcagtccggatgagccggttatcagccaaagcatccgagccagtgacgcctggacggatgatctggagccttactgagctacctaataaagccccaagaatgaggtgttctctcgcttgcacagtgcctcggatgactatcacgtgaacgtttcattttccctcttgttttcggtgtcaaaaattagggctcataccttctactcttctgactatgtcagttaatctgtacagaactttttctatgtcctgatgagcaacggaatgctcaagatgacatgacctattttcgtccaagttttcttgtctatatgacttggcctcttttattaatcttctctgtttgtatgatttgggtattctgtttttgtttactttcagtggacttttacttttcttctttcttctttttttttttctccgttatcttgcgcctttgcgtttgtcttcgtctgcttctttcttttctctcggtatggtgtttattctcttctggcttctttggtccgggtatttcccgctatacttgtatgattcgagatggtatgtttgctatgttttgttatgccttttcttaggtttgatatcagcgcagcgtagtatca

SEQ ID NO: 22138 - DNA, 401 bp, Sorghum bicolor
  Clone ID: 13585431
gacatctagtacttttacagattttatttttcaggctgctgttccaaagttcatcgaattgagactggatccggctagtggcaacactgttccagcaaatggaaatggttcggtcacacaagggctcaacgtgaccaataaccaacagggacagaaaccgcttgcaatgcgtatccggatgtcgtacaaagtgaatggcaaggacagattggaacaaggccaagtcagcaattttccttctggactatagtgccgttcgtgtatattatatgtcatgttgtgatagttctctgaaattgacgtgtcggggacaggcacagagcgaagccttattttaccccgttcctcgtttttttaatattcttgtcaccccccatttgtgggggttacatagagaaaat

SEQ ID NO: 22139 - DNA, 365 bp, Sorghum bicolor
  Clone ID: 13585435
gaagagtggatgctaactgaaatatatgagctttctctagcaagctcattaatctgagatgggaaggtcccagcaagctttccatcttccttgaagcaatgtctctggagagaatccagctgcctgttcatgtgactgaggctgattattttttcaacagtggggtacaagaaaaggggttggtgaagtggacaaccagacctgattacttgtgccatgcctgggagtcggctggtctagaagtaggaataagttacctctgctgttgttgtttgtatggtctaccatgatgaaatagctggcatccataagctaatctcagttcttatcatgtttacaaggggactggcattgtgtagctggag

SEQ ID NO: 22140 - DNA, 340 bp, Sorghum bicolor
  Clone ID: 13585449
ggcattctgtgtagttgttgcagcaagacgttatcaatttcagacttcaaggctcatgctatgatcagtcttcctagatcctccttgaatctgtgtcttcagtctggaaagtcattcactctttgtcaaattgaggcttggaatgccgaatatatggacaggcggagtaatgcatgcagaagaaaagtggaagcagccgatggaaatgacgatccttgtggtttctgtggagatggcggtgaactactttgctgtgatatctgcccatcaacataccatcaatcttgcctgtcagtcaaggagctcccagatgatagttggtactgccataactgtatat

SEQ ID NO: 22141 - DNA, 249 bp, Sorghum bicolor
  Clone ID: 13585477
ttgcgccagttggctgcaaaatatgcttccaatacaaaggatggatccaaactgcaagctctgtccaatcctgcaaaatcttgtgcatcgttccatcatgacgagctcaacaaatcaatttgccaagttgctgttcctgttcatagtgtatttgttgcaaagcatgaggataagttttctttacgcaacatattcattttgctcttcaaacacaaagaacccaatgcaacattgactaagcaggaaatt

SEQ ID NO: 22142 - DNA, 386 bp, Sorghum bicolor
  Clone ID: 13585479
tggatcaggaaagaccaagggatcagaagatagaagaactgaaagaaacagtaagagccacggaagatgcaaaagcacatgcacttaaagaattggaacttatcaaggaaaacaacatgaatgaaattaaaagatttaacaaggaaaggcgccaggatttggtggagatgctgaaaggctttgtatcggatcaggccacatactcagatcattttgctagcatatggacaaaggtagcagaagaaacaaaaggatatgcaaaaagcagcagttgaagtaggatgtacatatacaggtgaattggagctgttattgtgcagcgtgaacataggtacaccactgagaattatgcaaggcttatacgcagacaagaccacactctccat

SEQ ID NO: 22143 - DNA, 424 bp, Sorghum bicolor
  Clone ID: 13585492
agatcgacagcagctatcgcccggtgacgccctgatctgcagcatttctccttggcctgtgcccacagcctgcctggtggactcgaccaccgatttcttccgcagcatccatgagggcctccactggaacttgaggaaatcccagtcatttgacggcccgcgtgattgatgcaacagatttttttcagttatatatcagtccagtgccagaattcaagctgggaatcctcaaagtgcagctaacatcaagaggaataattgtatctactcgagggtgctcacctttaccgttcatgtgtgttatatatatacaaagttgcgtgcgtttagatatgaggtatagtgcagagtccaaatatatagccatggccatgcatgtgtgtgtacaggtttctgtgcttcagtgcttgattatagcacacgt

SEQ ID NO: 22144 - DNA, 425 bp, Sorghum bicolor
  Clone ID: 13585497
cgaaagctgatgacactaaggaaaacatccagcacatccagagaggaggttgagaaacttcagatggagaaccggtccctccgcgaaaaggaggagaaatcctccagcgaaacgaagaagcttcagcgagagattgcaaagctgaatgagagcatgaagaagctgaaatctgagacggaagagcacgagaggaaggcatcggtagcagaggcccatgtcaacgcgctgcagaagcagtcagaggagctgctcctggagtatgaccggttgctggaagacaaccagattctgcagactcagctacttagcagagcctaagctatgagggaagctgatagtgcagcttcagttgtttgttagcaagactcttgccagatggtgtcagagagccaaggacttacccggttctgaatgattacatgccg

SEQ ID NO: 22145 - DNA, 502 bp, Sorghum bicolor
  Clone ID: 13585504
tcctcgtcgttgattcagctgcgatttttgcgaggcagaatgatgagacgatctcttgtctactctcacgggggtggaagcagacggagcactgcagatcagtgagaggcaggagcaccagaacatgcacatatctctaaggagtatatacaagagccttagttctctgttactcatagttggacttgggaggcaccgcaggagattgaccacgtgttgtttaaggtagactgcgcagcaggtgacaaagagcatgcatcaaagggttgcagttgcagacggccagcacctccagaagaaagagaggaggaaaaggctgaagagagagagagggagagccaggtcagcaaggtgttcaaaccgccggcggtatctacgaatcttcctctttttcttcttttgtatatgtgtatgccttgtgaagtgcattcgagaggcacgactgattacaaagaattcgagtttttaaagtaatgcagcgaaagcgaagattctatctgta

SEQ ID NO: 22146 - DNA, 357 bp, Sorghum bicolor
  Clone ID: 13585511
gaaaaatccggtgttgcgcttgcgcttgtgcagttgtgcctagagatcccggaatatcatcaacgaacgtggtgtcttctatgatgcatatgtatcgttagactaatatctcctgaatatccagtgcctcctggtacaaaacttgtcagttgtttcggtgcagatgcttatctcagtgttaaatgacaccaagtacttgaattactgttactattattatcgtcaatgccttgtgtgtgctccgatttatggtcctgctacatgagttgtgttttagatttgtggcagtgacagtgatctgttaattgcacgggttttgcttgtactggaggccaaatagagttgtttcagtcggtg

SEQ ID NO: 22147 - DNA, 452 bp, Sorghum bicolor
  Clone ID: 13585514
ttctcagcatgaagaggtccgcagacaggcctttaccaatatttcccggtttatgatgaagctgaaggattcgaaatacgtcgaatggcgatcggtctttcttttgactgtcttgacgaaccccctgcacaagctgtacgggaaggtaaacaagttcctccaaaaggcacctttttgggaggttgaaaagatcgcgacgtattggattgacaagatcctgctgcatgagcccgaattggacgatgggtatttcgaagagatcagctggctcttggatttgttcgtcaagggcctccgaacagggacggacatggaagtataccgccgcgcgaacgtcttcgaacgagtgctctcgttctacgaatcccctagcgctctattctccgccaaacgacgcatcttacacttgctgtaccgctcgacgcaggtcgggggcagcacaactttggtga

SEQ ID NO: 22148 - DNA, 332 bp, Sorghum bicolor
  Clone ID: 13585519
tcttgtacaaggccattgctgatgaaccgtctgtcatattcagcatggcctttggctctgttaacgtgcagatgtaaaggagttatcacatttgggagcagtgacagtttctcagcctgaggtttgctcagatgacaattttgtacagtataaatggtgtcgattgactcttatggacctttacttagcccatttgaaggtgtagtctgtaacatagctagggtgggtaataatgtatcaaggtggagttgctcacatcggtaattgtttgtctgtatcatctactgctgtaatcgtgttccttcttttttttcccccttccctttataatg

SEQ ID NO: 22149 - DNA, 420 bp, Sorghum bicolor
  Clone ID: 13585531
cttccttcattggcagagccggacccaagaacaagggcagaatctcgcgattcctcgcaaacaagtgctctattgcttccagaatcgacaacttttccgaggagccatccaccaagtttggtgaagttcttaagaagcaggttgaggagcgtctggacttttacgctactggtgctgcgccaaccaagaatgaagttgcaatgaaatctgccatggattctgtccttgcggatatggacattgacgacgggagcgacgaagaaatgggggacgccgttgctgagagcaagaaggaggacaagaaagagaagaaggagaagaaagagaagaaagagaagaaggagaagaaggagaagagcgagaagagcgagaagaaggacaagggcgagaaggaagagaagaagaagaagcggaagcacg

SEQ ID NO: 22150 - DNA, 427 bp, Sorghum bicolor
  Clone ID: 13585549
ggagaactacaagcctgacgagtggtcgttgtggcgtgttgacttcaagtacaacgaggagctccgcatgaccttcatggctgctaaccagattggtggtttcttcaaccgtcttgaggcttctcgcaagtacatgttcggtgctgccgccgtctacggtgtcaactatgactgtgtcatccgcggtgtcatgttgatccgtggccaggaaagccaccctgcgatcgaggttgctcctgactgggagagctacgcattgaccaagctcgaccacaccaaggaagaggaccgcaagttcgtcggtgacatgtgggcctgggatgttcctcttgtcattgaaggcaaggagctcccctgggttgacggccacgagctcaaatagatgaccactcattgctaagccattgaaagatcatggtttactggt

SEQ ID NO: 22151 - DNA, 237 bp, Sorghum bicolor
  Clone ID: 13585552
cctttgagatccacgacttcgatactcagaaactgggccaccagtggcttgcgaataaggggtatgaggctgtgtggggcgttgggaggcacattctgggatcgcagctttttgattactggtgggatacgacgggcaatatgattgagcattatgcggatggcgatttggttagtgaggagacgccggttgggtatgggccggcgggggatgagtctttggcggtttgggggccga

SEQ ID NO: 22152 - DNA, 539 bp, Sorghum bicolor
  Clone ID: 13585591
gcacgaggggaagccctgtggtgctcccatatactgttttcattttagttgcatgtgtatctgtggctttttcactgtacctggctgttacaccattgagatctggaagtcatgaagctgaatcccatgaatggtctgtgcattctcagagagaactcttgaatactcctcaagaaagggaagatgttaaggtggacaatgttacctatgaggaagatcagagatcagatgttggcccttctcccagggatgcgcctgacagccatccggagctggccatggactatattgatacttctgacactgctgtagaatctgatcacgactctcaacaatctactgcatatgcatccactgctcctgaaacctgcccctccccgtcatttactcgtgaggagtcaaaatcagttgttgcagtcaactggccggagcctttggagaaggttcctacttctactgtgatagaggaaagcacagtagaaagtgtggtctctaggatcacgactgaaagagatgttttagtagaaacagatgttttc

SEQ ID NO: 22153 - DNA, 521 bp, Sorghum bicolor
  Clone ID: 13585592
gcacgagggagagaactagtttacgaaacataggccaagaggctagaccgagggggccggaagaagagagagacagagagagagaggccgaggagagagagagagagacaaaggggagagaccaagcgccagagacacagagagggggcggaggagagagagagggagagaggagaatcgcgggagggaggcggggttttggcgagatttgagtttccccccacgctcccgccatggtgtccgaccaggagatcgcaagctgcgtcgagtccgtcctccgtggctccgccggcgggcccggggaggcctcgctcgccgccgtgttgcagcaggcggaggccacgctcggcgtcgacctctcccacaaggcgggcttcatccgcgaccagatggacctcttcttcggcccgaacctccagccgcagccgccgaccaagccccagccggcgcctcccccgcctcaggccctcgttgcctcctcggccgctgtgccgcagctccagcctcagcatcagcatcag

SEQ ID NO: 22154 - DNA, 455 bp, Sorghum bicolor
  Clone ID: 13585596
gcacgaggccatcacgcctcgcgtttataagctagccacccttcttccccggctctcccacggtccttcctgcctgcaaagcacagacacaaatcacgagcgcgagggaggcacgaactaaaccgaacccatggcggcctcacgcgcgctcctccccagcccgcaggcgagccccgcggcccgcgtggccgtggcgccgtcctcgctcaccacgctcgcggcgcgcacaggcgcggcgcggctccgcgtcgtccggtgcgcggtcctgtcgtcgcccgcggcgcccgtggcggagtcgtcgaagccgccggcgcaccggatctcgcggtccgggtccgacggcgcgctgcggcccaagcccgcggtgctggtggcggagaagctgagcgaggccgggctcgccgtgctgcgggagttcgcggacgtggagtgcgcctacggcatgtccccggccg

SEQ ID NO: 22155 - DNA, 422 bp, Sorghum bicolor
  Clone ID: 13585615
gcacgagggcgggtgcgggagtcctccctccccggtagatttccttccttcccagagagccgcccaatcgggtccaatcccgtcgatctttctggctgcagccatcacgggactccagaagttgccttcgattcggccggggccggggaagcggggatggggctcggggaggcggcgcggcggctcctggcggccgtggactgggagcgcgaggcctacccggcgtacggcgacttcctcgctctccccgccttcgttctcttcttccctaccgtccgcttcctcctcgaccgcttcgccttcgagtgggttgcgaggaggcttatacatgggaatggacatcagagagctaataacgaaacagaagaagcaaggaagaagataagaaaattcaaggaatcagcttggaaatgtgtttattt

SEQ ID NO: 22156 - DNA, 477 bp, Sorghum bicolor
  Clone ID: 13585618
ctaatgtaggggcaggagagagcccactgttccatctctttcttggagtaggagggcaccaaggccccaacccccctcgcccccaccagattcggggaattcgcgcctcatccgatcgtcactggccgccggagcgcaagaaacagcggccgcgccaggactctggaggacacggcggctcggtggattcgggaaggggaggatcttttcttggatttctgttcttgattgaggagagggtcttgtattagctactgtgttattcactggatgttggcaatggggtcagaagagtgggagctctatccttcttcctacattggttcacaggtcatagaatacagaccggtctctgaagacagcgatgacgatcagaatggggatgtggcagtgtcgctggacgctgttctccctgatgatctcttggagaaggttctttccttcttgcctgttgcaagtattataagatctgggtct

SEQ ID NO: 22157 - DNA, 533 bp, Sorghum bicolor
  Clone ID: 13585631
ccccaaccctaaccgccgggcgccggcggtggccatgatggccaccgagccctcgtccccggtgagccccgtcgaggacctagacacactacccctcgaatcctcctcctccagtgtcggtgtcgcggccacgaccgaccccctgctccgcccacctcctcctccctcgtccacctcctcacccaccgccggcgagaaccacggcgtgtttctggacgaggaggacgaggatggggtggaggacttcacgcctcccccggctccccacaccgctgcggccgcgacgaagtcccgcgaggcgtcgccggggttcgctgagatcactgtctccgagcctaggaagcacgcggagcctgcgaccggagccgttggcgtcattccaggctcggccaactacgtctcctacctcatcgccactcgggtgcccgacggcggcgagttccgcgtgcgtcggcgcttccgcgacgtcgtggcgctcgccgaccgcctcgcggagacacaccgtggcctcttcgtaccggcaaggcccgaca

SEQ ID NO: 22158 - DNA, 562 bp, Sorghum bicolor
  Clone ID: 13585632
gcacgaggctgcagcagtacagccagttccccgacttcaacaactacctagtcttcatcctggcccgcggagaggggaaatctattgaagttagacaggcagctggtctactactgaaaaacaatttgcgaacgactttcagttccatgccacctccgttccagcattatgttaagtctgagctgttaccatgtataggggcaaccaatagggcaattagatccacagttggaacagtgatcagtgtacttttccaaattgtacgagttgctggatggatcgagttatttcaggcactccataagtgtttggatagtaatgacctggatcacatggaaggtgccatggatgcgatatacaagatctgtgaggatgtccctgaagagctcgatgttgatgttcctggtttgtctgaacgaccgatcaatgtgtttatgccgagaatactgcagtttttccagtcaccacatccaactttgagaaaactatcgttgggttgcgtaaatcagtacatagtagtgatgccatcggcactctacatgtctatggatcagtacattca

SEQ ID NO: 22159 - DNA, 537 bp, Sorghum bicolor
  unsure (1)..(537): unsure at all n locations
  Clone ID: 13585648
naggggagaaaggcatcatttaaactttcatggggatgtaatggggataaaaatggtcagcataagcatgattttgtgtcctttgaaaaaggtgatataacaaccgcagaaaggagcaataagcagatcttactgaaatgggaatcgccaccacaaacagtgcttttcataaccaaaccgaattccaactctgtgcgtgttctttgtgctgaaatggtcagatggcttagggagagtaaaaacataaacatctttgttgagccacgtgttagaaaggaacttctaacagaggattcctactacaacttcgtccaaacatgggataatgatgaggagataaagatgctgcacacgaaggttgatctaattgtaactttgggtggtgatggaactgttctgtgggctgcgtcgttgttcaaaggaccagttcctccagttgttgcattcgcccttggatcactgggcttcatgacgcctttcccaagcgagcaataccgtgagttgttggacaatgtgctgaatgggccatttagcatc

SEQ ID NO: 22160 - DNA, 431 bp, Sorghum bicolor
  Clone ID: 13585653
gcacgagggccaggtcttctgattgctgacggctcaccttttcgcagaccaagaaaaggtggtgatttcatttcctgcccgtcgtctccaatctctctccccaccaaatttctgatttttttccgccgccgcaaacctccgctcctgtgccacaccgccattccattccagttgggcgctaaagaaaggaaggaagcgaggccggctgtttcgctgaaatcccgccgccttttttttttctctggaccaccaaggtccggttgaagaatcgtagcagattgtgtgagagaggagcggcggcggccggtcggtcggtatgattcacctgctcttcctcgtgttgttcgcggagggcgcggtggcgctgctcctcatggtcaaggtcggcccgctgcgggagctggcgatgcgcggcgtggaccaggtgaaga

SEQ ID NO: 22161 - DNA, 493 bp, Sorghum bicolor
  Clone ID: 13585672
tgatgttcgcgacatcactcatgtgctgaactatgactaccccaacaactcggaagactatattcaccgtattggtagaactggtcgggctggtgccagtggaactgccatcaccttctttaccactgacaactctaagcaggctcgtgacttgattaatattctcactgaggccaagcagcaaattgatccccgtcttgctgagatggttcgctatggtggcggtggcggttatggcggcggtcgctggggtggccgtggtggtggccgtggtcggggccgtggtggtggtagctttaccgcttccaatgctgcgccgcttggaaaccaccgtcgctggtaaattggacatgatgcccagtgcagtcgctaagcttgtattccgttgtcaccggtagcttttccctctgccctttcttctcggttttctcgtaacccggcgcgggcggcgtttgtgtcaatgtcacgatagacttaatgtgtttttgattag

SEQ ID NO: 22162 - DNA, 451 bp, Sorghum bicolor
  Clone ID: 13585693
ctagagaccaaagtcagaaggacactggtcggaaaatgtggagatctgtcaatgaactaatgcttgttcggtgggacaaatcaaaggctgctggcatctcaaacttaatacttctcaagtttagtgaggctgacgcccatgaatccaccacactggagcgaatacaagaagaagaacctgaattctactctatggtttcacgtgtcctgaaacgagctgagatggagtttgccttatgactcaacgagtagcgagggttgatgatcttccctcttggaggactctcacggttgctattcagtggtggccttggaacaatggatcagcattcagtttggtcatttggtgggattcatatttgcgagtacttgatcggtatgctatggtgaaaacgacgtgcaaaagtttcttcctgtggcagccgaaacatcagctctctgttatcatagag

SEQ ID NO: 22163 - DNA, 355 bp, Sorghum bicolor
  Clone ID: 13585697
ttggagaagcagcagcctgcgtttgctctaaaggtgcagacagtacccctgacttgtaacaaccccaaaggccagaacagcttccaaatctcactagaaatcagttacacggggagccgtccagcctccaacatggtgattgctgatgtgaagatgctctctggcttcatcccattgaaaccaacagtgaagaagcttgaaagattagagcatgtaagcagaacagaagtgaccaccaacaacgtcctgttatatttggaccaggtaaccaatcagacattgtccttctccttcatcattcaacaagacatcccagtaaagaacctgcagcctgccattgtgaaagtgtatgaat

SEQ ID NO: 22164 - DNA, 512 bp, Sorghum bicolor
  Clone ID: 13585709
ttgggatatgaaaaccgtcgatggcagtgagcagttcttccctgccgatcttgtcctcctttccatgggtttcctgggtcccgaggaccgtcttctgggtgacgaaattgagcgtgatgctcgaaagaatgtcaagactccccctggtcattacgtttccaacattcctggcgtttttgctgcgggtgactgccgccgcgggcagtctcttatcgtttggggtatcaatgagggccgccagtgtgcccgcgaagtagacgcattcctcgtgggcaccggctctaggcttccagtgactggcggtattgttcgtcgtccagccattgacgcagttcctcagagtactgagaatatcctcgctgcataaagcagtgcttctgtagttactattagccaggatttggtggttacattactgggatcgtttatgataccaattccaacggagttcggcgtcggaaagataaaaggcaaattttggtggatatatatatactcaatttgggaaaatg

SEQ ID NO: 22165 - DNA, 290 bp, Sorghum bicolor
  Clone ID: 13585716
gccaacaatgccgcacatggcccacccagacttgcccctcctccatccacttcagttggaagagggcgtggtagaaatcagggacagtcagcactctctcgagcatcaaggccgcctcattccaactcgtcatcaggacaacaacctatcctggatttactttagtaagagaggctcgctgctgttcttcctgttccgattgtcaatgtgtacatcttcaaacctttgtaaggtgagcgtcatactgttcttttggacatgcatgtggcgaaaattttttttgttcattt

SEQ ID NO: 22166 - DNA, 524 bp, Sorghum bicolor
  Clone ID: 13585740
gcacgaggcttagatagacccagccatcaaattccttggaccgaattttgctccttgttgcttgaacgcttcgctcgcaaccagcatggaacgctcattcgccaaatgttccacatcagtcaaaccacaactgttgtcgactatgtcgaccgtttttccaccctcattgatcagctcaaagcatacaccaagaatcctgatatgcacacttatatcactcgttttgtggatggccttcggaccgacattcgttctgttgttgctttgcaatgtcccaatgacctggatactgcgtattctttggctttactgcaggaggaggtgtcggcactggtgacgaaaaatgaatatcccagggtgggtaataccccaggattcaagaccaatttcaggcacgctcaccccctacctcgacctccccaagctgacaagcctgcggaaccacctgctgcacaagctgtgacaacaccaaccacaacagacaagttatctgaactccgtcagtatcgccgtgcacaaggatt

SEQ ID NO: 22167 - DNA, 495 bp, Sorghum bicolor
  Clone ID: 13585743
gcacgagggttcctgcgggagctccccaagtcgctcacctacccggacatcgcgcgcctgctctgcagcccggaggggcgagagcgccttgacatttccggtaacgcgtccttcgcgctctactacttcctctcttacgtcgccatggagcaggacatgaggtccaacaccacggtgatgctgttggagaggctgaatgaattcgcggagcagccatggcagaagcagctggcgctgcaccagctcgggtgcgtgatgctgcagcgcggcgagtttgaggaggcgcaggagtggtttgaggccgccgttgccgagggccatgtctactcgctcgccggagaggcgcgcgccaagtacaagcgcgggcacaagtacgctgcgtacaagctgatgaacagtgtcgtcggcgactacgacgaacccgccgggtggatgtaccaagagcgctccctgtactgtgtcggcaaggagaagctggctgatctgcaggcggcg

SEQ ID NO: 22168 - DNA, 481 bp, Sorghum bicolor
  Clone ID: 13585750
gcacgaggtctgtctacagttatggatcgactgttgttgattccttgagtaatgatcaaaggtctgtccttgcttttgcacactttctgtaccactcatttaagatggagcacatagagagcttctggttatcaaagctctgctgtgccatgccgatagttgacagatatggcaatgttgtcaacaaaacagaaaacattatagttccagctaaggggagcaaatgggttggtttgctgggtacatacccatggaggaatcaaggctacattgaattgtcagcagattacaagtcagtaggccactttgctgggaactacacatctgaggatcagctgttggaatttctcaagatacacctgcatgcctcagatgtgccattgatacgcccaccaaatgtgaggttccatactgtctcatcacctctcaatgtggacaatacattcttgctactggaatggatacggaatatcaggtcaaa

SEQ ID NO: 22169 - DNA, 529 bp, Sorghum bicolor
  Clone ID: 13585754
gcacgaggctccgacgcaatgcccaacgttatgttcttgcaaatctgaagttccaacaggcatcagcaaagagcgacatccttgagcagcataagattatcagagctttttttgagcacgtgaggaaagattcttgggatattgttttggatatcgtcaagtccgctgaaagggatattgcacaggatgcttcgctttcgagaaacgcgaagacgaagttcttcagccggtggaatctggagagactcgtgacgctttatggatacgacagagaatctgataatccgaaccctaagggcgtgtccatcaccaacgaggtgcacaagcttttgatgaagatttgtaccaagtttgaccatggtgttctcctgccggagacaggctggtaccccaacggaagcgatcccgagtcattgccgactgaggatgatgcttgtattgagttgggtcttgactccgccctccatgtcgacaaatacaaggagtcagtgccagtccggaatggcagtctttcgtatcttatccagac

SEQ ID NO: 22170 - DNA, 484 bp, Sorghum bicolor
  Clone ID: 13585758
gcacgaggggaggattagagaagtccatcaccgctggttctgatggtgcatctaggaagcgctctctttcagatttcttgccaagtatcccttcattacgaggactgcaagctagtgagccaagaaagcggagaaaaaaatcagaatcagtgcagaatatcctgcctttgcaggcgcactcctctaatttgcaatcaagagtcagcctcacctatggagatgttcttgcagaaagaaataattgtgttccagcaactatatatgcttctgtgctactacatgtcataagacactgttcattatgcatcaaacatgctcaactaactgctcagatggattcccttgcaattccatatgttgaagaagttggtctgcggacaccatcatcgaatctttggttaagattaccttttgcacaagatgattcttggaagcatatatgcttgcgccttggtaaggctggaagcatgtcttgggatgttag

SEQ ID NO: 22171 - DNA, 294 bp, Sorghum bicolor
  unsure (1)..(294): unsure at all n locations
  Clone ID: 13585764
gcacgaggctccggctctcggctccggctccgcgatcgaggtcgaggtcgaggcccacgcagcaatctggagtagccttctggaaatttccaccaatccgattccgagcggcagaagattttcccttctcccggccaccaaccaaccaaacccaagcaagcagcccctgagccaccgccgcctccgcctcggatcacaattcacgcctggcatgcgccgcgccgccgcccccgccgccgcagcctgaggaggaggaggtggaggagaaggaggcggtggtctggaggggatgng

SEQ ID NO: 22172 - DNA, 428 bp, Sorghum bicolor
  Clone ID: 13585771
gcacgagggcaaatcttcactcccagtctttttcatccagcgtctgcgcccaaaaagctcttaaatcgcagactttttcaggttcgcgaaggggctcggtcgcttttattaagaatcactttctttagtcttggattttggcgttgtggcttaattttaccatggctgacgtccttctgttcgagggccccatgggctactcacttttcaaggtcaaccacaagggcgacagcgttggcaatcgcctgaaggaagttcaagaaggcgtcgatgatttggccaagtttggcaagatggtcgagctggcaagttttatgccttttgaaaacaacaagcaggcgcttagtgaaatcaacgatgtctcagaaggtgttgcttctgagactcttatttcgtttctcgagctaaacctgccgaagccgaacaag

SEQ ID NO: 22173 - DNA, 526 bp, Sorghum bicolor
  Clone ID: 13585790
gcacgaggcattcactctcaagatgtccttcggaaagctctacggcgccgctgaaaacggccgtaccatcgccgtccttgttgctgcgaagagcaacgacttggacctcgagctggtccgaactgagcccaactcgactgctgctttcaaccagtcggctgagtacgccaagatcaaccccttgggcaagatccctgcttttgagggtgccaatggcttcgtcctgtccgaggtcatcgctttggccatctatgtgacctcccagaacgagaagaccaccctcttgggtaagaccaagcaggactacgcctccatcctccgttggttgtcctttgccaactctgagatccttccccgcttcggcgcttggtaccgccccctcttgggtctggacggctacaacaagaagaacgtcgaggaagctgccaagggtgccctgaagaacactgccgttctcgagtcttacctctcctccaacacctacctggttggtgagcgtattaccttggctgacttcttcactgct

SEQ ID NO: 22174 - DNA, 320 bp, Sorghum bicolor
  Clone ID: 13585794
tcctggctatctacagttagctttgaagttacatagacaaaacataagagatggcaatcgaagcaacccacggctctgaagtccaagataccgtcgcgatcgggccagagcaagaagccctacaagcctggagggagagatgcaatatcaacactgatgctcagattcgactggtgaagctgtcgcatatgcgataccagcatccggatcttgatgagatcaccgtgtttcttcaggactttggaatggaaatcgtgaagaaaacagatgaccagatttggtatcgaggctacggaaccgatccgtacgtttactatgcg

SEQ ID NO: 22175 - DNA, 508 bp, Sorghum bicolor
  Clone ID: 13585799
gcacgagggcacctcctgcaccacagcagctccagctccaaatccaatggagttcccagctatcctccctcgccgcaccggcaggcctgtgcctgctctcagctcttgccgcagccttgctggtactcaccctctacgtcctgtgcgtcgtcgcgtccttcgccgtcttctgcgccagagagttcgcccggagagacccggaacggccaccgctcatgggaacgatgttccggcagctcaagaacttcgacaggctgttcgacgagcatgtcaagtacgcgctggcgcatcgcacctgcaggctggtctacgctggacacagcgagctcttcacggctgaccctgctgtcgttgagcatgttctcaagaccagtttcagcaaatacagcaagggagcatacaatattgaaattatgaaggatctcttcggggatggaatttttgcaatagacggggataagtggaggcaccagaggaagctggcaagtcatgaattctcaaccaaagt

SEQ ID NO: 22176 - DNA, 505 bp, Sorghum bicolor
  Clone ID: 13585801
gcacgaggctgaaaggggacctggtgtttctagtcaacctggtcatgtcatccaccgaagggagcctagtgggaagttgtataattatgcagcagcatctaaaggggctaaggtcctggatttcaacaaggaggctaagggtgcttccaatatcttagataaagacaaagacaagtacctccgtaatccttgttcagcagagggaaagtttgtcatcatagagctttctgaagaaaccttagtagatacaatcgcaattgcaaattttgagcattattcttctaatccgaaagaatttgaattgctgagcagtctgacatatcccacagaaaactgggagactcttggaagattcactgctgcaaatgcaaaagtttctcagaatttcacttttctcgagccaaagtgggctagatatttgaaactgaacttggtcagccattatggttctgagttctactgtacgctcagtatgcttgaagtgtatggaatggatgctgtaaaa

SEQ ID NO: 22177 - DNA, 440 bp, Sorghum bicolor
  Clone ID: 13585821
gcacgaggggaagctggtgctggtgcaggtcgccaacccggcgcgaggaagggggaaggacgtcgccgaggtgcagaccgagacgtacgccatggtggggcgcatcaacgaggtgtatggtgagccggggtacgagccggtggtcctgattgatgagcctttgcagttctacgagcgcgtggcctactatgtcatcgccgaggtgtgcctggtgaccgcggtcagggacggcatgaacctgattccctatgaatacatcgtctcacggcaaggcaacgagaagctggacgggatgctgcggcaggggaagccagaggagaaaaagagtatgcttgtggtgtccgagttcatcggatgctcgccgtctctgagcggcgccatccgggtgaacccgtggaacatcgaggccgtggctgacgccatggagactgcccttgtgt

SEQ ID NO: 22178 - DNA, 418 bp, Sorghum bicolor
  Clone ID: 13585825
gcacgagggtttaaatggccagtattgtgtaagcattattgcaagatattgtgatatgattatctgatcttttaggcatttaagaagctgataaagaaagtcattagatggaagacacacagcagatggaagcatgggccaactaacagctacggccaagagaaacttcttgagttctttagcagttatgacagtacgaacgaaatttttactttcctcagattggtagcagctatctggatatgctcccacagtaaagagtttaaaccacttgttcctgagcttagtgaaggttatactctcataaactggtgctttgacgaagttatccatcgtaaggtgttcacagatcatgttcagataacagcaatagtcagggcgcttggggtgccactgcgagtggaatacctctttcaag

SEQ ID NO: 22179 - DNA, 525 bp, Sorghum bicolor
  Clone ID: 13585831
gcacgaggagagatttttcactgtaccgagcaattggtgtatggggacattgtgtgggcaaagcttggcaaacgtcagccgatgtggccaggagtgctgatcgacccaactcagcaggtcgctgctgatgcaatgccaccacagcctcgccgtgtcgctgtgctttgtgtgatgctatttggctggtgcacagagttcagtgatgagaagaagtacgtgtgggtgaggcaggggttgatatttccattttcagactacatggaccgatttcaagggcagacagaactaagcagttgcaaacctgctgatttccggagggcagtagaagaggcctttttggctgatcagggattctcagaagtagtgattgattgcagcactaagggccaacctgtggtgtgtcattctttcccagatgatttacatgaagtgactggttcaaatgagttggagtaccagccacagattaagcggtgcagaagagcactgcagtgtgagagttgtggaaactgcttcccgaacaag

SEQ ID NO: 22180 - DNA, 604 bp, Sorghum bicolor
  unsure (1)..(604): unsure at all n locations
  Clone ID: 13585832
gcacgaggattgatggcagatctagcagcacatgctcctcctggtagtcttggaaggcttcgcctaattcatctaccagatcgtgcattacaggtgacattctccttagcggcagcggatcttcgcagcaacagcagcggcagcggtgtcctcggcgcgcagatgcggggactccctctcccccctcacgatgtatggcgaccagggactgtgattttggcagaagaggatctgctggtggtgctgtctaccctgtgtggctagagacctagcgctggtgacgcacacaatctgaaccatctcatgttgctacttgctagctgggtaattgatttttagtcctattttcttttcctgttgaatttgtagatcctgacacctacattctgaatgtaagttcagttctaattgataattggaatgtgtgtatttacctagacaaacggatgaatatattcaaatctcattttattactgaacttgagttattagcgtagttntgttacagaattcgatatctataataattactatttgaacatacaagtagcaagaaggatcatgtcagtgcaagtgatacagaccagcctgaaaatgatgatgg

SEQ ID NO: 22181 - DNA, 375 bp, Sorghum bicolor
  Clone ID: 13585837
gcacgaggcccgaggccgaggagcgagcgagcgagcgccgagccgccgggcctcggaagcatcgaccgaccgacggcagcggcagcggcagcggtgccatgaggctgctcgtccccgacggcgcgcgccggcagcggctgctccagtgcgaggcgcgggccccgtcgcccgcgccgccctccccgtcgccgtccacgtcgctggccaggacggtcgtggtggggatcaggcgcgacgccgccagccgcgagctgctcacctgggcgctcgtcaaggtcgccaatgcacgcgaccgcgtcgtcgcgctccacgtcgccaccgccgacgccgacggattgctcgtggggctggacgagcggagcagggccgcggact

SEQ ID NO: 22182 - DNA, 437 bp, Sorghum bicolor
  Clone ID: 13585838
gcacgaggcagcaatagctgttcaccccgaggatgaaaggtataagcatctgcatggaagatatgcagtccaccccttcaatggacgaaaactcaaaataatctgtgatgctgagttagttgatcccactttcggtactggggctgtcaagattactcctgcccatgatccaaatgactttgaggttggaaagcgtcataaccttgaattcatcaatatattcacagatgatggaaaaataaatagcaatggaggtgcacaattcgatggaatgcctagatttgccgctcgagttgctgttattgaggcactgaaggaaaaggggttgtataaggacacaaagaagaatgaaatgagtttgggcgtttgttcaagaactaatgatgtagtggaacctatgataaaaccacagtggtttgttaattgcagctccatgg

SEQ ID NO: 22183 - DNA, 512 bp, Sorghum bicolor
  Clone ID: 13585845
gcacgaggggcgactactatgatgagataggtatttgtatttgttcaatatactatcctcttgggagcgttacaaacttacaataaagtttcttttactggttaaatattaggacctggtcaattaggaacatttagataatgttctattgttcacctatcttgaattgtcaaaggtctttcactcactttttttttcaggaaaatgctataagagttaagaggctaaactagctattcaggtctgtatatgtaacacaaagttagatgatgggcagaacatggaataatctagtgcgtcgttgaattttttttatatagaaatggaaatatttaatgtaccataagctcacaaagagttacttatttttttaaagtgaactgaaattatatatctattgatgttgtacttatgcaagaagggacaaatagcaatttttttttttaaaaaaatatatatttggcaccaatactgaacattcagtctgtctgtttggtgatatataatggtat

SEQ ID NO: 22184 - DNA, 525 bp, Sorghum bicolor
  Clone ID: 13585849
gcacgagggaggcgagtggttgaataatcttcggtttggggtgtttggccttggaaatagacagtacgaacactttaacaaggttggaaaggtggttgatcaactcctcgcggaacaaggtggcaaacgtatcgttcctgttggtcttggagatgatgatcaatgcattgaggatgactttaatgcatggaaggaacttctatggccagaattggataagttactccgccaggaagatgattcttcaactgcaccaactccttacacagttgctattccagaatatagagttgtgtttgtcaaaccagaggatgccatgcacattaacaagtcttttactctcagtaatggccatgctgtctatgacattcaacatccttgcagagcaaatgtggctgtgcggcgagagcttcatacaccagcttctgaccgatcctgcattcatttagagtttgatattactggaactggcctaaaatatgagacaggagatcatgttggtgtctatgctgaaaactgcataga

SEQ ID NO: 22185 - DNA, 511 bp, Sorghum bicolor
  Clone ID: 13585851
ttacgttggttctactgcgtaacctgagctagggaccgacaatatggcaggaggacctaagaaacccgtcaatatcttccggctagggaaccttggcgatccaaaggaggtgttcaactggaaactatggttcgcagttgtttcctttgccctcatgggtgccgcccgtggtgtcgatgagggattgatctcgggggctttcgactcggcggatttccaacgctacatcaattatgactcgtatagcacggtcgagcagaccaatatcaaggccaacgtgtcggcgatggtccagattggctctgttggaggggctctttttgctttcgtggtatgcgatcgaatcggccgtatctgggcaactcgtcagctctgcttgctatggattctcggtatcgccatcttcatgggaaacagcggcaagttgggagctgtgtacgctggaagatttgtcgcaggattaggagttggacaaacagtcgtcgtcggtcctgtgtatctggcagagatc

SEQ ID NO: 22186 - DNA, 495 bp, Sorghum bicolor
  Clone ID: 13585864
gcacgagggtgccagctactctgccacagtggtcattgcccgccgtgcttggagactatattcactgatctcacttgtgcctgtggcagaacttctctcccaccacctttgccttgtggaacaccaacaccatcttgttcgcatcagtgttcagttccccagccttgtggacatccagcctcgcattcatgccattttggggactgtccgccttgtgtggtgccggtaatgagagaatgcatcgggggacatgtgatgctgaggaacatcccttgtggatcgaaggatatcaggtgcaaccaaccatgtgggaagaatcgccaatgtggagtccatgcttgcaacaggccttgtcatcctcccccttgtgatcagccacctgcaaatggagatgctagctcaagctctggtggcaaagcttcttgtggacaggtatgtggtgccgcaaggagagaatgcaagcatacatgcactgccccatgccacccatcgtcc

SEQ ID NO: 22187 - DNA, 505 bp, Sorghum bicolor
  unsure (1)..(505): unsure at all n locations
  Clone ID: 13585867
gcacgaggggaattgcttgtatgtcatgggcactggtgttctggtatgctggagtgttcatccggaacggccagacagatggtggcaaggccttcactgcaattttctcagcaatcgtcggtggcctgagcttggggcagtcattttcaaaccttggagcattcagcaaagggaagattgctggctacaagttgctggaagtgataaggcagaggccaacgatagttcaggacacggcagacgggaggtgccttgatgaagtacatggcaacatagagttcaaggaagtggccttcagctatccttcccgcccggatgtcatgattttccgtgatttttctctcttcttccctgctgggaagaccgcagcggtggttggaggcagtgggtctggaaagagcacagttgtagctctcattgagcggttntacgatcctaatcaggggcaagttttgctggataatgtagacatcaagacgctgcaattgaagtggcttagggagca

SEQ ID NO: 22188 - DNA, 395 bp, Sorghum bicolor
  unsure (1)..(395): unsure at all n locations
  Clone ID: 13585874
gcacgagggccgcctccgactcgccccctgatggcaggacaaccccgcgagcgcgggagtcgctcgtcccggaagggccgctccgcccgcgcggtgcccgcaccggcgcccccgccggcctctgatcccgatccggccgccggagaggatgcggctccgtggctccgcgccacggcggacgagcttgaggagcgcctgctcaagaggctggatgaggcgtacgcggcggccctggcccgcctcgccgacctcggccacggcgaggaggcatccctcgaggccgtcctccactcgggccactgctacggcaagctcaacgaccccgtgtccaacatcgtcgccaacgcccgcgcctacctctncgaccctaaccacgccaccgcgtccggtggctt

SEQ ID NO: 22189 - DNA, 465 bp, Sorghum bicolor
  Clone ID: 13585876
gcacgaggacaggggaatccttccttatcccgccgccgccgccgccgccagctgcgcctcgtcgtcagagggttctcatttctgctccctctgcctccggccctcgctgcgcctccggctggcgacgggtacgacaaacccgaggcccctctttccaccacccaagttccctttcctctctctctgcggaaggtgtcggtgctgccctctggtgtctggagtgctgtgcagatccacccagtcggacctggatcgatatctccgtttgttgggtcaacaaattctggggttcagctaaaccccaaatccgtgcctaactgccactctggtcctgcaaggtttctctaggatttttgtgcaacaacagccatgtggaggctcaagcagttcatccccaaggagcagcccagtggcctggagggtcggaccgtcgatgttggcaatgtcaaggtgcacgtccgggag

SEQ ID NO: 22190 - DNA, 522 bp, Sorghum bicolor
  Clone ID: 13585879
gcacgaggggaaatcgatttgtccacatctcaggcggacaccgccgtgtcggtcccgcgtcctaaacctctcacctcgccggcgtccggcaggcgcgcgaagccgcgaacgatgctccgccgcgccctcctctcctccgcctccccagcactccacggcagggcacgaatccgagccctgcttccccaatggagcagctacgcctccgtggcctcctcctcggccccgccgccggagcagccgccgccgccaccaccacctccatctccgcctcgaggtccgtcgaggtcgggcggtggtggtcccactgtctcgtcgctgaaccctgcagaggttgccaagttcgcttccatcgccgagacttggtgggattctagcggtccattcaaacctctgcatgtgatgaatccaacccgactgtcttttatccgctccactctttgtagacatttcaggagggatccaaattcgtccaagccacttgaaggtctcaaagttattgatgttggatgtggaggtggc

SEQ ID NO: 22191 - DNA, 485 bp, Sorghum bicolor
  Clone ID: 13585883
gtcgggccagtgtctccttatcctatttcagtttgttctttattctttggggtgttggtttattctatgtcctcgtttaagcttgtaaacatgctaaatgccagttctacttgattgcgataatatatttttatgccttttacctcctttgtcacttgaagacaaacattaatctttgcttttgccacaacttataattggttttcagcactttagttggatatcacatgttgaccattcgttttaagccaccacatgatgctttaatcgactgtgggctgttcaactactaaaaagatcattaagataattatgagttaaaaaacaaccaccaaaatctaaggtgttttttgttttgaccttagccaaacttcgctttgcccaagtttataaaaaagtgcaccaacatccacagcatcaaatttgtttcatcaagtccgccatgatagtgcatttatttggtacagtaggtgctaaacccctct

SEQ ID NO: 22192 - DNA, 486 bp, Sorghum bicolor
  Clone ID: 13585885
gcacgaggagaagataaagttcatctgcagctttggcggcgcgttcttaccaaggccaagtgacggggagctccggtacgttggtggcgagaggcatctggttcggattgaccgggacgtgtcgtggcgcgagctgatctgcaagacaacaaagctaatcaggcaggatcacacgatcaagtaccatctcccaggggagcaactgaacatgctcatttccatcacctccgacgatgaccttcgcaacatggttgatgagtgcattgtgctggaagcaagcagagagagacttaccatgtaccttttctccacgaacgaggacgagcacggtgtgcacttccttgttaagcgctcatcatccgaggcggaaaaggaagcgcaattcattgctctcgtcaatggactcactgcaccaattgtggcatcaagaatgcacagccttggcagcacgtcagccagtgatctagatcagatgatacttggtgc

SEQ ID NO: 22193 - DNA, 519 bp, Sorghum bicolor
  Clone ID: 13585888
gcacgaggggaggctctagcgacgaccctggcgtcctcgcgtgattcctcaggggaggaagagaagagcaagtgcccgcactcgatcgtcctcagcggtgacgagttccgggagagggggcggacggtggagctgccgtgcgggctcacgctgggttcgtatatcacggtcgccgcgacgccgcaccaggcgcaccctgagcgggatcctaagatcacgatgctcagggagggggaagagccgatcatggtgtcgcagttcatgatggagctgcaggggctcaagacggtggacggcgaggatccgcccaggattctccatttcaacccccgcctccgcggcgactggagcggcaagccggtgatcgagcagaacacctgctaccgcatgcagtggggcactccgcttcgctgcgagggctggaggtcccgtgccgacgaagagactgtggatgggttggtcaagtgtgagaagtggattcgggatgatgaaggaccgtcggaggagtcaaaaacgtca

SEQ ID NO: 22194 - DNA, 497 bp, Sorghum bicolor
  Clone ID: 13585906
gcacgaggttttcaccccgtgattcctcgtgattcctgtctttcgtgtttttctcgacttccatttcaacaaaccctcctgaaatttcataatgtcgtacggcggtggttatcgcggtgactcctaccggggcggttactctaatggcggcggttccaacggctactctggtggctacggaggcggcggcggcggttatggaggtggctatggtggcggctacggtggcagaggcggcggcggcgctgctgctgctggtggtgaccggatgtccaaccttggctccagcctaaagagacaagattgggattacagtgccctccccaaattcgagaagtctttctacaaggagcaccctgacgtcgccaaccgttctcagcaggaggttgacgaattccgcaaggccagtgaaatgtccgttcacggtagaggtgtccctcgtccggtcgagacttttgacgaggcgagcttccctcagtacgtgctgtccgaggtca

SEQ ID NO: 22195 - DNA, 541 bp, Sorghum bicolor
  Clone ID: 13585927
gcacgaggctcgaaacggcgaaacgttccaagggttttaggcagcagcagccggagggagatgggtgagcgggcgaaggaatggctcctcgccgccggcgccggcgtcgccgtcggcgcgctctctgccgccgtcatgaatcacctctcgagatccaagcggagagaggggtacgcgcgcaacctgctggaatccaatagaatgacgactgggaacgctcagtccacgaggcatctgggtgctgttggtagcttggatcttctctctgatgaagtggtctccgaacagcttacaaggaatatacaattttttggcattgactctcagaagaaagtgactaaatcctatgttgtggtcattggtcttggaggggttggcagtcatgcagcttcaatgctcctgagatctggtgttggcaggttgcttcttgtggattttgatcaggtatcactctcatcactaaatcggcatgctgtggcaaccagagatgatgttggaacttcaaaagcattatgcctcaagaagcatttttcaatgatat

SEQ ID NO: 22196 - DNA, 545 bp, Sorghum bicolor
  Clone ID: 13585930
gcacgagggtggagcaacgttgtcaagtagagaaacctgaacattttcagcctactgcagtagttagaatcccttctctacgctctagatccattggaaagggtgagaaggtggttgttgcaccagaaatagaagcagccacttctaagattatacaagaagaggaaagggagagtggtcaagtaagttggcgagtgtacaagctatacatgacagaggcctggggctggtggggagttgtgggcatgcttacctttgcagtcgtgtggcagggctcggaaatggctagtgattattggctatcatacgaaacgtcaggaagcattccatttaacccatcattgttcattggagtgtatgcggccatagcgactttttcgatggtccttcaagtaatcaagactcttcttgagacagttttgggacttcaaacagctcagatatttttcaagaagatgtttgacagcattctgcatgcccctatgtcatttttcgataccactccatcaggaaggattctcagtcgggcatcatctgaccaaacg

SEQ ID NO: 22197 - DNA, 464 bp, Sorghum bicolor
  Clone ID: 13585932
gcacgaggggaagtgtttctgtccaatcgtgggcaaatgccagcagtaatgatgccgcaaaaacatcctcaacaaatatagaaagcgacacatttgatgtttggcaagattttgctaaattcggtcatctgcaagaaaaaatgtctagtcttgggggagaaccgagtagtgtgtcacctgaaccagctaaagaaaatgattccttagatttgtggcttaccagcaacttcaaggaatctaaaagcattgatgttgttgggagaactaatgcctcatctgatggatggcaggattttgccagttttgatcaagctcagagaagtaatgaaattcctgtggaagggcaccatgtgaaagatccttcaggggctgaaactatggacttatgggcctcaagtcatgctaatgaaaagaaccttgaacagataagtggaaataatgatctattcgatgactggcaagat

SEQ ID NO: 22198 - DNA, 420 bp, Sorghum bicolor
  Clone ID: 13585940
gcacgaggatcttgaggactacatcggtatgatgcacttgtcggtgtatctcgtatcgctcgaatgatcatggatttttcaaccatattgaagatttttttctctttagaccctagcaccacttgtctacatcacctactaccaggctcacggactaacacctctaggtgaatgtgcttgcttttttgacccctacgacttttgatgattaaaatcacacctatacaagttactattgcttttcttcacagaaaataaagtgagcacgttacaaaaagaaatctttttctcaagagcactatgcattcttcgaacaacctacttcttcttcttctgttgcgtgcgcagtgctgggcgatgccctttgctgtgcgatgcggccggctggacatggctacgccgcccccatgtgtgttggct

SEQ ID NO: 22199 - DNA, 429 bp, Sorghum bicolor
  Clone ID: 13585941
gcacgagggagacttccattgcatcatcaatttcatatctcgataatggcgttgtttatgttggttcacggtttggcgattcacagctggtgaagctgaacctccaagctgatgcaagtggttcatttgtggaaatccttgaacggtatgttaatcttggaccgattgtggacttttgcgtggttgaccttgataggcagggtcaaggtcaggtggtcacttgttctggggcatttaaagatggttcccttcgggtggttcggaatggtatagggattaatgagcaggcttcagtagaactccaaggcataaagggattatggtcattgaaatcttcgttcaatgatccatatgacatgtaccttgttgtgagctttataagtgagacacgattcttggcaatgaacatggaagatgaactagaagaga

SEQ ID NO: 22200 - DNA, 492 bp, Sorghum bicolor
  Clone ID: 13585942
gcacgaggaccgtaacccgatcagtcgtactcgggactggggtgagattaccagccgtctaagcgaggatgaacttaagtaccagtccgctcgttgcatggattgtggtgtcccgttctgtcaatcagacactggctgccctatttccaacatcatccccaagtggaatgaactcgtgttccagaaccaatggcaagatgctttgaaccgtctgctgatgactaacaacttccccgaattcactggtcgtgtttgccctgcgccttgcgagggtgcatgcgttcttggtatcaacgaagacccggttggcatcaagtccatcgaatgcgccatcattgatcgtgggtttgagatgggctggatggttcctcgtcctcccaagactcgtaccggaagaactgttgccattattggatccggtccagccggtctggccgctgcggatcagctcaaccatgctggccacagtgttacggtttatgagcgtgctga

SEQ ID NO: 22201 - DNA, 318 bp, Sorghum bicolor
  Clone ID: 13585950
gcacgaggagatcttgtgccatccctggacaaagaaggtatactgggcaccttggagactattcggcgttgcactgctgttgaccatactgcgccaactcttatgtgcacacttggtgttgctaatgcaatctataaacaatgcggtgttgagtttgctgcggaatacgtgattcctctcatcttcccattgctcacagcacatcaactgaatgtacagcaatttgccaagtatatgctatttgtcaaggacattacaagcaagattgaagagaagcgtggtgtgacagttacagataatgggaacacagaggtaaaa

SEQ ID NO: 22202 - DNA, 302 bp, Sorghum bicolor
  Clone ID: 13585961
gcacgaggcaagattgcaccaggaaggcgataaaatggatgaacgttctggtggaagccctcttcgtgctcttattctgacacccaccagggagcttgccaaacaggtatgcgatcatctaaaagatgcggccaagttcttaggaatccatgttgttccaattgttggtggtctatccatggaaaagcaagagcggcttttgaaaaacaagcctgaaattgttgttggaactcctggaagattgtgggagcacatgtcgatgaacaatcaacacctagttgagctgcattcattggcattct

SEQ ID NO: 22203 - DNA, 550 bp, Sorghum bicolor
  Clone ID: 13585969
gcacgaggcgcggcggctgatgctgctgtccctggcctgctgctgcagcatttcgccaggcgggcggatcttcgctgctgcggacactgaccccaacgatcttaatgtcctcaacacgctcttcaccagtctgaattctcctgggcagctcacaggttggcaggcaaatggcggcgatccttgtggccagtcatggaagggcattacttgctcaggatcaggggtcactaaaatcatattaccaaacttgtcactcaccggaactttggcctacaacatgaataacttgggttcattagttgagcttgacatgagccaaaataaccttggcagtggagctcaaataccgtacaatcttcccaatatgaagcttgagaaactcaatcttgcaggaaatcaatttggtggaaatttaccctactcgatttcaacgatgcctaatcttaagtatttaaaccttaatcataaccaactacaaggaaacatcagtgatgtattttccagcctttatagtttgtcagaactggatctctcctttaattctcttagt

SEQ ID NO: 22204 - DNA, 364 bp, Sorghum bicolor
  Clone ID: 13586006
gtcaccagcaactcaaggatggggtacgccttctccagggacggagcggtgccattctcgcacgtttggtacaaggtgaacaagcaggaggtgcccttgaacgtcgtctggctctcagtgtccgtggcattcgccatggctctcacgtcgctggggagccaggtggcattccaggcgatgctgtcggtggcgacggtggggccgtacatcgcctacgggctacccatcgtgttccgcgtgaccacggcgcggagatccttcgtcccggggccgttccacctcgggaggtacgggctcgccgtcggctgggtcgccgtcgcctgggtggccaccgtcaccgtgctcttctccctgcccgtggcgt

SEQ ID NO: 22205 - DNA, 333 bp, Sorghum bicolor
  Clone ID: 13586009
ggcggcgatgcggcccgtgaacctgggacccgaggtgatcgccgcggcggccgcggagaagccccggcggaagaacgtgcgcatctcgagcgacccgcagacggtggcggcgcggctgcggcgggagcgcgtgagcgagcgcctgcgcgtgctgcagaagcttgtccccgggggcagcaagatggacacagcgtccatgctggacgaggcggcgagctacctcaagttcctcaagtcgcaggtccaggcgctggaaaccctaggcacgaccaacgacacgagcaccagcaacagcacagcaacagcaagcaggtcgcagcaatacaactatta

SEQ ID NO: 22206 - DNA, 485 bp, Sorghum bicolor
  Clone ID: 13586020
aactgagctagctgggaggatcctaaatatccatggcattagtcatggtacagatggctggacatatcagtggggttccacttttagttgcaagcaagcttattcagctatacagggtatcatgacgaagcaagttcaatttacctggctttggaaaaacagttgcaggggcaagcataaattcttttttttttttggctcctcctggagagtatcaatacaaggaacctgctgaagagaaagcatttcactttgccatcttataactgtgttgtttgtcaaggtaatgtggaagaaacggtggagcatttattctttggatgtccgtacaggagtgctgttggcctttgatgaatgtaaagtggcctcagaatgtgtcacttttggatcgttttggctctagctaaacctgttttggatctctgatttttctagagctcgtcattgtggctgcctggtgcatttggaaccatgagaaaccagta

SEQ ID NO: 22207 - DNA, 491 bp, Sorghum bicolor
  Clone ID: 13586036
ctgggtttggaccttcaccatccctttttgatttggaagttcctgccatcatgcccgtggtgaaggaactgtgcggcttggacaacgtagagaggtacctgcagagcctgccgagttccgaatgaagagccattctctgttttccctactcagccgtggaataccatacgtagataacatatgttgtgacgcggttgtgccgaagtcatcagagaagagagaatcataggtgtagatagatagtagatgatatcatcaggtctttgccattttgggttccgagcaagacggacttcctctgggtgtaaaaatctttgggaacatatacatatagcagtgaaactgagactattttctacccattccgttctgttctaattataagtcactttgacttttttggtagcatcgaatttgctatatgtatgatatacaatagcaagttggatgtataaaaaaagaagttaaaatgacttataatttagaaaagt

SEQ ID NO: 22208 - DNA, 326 bp, Sorghum bicolor
  Clone ID: 13586068
caagctctacgagcgccggatcggcaagaacaacctcaagatgatcgcgccgctggcgatggcagcggccgcggccgcgggcgcgtcgccgaggaaggcggcgccggaggtgctgtcgcccagcgtgctcgacttcccgtccctggcgctagggagccccgtcacgccgctgctgtccgaccccttcaaccggtcgccgccgtcggcgggcgaggaggacgaggccgccgagcgcgccgccatcgcgcggaagggcttcttcctgcacccatcgccgagggccgccgccgagccgccgcggctactgccgctgttccccgtcacgt

SEQ ID NO: 22209 - DNA, 576 bp, Sorghum bicolor
  Clone ID: 13586081
tatttgtcactcacagacgtgagggctttctgtcgcgaagaagttgctgactgtttcaattcctttggtgcttcacacagctgctgcatgccttatcctgaattcctgaattttgcaggatggtgcgagtcgcacaggcagatcttttgttgccagatcctaataatcgcatcaaatgtgaattctgggtctacctcctggacaaacacagtggatggggcttttcctggaaagaggttaatgttagaagaaagattcaggggaagcgtcgtgcatttttttgaagcggctacgaattcatttgttctacagaaagagctcagttagacgcttttggtacaggaggttagtagatagcagagaaattgatgcttcgtatctggagtagttttgttgtatctcaaaattaggatacatgttaatatgttcagttcattttttttaaatgcatatcctgtatatgatttagtgttccagtcttcctgaaaaggaacggattcaactgtcaaatcatactccaggcaccataacccaaacaggcccacaggccacaactggttacaagatggtcatgtt

SEQ ID NO: 22210 - DNA, 608 bp, Sorghum bicolor
  unsure (1)..(608): unsure at all n locations
  Clone ID: 13586126
aattctgaacgatttgaagaatgcactcggtagatactacttcaataacttcgctgatgggactaagcaggatgccatggatcttcttcaaggacattacatgacatctgttagtcgagacatggcagtcccaaccaaagcaggacttctggacagttatgcgtccttccgccttgcttttgcattggttatgggagctctaatgttcatgatgatgtcactaagacaagcccggaatgatgttcgccatttgttgctgtcacttctgtgggctggtctttgtattggcatcacacaatttgttaaagccaatggtcgcacgttcactaaccgacctaggtttcacaagtcacgccattgatggatgcaagctcgtcaggcgacctaggtttcacttgttgatacacattcgtttacatgaagtgttgcatttttttggcacggtacttgccctatgtaataagttttcttctattttgtaacaagtttttgtttccttctctcctacttttgattcatactgttctggccatcaggtcttttggtagaattcatttgtaaaaaccaagtgaacacgcttcagcacatatncagtgcattatgatttt

SEQ ID NO: 22211 - DNA, 207 bp, Sorghum bicolor
  Clone ID: 13586130
aatcaacacaattggacatgacgctcgagatgatgtccgatgccattgatgaaacacttgacaaagatgaggcggaggaggaaacagaagagcttacaaaccaggtccttgacgagattggcgtggatgtggcttctcagctttcttcggctcctaaagggcgcatcggagcaactaacaagaaagtcgataacagtcacgcacgta

SEQ ID NO: 22212 - DNA, 568 bp, Sorghum bicolor
  Clone ID: 13586133
tttcctaacgaacctgtgcccatgatgcttgctcaaatgattgggataatcggcccaattgacatggaaatgctagaattggggcaggagacacagaagtatttcactgatgattatgacctttttaccaagaatgaggagacagatcagctagagtatttgatcccagaaaaatcctccttgcgacgacacttacaatgtcctgattcagaatttgttgattttctgtcttatctgttgcaaattaaccccaggaaaagacctacagctgatgaagcactacagcatccatggctttcttttgcgtactaatgagaagccatccggtgctttcttcacatataaggatgagtttgtctcctaatttggagccctcataaagttattgaaaaatatcgattttcttggagtttctcttaattaacgtgaatcattactcttttcctacatttttagaagagccctccttttgtgggggcaggttttgtgtattcagggtaattcttggtgtgaacccctgatctgtgagtgattcatgagtgtatgtaaatatcagaaaattttaccg

SEQ ID NO: 22213 - DNA, 479 bp, Sorghum bicolor
  Clone ID: 13586141
gaataggacgcatttgaagtataactggagcatgtgcagcgatatcctgaactacagcaacaccgatggcaacatcaacatcttgcctacacttcaaagaattgttgagcacaagataccactctgggtgttcagcggcgatcaagactctgttgtgcccttgttgggcagccgaacccttgtgcgagagctagctcacaacatggggttacaagtcacagtcccctacagcacttggttccgcagaggccaggttggaggctgggtgacgcagtatggcaactttctgaccttcgccacagtgcgaggtgcatctcacatggtgccatttgcacagccagaccgggctctcaggctatttcagtcaattgtactcgggcaaagactaccaaacacaaccagtccaccaattgagtaaatgtatctacaaaagaaggtggagatagaaaaaaaaagtagcttagattttttttcaagtt

SEQ ID NO: 22214 - DNA, 647 bp, Sorghum bicolor
  unsure (1)..(647): unsure at all n locations
  Clone ID: 13586166
ttgggaagcatgattgttgtcacaagtcgaagccaaaaagttgcctctataatgggcactcttccacaccatgaactagcatgcttgagtgatggtgattcatgggaattgttctcaaagaaagcatttagtaaaggggtgcaaaagcaagaagagttgataacgatcggtaaactgattgttagcaagtgcaagggactacctcttgctttaaagacaatgggtggcttgatgagttccaaacatcaaattaaggaatgggaggccattgcagaggatgatagggttggcaaagatgaagtattgtccattttaaaattgagctacatgcacttgtcatccgaaatgaagcaatgctttgccttctgtgcggtattccctaaggattatgagatggataaggataagttaatccaactatggatggcaaacaattttattcatgcagatggaactacagattttgtgcagaaaggtgaatttattttcagcgagttggtgtggaggtcatttattcaagatgtggatgtcaagatatttgatgaatatcatttcgctgcacctgcacacaagaaaattgggtgtaaaatgcatgatttaatgcatgacttagcacaagaaactacagatgagtgtgttgttgnaag

SEQ ID NO: 22215 - DNA, 562 bp, Sorghum bicolor
  Clone ID: 13586168
tcgcggcttccccacatgctagtaagaggactgcctgcttcaagtgagggtatgttctcaacgctggacctagtgagtggggataaactcgagtttgttctcatcattgcaccagtgaaagagtcatatgagattgctcgtgccaccctcaagatagcagatgagcttaagctatcagccaaagtatgcgtaatgtggccaagaggttcgactggtgctgaagtggaagagagcaggtctgagttggcgccctggacaaactacatcgatgttgaggaagtacctagggtgtctggtagttcatggtgggagatgtgtcggattagtaggaaaaatgtccttttggttaggcctgatgagcacatagcatggcgaacagaatcggacagggtcagggatgctgaatcagaaattaggagagtattctctcatgttctgtgcctaaataggtgtaagaatttgtaaatttcctttcatttagtgattgggtttacatacaacatcagtgaattaggatagcaaatcattatatttgacaagttactcgctaaaaccaaatttg

SEQ ID NO: 22216 - DNA, 478 bp, Sorghum bicolor
  Clone ID: 13586169
gcacctccagggcgacaagcaggccggtggcaaggactcagctcgtcttgctagtgccggtgaccttggcgagattggacgtcttaaggaggagcttgctaccaaggaccgtgacatcgagaccctgaagaagcaggcggatggattggctcgtgagtaccacaacttgggtgacaaggtctccgataagcctgagggtcctaaaaaggatctataaatgtcaacaggttactgttgagaacctggtgtttaggctgtgctatgggattgacaacgtgacggttggtatttcaaatgcttcgaaagatatgtttgtgcatttagcaccaggtgaatatctgtacaacggatcttcggctttttgggctgggaattgatggatgggtgttttaagggattacatttgccaggagatacaaaacacgaatacttcacttgacatatgacattgctatgacctttacttcggtatgaaaat

SEQ ID NO: 22217 - DNA, 679 bp, Sorghum bicolor
  Clone ID: 13586171
gagttcggatgtgactcatgtgattgctaatacggatgaacgtggggcatgtgctaggacactcaaggttctcatggcaattttagctgggaagtgggttctcaatgtgaactggctgaaagactgtattgaggctaggaaaccaatcccagaagagccctatgagataagctgtgatgttcatggctctgttaatgggcctcgctcaggaaggcttcgagcaatgcagcaggcaccaaacctgtttgctgggttgaccttctatttcagtggccatttcatgccgggatacaaggccaaccttgaagatttgattgccgcaggagggggttccattttggagaagactcagctctcttgtgcatccttgattctttacagcatggagccaccacaaggaaacagtcccaacacccttgagaccatcaataagagaatagctgaggctcaagaactggcagccacggttggctgcaaagccattcctcatacatggcttctggattctattgcatcctgcaatttgagcgtgtgatgctgtactgcctaggttcaaactcaaacataggaatgtgatatctgttctgcttttttttcttttcaaaaaggagattaggatgtgattgacatgttgtcttgatccaaaattctttaaatgttgtagcagaaagcgcaatca

SEQ ID NO: 22218 - DNA, 431 bp, Sorghum bicolor
  Clone ID: 13586173
tcatgacaaccaaccacgccgagaaactcgacccagccctcctccgacccggtcgtgtcgacatgacagtgacatttggatacacctccaaagccgacatcgaggaactcttttccgcgatctactcaactctcgagggtgactgcggctccaagaagcagcgccagcagcagtaccagaagagaaaagaagagctggccgatggcaacggtgctgctgttgttgcccatgagaagaagaaggccgaggtagatgcccaccgtgttgcgagattagctgctgagttttctgcgagggtccctgggggggagttcacggctgctgagatccaggggtacctattgaattataagcatgcgccggcggatgcgattgagggagctgggaagtgggcggagggtgtgctgaagaagaggaaggcataatggaca

SEQ ID NO: 22219 - DNA, 432 bp, Sorghum bicolor
  Clone ID: 13586175
ccgcgacttcatccacgttatggatctcgcccagggccacgtcgcagcgcttgccgccgcaaaggccaaccccgcccgtgactctttcagggcttacaatcttggaacgggtcgtggcatgactgtggccgaagtcatctccagctttgagaaggcatccaaccagacagtccctgccgtccttgctccccgacgcgctggcgacgttggcgcctgcgtggcagccacacagcgtgccgagacggagcttggctggagtaccgcaaagggcgttgacgagtgcgccagagacacctggaatgccctcaatatgccggcagagtgctaggcgcatggaagacatggttgagcttccttctaatacgtgcacaacgaatcggcgtttttggaggcttggggataatttgtttactttactactttggggtttct

SEQ ID NO: 22220 - DNA, 586 bp, Sorghum bicolor
  Clone ID: 13586180
catgttaatacaattttagtgctttttaaatgcatgactatagcagataaacataccaccacttggctatcattatttttttctgaaccaaggttttttatttctgttcatcgatgttatgggttctatgaaatgattaatttatttttcccagcagctgcgctgagcgtatattttagtgtgagctgaatcttggtattctcattttagtcatgacctattagaatacaattttaattgagataaacttataaaatagcagtgtatatacttggtggctaatgtactgttggtagagttggatacatggatgaaatgaaggaaggttttgggagaagagcttcaccgctcaagattctggacagatttggccaagaaactatttgctccatgaattcttgcttgctttgtgctttagatggaattaattcacaactgattttcagttttgtaagtgcttgttgtggatatgtgctgcctagatgccaggacagaatcctgtttatgacagggtaggtcactcaagcaacttttcacagtgaacttgtgtttatgctgaattgtaggtactttgttggcatggaat

SEQ ID NO: 22221 - DNA, 496 bp, Sorghum bicolor
  Clone ID: 13586185
aaagtactgtgaaggatacaccatggttggcccgacctacaggctgggaggctttgggtttgctttccctatagggtcacccatggtgcatgacgtatcccaggccttcatgacacctgcagtgcaggaagagatggcgcggatagagaggaaatggttcggcaacccaggagcctgtgggagcagtagcgatggcatcaactcgtccaggctcgggttcagcaacttcagtgggctgttcctcatcagtggcctgacctctggccttgcgctcctcatcagcctcagcatcctcgtctaccagaagcgagacgagctcagcgctgaagcgtctcgcaccaggtcgatgtcactgcagaggctgcacatgtggcttgaacgcctacgtacgtggtaccaagcacagggagtcacccatcatcaataggcaggaaggtgagtatgagagggatgggtacagatcaagtcagcttcaaggagatgcataagggaatca

SEQ ID NO: 22222 - DNA, 469 bp, Sorghum bicolor
  Clone ID: 13586220
acccttgtgcagttcgaggagcgggtggtggtcggcaacgtgatcgaggaggtggtgtcgatcgggaagagcagggagtacggcctggtcgtcgtcggcaagggccggctgccatccccgatggtggcgcagctcgccgtccgcccggcagagcacccggagctcgggcccatcggcgacgcgctcgcatcgtccggccatggggtgacgtcgtcggtgctcgtggtccagcagcacgacatgagcaacgccgacgaggtgccggtctccgtggtggtcgatggccgtgctcaggacggcgagttcgccaaggacatggccgagccgtgagagcctttttcctctgaatctgaatgctctcgcttctagctaccttgatccagaaggatgatgacgactaaaaatattgctatagttgctgtttaaggttttcgataataagcttgtactaatcgtattattgttaagt

SEQ ID NO: 22223 - DNA, 359 bp, Sorghum bicolor
  Clone ID: 13586221
tagcaaagaaggcagccgcaaaagaaacaggagcccgaggactgcggtctataatggaggacattttgacagaagcaatgtttgagattcctgatgctatagagcggaaagagaaggtgattgctgttcttgtccacgaagagtctgtaggaccactacaccatcgaggatatggagcaaaactttttcgggatgatggagccttggaactgtatgtttaccataacaatatcaaggtgcccgggctgattcagagcaaccccagacgcagacgcatttttaggctctgccttctagtcgcattatcggctgacaaagctttggatttaccaaacattacctgtttttcatcgcatata

SEQ ID NO: 22224 - DNA, 362 bp, Sorghum bicolor
  Clone ID: 13586247
gcgttaacattgaacgcctatgaatcacaaggtttcctgctggttggcatcacaaaactagtgcctgatattcaaatattaagaagagatgatggttgaataatcctatattatcgctaattgagagacagtcgggcaccttctaataggcgaataggataggggcagtgtaagatataaaaggtgctgcggtgttgctagctgtttgtccatagataacaattttgtgtccagcaaatgtaccagccaatctctgtgctggagattggtggttactctccttcgttgcagttgtatcttcatataccttattacttcagttgtgtcttttcttcgctgtagccattgttataataatttta

SEQ ID NO: 22225 - DNA, 511 bp, Sorghum bicolor
  Clone ID: 13586288
gcacgaggcaacgcagatgtggaccccacgaccgagtcgtcgcatcgtctcccccgctcccgccactctcctgctccgcctcctcctccttgccggcgccgccaacgccgcgccgccgctcgtaggcgtttctccccaagatgaggcgtacttcgcgacgcaggtgatcgcctgcagagacggctcgggctcctttccgaggagccggctcaacgacggttactgcgactgcgccgatggaaccgatgagccaggtacttcagcttgtccagaaggcaagttttactgcagaaatatcggagatacccctcgactgttgttctcttcgtttgtgaatgataaaatatgtgattgttgtgatggaagtgatgagtacgaaagtggcatccattgtcagaacacgtgtagaaatataaagtatattgctgaggctgctgatggtggcagcgacctctcagtaacacatttagatgctaatactaacgagtttatgggtaaacatgcaattgct

SEQ ID NO: 22226 - DNA, 407 bp, Sorghum bicolor
  Clone ID: 13586299
cgcccccccagcgcccgcccgcgagcgcgcgcgcgcacgagagagacgagacccaccgcgaatggaagttgctgcggcgaagcaactcctccccatggcgcggggggtccccaactccccgtcctcctccacctcctcctcctcgccctcgtccgccgcctgcgcctccccgtcgccgcgccagcagtcccaggcgcccgtgccgccgtcgcccaagcccgtgccgcgcatcatcgacaccacgccgttccccaccaccttcgtgcaggccgacaccgccaacttcaagcaagtcgtccagaggctcaccggctccgacacgccgccgacgccggcggcggcccagcagaagcccgccaagagcagccacggtcattaccaccaccaccaccaccaccaccacgggg

SEQ ID NO: 22227 - DNA, 425 bp, Sorghum bicolor
  Clone ID: 13586309
gcacgaggcagcggcgccgcgcgttcgttcctcccttcgctttcgaatctcctggcgcaggtgcgcatggtatggccggcatgatcagcttgcgcaccggcccgaggagttcgccggcacttcctcggctgtcgtctgctcggccaccacaagttgcagttcgttttacaagcccgctgtttcgttgtgccaaactttgtaagagccgtaatctactggcagcagcactggaggtctctaaggacgggccctccgcggttctggccaataccctgccttctgaaggggctattgagacattgcggaatgctgatgcggtatgtttcgatgtcgatagcaccgtcatcctggatgagggcattgacgagcttgctgatttctgtggggcagggaaagctgttgctgaatggacagcaaaggccatg

SEQ ID NO: 22228 - DNA, 577 bp, Sorghum bicolor
  Clone ID: 13586311
gcacgagggtcgcaagggtggatgacaatgctgctggtcaagtcagtgttgatgacgatgacgatgacgacgaggatttagcccatatcaccagcgagaacgttcgtgccgccataaggaaaagcaaggaagtgctggcaaggcacaaggtcataatgaagcagatagcagaaaagaagaagctcctctcaactatactagacagttccattcataatgagcaagagccactcagtggtcagagtgatggttccttatcaaacctgaatgcaaatgcagaggtcacagagattggctatgggtcttcacagcaatctgaatttgacaccacttacggagaatccatctacaatcagaatgaatactatgaaagttcaaaacatgacggcactgatttcagtgagaattatcagtataacagttttcctagagctgctcgtagcgtgtatgaactagaagcagataatggtatgaaacaagattatggggtacaactaagtcaagtaagcgaacatgagcagtcagttaacgagggaacaaatgacgatgcatctggtggagttgatgttatgaatgt

SEQ ID NO: 22229 - DNA, 501 bp, Sorghum bicolor
  Clone ID: 13586321
gcacgaggcactcacgcagcacagcagcagcagcagcagcgcacactgttcttgtgccgaggaattatttattgccaccgcatcgaggttcatagtacggggaaattgattgctcattcccctctgcttcctgcatccaccccacccccccacgctgttgaatttcttgggatattttcctccactcggcggcgccggggcagcatttgctcgcgatttataaccgccccgcttttgccgctcctttctgcttgtcctttttttccccagtggggaggttagcatccggcacaagcaaagcgccgggttcttgtcgcagtttctgcacgcgcgctcgcttttttggctgcaagatctgatacaaagaggagagggagagccaagagaggagaggttcttgcgtggagttcttcggcgatgaggcccgacgcccgtctggattcggtggtcttccagctcacccccacccggaccaggttcgatttggttctgatagcgaat

SEQ ID NO: 22230 - DNA, 573 bp, Sorghum bicolor
  unsure (1)..(573): unsure at all n locations
  Clone ID: 13586322
gcacgaggcttctttgaggtctagattggttgaaagatttgggaagaaatcatgcttgaatgtcaccattgatgaaggcactgaagaacttgctcttggaaaagtagctgcaggacatggcaagcagtcaatgtatgttggacatcagttacaggaagcagagcagaatattatgacaactactcctgaaggtacaatggagctggaaaacgatggtgctgaaaaaactggcggcctctctaattctagtagtggtccttcaatgggcaactgtgatcctgaggacaacatttcttctctcaaagagttatgcatgccattggctatggacactctcatttttccttcttcagctccactaaatgccgctagacaaatcaagcgagcattacctgngatttgcaaggacccttcagattacaaaaatgactatctgaccagtgatgcagcgtctgaagttacagaaagtgtacaagatatgatgcatgaccttgttggagaaaatatgaagattctcccaactacccaaaaggataataatatggtacacagtgtgattgatcctttctggcc

SEQ ID NO: 22231 - DNA, 319 bp, Sorghum bicolor
  Clone ID: 13586344
gcacgaggcggatctcaccctgccgctgccgcagcgggacatgatctccctcgccgtgccgctgccgctgccgctcccgccgtcctccgcgccgtcgtccacgtcgtcgtcggggtcgctggcggcgccgtcgtcgctcggcgcgcccaccccgccgacctccgccggctccgcgccggcgaacccgccgccgctgtgcgagctggagcgcgtgcgtcgcatcgggagcggcgccggcgggacggtgtggatggtgcgccaccgccccacgggccgggcctacgcgctgaaggtgctctacggcaaccacgacgacgcg

SEQ ID NO: 22232 - DNA, 499 bp, Sorghum bicolor
  Clone ID: 13586352
gcacgaggcccctcccgccctcgcgccctcgcctccgtactccgcgcaccggccggcgaccctgtgtacgcacctccctctcccctcccgcctctgctgtaccgtgggagctcggccagctgctcagggtggccgggccttggctccgccggtgtcgggtaggatcagcacagccggagctcaaaggcgcctgcgaagtttattaaagaattttaggttcaacggaatccccatgtcccccaataaacccagccatgcttcaggccgggacgcggttttctggtcacaaggaatgaacgcatatcttattgataggctgctttaccatcaagacaatgggaacaggggtgagtctaaattctcatcggtggcatatgatagcatcatcaatggtgtcggtgataagttcggggtgacaattgaccggaacaatataaaaaatcgcctcaagtatatcaaggaatcgttccatgagtgtaggaacctccttggtgaagat

SEQ ID NO: 22233 - DNA, 436 bp, Sorghum bicolor
  Clone ID: 13586356
gcacgaggtgacactacccgttgggctcggctcgcgcggcgccgtcctcccccactctcccctcacacacacgcacgaacacacagcacgcgccgcacccccgcgctctcctctcctgcgaccaaatctgcgcggcgcgggagtgagcacactgagggcggtctcctcctcctcctccccgttcgcgagcggttcgtgtcccgagcgatccggcagccatgaacatcttcaagaagaaggtcgaccccaaagaggctctcaggaccagcaaacgtgagatggcggtcgccacgcggggagttgagcgagagattggttccctgcaaatggaggagaaaaagctggtcgcagagataaagaagactgccaagactggaaatgaggccgcaaccaaaatattagctcggcaacttgtcaggctgcggcaacaaatcct

SEQ ID NO: 22234 - DNA, 483 bp, Sorghum bicolor
  Clone ID: 13586359
gcacgaggctcctctcgcttcgcttccaagttcaccccaatggcgacgcaaccgcttacatcaccgcgccgcgcccgtgcgccacgcgcttgagcgagaggcagagaccgagaccgagagcacccaccaaccacgcgccttcgcggcggcgcatggcggcgcaggggctggaccaggtcatggcgttcctcacggaccacggcttcgccggcacggcctccgcgctccgtgacgacgtccttgcacgcaccgccgccggggacgagagccacgccgccgcattagatccccatctccctccgctccggatgcccgcctccgccgtcggtgctggcgctggcgctggcacgccggcgcccgcgagccccgattccagctccggctcggcgtcctcgtcagctttcgtcagcatgcgctccacgccgtcagggctgttgaatccgtatgggctgtggtcgccgcggcattcgcagtcggacgcgt

SEQ ID NO: 22235 - DNA, 558 bp, Sorghum bicolor
  Clone ID: 13586361
gcacgaggcaactatgcccatctgaacaaaggggatgtagcaacagagacaaagacagattctgaaggatcattttttgcaggtcctttgtatgatgacatagtatataaagttgaagcttcaaaggatggttaccatctcaagcaaactggtccatacaccttttcttgtcagaagcttggtcagatatcagtgcggatttatggtgaaaattcagagcttttaccttcagtattattatctttgagtggcgaggaagggtacagaaataactcaattagtagttctggtggaactttcacctttgacaacttatttcctggaagtttctatctccggccacttctaaaggaatataaattcaatccatcagcagtagctattgatcttaattctggagagtctagggaggctgaatttcgtgcaaccagagtggcttacagtgccatgggttctgtaacactattaactggccacccaaaggagggtgtttttgttgaagcaagatctgaatccacaggtttttatgaggaagctaccacagatgcttttggtagg

SEQ ID NO: 22236 - DNA, 470 bp, Sorghum bicolor
  Clone ID: 13586367
gcacgaggccgcctcctgcagtcctccctccctgttccgttagctcttgcagcagcggcggccggtaatggcggcggtttcttggagagccgtggtgctggcggtggccgcggtgggctggcttcttgttggcggcggtagcggtggcgcgtgggcgttcccggccgaggatttggtcacgcggctgccgggccagccgccgatcacgttcaggcagttcgccgggtacgtggacgtcgacttcaaggccggcaggagcctcttctactacttcgccgaggcgcagcaggacgccgccgccaagccgctcacgctctggctcaacggaggtcctggctgttcttcgattggaggcggtgctttcacagagctagggccattctatccgcgaggagatggtcgaggcctcagattgaacaagagatcatggaacaaagcatccaatcttctgtttgtggaatcaccggctg

SEQ ID NO: 22237 - DNA, 416 bp, Sorghum bicolor
  Clone ID: 13586377
gcacgaggctctctcccggggctggcctcctccagtactttagacactgcaccgtgttgccctctttcgtctctaaagacctccagaaccagaatccatggctgctcccctctcttcctggccatggacaagcctcggcgattacaagtacgcgctgctggggcctctggcgtggaaggtggtgcaagaatggcgggagcagggccaaggggcgctgccgctggtgctgggctcgtggtggctgcacctcctcttgctgttcgtggtgcgggggctcacctaccagttctggttcacctacggcaacatgctcttcttcacccgccgccgccgagtcgtcgccgacagcgtcgacttccggcagatcgacgccgagtgggactgggacaactttctcgtgctgcaaacgctgattg

SEQ ID NO: 22238 - DNA, 420 bp, Sorghum bicolor
  Clone ID: 13586383
cgccggcggaccctggtcgtgtccacggccgcggcggcggcggacctgttccggaaccacgacctcgccttctcctcccgcccgcacaacgcgctggctcacaagcagacgtacggctcccgctacatctccttcacgccgtacggggatcactggcgccgggccaagaaggtcgcggtggtgcacctcctctcccagcgccgcgtggatgcgttcgcgcccgtgcggcaagcataggcggcggcgctggtggcgcggacccggcgagccgccgaggccggagaggccgtgcagctgaaggagctcctgtacggctacaccaactcggtggtcacccgcgccgcggccgggaccgccgggacgacggccgagaggctgaggcagcttctggcgcacaccgcgacgctggtggccgggttc

SEQ ID NO: 22239 - DNA, 528 bp, Sorghum bicolor
  Clone ID: 13586394
gcctattccaccaccgacgccgaaggccgtacgcccccaatcgaatcgaccgcatccatgccgtcgatcaccggaggtggacgcgggggcctcttctcggtgcaccagggcgcgctctggtggctccgccgttgccacagcccgctcttctcgtcactagccggcggaggaggccggggcgacgcgccgcatcttcccgtactcatcgtcggagctggtccagttgggctcgtcctctccttcctcctgaccaaattcgggatcaaatgcacggtgatagagaagaatgtggaattcactaggcacccccgagcacacttcatcaacaaccgcacaatggaggtgtgtatgtctactaatgcactctaacttcgacattttgactaatgtgtgttgtttgggtggtgctttcacggatggctggtgttttcagatcttccgcaagttggatggtttggctggggacattgagaggtcccagccaccggtagatttgtggaggaagttcgtctactgtacttcactctc

SEQ ID NO: 22240 - DNA, 348 bp, Sorghum bicolor
  Clone ID: 13586397
gcacgaggcccgccccgccccgctctgccgcgctctcccgccgcaggccgcacagcatcgcgtcctccgccggcctcgctgtcggcgccattggcgcggctcgccttacactgcccgtccgcccgcccgccggaaccaaccaggtgtaaacatgcttcatcattcaaatagccggaaccaaaggaacaggggatcaagaatcaaaacactactccgagctaccttacttttaggtgttattttttggctcctgtatcaggtgaagcattcctttgataagaaaaatgagtacttggatgatgctgaggaccagcttgcccataatgatagaagcgtgttccatgggag

SEQ ID NO: 22241 - DNA, 563 bp, Sorghum bicolor
  Clone ID: 13586398
gcacgaggctcccaccgacactaggataggcaccaccatggctgaattcctcaatgataacaccaatggctccggccccggcccatcattcgacacccagctcctggaaacctttatcccaggctatgggctcgcctcacgcattctcgctacatatttccacctcgacctcagcagctacatccccgcgctgatcgccagcggtatcgtccttgccgttaccaaatacctctaccactggctctacagcctcttcaccgaccacttcatttccaccgcggaaatccgtcttgacgatgaaatctatacatacctcatgttctggatggcgcggcagtcattcacaacccgcacgacgaatttcattgccggaaccaagctaagtggcagaaattggtactactcagatgatgagtctgactctgaggccgaagacgaagaggaagatggcgagagcttcgacgactactggtcacgcacaatcaaccgtgacaagtataagaagctgcgcttcactccgtcgcagggcacgcattacttccggtttaatggacagtatattg

SEQ ID NO: 22242 - DNA, 520 bp, Sorghum bicolor
  unsure (1)..(520): unsure at all n locations
  Clone ID: 13586400
gcacgaggatcaacagtatcttgaacttgtactctttccctcctacaagccgagacatctctacctctgttcaatcagctacctcatcacaatgcctcactccatccggtctgtggcctccacggcatctctctctgacgagagctctgcaccgactagccccagttcctcgcagctcatcgacgactcttatgtactagcgaacgatgtactgcctgcggacgatggcaagcactacgttatggttctcggtggtctgggttacattggatcacacaccacactggaactcctcaaggatggatacaacgtcatcgttgtcgacgacttgagcaactgcttcgaagaggtactcaaccccatcaggatcctcgccgaagactactgcagggaacaaggcctcatcatgcctacactccgatttcacaagatggactacaggtccgcagagatgcgtgaactgttccccaggtacgcagcagcacgctctgctattaccggcgtcatccactntgctgct

SEQ ID NO: 22243 - DNA, 439 bp, Sorghum bicolor
  Clone ID: 13586402
gcacgaggccggctttcacttttctacgcagcgtctgcctgcgtcgcgcctcggcctcgcctacctcccgccgccgtcgtggacgccatgggccgaggccgcaaccgcaagccccgcaacttcgccacgttccgcctctgcccgcgccccggggtcgccgacgcctccgaccgcgtcttcgtccgcgtcgacgacaacccctactccgtccccgggttcgccgacgacgagggccactcgtcctccaccgccgtcggtgcagacggcggcgagcccgccgcctcctcctccgcctcggtcgacgacgacggagcgcccctgcccgagcacgtccgccgcgagatcttggagctcggcctccccgacgacggctacgactacctcacccacctccgcgagctccgcccctccctctcctccaccggcggcgggggatcct

SEQ ID NO: 22244 - DNA, 485 bp, Sorghum bicolor
  Clone ID: 13586404
gcacgaggcccacaatcacgctcacgatccatctaccgctcacgcagttgcctcctctccccacgccatcgatctcaccgttgcccattttccattcatcggatcgacgttgccgcatcctcttcctccctactgtgtcgccgccgccgatggagcaccaagaaggagaaggccctcgctcgatgtcgtcgtcctcgcccacaccatcgtcctcaacccaccccgatctgccgtcgtcctcaccggccaatccccttctccctcggcgctgcctttcctacacagcatggcttgtggtggcttcatagcccaacgaagccagagcctagcccccttgtgggtttgcttttggcctgtgcacggccagtgcggtggtcagctgggccaggcagctcgcagtggatgcggcggtgtggacctccagggtgtgccccctcccttgtgaagccgacaagtatgcccaccccttacctagcgatggttgt
